United States Patent 12,569,549 (FLAVIVIRUS VACCINE) - sequence listing, part 60

SEQ ID NO: 21043 - RNA, 9867 nt, synthetic construct
  misc_feature 1..9867: note = derived and/or modified CDS sequence (opt5) from DENV-4__KJ579248__SS-prME
  source 1..9867: mol_type = other RNA
agcaccatcacactgctctgcctgattcccacggtgatggccttccacctttccaccagagacggcgagcctctgatgatcgtcgctaagcatgaacgggggcgcccgctcctgtttaaaacaaccgagggaattaacaagtgtacacttatcgccatggatctgggcgaaatgtgcgaggacaccgttacatacaaatgtcccctcctggtgaataccgaacctgaggatattgactgctggtgtaacctgacgtctacctgggtgatgtatgggacatgcacccagagcggagagagacggcgcgaaaagagatccgtcgcgctcacaccccactctggcatggggctggagacccgggctgaaacgtggatgagctccgagggagcctggaaacatgcccaacgcgtggagtcttggatccttagaaatcctggcttcgctctgctcgccggctttatggcttacatgatcgggcagacaggaattcagcggaccgttttctttgtgctgatgatgcttgtcgcccccagctatggcatgcgctgtgtgggggttggaaacagagatttcgtggaaggcgtctccgggggagcgtgggtggacctggtgctcgagcacggcggctgcgtcacaaccatggcccaggggaagcctaccctggattttgaactgacaaagacgaccgctaaagaggttgccctcctgcggacatactgtatcgaagctcttattagcaatatcaccacagccacccgctgcccgacgcaaggagagccctatctgaaggaggaacaggaccagcagtacatttgtagacgggatgtggtggaccgcggctgggggaacggatgcggcctcttcgggaaaggaggcgtcgtgacatgcgcgaagttttcttgttccggcaaaatcaccgggaatctggttcaaattgagaaccttgaatataccgtggtcgtgacagttcataatggagatacccacgccgtgggcaacgacacaagcaatcacggggtcacggctaccatcacacctagatctccctccgtggaggtcaagctgcctgattacggagaactcaccctggactgcgagccccggagcggcatcgacttcaacgagatgattctgatgaagatgaaaaagaaaacatggctcgtgcataagcagtggtttctggatcttccgctgccttggaccacgggggccgacacctctgaagttcactggaattacaaagagagaatggtgacattcaaggtcccccatgctaaacgccaggatgtgaccgttctcggctcccaggaaggagccatgcacagcgccctggctggcgcgacagaggtggactccggggatggaaaccacatgtttgccggccatcttaagtgtaaggtccggatggaaaaactgagaatcaaggggatgtcttataccatgtgcagcggaaaattctccattgacaaggagatggctgagacgcaacacggcacaaccgtggtgaaagttaagtacgaaggggccggcgccccttgtaaggtccccatcgagattcgcgatgtgaataaagaaaaggtggtcggacgggtgatcagcgctacacccctcgccgagaacaccaactctgttaccaatatcgagctggaacctccgttcggcgactcctatattgtgatcggggtcggaaacagcgcgctgacactccattggtttagaaaaggctctagcattgggaagatgttcgagtccacgtaccgcggagctaaacggatggccatcctgggcgaaaccgcctgggattttgggtctgtgggcggacttttcacaagcctgggcaaggctgttcaccaggtgtttgggtccgtctataccacaatgttcggaggcgtgagctggatgattagaatcctcatcgggtttctggttctgtggattggaaccaattctcgcaacacgtccatggccatgacatgcatcgctgtgggcgggattacccttttcctcggctttaccgtccaggccgacatgggatgtgtggtgagctggtctggccgggagctgaagtgcgggtccggaatcttcgtcgttgataatgtgcatacatggaccgaacaatacaaatttcagcccgagagccctgcgagactggcctccgctattctcaacgcccacaaggacggcgtgtgtgggatccgctctacaacgcggctggagaatgtcatgtggaaacagattaccaacgaacttaattatgtgctgtgggagggaggccacgacctcacagttgtggctggcgatgtcaagggggtgctgaccaaaggaaagagagccctgacaccccctgcgagcgaccttaagtactcctggaaaacctggggcaaggccaaaatcttcacgcccgaagctcggaactctacctttctcatcgatgggccggacacaagcgagtgccctaatgaacgcagagcctggaactccttcgaggttgaggattacggattcggcatgtttaccacaaatatttggatgaagttccgggaagggagctctgaggtgtgtgaccatagactgatgtccgctgccatcaaagatcagaaggccgtccacgctgacatgggatattggattgaaagctctaaaaaccaaacctggcagatcgagcgcgcgtccctgattgaagtgaagacatgcctctggcccaagacccatacgctgtggagcaatggcgttcttgagtctcagatgctgatccctaaaagctacgccggccccttttcccagcacaactatcggcaagggtacgctacacagaccgtgggaccttggcacctcggcaagctggagatcgatttcggggaatgccccggaaccacagtcaccattcaggagaactgtgaccatagaggcccgagcctgcgcacgacaaccgcctctgggaaacttgtgacacagtggtgctgtagatcctgcaccatgcctcccctccggtttctgggagaagatggctgttggtatggcatggagatccgccccctgagcgagaaggaagagaatatggtgaaatcccaagtcacagccgggcagggaacctctgaaacgttcagcatgggcctcctgtgccttaccctgtttgttgaggaatgtctcagacggcgcgtgacaagaaagcacatgattctggctgtggtcatcaccctgtgcgccattatccttgggggactcacatggatggacctgctgcgggcgctcatcatgctgggcgataccatgtccgggcgcgtgggaggccagacgcatcttgctattatcgccgttttcaagatgtctcctggctacgtgctgggggtctttctcagaaaactgacaagccgggagaccgccctgatggtgattggaatggctatgacaaccaccctttccatcccgcacgacctgatggagctcattgacggcatctctctggggctcatcctgcttaagattgttacacagttcgataacacgcaagtgggaaccctggccctcagcctgacatttatccgctccaccatgagcctggtcatggcgtggagaacaattatggctgtgcttttcgtcgtgaccctgatccccctctgtcggacgtcttgcctgcagaaacagtcccattgggttgaaattacagccctcatcctgggcgcccaagctcttcctgtgtatctgatgaccctcatgaagggggccagcagacgctcttggcccctgaatgagggaattatggctgtcggcctggtgtcccttctgggcagcgccctcctgaaaaacgacgttcctctcgcggggcccatggtggccggaggcctgcttctggctgcctacgtcatgtctgggtccagcgctgatctgtccctcgaaaaggccgccaatgtgcagtgggacgagatggctgatatcaccggaagctctcctatcattgaagtgaagcaggacgaggatggcagcttttccatccgggacgttgaggaaacaaacatgattaccctgcttgtcaaactggcgctcatcacagtgtctgggctgtaccccctcgccattccgatcacgatgaccctgtggtatatgtggcaggtgaagacacaaagaagcggagctctttgggatgtcccttcccccgccgccacccagaaagctgccctgtctgagggcgtgtaccgcatcatgcagcggggcctgttcgggaagacacaggttggagtgggcattcacatggaaggggtcttccacaccatgtggcatgtgacgagaggaagcgttatctgtcacgagaccggccgcctcgaaccttcctgggcggacgtgcggaatgatatgatttcttatgggggaggctggagactgggcgacaaatgggataaggaggaggacgtccaagtgcttgctatcgaacccgggaagaacccgaaacatgttcagacaaagcctggactgtttaaaaccctcacaggcgagattggggccgtgaccctggacttcaagcccggaacaagcggctcccctatcatcaatcgcaaagggaaggtcattggcctctacggaaacggcgtggtgacgaaaagcggggattatgtctctgccatcacccaggctgaacggattggagagcccgactacgaggttgatgaagacatctttagaaagaagcggctgacaattatggatcttcaccccggcgccgggaaaaccaagcgcatcctgccttccattgtgagagaggcgctgaaacggcgcctcagaaccctgatccttgctccgacacgggtggtcgccgccgaaatggaggaagctctgagaggactccccatccgctatcagacgcctgccgtgaagagcgagcataccggccgggagattgttgacctgatgtgccacgctacattcaccacaagactcctgtcttccacccgcgtgcccaattacaaccttatcgtcatggatgaagcccactttacggaccctagctccgtggcggcccgggggtacatttctacaagagttgagatgggcgaagctgccgctatcttcatgaccgccaccccccctggagccacagatccgtttccccaaagcaattcccctattgaggacatcgaacgcgagatccccgagcggagctggaacaccggcttcgattggattacagactatcaggggaaaaccgtgtggtttgtcccttctatcaaggctggaaatgacattgcgaactgcctgagaaagtccggcaaaaaggtgatccagctgagccgcaaaacgttcgatacagaataccccaagaccaaactcacagactgggattttgtcgtgaccacggacatttctgagatgggggccaacttcagagctggacgggttatcgatccgcgcagatgtctgaagcctgtgatccttaccgacggccccgaacgggtgattctggccgggcccatccctgtcacacccgccagcgctgcccaacgcagaggccggattggaagaaatcctgcgcaggaggatgaccagtatgttttctccggcgatccgctcaagaacgacgaagatcatgctcactggaccgaggccaaaatgctgctggacaatatctacacacccgaggggattatccctaccctctttggacccgaacgcgagaagacacaggccattgatggcgaattccggcttagaggggagcaacgcaaaacctttgtggagctgatgcggagaggagacctgcctgtgtggctctcttataaggtcgctagcgccggcatctcctacaaagaccgggaatggtgcttcacgggcgagcgcaacaatcagatcctggaagagaacatggaagtggagatttggacaagagagggggaaaagaagaaacttcggcccaagtggctggatgcgcgcgtttatgccgacccgatggctctcaaagattttaaggagttcgcctctggaagaaaaagcatcaccctggacattctgaccgaaatcgcttccctccctacataccttagctctcgggccaagctggctctggataatattgtgatgctccataccacagagcgcggcgggagagcctaccagcacgcgctgaacgaacttcccgagtccctggagacgctcatgctggtcgccctgctcggagctatgaccgccggcatctttcttttctttatgcaggggaagggaatcggcaaactgagcatgggcctgattacaatcgctgtggcctccgggctcctgtgggtcgccgaaattcaacctcagtggatcgctgcgtctattatccttgagttctttctgatggtgctcctgatccccgaacctgagaagcagcggaccccccaggacaatcaactgatttatgttatcctcacaattcttaccatcattggactgatcgccgctaacgaaatgggcctgattgagaaaacgaagaccgatttcgggttttaccaggtgaaaacagagaccacaatcctcgacgtcgatctgcgcccggccagcgcctggaccctttatgctgtggccacgacaatcctgacccctatgctcagacacacaattgaaaatacctccgcgaacctgtctctggccgctatcgccaatcaggctgccgttctcatgggacttggcaaggggtggcccctgcatcggatggacctgggagtgcccctcctggcgatgggctgttacagccaggtcaaccctaccacacttacggcctccctggtgatgctcctggtgcactatgctattatcggcccggggctgcaagccaaagctaccagagaggcccagaagcgcacagctgccggaattatgaagaatcccaccgttgatggcatcacagtcatcgacctcgaacctattagctacgatcccaaattcgagaagcagcttgggcaagtgatgctgctggtgctctgcgcgggacagctgcttctgatgcggaccacgtgggccttctgtgaggtcctcacactggctaccggccctatcctgaccctctgggaagggaaccccggaagattttggaacacaaccattgccgtttctacagctaatatcttccgcggctcctatcttgccggcgccgggctggcgtttagcctgattaaaaacgctcagacgcctcggagaggaaccggcacagccggggagaccctcggagaaaagtggaaacgccagctgaattctcttgaccggaaggagttcgaagagtacaagagatccggcatcctggaggtggaccgcacagaagctaaaagcgccctcaaggatgggtctaaaatcaagcatgccgtgagccggggatcctctaaaattagatggatcgtcgagcgcggcatggtgaagccgaagggcaaagttgtggacctggggtgcggacggggcgggtggagctactatatggctaccctgaagaacgtcacggaagtgaaaggatacaccaagggcgggcccggacacgaggaacctattcccatggccacatatggctggaatctcgttaaacttcattccggcgtggatgtcttttacaagcctaccgagcaagtggacacactgctgtgtgatatcggggagagctcctctaaccccaccattgaagagggaagaacactccgcgtgctgaagatggtcgaaccgtggcttagctccaaacctgagttctgcatcaaggttctgaatccctatatgcccaccgtgattgaagagctcgagaaactgcagagaaagcacggcgggaacctggtgcggtgtcctctctctcgcaatagcacgcacgaaatgtactgggtctccggagcgtctggcaacatcgtgagctccgttaatacaaccagcaaaatgcttctgaacagatttaccacacggcatagaaagcccacgtatgagaaagacgtggatctgggggccggaacccggtctgtctccacagaaatcgagaagcctgacatgaccattatcggccgcagactccagcggctgcaggaggaacacaaggagacatggcattacgatcaagaaaatccgtaccgcacctgggcttatcacggcagctacgaggccccctctacagggtccgctagctctatggtgaacggagttgtgaaacttctgaccaagccttgggacgtcattcccatggtgacgcagctcgccatgaccgatacaacccctttcggccagcagagagtttttaaagaaaaggtggacacacggaccccccaaccgaaacctgggacgcgcatggtcatgacaaccacagcgaattggctgtgggccctgctcggaaagaagaaaaaccccagactgtgcacccgggaggagttcatctccaaggtgcgcagcaatgctgccattggcgctgtctttcaggaagagcaggggtggacgtccgccagcgaagctgtgaacgactctagattctgggagcttgttgataaagaacgggccctgcaccaagagggcaagtgtgagagctgcgtgtataacatgatgggaaaacgcgaaaagaagctcggcgagtttgggagagcgaaaggatcccgggccatctggtacatgtggctgggcgctcgcttccttgaattcgaggccctggggtttctcaatgaagaccattggttcggaagagagaactcttggagcggcgtcgagggggaaggcctgcaccggctgggatatatcctcgaggaaattgataagaaagacggcgatctgatgtacgctgacgataccgccgggtgggacacaagaatcaccgaggatgaccttcagaatgaggaactgattacagagcagatggcccctcatcacaagatcctcgcgaaagctatttttaagctgacctatcagaacaaggtggtgaaagttcttcgccccacacctcggggagccgtgatggatatcatctccagaaaggaccaacgcggctctgggcaggtcggaacctacggcctgaatacgttcacaaacatggaagtgcagctcattcggcagatggaggccgaaggggttatcacccaagatgacatgcagaatcccaaaggcctgaaggagagagtggagaaatggctgcgcgaatgcggagtcgaccggctcaagagaatggctattagcggcgatgactgtgtggtcaaaccgctggatgagcgctttgggacctcccttctgttcctcaacgacatgggaaaggtgcggaaggatatccctcagtgggaaccctctaaaggctggaagaattggcaggaggttcccttttgcagccatcacttccacaaaatttttatgaaggacgggagatccctggtggtcccttgtcgcaaccaagatgaacttatcggacgggccagaatcagccagggcgctgggtggtctctgcgggagacagcctgcctcggcaaagcgtacgcccagatgtggtccctgatgtatttccatagacgcgacctgcggctcgctagcatggccatttgttctgctgtgccgaccgagtggtttcccacatccagaacgacctggagcatccacgcccatcaccagtggatgacaaccgaagatatgctgaaggtttggaatcgcgtgtggattgaggacaaccctaatatgatcgataagacacccgtccactcctgggaagacattccttaccttggaaaaagagaggacctgtggtgcggctctctcatcgggctgagctcccgggcgacctgggccaagaacattcatacggctatcacccaagtgcgcaatcttatcggaaaagaagagtatgtggattacatgagcgttatgaagagatattctgccccctccgagagcgaaggcgtcctgtga

SEQ ID NO: 21044 - RNA, 9867 nt, synthetic construct
  misc_feature 1..9867: note = derived and/or modified CDS sequence (opt5) from DENV-4__KJ579240__SS-prME
  source 1..9867: mol_type = other RNA
agcaccatcacactgctctgcctgattcccacggtgatggccttccacctttccaccagagacggcgagcctctgatgatcgtcgctaagcatgaacgggggcgcccgctcctgtttaaaacaaccgagggaattaacaagtgtacacttatcgccatggatctgggcgaaatgtgcgaggacaccgttacatacaaatgtcccctcctggtgaataccgaacctgaggatattgactgctggtgtaacctgacgtctacctgggtgatgtatgggacatgcacccagagcggagagagacggcgcgaaaagagatccgtcgcgctcacaccccactctggcatggggctggagacccgggctgaaacgtggatgagctccgagggagcctggaaacatgcccaacgcgtggagtcttggatccttagaaatcctggcttcgctctgctcgccggctttatggcttacatgatcgggcagacaggaattcagcggaccgttttctttgtgctgatgatgcttgtcgcccccagctatggcatgcgctgtgtgggggttggaaacagagatttcgtggaaggcgtctccgggggagcgtgggtggacctggtgctcgagcacggcggctgcgtcacaaccatggcccaggggaagcctaccctggattttgaactgacaaagacgaccgctaaagaggttgccctcctgcggacatactgtatcgaagctcttattagcaatatcaccacagccacccgctgcccgacgcaaggagagccctatctgaaggaggaacaggaccagcagtacatttgtagacgggatgtggtggaccgcggctgggggaacggatgcggcctcttcgggaaaggaggcgtcgtgacatgcgcgaagttttcttgttccggcaaaatcaccgggaatctggttcaaattgagaaccttgaatataccgtggtcgtgacagttcataatggagatacccacgccgtgggcaacgacacaagcaatcacggggtcacggctaccatcacacctagatctccctccgtggaggtcaagctgcctgattacggagaactcaccctggactgcgagccccggagcggcatcgacttcaacgagatgattctgatgaagatgaaaaagaaaacatggctcgtgcataagcagtggtttctggatcttccgctgccttggaccacgggggccgacacctctgaagttcactggaattacaaagagagaatggtgacattcaaggtcccccatgctaaacgccaggatgtgaccgttctcggctcccaggaaggagccatgcacagcgccctggctggcgcgacagaggtggactccggggatggaaaccacatgtttgccggccatcttaagtgtaaggtccggatggaaaaactgagaatcaaggggatgtcttataccatgtgcagcggaaaattctccattgacaaggagatggctgagacgcaacacggcacaaccgtggtgaaagttaagtacgaaggggccggcgccccttgtaaggtccccatcgagattcgcgatgtgaataaagaaaaggtggtcggacgggtgatcagcgctacacccctcgccgagaacaccaactctgttaccaatatcgagctggaacctccgttcggcgactcctatattgtgatcggggtcggaaacagcgcgctgacactccattggtttagaaaaggctctagcattgggaagatgttcgagtccacgtaccgcggagctaaacggatggccatcctgggcgaaaccgcctgggattttgggtctgtgggcggacttttcacaagcctgggcaaggctgttcaccaggtgtttgggtccgtctataccacaatgttcggaggcgtgagctggatgattagaatcctcatcgggtttctggttctgtggattggaaccaattctcgcaacacgtccatggccgtgacatgcatcgctgtcggcgggattacccttttcctcggctttaccgtgcaggccgacatgggatgtgtggtcagctggtctggccgggagctgaagtgcgggtccggaatcttcgttgtggataatgtgcatacatggaccgaacaatacaaatttcagcccgagagccctgcgagactggcctccgctattctcaacgcccacaaggacggcgtctgtgggatccgctctacaacgcggctggagaatgtgatgtggaaacagattaccaacgaacttaattatgttctgtgggagggaggccacgacctcacagtggtcgctggcgatgtgaagggggttctgaccaaaggaaagagagccctgacaccccctgcgagcgaccttaagtactcctggaaaacctggggcaaggccaaaatcttcacgcccgaagctcggaactctacctttctcatcgatgggccggacacaagcgagtgccctaatgaacgcagagcctggaactccttcgaggtggaggattacggattcggcatgtttaccacaaatatttggatgaagttccgggaagggagctctgaggtctgtgaccatagactgatgtccgctgccatcaaagatcagaaggccgtgcacgctgacatgggatattggattgaaagctctaaaaaccaaacctggcagatcgagcgcgcgtccctgattgaagttaagacatgcctctggcccaagacccatacgctgtggagcaatggcgtgcttgagtctcagatgctgatccctaaaagctacgccggccccttttcccagcacaactatcggcaagggtacgctacacagaccgtcggaccttggcacctcggcaagctggagatcgatttcggggaatgccccggaaccacagtgaccattcaggagaactgtgaccatagaggcccgagcctgcgcacgacaaccgcctctgggaaacttgtgacacagtggtgctgtagatcctgcaccatgcctcccctccggtttctgggagaagatggctgttggtatggcatggagatccgccccctgagcgagaaggaagagaatatggtcaaatcccaagttacagccgggcagggaacctctgaaacgttcagcatgggcctcctgtgccttaccctgtttgtggaggaatgtctcagacggcgcgtgacaagaaagcacatgattctggctgtcgtgatcaccctgtgcgccattatccttgggggactcacatggatggacctgctgcgggcgctcatcatgctgggcgataccatgtccgggcgcattggaggccagacgcatcttgctatcattgccgttttcaagatgtctcctggctacgtgctgggggtctttctcagaaaactgacaagccgggagaccgccctgatggtgatcggaatggctatgacaaccaccctttccattccgcacgacctgatggagctcatcgacggcatctctctggggctcattctgcttaagatcgttacacagttcgataacacgcaagtgggaaccctggccctcagcctgacatttattcgctccaccatgagcctggtcatggcgtggagaacaatcatggctgtgcttttcgtcgtgaccctgattcccctctgtcggacgtcttgcctgcagaaacagtcccattgggttgaaatcacagccctcattctgggcgcccaagctcttcctgtgtatctgatgaccctcatgaagggggccagcagacgctcttggcccctgaatgagggaatcatggctgtcggcctggtgtcccttctgggcagcgccctcctgaaaaacgacgttcctctcgcggggcccatggtggccggaggcctgcttctggctgcctacgtcatgtctgggtccagcgctgatctgtccctcgaaaaggccgccaatgtgcagtgggacgagatggctgatatcaccggaagctctcctattatcgaagtgaagcaggacgaggatggcagcttttccattcgggacgttgaggaaacaaacatgatcaccctgcttgtcaaactggcgctcattacagtgtctgggctgtaccccctcgccatcccgatcacgatgaccctgtggtatatgtggcaggtgaagacacaaagaagcggagctctttgggatgtcccttcccccgccgccacccagaaagctgccctgtctgagggcgtgtaccgcattatgcagcggggcctgttcgggaagacacaggttggagtgggcatccacatggaaggggtcttccacaccatgtggcatgtgacgagaggaagcgttatttgtcacgagaccggccgcctcgaaccttcctgggcggacgtgcggaatgatatgatctcttatgggggaggctggagactgggcgacaaatgggataaggaggaggacgtccaagtgcttgctattgaacccgggaagaacccgaaacatgttcagacaaagcctggactgtttaaaaccctcacaggcgagatcggggccgtgaccctggacttcaagcccggaacaagcggctcccctatcattaatcgcaaagggaaggtcatcggcctctacggaaacggcgtggtgacgaaaagcggggattatgtctctgccattacccaggctgaacggatcggagagcccgactacgaggttgatgaagacatttttagaaagaagcggctgacaatcatggatcttcaccccggcgccgggaaaaccaagcgcattctgccttccatcgtgagagaggcgctgaaacggcgcctcagaaccctgatccttgctccgacacgggtggtcgccgccgaaatggaggaagctctgagaggactccccattcgctatcagacgcctgccgtgaagagcgagcataccggccgggagatcgttgacctgatgtgccacgctacattcaccacaagactcctgtcttccacccgcgtgcccaattacaaccttattgtcatggatgaagcccactttacggaccctagctccgtggcggcccgggggtacatctctacaagagttgagatgggcgaagctgccgctattttcatgaccgccaccccccctggagccacagatccgtttccccaaagcaattcccctatcgaggacatcgaacgcgagattcccgagcggagctggaacaccggcttcgattggatcacagactatcaggggaaaaccgtgtggtttgtcccttctattaaggctggaaatgacatcgcgaactgcctgagaaagtccggcaaaaaggtgattcagctgagccgcaaaacgttcgatacagaataccccaagaccaaactcacagactgggattttgtcgtgaccacggacatctctgagatgggggccaacttcagagctggacgggttatcgatccgcgcagatgtctgaagcctgtgattcttaccgacggccccgaacgggtgatcctggccgggcccattcctgtcacacccgccagcgctgcccaacgcagaggccggatcggaagaaatcctgcgcaggaggatgaccagtatgttttctccggcgatccgctcaagaacgacgaagatcatgctcactggaccgaggccaaaatgctgctggacaatatttacacacccgaggggatcattcctaccctctttggacccgaacgcgagaagacacaggccatcgatggcgaattccggcttagaggggagcaacgcaaaacctttgtggagctgatgcggagaggagacctgcctgtgtggctctcttataaggtcgctagcgccggcatctcctacaaagaccgggaatggtgcttcacgggcgagcgcaacaatcagattctggaagagaacatggaagtggagatctggacaagagagggggaaaagaagaaacttcggcccaagtggctggatgcgcgcgtttatgccgacccgatggctctcaaagattttaaggagttcgcctctggaagaaaaagcattaccctggacatcctgaccgaaattgcttccctccctacataccttagctctcgggccaagctggctctggataatatcgtgatgctccataccacagagcgcggcgggagagcctaccagcacgcgctgaacgaacttcccgagtccctggagacgctcatgctggtcgccctgctcggagctatgaccgccggcatctttcttttctttatgcaggggaagggaattggcaaactgagcatgggcctgatcacaattgctgtggcctccgggctcctgtgggtcgccgaaatccaacctcagtggattgctgcgtctatcatccttgagttctttctgatggtgctcctgattcccgaacctgagaagcagcggaccccccaggacaatcaactgatctatgttattctcacaatccttaccattatcggactgattgccgctaacgaaatgggcctgatcgagaaaacgaagaccgatttcgggttttaccaggtgaaaacagagaccacaatcctcgacgtcgatctgcgcccggccagcgcctggaccctttatgctgtggccacgacaattctgacccctatgctcagacacacaatcgaaaatacctccgcgaacctgtctctggccgctattgccaatcaggctgccgttctcatgggacttggcaaggggtggcccctgcatcggatggacctgggagtgcccctcctggcgatgggctgttacagccaggtcaaccctaccacacttacggcctccctggtgatgctcctggtgcactatgctatcattggcccggggctgcaagccaaagctaccagagaggcccagaagcgcacagctgccggaatcatgaagaatcccaccgttgatggcatcacagtcattgacctcgaacctatcagctacgatcccaaattcgagaagcagcttgggcaagtgatgctgctggtgctctgcgcgggacagctgcttctgatgcggaccacgtgggccttctgtgaggtcctcacactggctaccggccctattctgaccctctgggaagggaaccccggaagattttggaacacaaccatcgccgtttctacagctaatattttccgcggctcctatcttgccggcgccgggctggcgtttagcctgatcaaaaacgctcagacgcctcggagaggaaccggcacagccggggagaccctcggagaaaagtggaaacgccagctgaattctcttgaccggaaggagttcgaagagtacaagagatccggcatcctggaggtggaccgcacagaagctaaaagcgccctcaaggatgggtctaaaattaagcatgccgtgagccggggatcctctaaaatcagatggattgtcgagcgcggcatggtgaagccgaagggcaaagttgtggacctggggtgcggacggggcgggtggagctactatatggctaccctgaagaacgtcacggaagtgaaaggatacaccaagggcgggcccggacacgaggaacctatccccatggccacatatggctggaatctcgttaaacttcattccggcgtggatgtcttttacaagcctaccgagcaagtggacacactgctgtgtgatattggggagagctcctctaaccccaccatcgaagagggaagaacactccgcgtgctgaagatggtcgaaccgtggcttagctccaaacctgagttctgcattaaggttctgaatccctatatgcccaccgtgatcgaagagctcgagaaactgcagagaaagcacggcgggaacctggtgcggtgtcctctctctcgcaatagcacgcacgaaatgtactgggtctccggagcgtctggcaacatcgtgagctccgttaatacaaccagcaaaatgcttctgaacagatttaccacacggcatagaaagcccacgtatgagaaagacgtggatctgggggccggaacccggtctgtctccacagaaattgagaagcctgacatgaccatcattggccgcagactccagcggctgcaggaggaacacaaggagacatggcattacgatcaagaaaatccgtaccgcacctgggcttatcacggcagctacgaggccccctctacagggtccgctagctctatggtgaacggagttgtgaaacttctgaccaagccttgggacgtcatccccatggtgacgcagctcgccatgaccgatacaacccctttcggccagcagagagtttttaaagaaaaggtggacacacggaccccccaaccgaaacctgggacgcgcatggtcatgacaaccacagcgaattggctgtgggccctgctcggaaagaagaaaaaccccagactgtgcacccgggaggagttcatttccaaggtgcgcagcaatgctgccatcggcgctgtctttcaggaagagcaggggtggacgtccgccagcgaagctgtgaacgactctagattctgggagcttgttgataaagaacgggccctgcaccaagagggcaagtgtgagagctgcgtgtataacatgatgggaaaacgcgaaaagaagctcggcgagtttgggagagcgaaaggatcccgggccatctggtacatgtggctgggcgctcgcttccttgaattcgaggccctggggtttctcaatgaagaccattggttcggaagagagaactcttggagcggcgtcgagggggaaggcctgcaccggctgggatatattctcgaggaaatcgataagaaagacggcgatctgatgtacgctgacgataccgccgggtgggacacaagaattaccgaggatgaccttcagaatgaggaactgatcacagagcagatggcccctcatcacaagattctcgcgaaagctatctttaagctgacctatcagaacaaggtggtgaaagttcttcgccccacacctcggggagccgtgatggatatcatttccagaaaggaccaacgcggctctgggcaggtcggaacctacggcctgaatacgttcacaaacatggaagtgcagctcatccggcagatggaggccgaaggggttattacccaagatgacatgcagaatcccaaaggcctgaaggagagagtggagaaatggctgcgcgaatgcggagtcgaccggctcaagagaatggctatcagcggcgatgactgtgtggtcaaaccgctggatgagcgctttgggacctcccttctgttcctcaacgacatgggaaaggtgcggaaggatattcctcagtgggaaccctctaaaggctggaagaattggcaggaggttcccttttgcagccatcacttccacaaaatctttatgaaggacgggagatccctggtggtcccttgtcgcaaccaagatgaacttatcggacgggccagaattagccagggcgctgggtggtctctgcgggagacagcctgcctcggcaaagcgtacgcccagatgtggtccctgatgtatttccatagacgcgacctgcggctcgctagcatggccatctgttctgctgtgccgaccgagtggtttcccacatccagaacgacctggagcattcacgcccatcaccagtggatgacaaccgaagatatgctgaaggtttggaatcgcgtgtggatcgaggacaaccctaatatgattgataagacacccgtccactcctgggaagacatcccttaccttggaaaaagagaggacctgtggtgcggctctctcattgggctgagctcccgggcgacctgggccaagaacatccatacggctatcacccaagtgcgcaatcttattggaaaagaagagtatgtggattacatgagcgttatgaagagatattctgccccctccgagagcgaaggcgtcctgtga

SEQ ID NO: 21045 - RNA, 9867 nt, synthetic construct
  misc_feature 1..9867: note = derived and/or modified CDS sequence (opt5) from DENV-4__KJ596658__SS-prME
  source 1..9867: mol_type = other RNA
agcaccatcacactgctctgcctgattcccacggtgatggccttccacctttccaccagagacggcgagcctctgatgatcgtcgctaagcatgaacgggggcgcccgctcctgtttaaaacaaccgagggaattaacaagtgtacacttatcgccatggatctgggcgaaatgtgcgaggacaccgttacatacaaatgtcccctcctggtgaataccgaacctgaggatattgactgctggtgtaacctgacgtctacctgggtgatgtatgggacatgcacccagagcggagagagacggcgcgaaaagagatccgtcgcgctcacaccccactctggcatggggctggagacccgggctgaaacgtggatgagctccgagggagcctggaaacatgcccaacgcgtggagtcttggatccttagaaatcctggcttcgctctgctcgccggctttatggcttacatgatcgggcagacaggaattcagcggaccgttttctttgtgctgatgatgcttgtcgcccccagctatggcatgcgctgtgtgggggttggaaacagagatttcgtggaaggcgtctccgggggagcgtgggtggacctggtgctcgagcacggcggctgcgtcacaaccatggcccaggggaagcctaccctggattttgaactgacaaagacgaccgctaaagaggttgccctcctgcggacatactgtatcgaagctcttattagcaatatcaccacagccacccgctgcccgacgcaaggagagccctatctgaaggaggaacaggaccagcagtacatttgtagacgggatgtggtggaccgcggctgggggaacggatgcggcctcttcgggaaaggaggcgtcgtgacatgcgcgaagttttcttgttccggcaaaatcaccgggaatctggttcaaattgagaaccttgaatataccgtggtcgtgacagttcataatggagatacccacgccgtgggcaacgacacaagcaatcacggggtcacggctaccatcacacctagatctccctccgtggaggtcaagctgcctgattacggagaactcaccctggactgcgagccccggagcggcatcgacttcaacgagatgattctgatgaagatgaaaaagaaaacatggctcgtgcataagcagtggtttctggatcttccgctgccttggaccacgggggccgacacctctgaagttcactggaattacaaagagagaatggtgacattcaaggtcccccatgctaaacgccaggatgtgaccgttctcggctcccaggaaggagccatgcacagcgccctggctggcgcgacagaggtggactccggggatggaaaccacatgtttgccggccatcttaagtgtaaggtccggatggaaaaactgagaatcaaggggatgtcttataccatgtgcagcggaaaattctccattgacaaggagatggctgagacgcaacacggcacaaccgtggtgaaagttaagtacgaaggggccggcgccccttgtaaggtccccatcgagattcgcgatgtgaataaagaaaaggtggtcggacgggtgatcagcgctacacccctcgccgagaacaccaactctgttaccaatatcgagctggaacctccgttcggcgactcctatattgtgatcggggtcggaaacagcgcgctgacactccattggtttagaaaaggctctagcattgggaagatgttcgagtccacgtaccgcggagctaaacggatggccatcctgggcgaaaccgcctgggattttgggtctgtgggcggacttttcacaagcctgggcaaggctgttcaccaggtgtttgggtccgtctataccacaatgttcggaggcgtgagctggatgattagaatcctcatcgggtttctggttctgtggattggaaccaattctcgcaacacgtccatggccatgacatgcatcgctgtgggcgggattacccttttcctcggctttaccgtccaggccgacatgggatgtgtggtgagctggtctggccgggagctgaagtgcgggtccggaatcttcgtcgttgataatgtgcatacatggaccgaacaatacaaatttcagcccgagagccctgcgagactggcctccgctattctcaacgcccacaaggacggcgtgtgtgggatccgctctacaacgcggctggagaatgtcatgtggaaacagattaccaacgaacttaattatgtgctgtgggagggaggccacgacctcacagttgtggctggcgatgtcaagggggtgctgaccaaaggaaagagagccctgacaccccctgcgagcgaccttaagtactcctggaaaacctggggcaaggccaaaatcttcacgcccgaagctcggaactctacctttctcatcgatgggccggacacaagcgagtgccctaatgaacgcagagcctggaactccttcgaggttgaggattacggattcggcatgtttaccacaaatatttggatgaagttccgggaagggagctctgaggtgtgtgaccatagactgatgtccgctgccatcaaagatcagaaggccgtccacgctgacatgggatattggattgaaagctctaaaaaccaaacctggcagatcgagcgcgcgtccctgattgaagtgaagacatgcctctggcccaagacccatacgctgtggagcaatggcgttcttgagtctcagatgctgatccctaaaagctacgccggccccttttcccagcacaactatcggcaagggtacgctacacagaccgtgggaccttggcacctcggcaagctggagatcgatttcggggaatgccccggaaccacagtcaccattcaggagaactgtgaccatagaggcccgagcctgcgcacgacaaccgcctctgggaaacttgtgacacagtggtgctgtagatcctgcaccatgcctcccctccggtttctgggagaagatggctgttggtatggcatggagatccgccccctgagcgagaaggaagagaatatggtgaaatcccaagtcacagccgggcagggaacctctgaaacgttcagcatgggcctcctgtgccttaccctgtttgttgaggaatgtctcagacggcgcgtgacaagaaagcacatgattctggctgtggtcatcaccctgtgcgccattatccttgggggactcacatggatggacctgctgcgggcgctcatcattctgggcgataccatgtccgggcgcatcggaggccagacgcatcttgctattatggccgtgttcaagatgtctcctggctacgttctgggggtgtttctcagaaaactgacaagccgggagaccgccctgatggtcatcggaatggctatgacaaccaccctttccattccgcacgacctgatggagctcatcgacggcatctctctggggctcattctgcttaagatcgtgacacagttcgataacacgcaagttggaaccctggccctcagcctgacatttattcgctccaccatgagcctggtgatggcgtggagaacaatcatggctgtccttttcgtggtcaccctgattcccctctgtcggacgtcttgcctgcagaaacagtcccattgggtggaaatcacagccctcattctgggcgcccaagctcttcctgtttatctgatgaccctcatgaagggggccagcagacgctcttggcccctgaatgagggaatcatggctgtgggcctggtctcccttctgggcagcgccctcctgaaaaacgacgtgcctctcgcggggcccatggttgccggaggcctgcttctggctgcctacgtgatgtctgggtccagcgctgatctgtccctcgaaaaggccgccaatgtccagtgggacgagatggctgatatcaccggaagctctcctattatcgaagtgaagcaggacgaggatggcagcttttccattcgggacgtggaggaaacaaacatgatcaccctgcttgttaaactggcgctcattacagtctctgggctgtaccccctcgccatcccgatcacgatgaccctgtggtatatgtggcaggtgaagacacaaagaagcggagctctttgggatgtgccttcccccgccgccacccagaaagctgccctgtctgagggcgtctaccgcattatgcagcggggcctgttcgggaagacacaggtgggagttggcatccacatggaaggggtgttccacaccatgtggcatgtcacgagaggaagcgtgatttgtcacgagaccggccgcctcgaaccttcctgggcggacgttcggaatgatatgatctcttatgggggaggctggagactgggcgacaaatgggataaggaggaggacgtgcaagtccttgctattgaacccgggaagaacccgaaacatgtgcagacaaagcctggactgtttaaaaccctcacaggcgagatcggggccgttaccctggacttcaagcccggaacaagcggctcccctatcattaatcgcaaagggaaggtgatcggcctctacggaaacggcgtcgtgacgaaaagcggggattatgtgtctgccattacccaggctgaacggatcggagagcccgactacgaggtcgatgaagacatttttagaaagaagcggctgacaatcatggatcttcaccccggcgccgggaaaaccaagcgcattctgccttccatcgttagagaggcgctgaaacggcgcctcagaaccctgatccttgctccgacacgggtggtggccgccgaaatggaggaagctctgagaggactccccattcgctatcagacgcctgccgtcaagagcgagcataccggccgggagatcgtggacctgatgtgccacgctacattcaccacaagactcctgtcttccacccgcgttcccaattacaaccttattgtgatggatgaagcccactttacggaccctagctccgtcgcggcccgggggtacatctctacaagagtggagatgggcgaagctgccgctattttcatgaccgccaccccccctggagccacagatccgtttccccaaagcaattcccctatcgaggacatcgaacgcgagattcccgagcggagctggaacaccggcttcgattggatcacagactatcaggggaaaaccgtttggtttgtgccttctattaaggctggaaatgacatcgcgaactgcctgagaaagtccggcaaaaaggtcattcagctgagccgcaaaacgttcgatacagaataccccaagaccaaactcacagactgggattttgtggtcaccacggacatctctgagatgggggccaacttcagagctggacgggtgatcgatccgcgcagatgtctgaagcctgttattcttaccgacggccccgaacgggtgatcctggccgggcccattcctgtgacacccgccagcgctgcccaacgcagaggccggatcggaagaaatcctgcgcaggaggatgaccagtatgtcttctccggcgatccgctcaagaacgacgaagatcatgctcactggaccgaggccaaaatgctgctggacaatatttacacacccgaggggatcattcctaccctctttggacccgaacgcgagaagacacaggccatcgatggcgaattccggcttagaggggagcaacgcaaaacctttgttgagctgatgcggagaggagacctgcctgtgtggctctcttataaggtggctagcgccggcatctcctacaaagaccgggaatggtgcttcacgggcgagcgcaacaatcagattctggaagagaacatggaagtcgagatctggacaagagagggggaaaagaagaaacttcggcccaagtggctggatgcgcgcgtgtatgccgacccgatggctctcaaagattttaaggagttcgcctctggaagaaaaagcattaccctggacatcctgaccgaaattgcttccctccctacataccttagctctcgggccaagctggctctggataatatcgttatgctccataccacagagcgcggcgggagagcctaccagcacgcgctgaacgaacttcccgagtccctggagacgctcatgctggtggccctgctcggagctatgaccgccggcatctttcttttctttatgcaggggaagggaattggcaaactgagcatgggcctgatcacaattgctgtcgcctccgggctcctgtgggtggccgaaatccaacctcagtggattgctgcgtctatcatccttgagttctttctgatggtcctcctgattcccgaacctgagaagcagcggaccccccaggacaatcaactgatctatgtgattctcacaatccttaccattatcggactgattgccgctaacgaaatgggcctgatcgagaaaacgaagaccgatttcgggttttaccaggttaaaacagagaccacaatcctcgacgtggatctgcgcccggccagcgcctggaccctttatgctgtcgccacgacaattctgacccctatgctcagacacacaatcgaaaatacctccgcgaacctgtctctggccgctattgccaatcaggctgccgtgctcatgggacttggcaaggggtggcccctgcatcggatggacctgggagttcccctcctggcgatgggctgttacagccaggtgaaccctaccacacttacggcctccctggtcatgctcctggtgcactatgctatcattggcccggggctgcaagccaaagctaccagagaggcccagaagcgcacagctgccggaatcatgaagaatcccaccgtggatggcatcacagttattgacctcgaacctatcagctacgatcccaaattcgagaagcagcttgggcaagtcatgctgctggtgctctgcgcgggacagctgcttctgatgcggaccacgtgggccttctgtgaggtgctcacactggctaccggccctattctgaccctctgggaagggaaccccggaagattttggaacacaaccatcgccgtctctacagctaatattttccgcggctcctatcttgccggcgccgggctggcgtttagcctgatcaaaaacgctcagacgcctcggagaggaaccggcacagccggggagaccctcggagaaaagtggaaacgccagctgaattctcttgaccggaaggagttcgaagagtacaagagatccggcatcctggaggttgaccgcacagaagctaaaagcgccctcaaggatgggtctaaaattaagcatgccgtgagccggggatcctctaaaatcagatggattgtggagcgcggcatggtcaagccgaagggcaaagtggttgacctggggtgcggacggggcgggtggagctactatatggctaccctgaagaacgtgacggaagtcaaaggatacaccaagggcgggcccggacacgaggaacctatccccatggccacatatggctggaatctcgtgaaacttcattccggcgttgatgtgttttacaagcctaccgagcaagtcgacacactgctgtgtgatattggggagagctcctctaaccccaccatcgaagagggaagaacactccgcgtgctgaagatggtggaaccgtggcttagctccaaacctgagttctgcattaaggtcctgaatccctatatgcccaccgttatcgaagagctcgagaaactgcagagaaagcacggcgggaacctggtgcggtgtcctctctctcgcaatagcacgcacgaaatgtactgggtgtccggagcgtctggcaacatcgtcagctccgtgaatacaaccagcaaaatgcttctgaacagatttaccacacggcatagaaagcccacgtatgagaaagacgttgatctgggggccggaacccggtctgtgtccacagaaaccgagaagcctgacatgacaattatcggccgcagactccagcggctgcaggaggaacacaaggagacctggcattacgatcaagaaaatccgtaccgcacatgggcttatcacggcagctacgaggccccctctaccgggtccgctagctctatggtcaacggagtggttaaacttctgacgaagccttgggacgtgattcccatggtcacccagctcgccatgacagataccacacctttcggccagcagagagtgtttaaagaaaaggttgacacccggacgccccaaccgaaacctgggacacgcatggtgatgaccacaaccgcgaattggctgtgggccctgctcggaaagaagaaaaaccccagactgtgcacgcgggaggagttcatctccaaggtccgcagcaatgctgccattggcgctgtgtttcaggaagagcaggggtggacctccgccagcgaagctgtcaacgactctagattctgggagcttgtggataaagaacgggccctgcaccaagagggcaagtgtgagagctgcgtttataacatgatgggaaaacgcgaaaagaagctcggcgagtttgggagagcgaaaggatcccgggccatctggtacatgtggctgggcgctcgcttccttgaattcgaggccctggggtttctcaatgaagaccattggttcggaagagagaactcttggagcggcgtggagggggaaggcctgcaccggctgggatatatcctcgaggaaattgataagaaagacggcgatctgatgtacgctgacgatacagccgggtgggacaccagaatcacagaggatgaccttcagaatgaggaactgattaccgagcagatggcccctcatcacaagatcctcgcgaaagctatttttaagctgacatatcagaacaaggtcgtgaaagtgcttcgccccacccctcggggagccgttatggatatcatctccagaaaggaccaacgcggctctgggcaggtgggaacgtacggcctgaatacattcaccaacatggaagtccagctcattcggcagatggaggccgaaggggtgatcacccaagatgacatgcagaatcccaaaggcctgaaggagagagttgagaaatggctgcgcgaatgcggagtggaccggctcaagagaatggctattagcggcgatgactgtgtcgtgaaaccgctggatgagcgctttgggacatcccttctgttcctcaacgacatgggaaaggtccggaaggatatccctcagtgggaaccctctaaaggctggaagaattggcaggaggtgcccttttgcagccatcacttccacaaaatttttatgaaggacgggagatccctggttgtgccttgtcgcaaccaagatgaacttatcggacgggccagaatcagccagggcgctgggtggtctctgcgggagaccgcctgcctcggcaaagcgtacgcccagatgtggtccctgatgtatttccatagacgcgacctgcggctcgctagcatggccatttgttctgctgtcccgacagagtggtttcccacgtccagaaccacatggagcatccacgcccatcaccagtggatgaccacagaagatatgctgaaggtgtggaatcgcgtttggattgaggacaaccctaatatgatcgataagacccccgtgcactcctgggaagacattccttaccttggaaaaagagaggacctgtggtgcggctctctcatcgggctgagctcccgggcgacgtgggccaagaacattcataccgctatcacacaagtccgcaatcttatcggaaaagaagagtatgtggattacatgcccgtgatgaagagatatagcgccccttctgagtccgaaggcgttctgtga

SEQ ID NO: 21046 - RNA, 9867 nt, synthetic construct
  misc_feature 1..9867: note = derived and/or modified CDS sequence (opt5) from DENV-4__KJ596659__SS-prME
  source 1..9867: mol_type = other RNA
agcaccatcacactgctctgcctgattcccacggtgatggccttccacctttccaccagagacggcgagcctctgatgatcgtcgctaagcatgaacgggggcgcccgctcctgtttaaaacaaccgagggaattaacaagtgtacacttatcgccatggatctgggcgaaatgtgcgaggacaccgttacatacaaatgtcccctcctggtgaataccgaacctgaggatattgactgctggtgtaacctgacgtctacctgggtgatgtatgggacatgcacccagagcggagagagacggcgcgaaaagagatccgtcgcgctcacaccccactctggcatggggctggagacccgggctgaaacgtggatgagctccgagggagcctggaaacatgcccaacgcgtggagtcttggatccttagaaatcctggcttcgctctgctcgccggctttatggcttacatgatcgggcagacaggaattcagcggaccgttttctttgtgctgatgatgcttgtcgcccccagctatggcatgcgctgtgtgggggttggaaacagagatttcgtggaaggcgtctccgggggagcgtgggtggacctggtgctcgagcacggcggctgcgtcacaaccatggcccaggggaagcctaccctggattttgaactgacaaagacgaccgctaaagaggttgccctcctgcggacatactgtatcgaagctcttattagcaatatcaccacagccacccgctgcccgacgcaaggagagccctatctgaaggaggaacaggaccagcagtacatttgtagacgggatgtggtggaccgcggctgggggaacggatgcggcctcttcgggaaaggaggcgtcgtgacatgcgcgaagttttcttgttccggcaaaatcaccgggaatctggttcaaattgagaaccttgaatataccgtggtcgtgacagttcataatggagatacccacgccgtgggcaacgacacaagcaatcacggggtcacggctaccatcacacctagatctccctccgtggaggtcaagctgcctgattacggagaactcaccctggactgcgagccccggagcggcatcgacttcaacgagatgattctgatgaagatgaaaaagaaaacatggctcgtgcataagcagtggtttctggatcttccgctgccttggaccacgggggccgacacctctgaagttcactggaatcataaagagagaatggtgacattcaaggtcccccacgctaaacgccaggatgtgaccgttctcggctcccaggaaggagccatgcacagcgccctggctggcgcgacagaggtggactccggggatggaaaccatatgtttgccggccaccttaagtgtaaggtccggatggaaaaactgagaatcaaggggatgtcttacaccatgtgcagcggaaaattctccattgacaaggagatggctgagacgcaacatggcacaaccgtggtgaaagttaagtatgaaggggccggcgccccttgtaaggtccccatcgagattcgcgatgtgaataaagaaaaggtggtcggacgggtgatcagcgctacacccctcgccgagaacaccaactctgttaccaatatcgagctggaacctccgttcggcgactcctacattgtgatcggggtcggaaacagcgcgctgacactccactggtttagaaaaggctctagcattgggaagatgttcgagtccacgtatcgcggagctaaacggatggccatcctgggcgaaaccgcctgggattttgggtctgtgggcggacttttcacaagcctgggcaaggctgttcatcaggtgtttgggtccgtctacaccacaatgttcggaggcgtgagctggatgattagaatcctcatcgggtttctggttctgtggattggaaccaattctcgcaacacgtccatggccatgacatgcatcgctgtgggcgggattacccttttcctcggctttaccgtccaggccgacatgggatgtgtggtgagctggtctggccgggagctgaagtgcgggtccggaatcttcgtcgttgataatgtgcacacatggaccgaacaatataaatttcagcccgagagccctgcgagactggcctccgctattctcaacgcccacaaggacggcgtgtgtgggatccgctctacaacgcggctggagaatgtcatgtggaaacagattaccaacgaacttaattacgtgctgtgggagggaggccatgacctcacagttgtggctggcgatgtcaagggggtgctgaccaaaggaaagagagccctgacaccccctgcgagcgaccttaagtattcctggaaaacctggggcaaggccaaaatcttcacgcccgaagctcggaactctacctttctcatcgatgggccggacacaagcgagtgccctaatgaacgcagagcctggaactccttcgaggttgaggattacggattcggcatgtttaccacaaatatttggatgaagttccgggaagggagctctgaggtgtgtgaccacagactgatgtccgctgccatcaaagatcagaaggccgtccatgctgacatgggatactggattgaaagctctaaaaaccaaacctggcagatcgagcgcgcgtccctgattgaagtgaagacatgcctctggcccaagacccacacgctgtggagcaatggcgttcttgagtctcagatgctgatccctaaaagctatgccggccccttttcccagcacaactaccggcaagggtatgctacacagaccgtgggaccttggcatctcggcaagctggagatcgatttcggggaatgccccggaaccacagtcaccattcaggagaactgtgaccacagaggcccgagcctgcgcacgacaaccgcctctgggaaacttgtgacacagtggtgctgtagatcctgcaccatgcctcccctccggtttctgggagaagatggctgttggtacggcatggagatccgccccctgagcgagaaggaagagaatatggtgaaatcccaagtcacagccgggcagggaacctctgaaacgttcagcatgggcctcctgtgccttaccctgtttgttgaggaatgtctcagacggcgcgtgacaagaaagcatatgattctggctgtggtcatcaccctgtgcgccattatccttgggggactcacatggatggacctgctgcgggcgctcatcattctgggcgataccatgtccgggcgcatcggaggccagacgcaccttgctattatggccgtgttcaagatgtctcctggctatgttctgggggtgtttctcagaaaactgacaagccgggagaccgccctgatggtcatcggaatggctatgacaaccaccctttccattccgcatgacctgatggagctcatcgacggcatctctctggggctcattctgcttaagatcgtgacacagttcgataacacgcaagttggaaccctggccctcagcctgacatttattcgctccaccatgagcctggtgatggcgtggagaacaatcatggctgtccttttcgtggtcaccctgattcccctctgtcggacgtcttgcctgcagaaacagtcccactgggtggaaatcacagccctcattctgggcgcccaagctcttcctgtttacctgatgaccctcatgaagggggccagcagacgctcttggcccctgaatgagggaatcatggctgtgggcctggtctcccttctgggcagcgccctcctgaaaaacgacgtgcctctcgcggggcccatggttgccggaggcctgcttctggctgcctatgtgatgtctgggtccagcgctgatctgtccctcgaaaaggccgccaatgtccagtgggacgagatggctgatatcaccggaagctctcctattatcgaagtgaagcaggacgaggatggcagcttttccattcgggacgtggaggaaacaaacatgatcaccctgcttgttaaactggcgctcattacagtctctgggctgtaccccctcgccatcccgatcacgatgaccctgtggtacatgtggcaggtgaagacacaaagaagcggagctctttgggatgtgccttcccccgccgccacccagaaagctgccctgtctgagggcgtctatcgcattatgcagcggggcctgttcgggaagacacaggtgggagttggcatccacatggaaggggtgttccataccatgtggcacgtcacgagaggaagcgtgatttgtcatgagaccggccgcctcgaaccttcctgggcggacgttcggaatgatatgatctcttacgggggaggctggagactgggcgacaaatgggataaggaggaggacgtgcaagtccttgctattgaacccgggaagaacccgaaacacgtgcagacaaagcctggactgtttaaaaccctcacaggcgagatcggggccgttaccctggacttcaagcccggaacaagcggctcccctatcattaatcgcaaagggaaggtgatcggcctctatggaaacggcgtcgtgacgaaaagcggggattacgtgtctgccattacccaggctgaacggatcggagagcccgactatgaggtcgatgaagacatttttagaaagaagcggctgacaatcatggatcttcatcccggcgccgggaaaaccaagcgcattctgccttccatcgttagagaggcgctgaaacggcgcctcagaaccctgatccttgctccgacacgggtggtggccgccgaaatggaggaagctctgagaggactccccattcgctaccagacgcctgccgtcaagagcgagcacaccggccgggagatcgtggacctgatgtgccacgctacattcaccacaagactcctgtcttccacccgcgttcccaattataaccttattgtgatggatgaagcccattttacggaccctagctccgtcgcggcccgggggtacatctctacaagagtggagatgggcgaagctgccgctattttcatgaccgccaccccccctggagccacagatccgtttccccaaagcaattcccctatcgaggacatcgaacgcgagattcccgagcggagctggaacaccggcttcgattggatcacagactaccaggggaaaaccgtttggtttgtgccttctattaaggctggaaatgacatcgcgaactgcctgagaaagtccggcaaaaaggtcattcagctgagccgcaaaacgttcgatacagaatatcccaagaccaaactcacagactgggattttgtggtcaccacggacatctctgagatgggggccaacttcagagctggacgggtgatcgatccgcgcagatgtctgaagcctgttattcttaccgacggccccgaacgggtgatcctggccgggcccattcctgtgacacccgccagcgctgcccaacgcagaggccggatcggaagaaatcctgcgcaggaggatgaccagtacgtcttctccggcgatccgctcaagaacgacgaagatcacgctcattggaccgaggccaaaatgctgctggacaatatttatacacccgaggggatcattcctaccctctttggacccgaacgcgagaagacacaggccatcgatggcgaattccggcttagaggggagcaacgcaaaacctttgttgagctgatgcggagaggagacctgcctgtgtggctctcttacaaggtggctagcgccggcatctcctataaagaccgggaatggtgcttcacgggcgagcgcaacaatcagattctggaagagaacatggaagtcgagatctggacaagagagggggaaaagaagaaacttcggcccaagtggctggatgcgcgcgtgtacgccgacccgatggctctcaaagattttaaggagttcgcctctggaagaaaaagcattaccctggacatcctgaccgaaattgcttccctccctacatatcttagctctcgggccaagctggctctggataatatcgttatgctccacaccacagagcgcggcgggagagcctaccagcacgcgctgaacgaacttcccgagtccctggagacgctcatgctggtggccctgctcggagctatgaccgccggcatctttcttttctttatgcaggggaagggaattggcaaactgagcatgggcctgatcacaattgctgtcgcctccgggctcctgtgggtggccgaaatccaacctcagtggattgctgcgtctatcatccttgagttctttctgatggtcctcctgattcccgaacctgagaagcagcggaccccccaggacaatcaactgatctacgtgattctcacaatccttaccattatcggactgattgccgctaacgaaatgggcctgatcgagaaaacgaagaccgatttcgggttttatcaggttaaaacagagaccacaatcctcgacgtggatctgcgcccggccagcgcctggaccctttacgctgtcgccacgacaattctgacccctatgctcagacatacaatcgaaaatacctccgcgaacctgtctctggccgctattgccaatcaggctgccgtgctcatgggacttggcaaggggtggcccctgcaccggatggacctgggagttcccctcctggcgatgggctgttatagccaggtgaaccctaccacacttacggcctccctggtcatgctcctggtgcattacgctatcattggcccggggctgcaagccaaagctaccagagaggcccagaagcgcacagctgccggaatcatgaagaatcccaccgtggatggcatcacagttattgacctcgaacctatcagctatgatcccaaattcgagaagcagcttgggcaagtcatgctgctggtgctctgcgcgggacagctgcttctgatgcggaccacgtgggccttctgtgaggtgctcacactggctaccggccctattctgaccctctgggaagggaaccccggaagattttggaacacaaccatcgccgtctctacagctaatattttccgcggctcctaccttgccggcgccgggctggcgtttagcctgatcaaaaacgctcagacgcctcggagaggaaccggcacagccggggagaccctcggagaaaagtggaaacgccagctgaattctcttgaccggaaggagttcgaagagtataagagatccggcatcctggaggttgaccgcacagaagctaaaagcgccctcaaggatgggtctaaaattaagcacgccgtgagccggggatcctctaaaatcagatggattgtggagcgcggcatggtcaagccgaagggcaaagtggttgacctggggtgcggacggggcgggtggagctactacatggctaccctgaagaacgtgacggaagtcaaaggatataccaagggcgggcccggacatgaggaacctatccccatggccacatacggctggaatctcgtgaaacttcactccggcgttgatgtgttttataagcctaccgagcaagtcgacacactgctgtgtgatattggggagagctcctctaaccccaccatcgaagagggaagaacactccgcgtgctgaagatggtggaaccgtggcttagctccaaacctgagttctgcattaaggtcctgaatccctacatgcccaccgttatcgaagagctcgagaaactgcagagaaagcacggcgggaacctggtgcggtgtcctctctctcgcaatagcacgcatgaaatgtattgggtgtccggagcgtctggcaacatcgtcagctccgtgaatacaaccagcaaaatgcttctgaacagatttaccacacggcacagaaagcccacgtacgagaaagacgttgatctgggggccggaacccggtctgtgtccacagaaaccgagaagcctgacatgacaattatcggccgcagactccagcggctgcaggaggaacataaggagacctggcactatgatcaagaaaatccgtaccgcacatgggcttaccacggcagctatgaggccccctctaccgggtccgctagctctatggtcaacggagtggttaaacttctgacgaagccttgggacgtgattcccatggtcacccagctcgccatgacagataccacacctttcggccagcagagagtgtttaaagaaaaggttgacacccggacgccccaaccgaaacctgggacacgcatggtgatgaccacaaccgcgaattggctgtgggccctgctcggaaagaagaaaaaccccagactgtgcacgcgggaggagttcatctccaaggtccgcagcaatgctgccattggcgctgtgtttcaggaagagcaggggtggacctccgccagcgaagctgtcaacgactctagattctgggagcttgtggataaagaacgggccctgcatcaagagggcaagtgtgagagctgcgtttacaacatgatgggaaaacgcgaaaagaagctcggcgagtttgggagagcgaaaggatcccgggccatctggtatatgtggctgggcgctcgcttccttgaattcgaggccctggggtttctcaatgaagaccactggttcggaagagagaactcttggagcggcgtggagggggaaggcctgcatcggctgggatacatcctcgaggaaattgataagaaagacggcgatctgatgtatgctgacgatacagccgggtgggacaccagaatcacagaggatgaccttcagaatgaggaactgattaccgagcagatggcccctcaccataagatcctcgcgaaagctatttttaagctgacataccagaacaaggtcgtgaaagtgcttcgccccacccctcggggagccgttatggatatcatctccagaaaggaccaacgcggctctgggcaggtgggaacgtatggcctgaatacattcaccaacatggaagtccagctcattcggcagatggaggccgaaggggtgatcacccaagatgacatgcagaatcccaaaggcctgaaggagagagttgagaaatggctgcgcgaatgcggagtggaccggctcaagagaatggctattagcggcgatgactgtgtcgtgaaaccgctggatgagcgctttgggacatcccttctgttcctcaacgacatgggaaaggtccggaaggatatccctcagtgggaaccctctaaaggctggaagaattggcaggaggtgcccttttgcagccaccacttccataaaatttttatgaaggacgggagatccctggttgtgccttgtcgcaaccaagatgaacttatcggacgggccagaatcagccagggcgctgggtggtctctgcgggagaccgcctgcctcggcaaagcgtacgcccagatgtggtccctgatgtacttccacagacgcgacctgcggctcgctagcatggccatttgttctgctgtcccgacagagtggtttcccacgtccagaaccacatggagcatccatgcccaccaccagtggatgaccacagaagatatgctgaaggtgtggaatcgcgtttggattgaggacaaccctaatatgatcgataagacccccgtgcattcctgggaagacattccttatcttggaaaaagagaggacctgtggtgcggctctctcatcgggctgagctcccgggcgacgtgggccaagaacattcacaccgctatcacacaagtccgcaatcttatcggaaaagaagagtacgtggattatatgcccgtgatgaagagatacagcgccccttctgagtccgaaggcgttctgtga

SEQ ID NO: 21047 - RNA, 9867 nt, synthetic construct
  misc_feature 1..9867: note = derived and/or modified CDS sequence (opt5) from DENV-4__KJ596661__SS-prME
  source 1..9867: mol_type = other RNA
agcaccatcacactgctctgcctgattcccacggtgatggccttccacctttccaccagagacggcgagcctctgatgatcgtcgctaagcatgaacgggggcgcccgctcctgtttaaaacaaccgagggaattaacaagtgtacacttatcgccatggatctgggcgaaatgtgcgaggacaccgttacatacaaatgtcccctcctggtgaataccgaacctgaggatattgactgctggtgtaacctgacgtctacctgggtgatgtatgggacatgcacccagagcggagagagacggcgcgaaaagagatccgtcgcgctcacaccccactctggcatggggctggagacccgggctgaaacgtggatgagctccgagggagcctggaaacatgcccaacgcgtggagtcttggatccttagaaatcctggcttcgctctgctcgccggctttatggcttacatgatcgggcagacaggaattcagcggaccgttttctttgtgctgatgatgcttgtcgcccccagctatggcatgcgctgtgtgggggttggaaacagagatttcgtggaaggcgtctccgggggagcgtgggtggacctggtgctcgagcacggcggctgcgtcacaaccatggcccaggggaagcctaccctggattttgaactgacaaagacgaccgctaaagaggttgccctcctgcggacatactgtatcgaagctcttattagcaatatcaccacagccacccgctgcccgacgcaaggagagccctatctgaaggaggaacaggaccagcagtacatttgtagacgggatgtggtggaccgcggctgggggaacggatgcggcctcttcgggaaaggaggcgtcgtgacatgcgcgaagttttcttgttccggcaaaatcaccgggaatctggttcaaattgagaaccttgaatataccgtggtcgtgacagttcataatggagatacccacgccgtgggcaacgacacaagcaatcacggggtcacggctaccatcacacctagatctccctccgtggaggtcaagctgcctgattacggagaactcaccctggactgcgagccccggagcggcatcgacttcaacgagatgattctgatgaagatgaaaaagaaaacatggctcgtgcataagcagtggtttctggatcttccgctgccttggaccacgggggccgacacctctgaagttcactggaattacaaagagagaatggtgacattcaaggtcccccatgctaaacgccaggatgtgaccgttctcggctcccaggaaggagccatgcacagcgccctggctggcgcgacagaggtggactccggggatggaaaccacatgtttgccggccatcttaagtgtaaggtccggatggaaaaactgagaatcaaggggatgtcttataccatgtgcagcggaaaattctccattgacaaggagatggctgagacgcaacacggcacaaccgtggtgaaagttaagtacgaaggggccggcgccccttgtaaggtccccatcgagattcgcgatgtgaataaagaaaaggtggtcggacgggtgatcagcgctacacccctcgccgagaacaccaactctgttaccaatatcgagctggaacctccgttcggcgactcctatattgtgatcggggtcggaaacagcgcgctgacactccattggtttagaaaaggctctagcattgggaagatgttcgagtccacgtaccgcggagctaaacggatggccatcctgggcgaaaccgcctgggattttgggtctgtgggcggacttttcacaagcctgggcaaggctgttcaccaggtgtttgggtccgtctataccacaatgttcggaggcgtgagctggatgattagaatcctcatcgggtttctggttctgtggattggaaccaattctcgcaacacgtccatggccatgacatgcatcgctgtgggcgggattacccttttcctcggctttaccgtccaggccgacatgggatgtgtggtgagctggtctggccgggagctgaagtgcgggtccggaatcttcgtcgttgataatgtgcatacatggaccgaacaatacaaatttcagcccgagagccctgcgagactggcctccgctattctcaacgcccacaaggacggcgtgtgtgggatccgctctacaacgcggctggagaatgtcatgtggaaacagattaccaacgaacttaattatgtgctgtgggagggaggccacgacctcacagttgtggctggcgatgtcaagggggtgctgaccaaaggaaagagagccctgacaccccctgcgagcgaccttaagtactcctggaaaacctggggcaaggccaaaatcttcacgcccgaagctcggaactctacctttctcatcgatgggccggacacaagcgagtgccctaatgaacgcagagcctggaactccttcgaggttgaggattacggattcggcatgtttaccacaaatatttggatgaagttccgggaagggagctctgaggtgtgtgaccatagactgatgtccgctgccatcaaagatcagaaggccgtccacgctgacatgggatattggattgaaagctctaaaaaccaaacctggcagatcgagcgcgcgtccctgattgaagtgaagacatgcctctggcccaagacccatacgctgtggagcaatggcgttcttgagtctcagatgctgatccctaaaagctacgccggccccttttcccagcacaactatcggcaagggtacgctacacagaccgtgggaccttggcacctcggcaagctggagatcgatttcggggaatgccccggaaccacagtcaccattcaggagaactgtgaccatagaggcccgagcctgcgcacgacaaccgcctctgggaaacttgtgacacagtggtgctgtagatcctgcaccatgcctcccctccggtttctgggagaagatggctgttggtatggcatggagatccgccccctgagcgagaaggaagagaatatggtgaaatcccaagtcacagccgggcagggaacctctgaaacgttcagcatgggcctcctgtgccttaccctgtttgttgaggaatgtctcagacggcgcgtgacaagaaagcacatgattctggctgtggtcatcaccctgtgcgccattatccttgggggactcacatggatggacctgctgcgggcgctcatcatgctgggcgataccatgtccgggcgcattggaggccagacgcatcttgctatcatggccgtgttcaagatgtctcctggctacgttctgggggtgtttctcagaaaactgacaagccgggagaccgccctgatggtcattggaatggctatgacaaccaccctttccatcccgcacgacctgatggagctcattgacggcatctctctggggctcatcctgcttaagattgtgacacagttcgataacacgcaagttggaaccctggccctcagcctgacatttatccgctccaccatgagcctggtgatggcgtggagaacaattatggctgtccttttcgtggtcaccctgatccccctctgtcggacgtcttgcctgcagaaacagtcccattgggtggaaattacagccctcatcctgggcgcccaagctcttcctgtttatctgatgaccctcatgaagggggccagcagacgctcttggcccctgaatgagggaattatggctgtgggcctggtctcccttctgggcagcgccctcctgaaaaacgacgtgcctctcgcggggcccatggttgccggaggcctgcttctggctgcctacgtgatgtctgggtccagcgctgatctgtccctcgaaaaggccgccaatgtccagtgggacgagatggctgatatcaccggaagctctcctatcattgaagtgaagcaggacgaggatggcagcttttccatccgggacgtggaggaaacaaacatgattaccctgcttgttaaactggcgctcatcacagtctctgggctgtaccccctcgccattccgatcacgatgaccctgtggtatatgtggcaggtgaagacacaaagaagcggagctctttgggatgtgccttcccccgccgccacccagaaagctgccctgtctgagggcgtctaccgcatcatgcagcggggcctgttcgggaagacacaggtgggagttggcattcacatcgaaggggtgttccacaccatgtggcatgtcacgagaggaagcgtgatttgtcacgagaccggccgcctcgaaccttcctgggcggacgttcggaatgatatgatctcttatgggggaggctggagactgggcgacaaatgggataaggaggaggacgtgcaagtccttgctattgaacccgggaagaacccgaaacatgtgcagacaaagcctggactgtttaaaaccctcacaggcgagatcggggccgttaccctggacttcaagcccggaacaagcggctcccctatcattaatcgcaaagggaaggtgatcggcctctacggaaacggcgtcgtgacgaaaagcggggattatgtgtctgccattacccaggctgaacggatcggagagcccgactacgaggtcgatgaagacatttttagaaagaagcggctgacaatcatggatcttcaccccggcgccgggaaaaccaagcgcattctgccttccatcgttagagaggcgctgaaacggcgcctcagaaccctgatccttgctccgacacgggtggtggccgccgaaatggaggaagctctgagaggactccccattcgctatcagacgcctgccgtcaagagcgagcataccggccgggagatcgtggacctgatgtgccacgctacattcaccacaagactcctgtcttccacccgcgttcccaattacaaccttattgtgatggatgaagcccactttacggaccctagctccgtcgcggcccgggggtacatctctacaagagtggagatgggcgaagctgccgctattttcatgaccgccaccccccctggagccacagatccgtttccccaaagcaattcccctatcgaggacatcgaacgcgagattcccgagcggagctggaacaccggcttcgattggatcacagactatcaggggaaaaccgtttggtttgtgccttctattaaggctggaaatgacatcgcgaactgcctgagaaagtccggcaaaaaggtcattcagctgagccgcaaaacgttcgatacagaataccccaagaccaaactcacagactgggattttgtggtcaccacggacatctctgagatgggggccaacttcagagctggacgggtgatcgatccgcgcagatgtctgaagcctgttattcttaccgacggccccgaacgggtgatcctggccgggcccattcctgtgacacccgccagcgctgcccaacgcagaggccggatcggaagaaatcctgcgcaggaggatgaccagtatgtcttctccggcgatccgctcaagaacgacgaagatcatgctcactggaccgaggccaaaatgctgctggacaatatttacacacccgaggggatcattcctaccctctttggacccgaacgcgagaagacacaggccatcgatggcgaattccggcttagaggggagcaacgcaaaacctttgttgagctgatgcggagaggagacctgcctgtgtggctctcttataaggtggctagcgccggcatctcctacaaagaccgggaatggtgcttcacgggcgagcgcaacaatcagattctggaagagaacatggaagtcgagatctggacaagagagggggaaaagaagaaacttcggcccaagtggctggatgcgcgcgtgtatgccgacccgatggctctcaaagattttaaggagttcgcctctggaagaaaaagcattaccctggacatcctgaccgaaattgcttccctccctacataccttagctctcgggccaagctggctctggataatatcgttatgctccataccacagagcgcggcgggagagcctaccagcacgcgctgaacgaacttcccgagtccctggagacgctcatgctggtggccctgctcggagctatgaccgccggcatctttcttttctttatgcaggggaagggaattggcaaactgagcatgggcctgatcacaattgctgtcgcctccgggctcctgtgggtggccgaaatccaacctcagtggattgctgcgtctatcatccttgagttctttctgatggtcctcctgattcccgaacctgagaagcagcggaccccccaggacaatcaactgatctatgtgattctcacaatccttaccattatcggactgattgccgctaacgaaatgggcctgatcgagaaaacgaagaccgatttcgggttttaccaggttaaaacagagaccacaatcctcgacgtggatctgcgcccggccagcgcctggaccctttatgctgtcgccacgacaattctgacccctatgctcagacacacaatcgaaaatacctccgcgaacctgtctctggccgctattgccaatcaggctgccgtgctcatgggacttggcaaggggtggcccctgcatcggatggacctgggagttcccctcctggcgatgggctgttacagccaggtgaaccctaccacacttacggcctccctggtcatgctcctggtgcactatgctatcattggcccggggctgcaagccaaagctaccagagaggcccagaagcgcacagctgccggaatcatgaagaatcccaccgtggatggcatcacagttattgacctcgaacctatcagctacgatcccaaattcgagaagcagcttgggcaagtcatgctgctggtgctctgcgcgggacagctgcttctgatgcggaccacgtgggccttctgtgaggtgctcacactggctaccggccctaccctgacactctgggaagggaaccccggaagattttggaacaccacaattgccgtctctacggctaatatcttccgcggctcctatcttgccggcgccgggctggcgtttagcctgattaaaaacgctcagacccctcggagaggaacaggcaccgccggggagacactcggagaaaagtggaaacgccagctgaattctcttgaccggaaggagttcgaagagtacaagagatccggcatcctggaggttgaccgcaccgaagctaaaagcgccctcaaggatgggtctaaaatcaagcatgccgtgagccggggatcctctaaaattagatggatcgtggagcgcggcatggtcaagccgaagggcaaagtggttgacctggggtgcggacggggcgggtggagctactatatggctacgctgaagaacgtgaccgaagtcaaaggatacacaaagggcgggcccggacacgaggaacctattcccatggccacctatggctggaatctcgtgaaacttcattccggcgttgatgtgttttacaagcctacagagcaagtcgacaccctgctgtgtgatatcggggagagctcctctaaccccacaattgaagagggaagaaccctccgcgtgctgaagatggtggaaccgtggcttagctccaaacctgagttctgcatcaaggtcctgaatccctatatgcccacggttattgaagagctcgagaaactgcagagaaagcacggcgggaacctggtgcggtgtcctctctctcgcaatagcacacacgaaatgtactgggtgtccggagcgtctggcaacatcgtcagctccgtgaataccaccagcaaaatgcttctgaacagatttacaacgcggcatagaaagcccacctatgagaaagacgttgatctgggggccggaacacggtctgtgtccaccgaaacagagaagcctgacatgaccatcattggccgcagactccagcggctgcaggaggaacacaaggagacatggcattacgatcaagaaaatccgtaccgcacctgggcttatcacggcagctacgaggccccctctacggggtccgctagctctatggtcaacggagtggttaaacttctgaccaagccttgggacgtgatccccatggtcacacagctcgccatgaccgatacaacccctttcggccagcagagagtgtttaaagaaaaggttgacacgcggacaccccaaccgaaacctgggacccgcatggtgatgacaaccacggcgaattggctgtgggccctgctcggaaagaagaaaaaccccagactgtgcacccgggaggagttcatttccaaggtccgcagcaatgctgccatcggcgctgtgtttcaggaagagcaggggtggacatccgccagcgaagctgtcaacgactctagattctgggagcttgtggataaagaacgggccctgcaccaagagggcaagtgtgagagctgcgtttataacatgatgggaaaacgcgaaaagaagctcggcgagtttgggagagcgaaaggatcccgggccatttggtacatgtggctgggcgctcgcttccttgaattcgaggccctggggtttctcaatgaagaccattggttcggaagagagaactcttggagcggcgtggagggggaaggcctgcaccggctgggatatatcctcgaggaaatcgataagaaagacggcgatctgatgtacgctgacgataccgccgggtgggacacaagaattaccgaggatgaccttcagaatgaggaactgatcacagagcagatggcccctcatcacaagattctcgcgaaagctatctttaagctgacctatcagaacaaggtcgtgaaagtgcttcgccccacgcctcggggagccgttatggatattatctccagaaaggaccaacgcggctctgggcaggtgggaacatacggcctgaataccttcaccaacatggaagtccagctcatccggcagatggaggccgaaggggtgattacacaagatgacatgcagaatcccaaaggcctgaaggagagagttgagaaatggctgcgcgaatgcggagtggaccggctcaagagaatggctatcagcggcgatgactgtgtcgtgaaaccgctggatgagcgctttgggacctcccttctgttcctcaacgacatgggaaaggcccggaaggatattcctcagtgggaaccctctaaaggctggaagaattggcaggaggtccccttttgcagccatcacttccacaaaatctttatgaaggacgggagatccctggtggttccttgtcgcaaccaagatgaacttattggacgggctagaatcagccagggcgccgggtggtctctgcgggagacagcgtgcctcggcaaagcctacgctcagatgtggtccctgatgtatttccatagacgcgacctgcggctcgccagcatggctatctgttctgccgtgccgacggagtggtttcccacctccagaacaacctggagcattcacgcgcatcaccagtggatgacaaccgaagatatgctgaaggtctggaatcgcgtgtggatcgaggacaaccctaatatgattgataagacgcccgttcactcctgggaagacatcccttaccttggaaaaagagaggacctgtggtgcggctctctcattgggctgagctcccgggccacctgggctaagaacatccatacagccattacccaagtgcgcaatcttatcggaaaagaagagtatgtcgattacatgcccgtgatgaagagatatagcgctccttctgagtccgaaggcgtgctgtga

SEQ ID NO: 21048 - RNA, 9867 nt, synthetic construct
  misc_feature 1..9867: note = derived and/or modified CDS sequence (opt5) from DENV-4__KJ596663__SS-prME
  source 1..9867: mol_type = other RNA
agcaccatcacactgctctgcctgattcccacggtgatggccttccacctttccaccagagacggcgagcctctgatgatcgtcgctaagcatgaacgggggcgcccgctcctgtttaaaacaaccgagggaattaacaagtgtacacttatcgccatggatctgggcgaaatgtgcgaggacaccgttacatacaaatgtcccctcctggtgaataccgaacctgaggatattgactgctggtgtaacctgacgtctacctgggtgatgtatgggacatgcacccagagcggagagagacggcgcgaaaagagatccgtcgcgctcacaccccactctggcatggggctggagacccgggctgaaacgtggatgagctccgagggagcctggaaacatgcccaacgcgtggagtcttggatccttagaaatcctggcttcgctctgctcgccggctttatggcttacatgatcgggcagacaggaattcagcggaccgttttctttgtgctgatgatgcttgtcgcccccagctatggcatgcgctgtgtgggggttggaaacagagatttcgtggaaggcgtctccgggggagcgtgggtggacctggtgctcgagcacggcggctgcgtcacaaccatggcccaggggaagcctaccctggattttgaactgacaaagacgaccgctaaagaggttgccctcctgcggacatactgtatcgaagctcttattagcaatatcaccacagccacccgctgcccgacgcaaggagagccctatctgaaggaggaacaggaccagcagtacatttgtagacgggatgtggtggaccgcggctgggggaacggatgcggcctcttcgggaaaggaggcgtcgtgacatgcgcgaagttttcttgttccggcaaaatcaccgggaatctggttcaaattgagaaccttgaatataccgtggtcgtgacagttcataatggagatacccacgccgtgggcaacgacacaagcaatcacggggtcacggctaccatcacacctagatctccctccgtggaggtcaagctgcctgattacggagaactcaccctggactgcgagccccggagcggcatcgacttcaacgagatgattctgatgaagatgaaaaagaaaacatggctcgtgcataagcagtggtttctggatcttccgctgccttggaccacgggggccgacacctctgaagttcactggaattacaaagagagaatggtgacattcaaggtcccccatgctaaacgccaggatgtgaccgttctcggctcccaggaaggagccatgcacagcgccctggctggcgcgacagaggtggactccggggatggaaaccacatgtttgccggccatcttaagtgtaaggtccggatggaaaaactgagaatcaaggggatgtcttataccatgtgcagcggaaaattctccattgacaaggagatggctgagacgcaacacggcacaaccgtggtgaaagttaagtacgaaggggccggcgccccttgtaaggtccccatcgagattcgcgatgtgaataaagaaaaggtggtcggacgggtgatcagcgctacacccctcgccgagaacaccaactctgttaccaatatcgagctggaacctccgttcggcgactcctatattgtgatcggggtcggaaacagcgcgctgacactccattggtttagaaaaggctctagcattgggaagatgttcgagtccacgtaccgcggagctaaacggatggccatcctgggcgaaaccgcctgggattttgggtctgtgggcggacttttcacaagcctgggcaaggctgttcaccaggtgtttgggtccgtctataccacaatgttcggaggcgtgagctggatgattagaatcctcatcgggtttctggttctgtggattggaaccaattctcgcaacacgtccatggccatgacatgcatcgctgtgggcgggattacccttttcctcggctttaccgtccaggccgacatgggatgtgtggtgagctggtctggccgggagctgaagtgcgggtccggaatcttcgtcgttgataatgtgcatacatggaccgaacaatacaaatttcagcccgagagccctgcgagactggcctccgctattctcaacgcccacaaggacggcgtgtgtgggatccgctctacaacgcggctggagaatgtcatgtggaaacagattaccaacgaacttaattatgtgctgtgggagggaggccacgacctcacagttgtggctggcgatgtcaagggggtgctgaccaaaggaaagagagccctgacaccccctgcgagcgaccttaagtactcctggaaaacctggggcaaggccaaaatcttcacgcccgaagctcggaactctacctttctcatcgatgggccggacacaagcgagtgccctaatgaacgcagagcctggaactccttcgaggttgaggattacggattcggcatgtttaccacaaatatttggatgaagttccgggaagggagctctgaggtgtgtgaccatagactgatgtccgctgccatcaaagatcagaaggccgtccacgctgacatgggatattggattgaaagctctaaaaaccaaacctggcagatcgagcgcgcgtccctgattgaagtgaagacatgcctctggcccaagacccatacgctgtggagcaatggcgttcttgagtctcagatgctgatccctaaaagctacgccggccccttttcccagcacaactatcggcaagggtacgctacacagaccgtgggaccttggcacctcggcaagctggagatcgatttcggggaatgccccggaaccacagtcaccattcaggagaactgtgaccatagaggcccgagcctgcgcacgacaaccgcctctgggaaacttgtgacacagtggtgctgtagatcctgcaccatgcctcccctccggtttctgggagaagatggctgttggtatggcatggagatccgccccctgagcgagaaggaagagaatatggtgaaatcccaagtcacagccgggcagggaacctctgaaacgttcagcatgggcctcctgtgccttaccctgtttgttgaggaatgtctcagacggcgcgtgacaagaaagcacatgattctggctgtggtcatcaccctgtgcgccattatccttgggggactcacatggatggacctgctgcgggcgctcatcattctgggcgataccatgtccgggcgcatcggaggccagacgcatcttgctattatggccgtgttcaagatgtctcctggctacgttctgggggtgtttctcagaaaactgacaagccgggagaccgccctgatggtcatcggaatggctatgacaaccaccctttccattccgcacgacctgatggagctcatcgacggcatctctctggggctcattctgcttaagatcgtgacacagttcgataacacgcaagttggaaccctggccctcagcctgacatttattcgctccaccatgagcctggtgatggcgtggagaacaatcatggctgtccttttcgtggtcaccctgattcccctctgtcggacgtcttgcctgcagaaacagtcccattgggtggaaatcacagccctcattctgggcgcccaagctcttcctgtttatctgatgaccctcatgaagggggccagcagacgctcttggcccctgaatgagggaatcatggctgtgggcctggtctcccttctgggcagcgccctcctgaaaaacgacgtgcctctcgcggggcccatggttgccggaggcctgcttctggctgcctacgtgatgtctgggtccagcgctgatctgtccctcgaaaaggccgccaatgtccagtgggacgagatggctgatatcaccggaagctctcctattatcgaagtgaagcaggacgaggatggcagcttttccattcgggacgtggaggaaacaaacatgatcaccctgcttgttaaactggcgctcattacagtctctgggctgtaccccctcgccatcccgatcacgatgaccctgtggtatatgtggcaggtgaagacacaaagaagcggagctctttgggatgtgccttcccccgccgccacccagaaagctgccctgtctgagggcgtctaccgcattatgcagcggggcctgttcgggaagacacaggtgggagttggcatccacatggaaggggtgttccacaccatgtggcatgtcacgagaggaagcgtgatttgtcacgagaccggccgcctcgaaccttcctgggcggacgttcggaatgatatgatctcttatgggggaggctggagactgggcgacaaatgggataaggaggaggacgtgcaagtccttgctattgaacccgggaagaacccgaaacatgtgcagacaaagcctggactgtttaaaaccctcacaggcgagatcggggccgttaccctggacttcaagcccggaacaagcggctcccctatcattaatcgcaaagggaaggtgatcggcctctacggaaacggcgtcgtgacgaaaagcggggattatgtgtctgccattacccaggctgaacggatcggagagcccgactacgaggtcgatgaagacatttttagaaagaagcggctgacaatcatggatcttcaccccggcgccgggaaaaccaagcgcattctgccttccatcgttagagaggcgctgaaacggcgcctcagaaccctgatccttgctccgacacgggtggtggccgccgaaatggaggaagctctgagaggactccccattcgctatcagacgcctgccgtcaagagcgagcataccggccgggagatcgtggacctgatgtgccacgctacattcaccacaagactcctgtcttccacccgcgttcccaattacaaccttattgtgatggatgaagcccactttacggaccctagctccgtcgcggcccgggggtacatctctacaagagtggagatgggcgaagctgccgctattttcatgaccgccaccccccctggagccacagatccgtttccccaaagcaattcccctatcgaggacatcgaacgcgagattcccgagcggagctggaacaccggcttcgattggatcacagactatcaggggaaaaccgtttggtttgtgccttctattaaggctggaaatgacatcgcgaactgcctgagaaagtccggcaaaaaggtcattcagctgagccgcaaaacgttcgatacagaataccccaagaccaaactcacagactgggattttgtggtcaccacggacatctctgagatgggggccaacttcagagctggacgggtgatcgatccgcgcagatgtctgaagcctgttattcttaccgacggccccgaacgggtgatcctggccgggcccattcctgtgacacccgccagcgctgcccaacgcagaggccggatcggaagaaatcctgcgcaggaggatgaccagtatgtcttctccggcgatccgctcaagaacgacgaagatcatgctcactggaccgaggccaaaatgctgctggacaatatttacacacccgaggggatcattcctaccctctttggacccgaacgcgagaagacacaggccatcgatggcgaattccggcttagaggggagcaacgcaaaacctttgttgagctgatgcggagaggagacctgcctgtgtggctctcttataaggtggctagcgccggcatctcctacaaagaccgggaatggtgcttcacgggcgagcgcaacaatcagattctggaagagaacatggaagtcgagatctggacaagagagggggaaaagaagaaacttcggcccaagtggctggatgcgcgcgtgtatgccgacccgatggctctcaaagattttaaggagttcgcctctggaagaaaaagcattaccctggacatcctgaccgaaattgcttccctccctacataccttagctctcgggccaagctggctctggataatatcgttatgctccataccacagagcgcggcgggagagcctaccagcacgcgctgaacgaacttcccgagtccctggagacgctcatgctggtggccctgctcggagctatgaccgccggcatctttcttttctttatgcaggggaagggaattggcaaactgagcatgggcctgatcacaattgctgtcgcctccgggctcctgtgggtggccgaaatccaacctcagtggattgctgcgtctatcatccttgagttctttctgatggtcctcctgattcccgaacctgagaagcagcggaccccccaggacaatcaactgatctatgtgattctcacaatccttaccattatcggactgattgccgctaacgaaatgggcctgatcgagaaaacgaagaccgatttcgggttttaccaggttaaaacagagaccacaatcctcgacgtggatctgcgcccggccagcgcctggaccctttatgctgtcgccacgacaattctgacccctatgctcagacacacaatcgaaaatacctccgcgaacctgtctctggccgctattgccaatcaggctgccgtgctcatgggacttggcaaggggtggcccctgcatcggatggacctgggagttcccctcctggcgatgggctgttacagccaggtgaaccctaccacacttacggcctccctggtcatgctcctggtgcactatgctatcattggcccggggctgcaagccaaagctaccagagaggcccagaagcgcacagctgccggaatcatgaagaatcccaccgtggatggcatcacagttattgacctcgaacctatcagctacgatcccaaattcgagaagcagcttgggcaagtcatgctgctggtgctctgcgcgggacagctgcttctgatgcggaccacgtgggccttctgtgaggtgctcacactggctaccggccctattctgaccctctgggaagggaaccccggaagattttggaacacaaccatcgccgtctctacagctaatattttccgcggctcctatcttgccggcgccgggctggcgtttagcctgatcaaaaacgctcagacgcctcggagaggaaccggcacagccggggagaccctcggagaaaagtggaaacgccagctgaattctcttgaccggaaggagttcgaagagtacaagagatccggcatcctggaggttgaccgcacagaagctaaaagcgccctcaaggatgggtctaaaattaagcatgccgtgagccggggatcctctaaaatcagatggattgtggagcgcggcatggtcaagccgaagggcaaagtggttgacctggggtgcggacggggcgggtggagctactatatggctaccctgaagaacgtgacggaagtcaaaggatacaccaagggcgggcccggacacgaggaacctatccccatggccacatatggctggaatctcgtgaaacttcattccggcgttgatgtgttttacaagcctaccgagcaagtcgacacactgctgtgtgatattggggagagctcctctaaccccaccatcgaagagggaagaacactccgcgtgctgaagatggtggaaccgtggcttagctccaaacctgagttctgcattaaggtcctgaatccctatatgcccaccgttatcgaagagctcgagaaactgcagagaaagcacggcgggaacctggtgcggtgtcctctctctcgcaatagcacgcacgaaatgtactgggtgtccggagcgtctggcaacatcgtcagctccgtgaatacaaccagcaaaatgcttctgaacagatttaccacacggcatagaaagcccacgtatgagaaagacgttgatctgggggccggaacccggtctgtgtccacagaaaccgagaagcctgacatgacaattatcggccgcagactccagcggctgcaggaggaacacaaggagacctggcattacgatcaagaaaatccgtaccgcacatgggcttatcacggcagctacgaggccccctctaccgggtccgctagctctatggtcaacggagtggttaaacttctgacgaagccttgggacgtgattcccatggtcacccagctcgccatgacagataccacacctttcggccagcagagagtgtttaaagaaaaggttgacacccggacgccccaaccgaaacctgggacacgcatggtgatgaccacaaccgcgaattggctgtgggccctgctcggaaagaagaaaaaccccagactgtgcacgcgggaggagttcatctccaaggtccgcagcaatgctgccattggcgctgtgtttcaggaagagcaggggtggacctccgccagcgaagctgtcaacgactctagattctgggagcttgtggataaagaacgggccctgcaccaagagggcaagtgtgagagctgcgtttataacatgatgggaaaacgcgaaaagaagctcggcgagtttgggagagcgaaaggatcccgggccatctggtacatgtggctgggcgctcgcttccttgaattcgaggccctggggtttctcaatgaagaccattggttcggaagagagaactcttggagcggcgtggagggggaaggcctgcaccggctgggatatatcctcgaggaaattgataagaaagacggcgatctgatgtacgctgacgatacagccgggtgggacaccagaatcacagaggatgaccttcagaatgaggaactgattaccgagcagatggcccctcatcacaagacactcgcgaaagctatctttaagctgacctatcagaacaaggtcgtgaaagtgcttcgccccacgcctcggggagccgttatggatattatctccagaaaggaccaacgcggctctgggcaggtgggaacatacggcctgaataccttcaccaacatggaagtccagctcatccggcagatggaggccgaaggggtgattacacaagatgacatgcagaatcccaaaggcctgaaggagagagttgagaaatggctgcgcgaatgcggagtggaccggctcaagagaatggctatcagcggcgatgactgtgtcgtgaaaccgctggatgagcgctttgggacctcccttctgttcctcaacgacatgggaaaggtccggaaggatattcctcagtgggaaccctctaaaggctggaagaattggcaggaggtgcccttttgcagccatcacttccacaaaatctttatgaaggacgggagatccctggttgtgccttgtcgcaaccaagatgaacttattggacgggccagaatcagccagggcgctgggtggtctctgcgggagacagcctgcctcggcaaagcgtacgcccagatgtggtccctgatgtatttccatagacgcgacctgcggctcgctagcatggccatctgttctgctgtcccgacggagtggtttcccacctccagaacaacctggagcattcacgcccatcaccagtggatgacaaccgaagatatgctgaaggtgtggaatcgcgtttggatcgaggacaaccctaatatgattgataagacgcccgtgcactcctgggaagacatcccttaccttggaaaaagagaggacctgtggtgcggctctctcattgggctgagctcccgggcgacctgggccaagaacatccatacagctattacccaagtccgcaatcttatcggaaaagaagagtatgtggattacatgcccgtgatgaagagatatagcgccccttctgagtccgaaggcgttctgtga

SEQ ID NO: 21049 - RNA, 9867 nt, synthetic construct
  misc_feature 1..9867: note = derived and/or modified CDS sequence (opt5) from DENV-4__KJ596664__SS-prME
  source 1..9867: mol_type = other RNA
agcaccatcacactgctctgcctgattcccacggtgatggccttccacctttccaccagagacggcgagcctctgatgatcgtcgctaagcatgaacgggggcgcccgctcctgtttaaaacaaccgagggaattaacaagtgtacacttatcgccatggatctgggcgaaatgtgcgaggacaccgttacatacaaatgtcccctcctggtgaataccgaacctgaggatattgactgctggtgtaacctgacgtctacctgggtgatgtatgggacatgcacccagagcggagagagacggcgcgaaaagagatccgtcgcgctcacaccccactctggcatggggctggagacccgggctgaaacgtggatgagctccgagggagcctggaaacatgcccaacgcgtggagtcttggatccttagaaatcctggcttcgctctgctcgccggctttatggcttacatgatcgggcagacaggaattcagcggaccgttttctttgtgctgatgatgcttgtcgcccccagctatggcatgcgctgtgtgggggttggaaacagagatttcgtggaaggcgtctccgggggagcgtgggtggacctggtgctcgagcacggcggctgcgtcacaaccatggcccaggggaagcctaccctggattttgaactgacaaagacgaccgctaaagaggttgccctcctgcggacatactgtatcgaagctcttattagcaatatcaccacagccacccgctgcccgacgcaaggagagccctatctgaaggaggaacaggaccagcagtacatttgtagacgggatgtggtggaccgcggctgggggaacggatgcggcctcttcgggaaaggaggcgtcgtgacatgcgcgaagttttcttgttccggcaaaatcaccgggaatctggttcaaattgagaaccttgaatataccgtggtcgtgacagttcataatggagatacccacgccgtgggcaacgacacaagcaatcacggggtcacggctaccatcacacctagatctccctccgtggaggtcaagctgcctgattacggagaactcaccctggactgcgagccccggagcggcatcgacttcaacgagatgattctgatgaagatgaaaaagaaaacatggctcgtgcataagcagtggtttctggatcttccgctgccttggaccacgggggccgacacctctgaagttcactggaattacaaagagagaatggtgacattcaaggtcccccatgctaaacgccaggatgtgaccgttctcggctcccaggaaggagccatgcacagcgccctggctggcgcgacagaggtggactccggggatggaaaccacatgtttgccggccatcttaagtgtaaggtccggatggaaaaactgagaatcaaggggatgtcttataccatgtgcagcggaaaattctccattgacaaggagatggctgagacgcaacacggcacaaccgtggtgaaagttaagtacgaaggggccggcgccccttgtaaggtccccatcgagattcgcgatgtgaataaagaaaaggtggtcggacgggtgatcagcgctacacccctcgccgagaacaccaactctgttaccaatatcgagctggaacctccgttcggcgactcctatattgtgatcggggtcggaaacagcgcgctgacactccattggtttagaaaaggctctagcattgggaagatgttcgagtccacgtaccgcggagctaaacggatggccatcctgggcgaaaccgcctgggattttgggtctgtgggcggacttttcacaagcctgggcaaggctgttcaccaggtgtttgggtccgtctataccacaatgttcggaggcgtgagctggatgattagaatcctcatcgggtttctggttctgtggattggaaccaattctcgcaacacgtccatggccatgacatgcatcgctgtgggcgggattacccttttcctcggctttaccgtccaggccgacatgggatgtgtggtgagctggtctggccgggagctgaagtgcgggtccggaatcttcgtcgttgataatgtgcatacatggaccgaacaatacaaatttcagcccgagagccctgcgagactggcctccgctattctcaacgcccacaaggacggcgtgtgtgggatccgctctacaacgcggctggagaatgtcatgtggaaacagattaccaacgaacttaattatgtgctgtgggagggaggccacgacctcacagttgtggctggcgatgtcaagggggtgctgaccaaaggaaagagagccctgacaccccctgcgagcgaccttaagtactcctggaaaacctggggcaaggccaaaatcttcacgcccgaagctcggaactctacctttctcatcgatgggccggacacaagcgagtgccctaatgaacgcagagcctggaactccttcgaggttgaggattacggattcggcatgtttaccacaaatatttggatgaagttccgggaagggagctctgaggtgtgtgaccatagactgatgtccgctgccatcaaagatcagaaggccgtccacgctgacatgggatattggattgaaagctctaaaaaccaaacctggcagatcgagcgcgcgtccctgattgaagtgaagacatgcctctggcccaagacccatacgctgtggagcaatggcgttcttgagtctcagatgctgatccctaaaagctacgccggccccttttcccagcacaactatcggcaagggtacgctacacagaccgtgggaccttggcacctcggcaagctggagatcgatttcggggaatgccccggaaccacagtcaccattcaggagaactgtgaccatagaggcccgagcctgcgcacgacaaccgcctctgggaaacttgtgacacagtggtgctgtagatcctgcaccatgcctcccctccggtttctgggagaagatggctgttggtatggcatggagatccgccccctgagcgagaaggaagagaatatggtgaaatcccaagtcacagccgggcagggaacctctgaaacgttcagcatgggcctcctgtgccttaccctgtttgttgaggaatgtctcagacggcgcgtgacaagaaagcacatgattctggctgtggtcatcaccctgtgcgccattatccttgggggactcacatggatggacctgctgcgggcgctcatcatgctgggcgataccatgtccgggcgcattggaggccagacgcatcttgctatcattgccgtgttcaagatgtctcctggctacgttctgggggtgtttctcagaaaactgacaagccgggagaccgccctgatggtcatcggaatggctatgacaaccaccctttccattccgcacgacctgatggagctcatcgacggcatctctctggggctcattctgcttaagatcgtgacacagttcgataacacgcaagttggaaccctggccctcagcctgacatttattcgctccaccatgagcctggtgatggcgtggagaacaatcatggctgtccttttcgtggtcaccctgattcccctctgtcggacgtcttgcctgcagaaacagtcccattgggtggaaatcacagccctcattctgggcgcccaagctcttcctgtttatctgatgaccctcatgaagggggccagcagacgctcttggcccctgaatgagggaatcatggctgtgggcctggtctcccttctgggcagcgccctcctgaaaaacgacgtgcctctcgcggggcccatggttgccggaggcctgcttctggctgcctacgtgatgtctgggtccagcgctgatctgtccctcgaaaaggccgccaatgtccagtgggacgagatggctgatatcaccggaagctctcctattatcgaagtgaagcaggacgaggatggcagcttttccattcgggacgtggaggaaacaaacatgatcaccctgcttgttaaactggcgctcattacagtctctgggctgtaccccctcgccatcccgatcacgatgaccctgtggtatatgtggcaggtgaagacacaaagaagcggagctctttgggatgtgccttcccccgccgccacccagaaagctgccctgtctgagggcgtctaccgcattatgcagcggggcctgttcgggaagacacaggtgggagttggcatccacatggaaggggtgttccacaccatgtggcatgtcacgagaggaagcgtgatttgtcacgagaccggccgcctcgaaccttcctgggcggacgttcggaatgatatgatctcttatgggggaggctggagactgggcgacaaatgggataaggaggaggacgtgcaagtccttgctattgaacccgggaagaacccgaaacatgtgcagacaaagcctggactgtttaaaaccctcacaggcgagatcggggccgttaccctggacttcaagcccggaacaagcggctcccctatcattaatcgcaaagggaaggtgatcggcctctacggaaacggcgtcgtgacgaaaagcggggattatgtgtctgccattacccaggctgaacggatcggagagcccgactacgaggtcgatgaagacatttttagaaagaagcggctgacaatcatggatcttcaccccggcgccgggaaaaccaagcgcattctgccttccatcgttagagaggcgctgaaacggcgcctcagaaccctgatccttgctccgacacgggtggtggccgccgaaatggaggaagctctgagaggactccccattcgctatcagacgcctgccgtcaagagcgagcataccggccgggagatcgtggacctgatgtgccacgctacattcaccacaagactcctgtcttccacccgcgttcccaattacaaccttattgtgatggatgaagcccactttacggaccctagctccgtcgcggcccgggggtacatctctacaagagtggagatgggcgaagctgccgctattttcatgaccgccaccccccctggagccacagatccgtttccccaaagcaattcccctatcgaggacatcgaacgcgagattcccgagcggagctggaacaccggcttcgattggatcacagactatcaggggaaaaccgtttggtttgtgccttctattaaggctggaaatgacatcgcgaactgcctgagaaagtccggcaaaaaggtcattcagctgagccgcaaaacgttcgatacagaataccccaagaccaaactcacagactgggattttgtggtcaccacggacatctctgagatgggggccaacttcagagctggacgggtgatcgatccgcgcagatgtctgaagcctgttattcttaccgacggccccgaacgggtgatcctggccgggcccattcctgtgacacccgccagcgctgcccaacgcagaggccggatcggaagaaatcctgcgcaggaggatgaccagtatgtcttctccggcgatccgctcaagaacgacgaagatcatgctcactggaccgaggccaaaatgctgctggacaatatttacacacccgaggggatcattcctaccctctttggacccgaacgcgagaagacacaggccatcgatggcgaattccggcttagaggggagcaacgcaaaacctttgttgagctgatgcggagaggagacctgcctgtgtggctctcttataaggtggctagcgccggcatctcctacaaagaccgggaatggtgcttcacgggcgagcgcaacaatcagattctggaagagaacatggaagtcgagatctggacaagagagggggaaaagaagaaacttcggcccaagtggctggatgcgcgcgtgtatgccgacccgatggctctcaaagattttaaggagttcgcctctggaagaaaaagcattaccctggacatcctgaccgaaattgcttccctccctacataccttagctctcgggccaagctggctctggataatatcgttatgctccataccacagagcgcggcgggagagcctaccagcacgcgctgaacgaacttcccgagtccctggagacgctcatgctggtggccctgctcggagctatgaccgccggcatctttcttttctttatgcaggggaagggaattggcaaactgagcatgggcctgatcacaattgctgtcgcctccgggctcctgtgggtggccgaaatccaacctcagtggattgctgcgtctatcatccttgagttctttctgatggtcctcctgattcccgaacctgagaagcagcggaccccccaggacaatcaactgatctatgtgattctcacaatccttaccattatcggactgattgccgctaacgaaatgggcctgatcgagaaaacgaagaccgatttcgggttttaccaggttaaaacagagaccacaatcctcgacgtggatctgcgcccggccagcgcctggaccctttatgctgtcgccacgacaattctgacccctatgctcagacacacaatcgaaaatacctccgcgaacctgtctctggccgctattgccaatcaggctgccgtgctcatgggacttggcaaggggtggcccctgcatcggatggacctgggagttcccctcctggcgatgggctgttacagccaggtgaaccctaccacacttacggcctccctggtcatgctcctggtgcactatgctatcattggcccggggctgcaagccaaagctaccagagaggcccagaagcgcacagctgccggaatcatgaagaatcccaccgtggatggcatcacagttattgacctcgaacctatcagctacgatcccaaattcgagaagcagcttgggcaagtcatgctgctggtgctctgcgcgggacagctgcttctgatgcggaccacgtgggccttctgtgaggtgctcacactggctaccggccctattctgaccctctgggaagggaaccccggaagattttggaacacaaccatcgccgtctctacagctaatattttccgcggctcctatcttgccggcgccgggctggcgtttagcctgatcaaaaacgctcagacgcctcggagaggaaccggcacagccggggagaccctcggagaaaagtggaaacgccagctgaattctcttgaccggaaggagttcgaagagtacaagagatccggcatcctggaggttgaccgcacagaagctaaaagcgccctcaaggatgggtctaaaattaagcatgccgtgagccggggatcctctaaaatcagatggattgtggagcgcggcatggtcaagccgaagggcaaagtggttgacctggggtgcggacggggcgggtggagctactatatggctaccctgaagaacgtgacggaagtcaaaggatacaccaagggcgggcccggacacgaggaacctatccccatggccacatatggctggaatctcgtgaaacttcattccggcgttgatgtgttttacaagcctaccgagcaagtcgacacactgctgtgtgatattggggagagctcctctaaccccaccatcgaagagggaagaacactccgcgtgctgaagatggtggaaccgtggcttagctccaaacctgagttctgcattaaggtcctgaatccctatatgcccaccgttatcgaagagctcgagaaactgcagagaaagcacggcgggaacctggtgcggtgtcctctctctcgcaatagcacgcacgaaatgtactgggtgtccggagcgtctggcaacatcgtcagctccgtgaatacaaccagcaaaatgcttctgaacagatttaccacacggcatagaaagcccacgtatgagaaagacgttgatctgggggccggaacccggtctgtgtccacagaaattgagaagcctgacatgaccatcattggccgcagactccagcggctgcaggaggaacacaaggagacatggcattacgatcaagaaaatccgtaccgcacctgggcttatcacggcagctacgaggccccctctacagggtccgctagctctatggtcaacggagtggttaaacttctgaccaagccttgggacgtgatccccatggtcacgcagctcgccatgaccgatacaacccctttcggccagcagagagtgtttaaagaaaaggttgacacacggaccccccaaccgaaacctgggacgcgcatggtgatgacaaccacagcgaattggctgtgggccctgctcggaaagaagaaaaaccccagactgtgcacccgggaggagttcatttccaaggtccgcagcaatgctgccatcggcgctgtgtttcaggaagagcaggggtggacgtccgccagcgaagctgtcaacgactctagattctgggagcttgtggataaagaacgggccctgcaccaagagggcaagtgtgagagctgcgtttataacatgatgggaaaacgcgaaaagaagctcggcgagtttgggagagcgaaaggatcccgggccatctggtacatgtggctgggcgctcgcttccttgaattcgaggccctggggtttctcaatgaagaccattggttcggaagagagaactcttggagcggcgtggagggggaaggcctgcaccggctgggatatattctcgaggaaatcgataagaaagacggcgatctgatgtacgctgacgataccgccgggtgggacacaagaattaccgaggatgaccttcagaatgaggaactgatcacagagcagatggcccctcatcacaagattctcgcgaaagctatctttaagctgacctatcagaacaaggtcgtgaaagtgcttcgccccacacctcggggagccgttatggatatcatttccagaaaggaccaacgcggctctgggcaggtgggaacctacggcctgaatacgttcacaaacatggaagtccagctcatccggcagatggaggccgaaggggtgattacccaagatgacatgcagaatcccaaaggcctgaaggagagagttgagaaatggctgcgcgaatgcggagtggaccggctcaagagaatggctatcagcggcgatgactgtgtcgtgaaaccgctggatgagcgctttgggacctcccttctgttcctcaacgacatgggaaaggtccggaaggatattcctcagtgggaaccctctaaaggctggaagaattggcaggaggtgcccttttgcagccatcacttccacaaaatctttatgaaggacgggagatccctggttgtgccttgtcgcaaccaagatgaacttatcggacgggccagaattagccagggcgctgggtggaatctgcgggagacagcctgcctcggcaaagcgtacgcccagatgtggtctctgatgtatttccatagacgcgacctgcggctcgcttccatggccatctgtagcgctgtcccgaccgagtggtttcccacatctagaacgacctggtccattcacgcccatcaccagtggatgacaaccgaagatatgctgaaggtgtggaaccgcgtttggatcgaggacaatcctaacatgattgataagacacccgtgcacagctgggaagacatcccttaccttggaaaaagagaggacctgtggtgcggctccctcattgggctgtctagccgggcgacctgggccaagaatatccatacggctatcacccaagtccgcaaccttattggaaaagaagagtatgtggattacatgtccgtgatgaagagatatagcgccccctctgagtccgaaggcgttctgtga

SEQ ID NO: 21050 - RNA, 9867 nt, synthetic construct
  misc_feature 1..9867: note = derived and/or modified CDS sequence (opt5) from DENV-4__KJ596665__SS-prME
  source 1..9867: mol_type = other RNA
agcaccatcaccctgctctgcctgattcccacggtgatggccttccacctttccaccagagacggagagcctctgatgatcgtcgctaagcatgaacgggggcgcccgctcctgtttaagaccaccgagggaattaacaagtgtacacttatcgccatggatctgggcgaaatgtgcgaggacaccgttacatacaaatgtcccctcctggtgaataccgaacctgaggatattgactgctggtgtaacctgacgtctacctgggtgatgtatgggacatgcacccagagcggagagagacggcgcgaaaagagatccgtcgcgctcacaccccactctggcatggggctggagacccgggctgaaacgtggatgagctccgagggagcctggaaacatgcccagcgcgtggagtcttggatccttagaaatcctggcttcgctctgctcgccggctttatggcttacatgatcgggcagacaggcattcagcggaccgttttctttgtgctgatgatgcttgtcgcccccagctatggcatgcgctgtgtgggggttggaaacagagatttcgtggaaggcgtctccgggggagcgtgggtggacctggtgctcgagcacggcggctgcgtcacaaccatggcccaggggaagcctaccctggattttgaactgacaaagacgaccgctaaagaggttgccctcctgcggacatactgtatcgaagctcttattagcaatatcaccacagccacccgctgcccgacgcaaggagagccctatctgaaggaggaacaggaccagcagtacatttgtagacgggatgtggtggaccgcggctgggggaacggatgcggcctcttcgggaaaggaggcgtcgtgacatgcgcgaagttttcttgttccggcaaaatcaccgggaatctggttcaaattgagaaccttgaatataccgtggtcgtgacagttcataatggagatacccacgccgtgggcaacgacacaagcaatcacggggtcacggctaccatcacacctagatctccctccgtggaggtcaagctgcctgattacggagaactcaccctggactgcgagccccggagcggcatcgacttcaacgagatgattctgatgaagatgaaaaagaaaacatggctcgtgcataagcagtggtttctggatcttccgctgccttggaccacgggggccgacacctctgaagttcactggaattacaaagagagaatggtgacattcaaggtcccccatgctaaacgccaggatgtgaccgttctcggctcccaggaaggagccatgcacagcgccctggctggcgcgacagaggtggactccggggatggaaaccacatgtttgccggccatcttaagtgtaaggtccggatggaaaaactgagaatcaaggggatgtcttataccatgtgcagcggaaaattctccattgacaaggagatggctgagacgcaacacggcacaaccgtggtgaaagttaagtacgaaggggccggcgccccttgtaaggtccccatcgagattcgcgatgtgaataaagaaaaggtggtcggacgggtgatcagcgctacacccctcgccgagaacaccaactctgttaccaatatcgagctggaacctccgttcggcgactcctatattgtgatcggggtcggaaacagcgcgctgacactccattggtttagaaaaggctctagcattgggaagatgttcgagtccacgtaccgcggagctaaacggatggccatcctgggcgaaaccgcctgggattttgggtctgtgggcggacttttcacaagcctgggcaaggctgttcaccaggtgtttgggtccgtctataccacaatgttcggaggcgtgagctggatgattagaatcctcatcgggtttctggttctgtggattggaaccaattctcgcaacacgtccatggccatgacatgcatcgctgtgggcgggattacccttttcctcggctttaccgtccaggccgacatgggatgtgtggtgagctggtctggccgggagctgaagtgcgggtccggaatcttcgtcgttgataatgtgcatacatggaccgaacaatacaaatttcagcccgagagccctgcgagactggcctccgctattctcaacgcccacaaggacggcgtgtgtgggatccgctctacaacgcggctggagaatgtcatgtggaaacagattaccaacgaacttaattatgtgctgtgggagggaggccacgacctcacagttgtggctggcgatgtcaagggggtgctgaccaaaggaaagagagccctgacaccccctgcgagcggccttaagtactcctggaaaacctgggggaaggccaaaatcttcacgcccgaagctcggaactctacctttctcatcgacggaccggatacaagcgagtgccctaatgaacgcagagcctggaactccttcgaggttgaggactacggcttcgggatgtttaccacaaatatttggatgaagttccgggaaggaagctctgaggtgtgtgatcatagactgatgtccgctgccatcaaagaccagaaggccgtccacgctgatatgggctattggattgaaagctctaaaaaccaaacctggcagatcgagcgcgcgtccctgattgaagtgaagacatgcctctggcccaagacccatacgctgtggagcaatggcgttcttgagtctcagatgctgatccctaaaagctacgccgggcccttttcccagcacaactatcggcaaggatacgctacacagaccgtgggcccttggcacctcgggaagctggagatcgacttcggagaatgccccggcaccacagtcaccattcaggagaactgtgatcatagagggccgagcctgcgcacgacaaccgcctctggaaaacttgtgacacagtggtgctgtagatcctgcaccatgcctcccctccggtttctgggcgaagacggctgttggtatgggatggagatccgccccctgagcgagaaggaagagaatatggtgaaatcccaagtcacagccggacagggcacctctgaaacgttcagcatggggctcctgtgccttaccctgtttgttgaggaatgtctcagacggcgcgtgacaagaaagcacatgattctggctgtggtcatcaccctgtgcgccattatccttggaggcctcacatggatggatctgctgcgggcgctcatcattctgggggacaccatgtccggacgcatcggcggccagacgcatcttgctattatggccgtgttcaagatgtctcctgggtacgttctgggagtgtttctcagaaaactgacaagccgggagaccgccctgatggtcatcggcatggctatgacaaccaccctttccattccgcacgatctgatggagctcatcgacgggatctctctgggactcattctgcttaagatcgtgacacagttcgacaacacgcaagttggcaccctggccctcagcctgacatttattcgctccaccatgagcctggtgatggcgtggagaacaatcatggctgtccttttcgtggtcaccctgattcccctctgtcggacgtcttgcctgcagaaacagtcccattgggtggaaatcacagccctcattctgggggcccaagcccttcctgtttatctgatgaccctcatgaagggagccagcagacgctcttggcccctgaatgagggcatcatggctgtgggcctggtctcccttctggggagcgccctcctgaaaaacgatgtgcctctcgcgggacccatggttgccggcgggctgcttctggctgcctacgtgatgtctggatccagcgctgacctgtccctcgaaaaggccgccaatgtccagtgggatgagatggctgacatcaccggcagctctcctattatcgaagtgaagcaggatgaggacgggagcttttccattcgggatgtggaggaaacaaacatgatcaccctgcttgttaaactggcgctcattacagtctctggactgtaccccctcgccatcccgatcacgatgaccctgtggtatatgtggcaagtgaagacacaaagaagcggcgctctttgggacgtgccttcccccgccgccacccagaaagctgccctgtctgagggcgtctaccgcattatgcagcgggggctgttcggaaagacacaggtgggcgttgggatccacatggaaggagtgttccacaccatgtggcatgtcacgagaggcagcgtgatttgtcacgagaccgggcgcctcgaaccttcctgggcggatgttcggaatgacatgatctcttatggaggcggctggagactgggggataaatgggacaaggaggaggatgtgcaagtccttgctattgaacccggaaagaacccgaaacatgtgcagacaaagcctggcctgtttaaaaccctcacaggggagatcggagccgttaccctggacttcaagcccggcacaagcgggtcccctatcattaatcgcaaaggcaaggtgatcggactctacggcaacggggtcgtgacgaaaagcggagactatgtgtctgccattacccaggctgaacggatcggcgagcccgattacgaggtcgacgaagatatttttagaaagaagcggctgacaatcatggaccttcaccccggggccggaaaaaccaagcgcattctgccttccatcgttagagaggcgctgaaacggcgcctcagaaccctgatccttgctccgacacgggtggtggccgccgaaatggaggaagctctgagaggcctccccattcgctatcagacgcctgccgtcaagagcgagcataccgggcgggagatcgtggatctgatgtgccacgctacattcaccacaagactcctgtcttccacccgcgttcccaattacaaccttattgtgatggacgaagcccactttacggatcctagctccgtcgcggcccggggctacatctctacaagagtggagatgggagaagctgccgctattttcatgaccgccacaccccctggcgccacagacccgtttccccaaagcaattcccctatcgaggatatcgaacgcgagattcccgagcggagctggaacaccgggttcgactggatcacagattatcagggaaaaaccgtttggtttgtgccttctattaaggctggcaatgacatcgcgaactgcctgagaaagtccgggaaaaaggtcattcagctgagccgcaaaacgttcgacacagaataccccaagaccaaactcacagattgggactttgtggtcaccacggatatctctgagatgggagccaacttcagagctggccgggtgatcgacccgcgcagatgtctgaagcctgttattcttaccgatgggcccgaacgggtgatcctggccggccccattcctgtgacacccgccagcgctgcccaacgcagaggacggatcggcagaaatcctgcgcaggaggacgatcagtatgtcttctccggggacccgctcaagaacgatgaagaccatgctcactggaccgaggccaaaatgctgctggataatatttacacacccgagggaatcattcctaccctctttggccccgaacgcgagaagacacaggccatcgacggggagttccggcttagaggagagcaacgcaaaacctttgttgagctgatgcggagaggcgatctgcctgtgtggctctcttataaggtggctagcgccggcatctcctacaaagaccgggaatggtgcttcacgggggagcgcaacaatcagattctggaagagaacatggaagtcgagatctggacaagagagggagaaaagaagaaacttcggcccaagtggctggacgcgcgcgtgtatgccgatccgatggctctcaaagactttaaggagttcgcctctggcagaaaaagcattaccctggatatcctgaccgaaattgcttccctccctacataccttagctctcgggccaagctggctctggacaatatcgttatgctccataccacagagcgcgggggcagagcttaccagcacgcgctgaacgaacttcccgagtccctggagacgctcatgctggtggccctgctcggagctatgaccgccgggatctttcttttctttatgcagggaaagggcattggcaaactgagcatggggctgatcacaattgctgtcgcctccggactcctgtgggtggccgaaatccaacctcagtggattgctgcgtctatcatccttgagttctttctgatggtcctcctgattcccgaacctgagaagcagcggacaccccaggataatcaactgatctatgtgattctcacaatccttaccattatcggcctgattgccgctaacgaaatggggctgatcgagaaaacgaagaccgacttcggattttaccaggttaaaacagagaccacaatcctcgatgtggacctgcgcccggccagcgcctggaccctttatgctgtcgccacgacaattctgacccctatgctcagacacacaatcgaaaatacctccgcgaacctgtctctggccgctattgccaatcaggctgccgtgctcatgggccttgggaagggatggcccctgcatcggatggatctgggcgttcccctcctggcgatgggctgttacagccaggtgaaccctaccacacttacggcctccctggtcatgctcctggtgcactatgctatcattgggccgggactgcaagccaaagctaccagagaggcccagaagcgcacagctgccggcatcatgaagaatcccaccgtggacgggatcacagttattgatctcgaacctatcagctacgaccccaaattcgagaagcagcttggacaagtcatgctgctggtgctctgcgcgggccagctgcttctgatgcggaccacgtgggccttctgtgaggtgctcacactggctaccgggcctattctgaccctctgggaaggaaaccccggcagattttggaacacaaccatcgccgtctctacagctaatattttccgcggctcctatcttgccggggccggactggcgtttagcctgatcaaaaacgctcagacgcctcggagaggcaccgggacagccggagagaccctcggcgaaaagtggaaacgccagctcaattctcttgatcggaaggagttcgaagagtacaagagatccgggatcctggaggttgaccgcacagaagctaaaagcgccctcaaggacggatctaaaattaagcatgccgtgagccggggctcctctaaaatcagatggattgtggagcgcggcatggtcaagccgaaggggaaagtggttgatctgggatgcggcagagggggatggagctactatatggctaccctgaagaacgtgacggaagtcaaaggctacaccaaagggggacccggccacgaggaacctatccccatggccacatatggctggaatctcgtgaaacttcattccggggttgacgtgttttacaagcctaccgagcaagtcgatacactgctgtgtgacattggagagagctcctctaaccccaccatcgaagagggcagaacactccgcgtgctgaagatggtggaaccgtggcttagctccaaacctgagttctgcattaaggtcctgaatccctatatgcccaccgttatcgaagaactggagaaactgcagagaaagcacgggggaaacctggtgcggtgtcctctctctcgcaatagcacgcacgaaatgtactgggtgtccggcgcgtctgggaacatcgtcagctccgtgaatacaaccagcaaaatgcttctgaacagatttaccacacggcatagaaagcccacgtatgagaaagatgttgacctgggagccggcacccggtctgtgtccacagaaaccgagaagcctgatatgacaattatcggccgcagactccagcggctgcaggaggaacacaaggagacctggcattacgaccaagaaaatccgtaccgcacatgggcttatcacgggagctacgaggccccctctaccggatccgctagctctatggtcaacggcgtggttaaacttctgacgaagccttgggatgtgattcccatggtcacccagctcgccatgacagacaccacacctttcgggcagcagagagtgtttaaagaaaaggttgatacccggacgccccaaccgaaacctggaacacgcatggtgatgaccacaaccgcgaattggctgtgggccctgctcggcaagaagaaaaaccccagactgtgcacgcgggaggagttcatctccaaggtccgcagcaatgctgccattggggctgtgtttcaggaagaacagggctggacctccgccagcgaagctgtcaacgactctagattctgggagcttgtggacaaagaacgggccctgcaccaagagggaaagtgtgagagctgcgtttataacatgatgggcaaacgcgaaaagaagctcggggagtttggacgggcgaaaggctcccgggccatctggtacatgtggctgggggctcgcttccttgagttcgaggccctgggatttctcaatgaagatcattggttcggcagagagaactcttggagcggggtggagggcgaaggactgcaccggctgggctatatcctcgaggaaattgacaagaaagatggggacctgatgtacgctgatgacacagccggatgggataccagaatcacagaggacgatcttcagaatgaggaactgattaccgagcagatggcccctcatcacaagatcctcgcgaaagctatttttaagctgacatatcagaacaaggtcgtgaaagtgcttcgccccacccctcggggcgccgttatggacatcatctccagaaaggatcaacgcgggtctggacaggtgggcacgtacgggctgaatacattcaccaacatggaagtccagctcattcggcagatggaggccgaaggcgtgatcacccaagacgatatgcagaatcccaaaggactgaaggagagagttgagaaatggctgcgcgaatgcggcgtggaccggctcaagagaatggctattagcggggacgattgtgtcgtgaaaccgctggacgagcgctttggaacatcccttctgttcctcaacgatatgggcaaggtccggaaggacatccctcagtgggaaccctctaaagggtggaagaattggcaggaggtgcccttttgcagccatcacttccacaaaatttttatgaaggatggaagatccctggttgtgccttgtcgcaaccaagacgaacttatcggccgggccagaatcagccagggggctggctggtctctgcgggagaccgcctgcctcggaaaagcgtacgcccagatgtggtccctgatgtatttccatagacgcgatctgcggctcgctagcatggccatttgttctgctgtcccgacagagtggtttcccacgtccagaaccacatggagcatccacgcccatcaccagtggatgaccacagaaaatatgctgaaggtgtggaaccgcgtttggattgaggacaatcctaacatgatcgataagacccccgtgcactcctgggaagacattccttaccttggcaaaagagaggatctgtggtgcgggtctctcatcggactgagctcccgggcgacgtgggccaagaatattcataccgctatcacacaagtccgcaaccttatcggcaaagaagagtatgtggactacatgcccgtgatgaagagatatagcgccccttctgagtccgaaggggttctgtga

SEQ ID NO: 21051 - RNA, 9867 nt, synthetic construct
  misc_feature 1..9867: note = derived and/or modified CDS sequence (opt5) from DENV-4__KJ596668__SS-prME
  source 1..9867: mol_type = other RNA
agcaccatcacactgctctgcctgattcccacggtgatggccttccacctttccaccagagacggcgagcctctgatgatcgtcgctaagcatgaacgggggcgcccgctcctgtttaaaacaaccgagggaattaacaagtgtacacttatcgccatggatctgggcgaaatgtgcgaggacaccgttacatacaaatgtcccctcctggtgaataccgaacctgaggatattgactgctggtgtaacctgacgtctacctgggtgatgtatgggacatgcacccagagcggagagagacggcgcgaaaagagatccgtcgcgctcacaccccactctggcatggggctggagacccgggctgaaacgtggatgagctccgagggagcctggaaacatgcccaacgcgtggagtcttggatccttagaaatcctggcttcgctctgctcgccggctttatggcttacatgatcgggcagacaggaattcagcggaccgttttctttgtgctgatgatgcttgtcgcccccagctatggcatgcgctgtgtgggggttggaaacagagatttcgtggaaggcgtctccgggggagcgtgggtggacctggtgctcgagcacggcggctgcgtcacaaccatggcccaggggaagcctaccctggattttgaactgacaaagacgaccgctaaagaggttgccctcctgcggacatactgtatcgaagctcttattagcaatatcaccacagccacccgctgcccgacgcaaggagagccctatctgaaggaggaacaggaccagcagtacatttgtagacgggatgtggtggaccgcggctgggggaacggatgcggcctcttcgggaaaggaggcgtcgtgacatgcgcgaagttttcttgttccggcaaaatcaccgggaatctggttcaaattgagaaccttgaatataccgtggtcgtgacagttcataatggagatacccacgccgtgggcaacgacacaagcaatcacggggtcacggctaccatcacacctagatctccctccgtggaggtcaagctgcctgattacggagaactcaccctggactgcgagccccggagcggcatcgacttcaacgagatgattctgatgaagatgaaaaagaaaacatggctcgtgcataagcagtggtttctggatcttccgctgccttggaccacgggggccgacacctctgaagttcactggaattacaaagagagaatggtgacattcaaggtcccccatgctaaacgccaggatgtgaccgttctcggctcccaggaaggagccatgcacagcgccctggctggcgcgacagaggtggactccggggatggaaaccacatgtttgccggccatcttaagtgtaaggtccggatggaaaaactgagaatcaaggggatgtcttataccatgtgcagcggaaaattctccattgacaaggagatggctgagacgcaacacggcacaaccgtggtgaaagttaagtacgaaggggccggcgccccttgtaaggtccccatcgagattcgcgatgtgaataaagaaaaggtggtcggacgggtgatcagcgctacacccctcgccgagaacaccaactctgttaccaatatcgagctggaacctccgttcggcgactcctatattgtgatcggggtcggaaacagcgcgctgacactccattggtttagaaaaggctctagcattgggaagatgttcgagtccacgtaccgcggagctaaacggatggccatcctgggcgaaaccgcctgggattttgggtctgtgggcggacttttcacaagcctgggcaaggctgttcaccaggtgtttgggtccgtctataccacaatgttcggaggcgtgagctggatgattagaatcctcatcgggtttctggttctgtggattggaaccaattctcgcaacacgtccatggccatgacatgcatcgctgtgggcgggattacccttttcctcggctttaccgtccaggccgacatgggatgtgtggtgagctggtctggccgggagctgaagtgcgggtccggaatcttcgtcgttgataatgtgcatacatggaccgaacaatacaaatttcagcccgagagccctgcgagactggcctccgctattctcaacgcccacaaggacggcgtgtgtgggatccgctctacaacgcggctggagaatgtcatgtggaaacagattaccaacgaacttaattatgtgctgtgggagggaggccacgacctcacagttgtggctggcgatgtcaagggggtgctgaccaaaggaaagagagccctgacaccccctgcgagcgaccttaagtactcctggaaaacctggggcaaggccaaaatcttcacgcccgaagctcggaactctacctttctcatcgatgggccggacacaagcgagtgccctaatgaacgcagagcctggaactccttcgaggttgaggattacggattcggcatgtttaccacaaatatttggatgaagttccgggaagggagctctgaggtgtgtgaccatagactgatgtccgctgccatcaaagatcagaaggccgtccacgctgacatgggatattggattgaaagctctaaaaaccaaacctggcagatcgagcgcgcgtccctgattgaagtgaagacatgcctctggcccaagacccatacgctgtggagcaatggcgttcttgagtctcagatgctgatccctaaaagctacgccggccccttttcccagcacaactatcggcaagggtacgctacacagaccgtgggaccttggcacctcggcaagctggagatcgatttcggggaatgccccggaaccacagtcaccattcaggagaactgtgaccatagaggcccgagcctgcgcacgacaaccgcctctgggaaacttgtgacacagtggtgctgtagatcctgcaccatgcctcccctccggtttctgggagaagatggctgttggtatggcatggagatccgccccctgagcgagaaggaagagaatatggtgaaatcccaagtcacagccgggcagggaacctctgaaacgttcagcatgggcctcctgtgccttaccctgtttgttgaggaatgtctcagacggcgcgtgacaagaaagcacatgattctggctgtggtcatcaccctgtgcgccattatccttgggggactcacatggatggacctgctgcgggcgctcatcattctgggcgataccatgtccgggcgcatcggaggccagacgcatcttgctattatggccgtgttcaagatgtctcctggctacgttctgggggtgtttctcagaaaactgacaagccgggagaccgccctgatggtcatcggaatggctatgacaaccaccctttccattccgcacgacctgatggagctcatcgacggcatctctctggggctcattctgcttaagatcgtgacacagttcgataacacgcaagttggaaccctggccctcagcctgacatttattcgctccaccatgagcctggtgatggcgtggagaacaatcatggctgtccttttcgtggtcaccctgattcccctctgtcggacgtcttgcctgcagaaacagtcccattgggtggaaatcacagccctcattctgggcgcccaagctcttcctgtttatctgatgaccctcatgaagggggccagcagacgctcttggcccctgaatgagggaatcatggctgtgggcctggtctcccttctgggcagcgccctcctgaaaaacgacgtgcctctcgcggggcccatggttgccggaggcctgcttctggctgcctacgtgatgtctgggtccagcgctgatctgtccctcgaaaaggccgccaatgtccagtgggacgagatggctgatatcaccggaagctctcctattatcgaagtgaagcaggacgaggatggcagcttttccattcgggacgtggaggaaacaaacatgatcaccctgcttgttaaactggcgctcattacagtctctgggctgtaccccctcgccatcccggtgacgatgaccctgtggtatatgtggcaggtgaagacacaaagaagcggagctctttgggatgtcccttcccccgccgccacccagaaagctgccctgtctgagggcgtgtaccgcatcatgcagcggggcctgttcgggaagacacaggttggagtgggcattcacatggaaggggtcttccacaccatgtggcatgtgacgagaggaagcgttatctgtcacgagaccggccgcctcgaaccttcctgggcggacgtgcggaatgatatgatttcttatgggggaggctggagactgggcgacaaatgggataaggaggaggacgtccaagtgcttgctatcgaacccgggaagaacccgaaacatgttcagacaaagcctggactgtttaaaaccctcacaggcgagattggggccgtgaccctggacttcaagcccggaacaagcggctcccctatcatcaatcgcaaagggaaggtcattggcctctacggaaacggcgtggtgacgaaaagcggggattatgtctctgccatcacccaggctgaacggattggagagcccgactacgaggttgatgaagacatctttagaaagaagcggctgacaattatggatcttcaccccggcgccgggaaaaccaagcgcatcctgccttccattgtgagagaggcgctgaaacggcgcctcagaaccctgatccttgctccgacacgggtggtcgccgccgaaatggaggaagctctgagaggactccccatccgctatcagacgcctgccgtgaagagcgagcataccggccgggagattgttgacctgatgtgccacgctacattcaccacaagactcctgtcttccacccgcgtgcccaattacaaccttatcgtcatggatgaagcccactttacggaccctagctccgtggcggcccgggggtacatttctacaagagttgagatgggcgaagctgccgctatcttcatgaccgccaccccccctggagccacagatccgtttccccaaagcaattcccctattgaggacatcgaacgcgagatccccgagcggagctggaacaccggcttcgattggattacagactatcaggggaaaaccgtgtggtttgtcccttctatcaaggctggaaatgacattgcgaactgcctgagaaagtccggcaaaaaggtgatccagctgagccgcaaaacgttcgatacagaataccccaagaccaaactcacagactgggattttgtcgtgaccacggacatttctgagatgggggccaacttcagagctggacgggttatcgatccgcgcagatgtctgaagcctgtgatccttaccgacggccccgaacgggtgattctggccgggcccatccctgtcacacccgccagcgctgcccaacgcagaggccggattggaagaaatcctgcgcaggaggatgaccagtatgttttctccggcgatccgctcaagaacgacgaagatcatgctcactggaccgaggccaaaatgctgctggacaatatctacacacccgaggggattatccctaccctctttggacccgaacgcgagaagacacaggccattgatggcgaattccggcttagaggggagcaacgcaaaacctttgtggagctgatgcggagaggagacctgcctgtgtggctctcttataaggtcgctagcgccggcatctcctacaaagaccgggaatggtgcttcacgggcgagcgcaacaatcagatcctggaagagaacatggaagtggagatttggacaagagagggggaaaagaagaaacttcggcccaagtggctggatgcgcgcgtttatgccgacccgatggctctcaaagattttaaggagttcgcctctggaagaaaaagcatcaccctggacattctgaccgaaatcgcttccctccctacataccttagctctcgggccaagctggctctggataatattgtgatgctccataccacagagcgcggcgggagagcctaccagcacgcgctgaacgaacttcccgagtccctggagacgctcatgctggtcgccctgctcggagctatgaccgccggcatctttcttttctttatgcaggggaagggaatcggcaaactgagcatgggcctgattacaatcgctgtggcctccgggctcctgtgggtcgccgaaattcaacctcagtggatcgctgcgtctattatccttgagttctttctgatggtgctcctgatccccgaacctgagaagcagcggaccccccaggacaatcaactgatttatgttatcctcacaattcttaccatcattggactgatcgccgctaacgaaatgggcctgattgagaaaacgaagaccgatttcgggttttaccaggtgaaaacagagaccacaatcctcgacgtcgatctgcgcccggccagcgcctggaccctttatgctgtggccacgacaatcctgacccctatgctcagacacacaattgaaaatacctccgcgaacctgtctctggccgctatcgccaatcaggctgccgttctcatgggacttggcaaggggtggcccctgcatcggatggacctgggagtgcccctcctggcgatgggctgttacagccaggtcaaccctaccacacttacggcctccctggtgatgctcctggtgcactatgctattatcggcccggggctgcaagccaaagctaccagagaggcccagaagcgcacagctgccggaattatgaagaatcccaccgttgatggcatcacagtcatcgacctcgaacctattagctacgatcccaaattcgagaagcagcttgggcaagtgatgctgctggtgctctgcgcgggacagctgcttctgatgcggaccacgtgggccttctgtgaggtcctcacactggctaccggccctatcctgaccctctgggaagggaaccccggaagattttggaacacaaccattgccgtttctacagctaatatcttccgcggctcctatcttgccggcgccgggctggcgtttagcctgattaaaaacgctcagacgcctcggagaggaaccggcacagccggggagaccctcggagaaaagtggaaacgccagctgaattctcttgaccggaaggagttcgaagagtacaagagatccggcatcctggaggtggaccgcacagaagctaaaagcgccctcaaggatgggtctaaaatcaagcatgccgtgagccggggatcctctaaaattagatggatcgtcgagcgcggcatggtgaagccgaagggcaaagttgtggacctggggtgcggacggggcgggtggagctactatatggctaccctgaagaacgtcacggaagtgaaaggatacaccaagggcgggcccggacacgaggaacctattcccatggccacatatggctggaatctcgttaaacttcattccggcgtggatgtcttttacaagcctaccgagcaagtggacacactgctgtgtgatatcggggagagctcctctaaccccaccattgaagagggaagaacactccgcgtgctgaagatggtcgaaccgtggcttagctccaaacctgagttctgcatcaaggttctgaatccctatatgcccaccgtgattgaagagctcgagaaactgcagagaaagcacggcgggaacctggtgcggtgtcctctctctcgcaatagcacgcacgaaatgtactgggtctccggagcgtctggcaacatcgtgagctccgttaatacaaccagcaaaatgcttctgaacagatttaccacacggcatagaaagcccacgtatgagaaagacgtggatctgggggccggaacccggtctgtctccacagaaaccgagaagcctgacatgacaatcattggccgcagactccagcggctgcaggaggaacacaaggagacctggcattacgatcaagaaaatccgtaccgcacatgggcttatcacggcagctacgaggccccctctaccgggtccgctagctctatggtgaacggagttgtgaaacttctgacgaagccttgggacgtcatccccatggtgacccagctcgccatgacagataccacacctttcggccagcagagagtttttaaagaaaaggtggacacccggacgccccaaccgaaacctgggacacgcatggtcatgaccacaaccgcgaattggctgtgggccctgctcggaaagaagaaaaaccccagactgtgcacgcgggaggagttcatttccaaggtgcgcagcaatgctgccatcggcgctgtctttcaggaagagcaggggtggacctccgccagcgaagctgtgaacgactctagattctgggagcttgttgataaagaacgggccctgcaccaagagggcaagtgtgagagctgcgtgtataacatgatgggaaaacgcgaaaagaagctcggcgagtttgggagagcgaaaggatcccgggccatttggtacatgtggctgggcgctcgcttccttgaattcgaggccctggggtttctcaatgaagaccattggttcggaagagagaactcttggagcggcgtcgagggggaaggcctgcaccggctgggatatatcctcgaggaaatcgataagaaagacggcgatctgatgtacgctgacgatacagccgggtgggacaccagaattacagaggatgaccttcagaatgaggaactgatcaccgagcagatggcccctcatcacaagattctcgcgaaagctatctttaagctgacatatcagaacaaggtggtgaaagttcttcgccccacccctcggggagccgtgatggatattatctccagaaaggaccaacgcggctctgggcaggtcggaacgtacggcctgaatacattcaccaacatggaagtgcagctcatccggcagatggaggccgaaggggttattacccaagatgacatgcagaatcccaaaggcctgaaggagagagtggagaaatggctgcgcgaatacggagtcgaccggctcaagagaatggctatcagcggcgatgactgcgtggtcaaaccgctggatgagcgctttgggacatcccttctgttcctcaacgacatgggaaaggtgcggaaggatattcctcagtgggaaccctctaaaggctggaagaattggcaggaggttcccttttgtagccatcacttccacaaaatctttatgaaggacgggagatccctggtggtcccttgccgcaaccaagatgaacttattggacgggccagaatcagccagggcgctgggtggtctctgcgggagaccgcctgtctcggcaaagcgtatgcccagatgtggtccctgatgtacttccatagacgcgacctgcggctcgctagcatggccatctgctctgctgtgccgacagagtggtttcccacgtccagaaccacatggagcattcacgcccatcaccagtggatgaccacagaagatatgctgaaggtttggaatcgcgtgtggatcgaggacaaccctaatatgattgataagacccccgtccactcctgggaagacatcccttatcttggaaaaagagaggacctgtggtgtggctctctcattgggctgagctcccgggcgacgtgggccaagaacatccataccgctattacacaagtgcgcaatcttatcggaaaagaagagtacgtggattatatgcccgttatgaagagatacagcgccccttctgagtccgaaggcgtcctgtga

SEQ ID NO: 21052 - RNA, 9867 nt, synthetic construct
  misc_feature 1..9867: note = derived and/or modified CDS sequence (opt5) from DENV-4__KJ596670__SS-prME
  source 1..9867: mol_type = other RNA
agcaccatcacactgctctgcctgattcccacggtgatggccttccacctttccaccagagacggcgagcctctgatgatcgtcgctaagcatgaacgggggcgcccgctcctgtttaaaacaaccgagggaattaacaagtgtacacttatcgccatggatctgggcgaaatgtgcgaggacaccgttacatacaaatgtcccctcctggtgaataccgaacctgaggatattgactgctggtgtaacctgacgtctacctgggtgatgtatgggacatgcacccagagcggagagagacggcgcgaaaagagatccgtcgcgctcacaccccactctggcatggggctggagacccgggctgaaacgtggatgagctccgagggagcctggaaacatgcccaacgcgtggagtcttggatccttagaaatcctggcttcgctctgctcgccggctttatggcttacatgatcgggcagacaggaattcagcggaccgttttctttgtgctgatgatgcttgtcgcccccagctatggcatgcgctgtgtgggggttggaaacagagatttcgtggaaggcgtctccgggggagcgtgggtggacctggtgctcgagcacggcggctgcgtcacaaccatggcccaggggaagcctaccctggattttgaactgacaaagacgaccgctaaagaggttgccctcctgcggacatactgtatcgaagctcttattagcaatatcaccacagccacccgctgcccgacgcaaggagagccctatctgaaggaggaacaggaccagcagtacatttgtagacgggatgtggtggaccgcggctgggggaacggatgcggcctcttcgggaaaggaggcgtcgtgacatgcgcgaagttttcttgttccggcaaaatcaccgggaatctggttcaaattgagaaccttgaatataccgtggtcgtgacagttcataatggagatacccacgccgtgggcaacgacacaagcaatcacggggtcacggctaccatcacacctagatctccctccgtggaggtcaagctgcctgattacggagaactcaccctggactgcgagccccggagcggcatcgacttcaacgagatgattctgatgaagatgaaaaagaaaacatggctcgtgcataagcagtggtttctggatcttccgctgccttggaccacgggggccgacacctctgaagttcactggaattacaaagagagaatggtgacattcaaggtcccccatgctaaacgccaggatgtgaccgttctcggctcccaggaaggagccatgcacagcgccctggctggcgcgacagaggtggactccggggatggaaaccacatgtttgccggccatcttaagtgtaaggtccggatggaaaaactgagaatcaaggggatgtcttataccatgtgcagcggaaaattctccattgacaaggagatggctgagacgcaacacggcacaaccgtggtgaaagttaagtacgaaggggccggcgccccttgtaaggtccccatcgagattcgcgatgtgaataaagaaaaggtggtcggacgggtgatcagcgctacacccctcgccgagaacaccaactctgttaccaatatcgagctggaacctccgttcggcgactcctatattgtgatcggggtcggaaacagcgcgctgacactccattggtttagaaaaggctctagcattgggaagatgttcgagtccacgtaccgcggagctaaacggatggccatcctgggcgaaaccgcctgggattttgggtctgtgggcggacttttcacaagcctgggcaaggctgttcaccaggtgtttgggtccgtctataccacaatgttcggaggcgtgagctggatgattagaatcctcatcgggtttctggttctgtggattggaaccaattctcgcaacacgtccatggccatgacatgcatcgctgtgggcgggattacccttttcctcggctttaccgtccaggccgacatgggatgtgtggtgagctggtctggccgggagctgaagtgcgggtccggaatcttcgtcgttgataatgtgcatacatggaccgaacaatacaaatttcagcccgagagccctgcgagactggcctccgctattctcaacgcccacaaggacggcgtgtgtgggatccgctctacaacgcggctggagaatgtcatgtggaaacagattaccaacgaacttaattatgtgctgtgggagggaggccacgacctcacagttgtggctggcgatgtcaagggggtgctgaccaaaggaaagagagccctgacaccccctgcgagcgaccttaagtactcctggaaaacctggggcaaggccaaaatcttcacgcccgaagctcggaactctacctttctcatcgatgggccggacacaagcgagtgccctaatgaacgcagagcctggaactccttcgaggttgaggattacggattcggcatgtttaccacaaatatttggatgaagttccgggaagggagctctgaggtgtgtgaccatagactgatgtccgctgccatcaaagatcagaaggccgtccacgctgacatgggatattggattgaaagctctaaaaaccaaacctggcagatcgagcgcgcgtccctgattgaagtgaagacatgcctctggcccaagacccatacgctgtggagcaatggcgttcttgagtctcagatgctgatccctaaaagctacgccggccccttttcccagcacaactatcggcaagggtacgctacacagaccgtgggaccttggcacctcggcaagctggagatcgatttcggggaatgccccggaaccacagtcaccattcaggagaactgtgaccatagaggcccgagcctgcgcacgacaaccgcctctgggaaacttgtgacacagtggtgctgtagatcctgcaccatgcctcccctccggtttctgggagaagatggctgttggtatggcatggagatccgccccctgagcgagaaggaagagaatatggtgaaatcccaagtcacagccgggcagggaacctctgaaacgttcagcatgggcctcctgtgccttaccctgtttgttgaggaatgtctcagacggcgcgtgacaagaaagcacatgattctggctgtggtcatcaccctgtgcgccattgtgcttgggggactcacatggatggacctgctgcgggcgctcatcatgctgggcgataccatgtccgggcgcatcggaggccagacgcatcttgctattatcgccgttttcaagatgtctcctggctacgtgctgggggtctttctcagaaaactgacaagccgggagaccgccctgatggtgattggaatggctatgacaaccaccctttccatcccgcacgacctgatggagctcattgacggcatctctctggggctcatcctgcttaagattgttacacagttcgataacacgcaagtgggaaccctggccctcagcctgacatttatccgctccaccatgagcctggtcatggcgtggagaacaattatggctgtgcttttcgtcgtgaccctgatccccctctgtcggacgtcttgcctgcagaaacagtcccattgggttgaaattacagccctcatcctgggcgcccaagctcttcctgtgtatctgatgaccctcatgaagggggccagcagacgctcttggcccctgaatgagggaattatggctgtcggcctggtgtcccttctgggcagcgccctcctgaaaaacgacgttcctctcgcggggcccatggtggccggaggcctgcttctggctgcctacgtcatgtctgggtccagcgctgatctgtccctcgaaaaggccgccaatgtgcagtgggacgagatggctgatatcaccggaagctctcctatcattgaagtgaagcaggacgaggatggcagcttttccatccgggacgttgaggaaacaaacatgattaccctgcttgtcaaactggcgctcatcacagtgtctgggctgtaccccctcgccattccgatcacgatgaccctgtggtatatgtggcaggtgaagacacaaagaagcggagctctttgggatgtcccttcccccgccgccacccagaaagctgccctgtctgagggcgtgtaccgcatcatgcagcggggcctgttcgggaagacacagattggagttggcatccacatggaaggggtgttccacaccatgtggcatgtcacgagaggaagcgtgatttgtcacgagaccggccgcctcgaaccttcctgggcggacgttcggaatgatatgatctcttatgggggaggctggagactgggcgacaaatgggataaggaggaggacgtgcaagtccttgctattgaacccgggaagaacccgaaacatgtgcagacaaagcctggactgtttaaaaccctcacaggcgagatcggggccgttaccctggacttcaagcccggaacaagcggctcccctatcattaatcgcaaagggaaggtgatcggcctctacggaaacggcgtcgtgacgaaaagcggggattatgtgtctgccattacccaggctgaacggatcggagagcccgactacgaggtcgatgaagacatttttagaaagaagcggctgacaatcatggatcttcaccccggcgccgggaaaaccaagcgcattctgccttccatcgttagagaggcgctgaaacggcgcctcagaaccctgatccttgctccgacacgggtggtggccgccgaaatggaggaagctctgagaggactccccattcgctatcagacgcctgccgtcaagagcgagcataccggccgggagatcgtggacctgatgtgccacgctacattcaccacaagactcctgtcttccacccgcgttcccaattacaaccttattgtgatggatgaagcccactttacggaccctagctccgtcgcggcccgggggtacatctctacaagagtggagatgggcgaagctgccgctattttcatgaccgccaccccccctggagccacagatccgtttccccaaagcaattcccctatcgaggacatcgaacgcgagattcccgagcggagctggaacaccggcttcgattggatcacagactatcaggggaaaaccgtttggtttgtgccttctattaaggctggaaatgacatcgcgaactgcctgagaaagtccggcaaaaaggtcattcagctgagccgcaaaacgttcgatacagaataccccaagaccaaactcacagactgggattttgtggtcaccacggacatctctgagatgggggccaacttcagagctggacgggtgatcgatccgcgcagatgtctgaagcctgttattcttaccgacggccccgaacgggtgatcctggccgggcccattcctgtgacacccgccagcgctgcccaacgcagaggccggatcggaagaaatcctgcgcaggaggatgaccagtatgtcttctccggcgatccgctcaagaacgacgaagatcatgctcactggaccgaggccaaaatgctgctggacaatatttacacacccgaggggatcattcctaccctctttggacccgaacgcgagaagacacaggccatcgatggcgaattccggcttagaggggagcaacgcaaaacctttgttgagctgatgcggagaggagacctgcctgtgtggctctcttataaggtggctagcgccggcatctcctacaaagaccgggaatggtgcttcacgggcgagcgcaacaatcagattctggaagagaacatggaagtcgagatctggacaagagagggggaaaagaagaaacttcggcccaagtggctggatgcgcgcgtgtatgccgacccgatggctctcaaagattttaaggagttcgcctctggaagaaaaagcattaccctggacatcctgaccgaaattgcttccctccctacataccttagctctcgggccaagctggctctggataatatcgttatgctccataccacagagcgcggcgggagagcctaccagcacgcgctgaacgaacttcccgagtccctggagacgctcatgctggtggccctgctcggagctatgaccgccggcatctttcttttctttatgcaggggaagggaattggcaaactgagcatgggcctgatcacaattgctgtcgcctccgggctcctgtgggtggccgaaatccaacctcagtggattgctgcgtctatcatccttgagttctttctgatggtcctcctgattcccgaacctgagaagcagcggaccccccaggacaatcaactgatctatgtgattctcacaatccttaccattatcggactgattgccgctaacgaaatgggcctgatcgagaaaacgaagaccgatttcgggttttaccaggttaaaacagagaccacaatcctcgacgtggatctgcgcccggccagcgcctggaccctttatgctgtcgccacgacaattctgacccctatgctcagacacacaatcgaaaatacctccgcgaacctgtctctggccgctattgccaatcaggctgccgtgctcatgggacttggcaaggggtggcccctgcatcggatggacctgggagttcccctcctggcgatgggctgttacagccaggtgaaccctaccacacttacggcctccctggtcatgctcctggtgcactatgctatcattggcccggggctgcaagccaaagctaccagagaggcccagaagcgcacagctgccggaatcatgaagaatcccaccgtggatggcatcacagttattgacctcgaacctatcagctacgatcccaaattcgagaagcagcttgggcaagtcatgctgctggtgctctgcgcgggacagctgcttctgatgcggaccacgtgggccttctgtgaggtgctcacactggctaccggccctattctgaccctctgggaagggaaccccggaagattttggaacacaaccatcgccgtctctacagctaatattttccgcggctcctatcttgccggcgccgggctggcgtttagcctgatcaaaaacgctcagacgcctcggagaggaaccggcacagccggggagaccctcggagaaaagtggaaacgccagctgaattctcttgaccggaaggagttcgaagagtacaagagatccggcatcctggaggttgaccgcacagaagctaaaagcgccctcaaggatgggtctaaaattaagcatgccgtgagccggggatcctctaaaatcagatggattgtggagcgcggcatggtcaagccgaagggcaaagtggttgacctggggtgcggacggggcgggtggagctactatatggctaccctgaagaacgtgacggaagtcaaaggatacaccaagggcgggcccggacacgaggaacctatccccatggccacatatggctggaatctcgtgaaacttcattccggcgttgatgtgttttacaagcctaccgagcaagtcgacacactgctgtgtgatattggggagagctcctctaaccccaccatcgaagagggaagaacactccgcgtgctgaagatggtggaaccgtggcttagctccaaacctgagttctgcattaaggtcctgaatccctatatgcccaccgttatcgaagagctcgagaaactgcagagaaagcacggcgggaacctggtgcggtgtcctctctctcgcaatagcacgcacgaaatgtactgggtgtccggagcgtctggcaacatcgtcagctccgtgaatacaaccagcaaaatgcttctgaacagatttaccacacggcatagaaagcccacgtatgagaaagacgttgatctgggggccggaacccggtctgtgtccacagaaattgagaagcctgacatgaccatcattggccgcagactccagcggctgcaggaggaacacaaggagacatggcattacgatcaagaaaatccgtaccgcacctgggcttatcacggcagctacgaggccccctctacagggtccgctagctctatggtcaacggagtggttaaacttctgaccaagccttgggacgtgatccccatggtcacgcagctcgccatgaccgatacaacccctttcggccagcagagagtgtttaaagaaaaggttgacacacggaccccccaaccgaaacctgggacgcgcatggtgatgacaaccacagcgaattggctgtgggccctgctcggaaagaagaaaaaccccagactgtgcacccgggaggagttcatttccaaggtccgcagcaatgctgccatcggcgctgtgtttcaggaagagcaggggtggacgtccgccagcgaagctgtcaacgactctagattctgggagcttgtggataaagaacgggccctgcaccaagagggcaagtgtgagagctgcgtttataacatgatgggaaaacgcgaaaagaagctcggcgagtttgggagagcgaaaggatcccgggccatctggtacatgtggctgggcgctcgcttccttgaattcgaggccctggggtttctcaatgaagaccattggttcggaagagagaactcttggagcggcgtggagggggaaggcctgcaccggctgggatatattctcgaggaaatcgataagaaagacggcgatctgatgtacgctgacgataccgccgggtgggacacaagaattaccgaggatgaccttcagaatgaggaactgatcacagagcagatggcccctcatcacaagattctcgcgaaagctatctttaagctgacctatcagaacaaggtcgtgaaagtgcttcgccccacacctcggggagccgttatggatatcatttccagaaaggaccaacgcggctctgggcaggtgggaacctacggcctgaatacgttcacaaacatggaagtccagctcatccggcagatggaggccgaaggggtgattacccaagatgacatgcagaatcccaaaggcctgaaggagagagttgagaaatggctgcgcgaatgcggagtggaccggctcaagagaatggctatcagcggcgatgactgtgtcgtgaaaccgctggatgagcgctttgggacctcccttctgttcctcaacgacatgggaaaggtccggaaggatattcctcagtgggaaccctctaaaggctggaagaattggcaggaggtgcccttttgcagccatcacttccacaaaatctttatgaaggacgggagatccctggttgtgccttgtcgcaaccaagatgaacttatcggacgggccagaattagccagggcgctgggtggtctctgcgggagacagcctgcctcggcaaagcgtacgcccagatgtggtccctgatgtatttccatagacgcgacctgcggctcgctagcatggccatctgttctgctgtcccgaccgagtggtttcccacatccagaacgacctggagcattcacgcccatcaccagtggatgacaaccgaagatatgctgaaggtgtggaatcgcgtttggatcgaggacaaccctaatatgattgataagacacccgtgcactcctgggaagacatcccttaccttggaaaaagagaggacctgtggtgcggctctctcattgggctgagctcccgggcgacctgggccaagaacatccatacggctatcacccaagtccgcaatcttattggaaaagaagagtatgtggattacatgagcgtgatgaagagatattctgccccctccgagagcgaaggcgttctgtga

SEQ ID NO: 21053 - RNA, 9867 nt, synthetic construct
  misc_feature 1..9867: note = derived and/or modified CDS sequence (opt5) from DENV-4__KJ596671__SS-prME
  source 1..9867: mol_type = other RNA
agcaccatcacactgctctgcctgattcccacggtgatggccttccacctttccaccagagacggcgagcctctgatgatcgtcgctaagcatgaacgggggcgcccgctcctgtttaaaacaaccgagggaattaacaagtgtacacttatcgccatggatctgggcgaaatgtgcgaggacaccgttacatacaaatgtcccctcctggtgaataccgaacctgaggatattgactgctggtgtaacctgacgtctacctgggtgatgtatgggacatgcacccagagcggagagagacggcgcgaaaagagatccgtcgcgctcacaccccactctggcatggggctggagacccgggctgaaacgtggatgagctccgagggagcctggaaacatgcccaacgcgtggagtcttggatccttagaaatcctggcttcgctctgctcgccggctttatggcttacatgatcgggcagacaggaattcagcggaccgttttctttgtgctgatgatgcttgtcgcccccagctatggcatgcgctgtgtgggggttggaaacagagatttcgtggaaggcgtctccgggggagcgtgggtggacctggtgctcgagcacggcggctgcgtcacaaccatggcccaggggaagcctaccctggattttgaactgacaaagacgaccgctaaagaggttgccctcctgcggacatactgtatcgaagctcttattagcaatatcaccacagccacccgctgcccgacgcaaggagagccctatctgaaggaggaacaggaccagcagtacatttgtagacgggatgtggtggaccgcggctgggggaacggatgcggcctcttcgggaaaggaggcgtcgtgacatgcgcgaagttttcttgttccggcaaaatcaccgggaatctggttcaaattgagaaccttgaatataccgtggtcgtgacagttcataatggagatacccacgccgtgggcaacgacacaagcaatcacggggtcacggctaccatcacacctagatctccctccgtggaggtcaagctgcctgattacggagaactcaccctggactgcgagccccggagcggcatcgacttcaacgagatgattctgatgaagatgaaaaagaaaacatggctcgtgcataagcagtggtttctggatcttccgctgccttggaccacgggggccgacacctctgaagttcactggaattacaaagagagaatggtgacattcaaggtcccccatgctaaacgccaggatgtgaccgttctcggctcccaggaaggagccatgcacagcgccctggctggcgcgacagaggtggactccggggatggaaaccacatgtttgccggccatcttaagtgtaaggtccggatggaaaaactgagaatcaaggggatgtcttataccatgtgcagcggaaaattctccattgacaaggagatggctgagacgcaacacggcacaaccgtggtgaaagttaagtacgaaggggccggcgccccttgtaaggtccccatcgagattcgcgatgtgaataaagaaaaggtggtcggacgggtgatcagcgctacacccctcgccgagaacaccaactctgttaccaatatcgagctggaacctccgttcggcgactcctatattgtgatcggggtcggaaacagcgcgctgacactccattggtttagaaaaggctctagcattgggaagatgttcgagtccacgtaccgcggagctaaacggatggccatcctgggcgaaaccgcctgggattttgggtctgtgggcggacttttcacaagcctgggcaaggctgttcaccaggtgtttgggtccgtctataccacaatgttcggaggcgtgagctggatgattagaatcctcatcgggtttctggttctgtggattggaaccaattctcgcaacacgtccatggccatgacatgcatcgctgtgggcgggattacccttttcctcggctttaccgtccaggccgacatgggatgtgtggtgagctggtctggccgggagctgaagtgcgggtccggaatcttcgtcgttgataatgtgcatacatggaccgaacaatacaaatttcagcccgagagccctgcgagactggcctccgctattctcaacgcccacaaggacggcgtgtgtgggatccgctctacaacgcggctggagaatgtcatgtggaaacagattaccaacgaacttaattatgtgctgtgggagggaggccacgacctcacagttgtggctggcgatgtcaagggggtgctgaccaaaggaaagagagccctgacaccccctgcgagcgaccttaagtactcctggaaaacctggggcaaggccaaaatcttcacgcccgaagctcggaactctacctttctcatcgatgggccggacacaagcgagtgccctaatgaacgcagagcctggaactccttcgaggttgaggattacggattcggcatgtttaccacaaatatttggatgaagttccgggaagggagctctgaggtgtgtgaccatagactgatgtccgctgccatcaaagatcagaaggccgtccacgctgacatgggatattggattgaaagctctaaaaaccaaacctggcagatcgagcgcgcgtccctgattgaagtgaagacatgcctctggcccaagacccatacgctgtggagcaatggcgttcttgagtctcagatgctgatccctaaaagctacgccggccccttttcccagcacaactatcggcaagggtacgctacacagaccgtgggaccttggcacctcggcaagctggagatcgatttcggggaatgccccggaaccacagtcaccattcaggagaactgtgaccatagaggcccgagcctgcgcacgacaaccgcctctgggaaacttgtgacacagtggtgctgtagatcctgcaccatgcctcccctccggtttctgggagaagatggctgttggtatggcatggagatccgccccctgagcgagaaggaagagaatatggtgaaatcccaagtcacagccgggcagggaacctctgaaacgttcagcatgggcctcctgtgccttaccctgtttgttgaggaatgtctcagacggcgcgtgacaagaaagcacatgattctggctgtggtcatcaccctgtgcgccattatccttgggggactcacatggatggacctgctgcgggcgctcatcatgctgggcgataccatgtccgggcgcattggaggccagacgcatcttgctatcattgccgtgttcaagatgtctcctggctacgttctgggggtgtttctcagaaaactgacaagccgggagaccgccctgatggtcatcggaatggctatgacaaccaccctttccattccgcacgacctgatggagctcatcgacggcatctctctggggctcattctgcttaagatcgtgacacagttcgataacacgcaagttggaaccctggccctcagcctgacatttattcgctccaccatgagcctggtgatggcgtggagaacaatcatggctgtccttttcgtggtcaccctgattcccctctgtcggacgtcttgcctgcagaaacagtcccattgggtggaaatcacagccctcattctgggcgcccaagctcttcctgtttatctgatgaccctcatgaagggggccagcagacgctcttggcccctgaatgagggaatcatggctgtgggcctggtctcccttctgggcagcgccctcctgaaaaacgacgtgcctctcgcggggcccatggttgccggaggcctgcttctggctgcctacgtgatgtctgggtccagcgctgatctgtccctcgaaaaggccgccaatgtccagtgggacgagatggctgatatcaccggaagctctcctattatcgaagtgaagcaggacgaggatggcagcttttccattcgggacgtggaggaaacaaacatgatcaccctgcttgttaaactggcgctcattacagtctctgggctgtaccccctcgccatcccgatcacgatgaccctgtggtatatgtggcaggtgaagacacaaagaagcggagctctttgggatgtgccttcccccgccgccacccagaaagctgccctgtctgagggcgtctaccgcattatgcagcggggcctgttcgggaagacacaggtgggagttggcatccacatggaaggggtgttccacaccatgtggcatgtcacgagaggaagcgtgatttgtcacgagaccggccgcctcgaaccttcctgggcggacgttcggaatgatatgatctcttatgggggaggctggagactgggcgacaaatgggataaggaggaggacgtgcaagtccttgctattgaacccgggaagaacccgaaacatgtgcagacaaagcctggactgtttaaaaccctcacaggcgagatcggggccgttaccctggacttcaagcccggaacaagcggctcccctatcattaatcgcaaagggaaggtgatcggcctctacggaaacggcgtcgtgacgaaaagcggggattatgtgtctgccattacccaggctgaacggatcggagagcccgactacgaggtcgatgaagacatttttagaaagaagcggctgacaatcatggatcttcaccccggcgccgggaaaaccaagcgcattctgccttccatcgttagagaggcgctgaaacggcgcctcagaaccctgatccttgctccgacacgggtggtggccgccgaaatggaggaagctctgagaggactccccattcgctatcagacgcctgccgtcaagagcgagcataccggccgggagatcgtggacctgatgtgccacgctacattcaccacaagactcctgtcttccacccgcgttcccaattacaaccttattgtgatggatgaagcccactttacggaccctagctccgtcgcggcccgggggtacatctctacaagagtggagatgggcgaagctgccgctattttcatgaccgccaccccccctggagccacagatccgtttccccaaagcaattcccctatcgaggacatcgaacgcgagattcccgagcggagctggaacaccggcttcgattggatcacagactatcaggggaaaaccgtttggtttgtgccttctattaaggctggaaatgacatcgcgaactgcctgagaaagtccggcaaaaaggtcattcagctgagccgcaaaacgttcgatacagaataccccaagaccaaactcacagactgggattttgtggtcaccacggacatctctgagatgggggccaacttcagagctggacgggtgatcgatccgcgcagatgtctgaagcctgttattcttaccgacggccccgaacgggtgatcctggccgggcccattcctgtgacacccgccagcgctgcccaacgcagaggccggatcggaagaaatcctgcgcaggaggatgaccagtatgtcttctccggcgatccgctcaagaacgacgaagatcatgctcactggaccgaggccaaaatgctgctggacaatatttacacacccgaggggatcattcctaccctctttggacccgaacgcgagaagacacaggccatcgatggcgaattccggcttagaggggagcaacgcaaaacctttgttgagctgatgcggagaggagacctgcctgtgtggctctcttataaggtggctagcgccggcatctcctacaaagaccgggaatggtgcttcacgggcgagcgcaacaatcagattctggaagagaacatggaagtcgagatctggacaagagagggggaaaagaagaaacttcggcccaagtggctggatgcgcgcgtgtatgccgacccgatggctctcaaagattttaaggagttcgcctctggaagaaaaagcattaccctggacatcctgaccgaaattgcttccctccctacataccttagctctcgggccaagctggctctggataatatcgttatgctccataccacagagcgcggcgggagagcctaccagcacgcgctgaacgaacttcccgagtccctggagacgctcatgctggtggccctgctcggagctatgaccgccggcatctttcttttctttatgcaggggaagggaattggcaaactgagcatgggcctgatcacaattgctgtcgcctccgggctcctgtgggtggccgaaatccaacctcagtggattgctgcgtctatcatccttgagttctttctgatggtcctcctgattcccgaacctgagaagcagcggaccccccaggacaatcaactgatctatgtgattctcacaatccttaccattatcggactgattgccgctaacgaaatgggcctgatcgagaaaacgaagaccgatttcgggttttaccaggttaaaacagagaccacaatcctcgacgtggatctgcgcccggccagcgcctggaccctttatgctgtcgccacgacaattctgacccctatgctcagacacacaatcgaaaatacctccgcgaacctgtctctggccgctattgccaatcaggctgccgtgctcatgggacttggcaaggggtggcccctgcatcggatggacctgggagttcccctcctggcgatgggctgttacagccaggtgaaccctaccacacttacggcctccctggtcatgctcctggtgcactatgctatcattggcccggggctgcaagccaaagctaccagagaggcccagaagcgcacagctgccggaatcatgaagaatcccaccgtggatggcatcacagttattgacctcgaacctatcagctacgatcccaaattcgagaagcagcttgggcaagtcatgctgctggtgctctgcgcgggacagctgcttctgatgcggaccacgtgggccttctgtgaggtgctcacactggctaccggccctattctgaccctctgggaagggaaccccggaagattttggaacacaaccatcgccgtctctacagctaatattttccgcggctcctatcttgccggcgccgggctggcgtttagcctgatcaaaaacgctcagacgcctcggagaggaaccggcacagccggggagaccctcggagaaaagtggaaacgccagctgaattctcttgaccggaaggagttcgaagagtacaagagatccggcatcctggaggttgaccgcacagaagctaaaagcgccctcaaggatgggtctaaaattaagcatgccgtgagccggggatcctctaaaatcagatggattgtggagcgcggcatggtcaagccgaagggcaaagtggttgacctggggtgcggacggggcgggtggagctactatatggctaccctgaagaacgtgacggaagtcaaaggatacaccaagggcgggcccggacacgaggaacctatccccatggccacatatggctggaatctcgtgaaacttcattccggcgttgatgtgttttacaagcctaccgagcaagtcgacacactgctgtgtgatattggggagagctcctctaaccccaccatcgaagagggaagaacactccgcgtgctgaagatggtggaaccgtggcttagctccaaacctgagttctgcattaaggtcctgaatccctatatgcccaccgttatcgaagagctcgagaaactgcagagaaagcacggcgggaacctggtgcggtgtcctctctctcgcaatagcacgcacgaaatgtactgggtgtccggagcgtctggcaacatcgtcagctccgtgaatacaaccagcaaaatgcttctgaacagatttaccacacggcatagaaagcccacgtatgagaaagacgttgatctgggggccggaacccggtctgtgtccacagaaattgagaagcctgacatgaccatcattggccgcagactccagcggctgcaggaggaacacaaggagacatggcattacgatcaagaaaatccgtaccgcacctgggcttatcacggcagctacgaggccccctctacagggtccgctagctctatggtcaacggagtggttaaacttctgaccaagccttgggacgtgatccccatggtcacgcagctcgccatgaccgatacaacccctttcggccagcagagagtgtttaaagaaaaggttgacacacggaccccccaaccgaaacctgggacgcgcatggtgatgacaaccacagcgaattggctgtgggccctgctcggaaagaagaaaaaccccagactgtgcacccgggaggagttcatttccaaggtccgcagcaatgctgccatcggcgctgtgtttcaggaagagcaggggtggacgtccgccagcgaagctgtcaacgactctagattctgggagcttgtggataaagaacgggccctgcaccaagagggcaagtgtgagagctgcgtttataacatgatgggaaaacgcgaaaagaagctcggcgagtttgggagagcgaaaggatcccgggccatctggtacatgtggctgggcgctcgcttccttgaattcgaggccctggggtttctcaatgaagaccattggttcggaagagagaactcttggagcggcgtggagggggaaggcctgcaccggctgggatatattctcgaggaaatcgataagaaagacggcgatctgatgtacgctgacgataccgccgggtgggacacaagaattaccgaggatgaccttcagaatgaggaactgatcacagagcagatggcccctcatcacaagattctcgcgaaagctatctttaagctgacctatcagaacaaggtcgtgaaagtgcttcgccccacacctcggggagccgttatggatatcatttccagaaaggaccaacgcggctctgggcaggtgggaacctacggcctgaatacgttcacaaacatggaagtccagctcatccggcagatggaggccgaaggggtgattacccaagatgacatgcagaatcccaaaggcctgaaggagagagttgagaaatggctgcgcgaatgcggagtggaccggctcaagagaatggctatcagcggcgatgactgtgtcgtgaaaccgctggatgagcgctttgggacctcccttctgttcctcaacgacatgggaaaggtccggaaggatattcctcagtgggaaccctctaaaggctggaagaattggcaggaggtgcccttttgcagccatcacttccacaaaatctttatgaaggacgggagatccctggttgtgccttgtcgcaaccaagatgaacttatcggacgggccagaattagccagggcgctgggtggtctctgcgggagacagcctgcctcggcaaagcgtacgcccagatgtggtccctgatgtatttccatagacgcgacctgcggctcgctagcatggccatctgttctgctgtcccgaccgagtggtttcccacatccagaacgacctggagcattcacgcccatcaccagtggatgacaaccgaagatatgctgaaggtgtggaatcgcgtttggatcgaggacaaccctaatatgattgataagacacccgtgcactcctgggaagacatcccttaccttggaaaaagagaggacctgtggtgcggctctctcattgggctgagctcccgggcgacctgggccaagaacatccatacggctatcacccaagtccgcaatcttattggaaaagaagagtatgtggattacatgagcgtgatgaagagatattctgccccctccgagagcgaaggcgttctgtga

SEQ ID NO: 21054 - RNA, 9867 nt, synthetic construct
  misc_feature 1..9867: note = derived and/or modified CDS sequence (opt5) from DENV-4__KJ579241__SS-prME
  source 1..9867: mol_type = other RNA
agcaccatcacactgctctgcctgattcccacggtgatggccttccacctttccaccagagacggcgagcctctgatgatcgtcgctaagcatgaacgggggcgcccgctcctgtttaaaacaaccgagggaattaacaagtgtacacttatcgccatggatctgggcgaaatgtgcgaggacaccgttacatacaaatgtcccctcctggtgaataccgaacctgaggatattgactgctggtgtaacctgacgtctacctgggtgatgtatgggacatgcacccagagcggagagagacggcgcgaaaagagatccgtcgcgctcacaccccactctggcatggggctggagacccgggctgaaacgtggatgagctccgagggagcctggaaacatgcccaacgcgtggagtcttggatccttagaaatcctggcttcgctctgctcgccggctttatggcttacatgatcgggcagacaggaattcagcggaccgttttctttgtgctgatgatgcttgtcgcccccagctatggcatgcgctgtgtgggggttggaaacagagatttcgtggaaggcgtctccgggggagcgtgggtggacctggtgctcgagcacggcggctgcgtcacaaccatggcccaggggaagcctaccctggattttgaactgacaaagacgaccgctaaagaggttgccctcctgcggacatactgtatcgaagctcttattagcaatatcaccacagccacccgctgcccgacgcaaggagagccctatctgaaggaggaacaggaccagcagtacatttgtagacgggatgtggtggaccgcggctgggggaacggatgcggcctcttcgggaaaggaggcgtcgtgacatgcgcgaagttttcttgttccggcaaaatcaccgggaatctggttcaaattgagaaccttgaatataccgtggtcgtgacagttcataatggagatacccacgccgtgggcaacgacacaagcaatcacggggtcacggctaccatcacacctagatctccctccgtggaggtcaagctgcctgattacggagaactcaccctggactgcgagccccggagcggcatcgacttcaacgagatgattctgatgaagatgaaaaagaaaacatggctcgtgcataagcagtggtttctggatcttccgctgccttggaccacgggggccgacacctctgaagttcactggaattacaaagagagaatggtgacattcaagatcccccatgctaaacgccaggatgtcaccgtgctcggctcccaggaaggagccatgcacagcgccctggctggcgcgacagaggttgactccggggatggaaaccacatgtttgccggccatcttaagtgtaaggtgcggatggaaaaactgagaattaaggggatgtcttataccatgtgcagcggaaaattctccatcgacaaggagatggctgagacgcaacacggcacaaccgtcgtgaaagtgaagtacgaaggggccggcgccccttgtaaggttcccattgagatccgcgatgtcaataaagaaaaggtggtgggacgggtcatcagcgctacacccctcgccgagaacaccaactctgtgaccaatattgagctggaacctccgttcggcgactcctatatcgttattggggtgggaaacagcgcgctgacactccattggtttagaaaaggctctagcatcgggaagatgttcgagtccacgtaccgcggagctaaacggatggccattctgggcgaaaccgcctgggattttgggtctgtcggcggacttttcacaagcctgggcaaggctgtgcaccaggtttttgggtccgtgtataccacaatgttcggaggcgtcagctggatgatcagaatcctcattgggtttctggtgctgtggatcggaaccaattctcgcaacacgtccatggccatgacatgcattgctgttggcgggatcacccttttcctcggctttaccgtgcaggccgacatgggatgtgtcgtgagctggtctggccgggagctgaagtgcgggtccggaattttcgtggtcgataatgttcatacatggaccgaacaatacaaatttcagcccgagagccctgcgagactggcctccgctatcctcaacgcccacaaggacggcgtgtgtgggattcgctctacaacgcggctggagaatgtgatgtggaaacagatcaccaacgaacttaattatgtcctgtgggagggaggccacgacctcacagtggttgctggcgatgtgaagggggtcctgaccaaaggaaagagagccctgacaccccctgcgagcgaccttaagtactcctggaaaacctggggcaaggccaaaatcttcacgcccgaagctcggaactctacctttctcattgatgggccggacacaagcgagtgccctaatgaacgcagagcctggaactccttcgaggtggaggattacggattcggcatgtttaccacaaatatctggatgaagttccgggaagggagctctgaggtttgtgaccatagactgatgtccgctgccattaaagatcagaaggccgtgcacgctgacatgggatattggatcgaaagctctaaaaaccaaacctggcagattgagcgcgcgtccctgatcgaagtcaagacatgcctctggcccaagacccatacgctgtggagcaatggcgtgcttgagtctcagatgctgatccctaaaagctacgccggccccttttcccagcacaactatcggcaagggtacgctacacagaccgttggaccttggcacctcggcaagctggagattgatttcggggaatgccccggaaccacagtgaccatccaggagaactgtgaccatagaggcccgagcctgcgcacgacaaccgcctctgggaaacttgtcacacagtggtgctgtagatcctgcaccatgcctcccctccggtttctgggagaagatggctgttggtatggcatggagattcgccccctgagcgagaaggaagagaatatggtgaaatcccaagtgacagccgggcagggaacctctgaaacgttcagcatgggcctcctgtgccttaccctgtttgtcgaggaatgtctcagacggcgcgttacaagaaagcacatgatcctggctgtggtgattaccctgtgcgccatcatccttgggggactcacatggatggacctgctgcgggcgctcattatcctgggcgataccatgtccgggcgcattggaggccagacgcatcttgctatcatggccgtcttcaagatgtctcctggctacgtgctgggggtttttctcagaaaactgacaagccgggagaccgccctgatggtgattggaatggctatgacaaccaccctttccatcccgcacgacctgatggagctcatcgacggcatttctctggggctcatcctgcttaagattgtcacacagttcgataacacgcaagtgggaaccctggccctcagcctgacatttatccgctccaccatgagcctggttatggcgtggagaacaattatggctgtgcttttcgtcgtgaccctgatccccctctgtcggacgtcttgcctgcagaaacagtcccattgggtcgaaattacagccctcatcctgggcgcccaagctcttcctgtgtatctgatgaccctcatgaagggggccagcagacgctcttggcccctgaatgagggaatcatggctgttggcctggtgtcccttctgggcagcgccctcctgaaaaacgacgtccctctcgcggggcccatggtggccggaggcctgcttctggctgcctacgttatgtctgggtccagcgctgatctgtccctcgaaaaggccgccaatgtgcagtgggacgagatggctgatattaccggaagctctcctatcattgaagtcaagcaggacgaggatggcagcttttccatccgggacgtggaggaaacaaacatgattaccctgcttgtgaaactggcgctcatcacagtttctgggctgtaccccctcgccatcccgattacgatgaccctgtggtatatgtggcaggtcaagacacaaagaagcggagctctttgggatgtgccttcccccgccgccacccagaaagctgccctgtctgagggcgtgtaccgcatcatgcagcggggcctgttcgggaagacacaggtcggagtgggcattcacatggaaggggttttccacaccatgtggcatgtgacgagaggaagcgtcatctgtcacgagaccggccgcctcgaaccttcctgggcggacgtgcggaatgatatgatttcttatgggggaggctggagactgggcgacaaatgggataaggaggaggacgttcaagtgcttgctatcgaacccgggaagaacccgaaacatgtccagacaaagcctggactgtttaaaaccctcacaggcgagatcggggccgtgaccctggacttcaagcccggaacaagcggctcccctattatcaatcgcaaagggaaggttattggcctctacggaaacggcgtggtcacgaaaagcggggattatgtgtctgccatcacccaggctgaacggattggagagcccgactacgaggtggatgaagacatctttagaaagaagcggctgacaattatggatcttcaccccggcgccgggaaaaccaagcgcatcctgccttccatcgtcagagaggcgctgaaacggcgcctcagaaccctgattcttgctccgacacgggttgtggccgccgaaatggaggaagctctgagaggactccccatccgctatcagacgcctgccgtgaagagcgagcataccggccgggagattgtcgacctgatgtgccacgctacattcaccacaagactcctgtcttccacccgcgtgcccaattacaaccttatcgttatggatgaagcccactttacggaccctagctccgtggcggcccgggggtacatttctacaagagtcgagatgggcgaagctgccgctatcttcatgaccgccaccccccctggagccacagatccgtttccccaaagcaattcccctatcgaggacattgaacgcgagatccccgagcggagctggaacaccggcttcgattggattacagactatcaggggaaaaccgtgtggtttgttccttctatcaaggctggaaatgacattgcgaactgcctgagaaagtccggcaaaaaggtgatccagctgagccgcaaaacgttcgatacagaataccccaagaccaaactcacagactgggattttgtcgtgaccacggacatctctgagatgggggccaacttcagagctggacgggtcattgatccgcgcagatgtctgaagcctgtgatccttaccgacggccccgaacgggttattctggccgggcccatccctgtgacacccgccagcgctgcccaacgcagaggccggattggaagaaatcctgcgcaggaggatgaccagtatgtgttctccggcgatccgctcaagaacgacgaagatcatgctcactggaccgaggccaaaatgctgctggacaatatctacacacccgaggggattatccctaccctctttggacccgaacgcgagaagacacaggccatcgatggcgaattccggcttagaggggagcaacgcaaaacctttgtcgagctgatgcggagaggagacctgcctgtttggctctcttataaggtggctagcgccggcatttcctacaaagaccgggaatggtgcttcacgggcgagcgcaacaatcagatcctggaagagaacatggaagtggagatttggacaagagagggggaaaagaagaaacttcggcccaagtggctggatgcgcgcgtctatgccgacccgatggctctcaaagattttaaggagttcgcctctggaagaaaaagcatcaccctggacattctgaccgaaatcgcttccctccctacataccttagctctcgggccaagctggctctggataatatcgtgatgctccataccacagagcgcggcgggagagcctaccagcacgcgctgaacgaacttcccgagtccctggagacgctcatgctggttgccctgctcggagctatgaccgccggcatttttcttttctttatgcaggggaagggaatcggcaaactgagcatgggcctgattacaatcgctgtggcctccgggctcctgtgggtcgccgaaattcaacctcagtggatcgctgcgtctatcattcttgagttctttctgatggtgctcctgatccccgaacctgagaagcagcggaccccccaggacaatcaactgatttatgtcatcctcacaattcttaccatcattggactgatcgccgctaacgaaatgggcctgatcgagaaaacgaagaccgatttcgggttttaccaggtgaaaacagagaccacaattctcgacgttgatctgcgcccggccagcgcctggaccctttatgctgtggccacgacaatcctgacccctatgctcagacacacaattgaaaatacctccgcgaacctgtctctggccgctatcgccaatcaggctgccgtcctcatgggacttggcaaggggtggcccctgcatcggatggacctgggagtgcccctcctggcgatgggctgttacagccaggttaaccctaccacacttacggcctccctggtgatgctcctggtccactatgctattatcggcccggggctgcaagccaaagctaccagagaggcccagaagcgcacagctgccggaatcatgaagaatcccaccgtggatggcattacagtgatcgacctcgaacctattagctacgatcccaaattcgagaagcagcttgggcaagttatgctgctggtcctctgcgcgggacagctgcttctgatgcggaccacgtgggccttctgtgaggtgctcacactggctaccggccctatcctgaccctctgggaagggaaccccggaagattttggaacacaaccattgccgtgtctacagctaatatcttccgcggctcctatcttgccggcgccgggctggcgtttagcctgatcaaaaacgctcagacgcctcggagaggaaccggcacagccggggagaccctcggagaaaagtggaaacgccagctgaattctcttgaccggaaggagttcgaagagtacaagagatccggcattctggaggtcgaccgcacagaagctaaaagcgccctcaaggatgggtctaaaatcaagcatgccgttagccggggatcctctaaaattagatggatcgtggagcgcggcatggtgaagccgaagggcaaagtcgtggacctggggtgcggacggggcgggtggagctactatatggctaccctgaagaacgttacggaagtgaaaggatacaccaagggcgggcccggacacgaggaacctattcccatggccacatatggctggaatctcgtcaaacttcattccggcgtggatgttttttacaagcctaccgagcaagtggacacactgctgtgtgatatcggggagagctcctctaaccccaccattgaagagggaagaacaatgcgcgtcctcaagatggtggaaccgtggctgagctccaaacctgagttctgcatcaaggtgcttaatccctatatgcccaccgtcatcgaagagctggagaaactccagagaaagcacggcgggaacctggttcggtgtcctctgtctcgcaatagcacgcacgaaatgtactgggtgtccggagcgtctggcaacattgtgagctccgtcaatacaaccagcaaaatgctccttaacagatttaccacacggcatagaaagcccacgtatgagaaagacgtggatctgggggccggaacccggtctgtttccacagaaaccgagaagcctgacatgacaatcattggccgcagactgcagcggctccaggaggaacacaaggagacctggcattacgatcaagaaaatccgtaccgcacatgggcttatcacggcagctacgaggccccctctaccgggtccgctagctctatggtgaacggagtcgtgaaactgcttacgaagccttgggacgttatccccatggtgacccagctggccatgacagataccacacctttcggccagcagagagtctttaaagaaaaggtggacacccggacgccccaaccgaaacctgggacacgcatggttatgaccacaaccgcgaattggctctgggccctgctgggaaagaagaaaaaccccagactctgcacgcgggaggagttcatttccaaggtgcgcagcaatgctgccatcggcgctgtctttcaggaagagcaggggtggacctccgccagcgaagctgtgaacgactctagattctgggagctggtcgataaagaacgggcccttcaccaagagggcaagtgtgagagctgcgtgtataacatgatgggaaaacgcgaaaagaagctgggcgagtttgggagagcgaaaggatcccgggccatctggtacatgtggctcggcgctcgcttcctggaattcgaggcccttgggtttctgaatgaagaccattggttcggaagagagaactcttggagcggcgttgagggggaaggcctccaccggctgggatatattctggaggaaatcgataagaaagacggcgatctcatgtacgctgacgatacagccgggtgggacaccagaattacagaggatgacctgcagaatgaggaacttatcaccgagcagatggcccctcatcacaagattctggcgaaagctatctttaagctcacatatcagaacaaggtggtcaaagtgctgcgccccacccctcggggagccgtgatggatatcatttccagaaaggaccaacgcggctctgggcaggttggaacgtacggccttaatacattcaccaacatggaagtgcagctgatccggcagatggaggccgaaggggtcattacccaagatgacatgcagaatcccaaaggcctcaaggagagagtggagaaatggctgcgcgaatgcggagttgaccggctgaagagaatggctatcagcggcgatgactgtgtggtcaaaccgctcgatgagcgctttgggacatccctgcttttcctgaacgacatgggaaaggtgcggaaggatattcctcagtgggaaccctctaaaggctggaagaattggcaggaggtccccttttgcagccatcacttccacaaaatctttatgaaggacgggagatccctcgtggttccttgtcgcaaccaagatgaactgatcggacgggccagaattagccagggcgctgggtggtctcttcgggagaccgcctgcctgggcaaagcgtacgcccagatgtggtccctcatgtatttccatagacgcgacctgcggctggctagcatggccatctgttctgctgtgccgacagagtggtttcccacgtccagaaccacatggagcattcacgcccatcaccagtggatgaccacagaagatatgctcaaggtctggaatcgcgtgtggatcgaggacaaccctaatatgattgataagacccccgttcactcctgggaagacatcccttacctgggaaaaagagaggacctttggtgcggctctctgattgggctcagctcccgggcgacgtgggccaagaacatccataccgctatcacacaagtgcgcaatctgattggaaaagaagagtatgtcgattacatgcccgtgatgaagagatatagcgccccttctgagtccgaaggcgtgctttga

SEQ ID NO: 21055 - RNA, 9867 nt, synthetic construct
  misc_feature 1..9867: note = derived and/or modified CDS sequence (opt5) from DENV-4__KJ596672__SS-prME
  source 1..9867: mol_type = other RNA
agcaccatcacactgctctgcctgattcccacggtgatggccttccacctttccaccagagacggcgagcctctgatgatcgtcgctaagcatgaacgggggcgcccgctcctgtttaaaacaaccgagggaattaacaagtgtacacttatcgccatggatctgggcgaaatgtgcgaggacaccgttacatacaaatgtcccctcctggtgaataccgaacctgaggatattgactgctggtgtaacctgacgtctacctgggtgatgtatgggacatgcacccagagcggagagagacggcgcgaaaagagatccgtcgcgctcacaccccactctggcatggggctggagacccgggctgaaacgtggatgagctccgagggagcctggaaacatgcccaacgcgtggagtcttggatccttagaaatcctggcttcgctctgctcgccggctttatggcttacatgatcgggcagacaggaattcagcggaccgttttctttgtgctgatgatgcttgtcgcccccagctatggcatgcgctgtgtgggggttggaaacagagatttcgtggaaggcgtctccgggggagcgtgggtggacctggtgctcgagcacggcggctgcgtcacaaccatggcccaggggaagcctaccctggattttgaactgacaaagacgaccgctaaagaggttgccctcctgcggacatactgtatcgaagctcttattagcaatatcaccacagccacccgctgcccgacgcaaggagagccctatctgaaggaggaacaggaccagcagtacatttgtagacgggatgtggtggaccgcggctgggggaacggatgcggcctcttcgggaaaggaggcgtcgtgacatgcgcgaagttttcttgttccggcaaaatcaccgggaatctggttcaaattgagaaccttgaatataccgtggtcgtgacagttcataatggagatacccacgccgtgggcaacgacacaagcaatcacggggtcacggctaccatcacacctagatctccctccgtggaggtcaagctgcctgattacggagaactcaccctggactgcgagccccggagcggcatcgacttcaacgagatgattctgatgaagatgaaaaagaaaacatggctcgtgcataagcagtggtttctggatcttccgctgccttggaccacgggggccgacacctctgaagttcactggaattacaaagagagaatggtgacattcaaggtcccccatgctaaacgccaggatgtgaccgttctcggctcccaggaaggagccatgcacagcgccctggctggcgcgacagaggtggactccggggatggaaaccacatgtttgccggccatcttaagtgtaaggtccggatggaaaaactgagaatcaaggggatgtcttataccatgtgcagcggaaaattctccattgacaaggagatggctgagacgcaacacggcacaaccgtggtgaaagttaagtacgaaggggccggcgccccttgtaaggtccccatcgagattcgcgatgtgaataaagaaaaggtggtcggacgggtgatcagcgctacacccctcgccgagaacaccaactctgttaccaatatcgagctggaacctccgttcggcgactcctatattgtgatcggggtcggaaacagcgcgctgacactccattggtttagaaaaggctctagcattgggaagatgttcgagtccacgtaccgcggagctaaacggatggccatcctgggcgaaaccgcctgggattttgggtctgtgggcggacttttcacaagcctgggcaaggctgttcaccaggtgtttgggtccgtctataccacaatgttcggaggcgtgagctggatgattagaatcctcatcgggtttctggttctgtggattggaaccaattctcgcaacacgtccatggccatgacatgcatcgctgtgggcgggattacccttttcctcggctttaccgtccaggccgacatgggatgtgtggtgagctggtctggccgggagctgaagtgcgggtccggaatcttcgtcgttgataatgtgcatacatggaccgaacaatacaaatttcagcccgagagccctgcgagactggcctccgctattctcaacgcccacaaggacggcgtgtgtgggatccgctctacaacgcggctggagaatgtcatgtggaaacagattaccaacgaacttaattatgtgctgtgggagggaggccacgacctcacagttgtggctggcgatgtcaagggggtgctgaccaaaggaaagagagccctgacaccccctgcgagcgaccttaagtactcctggaaaacctggggcaaggccaaaatcttcacgcccgaagctcggaactctacctttctcatcgatgggccggacacaagcgagtgccctaatgaacgcagagcctggaactccttcgaggttgaggattacggattcggcatgtttaccacaaatatttggatgaagttccgggaagggagctctgaggtgtgtgaccatagactgatgtccgctgccatcaaagatcagaaggccgtccacgctgacatgggatattggattgaaagctctaaaaaccaaacctggcagatcgagcgcgcgtccctgattgaagtgaagacatgcctctggcccaagacccatacgctgtggagcaatggcgttcttgagtctcagatgctgatccctaaaagctacgccggccccttttcccagcacaactatcggcaagggtacgctacacagaccgtgggaccttggcacctcggcaagctggagatcgatttcggggaatgccccggaaccacagtcaccattcaggagaactgtgaccatagaggcccgagcctgcgcacgacaaccgcctctgggaaacttgtgacacagtggtgctgtagatcctgcaccatgcctcccctccggtttctgggagaagatggctgttggtatggcatggagatccgccccctgagcgagaaggaagagaatatggtgaaatcccaagtcacagccgggcagggaacctctgaaacgttcagcatgggcctcctgtgccttaccctgtttgttgaggaatgtctcagacggcgcgtgacaagaaagcacatgattctggctgtggtcatcaccctgtgcgccattatccttgggggactcacatggatggacctgctgcgggcgctcatcatgctgggcgataccatgtccgggcgcattggaggccagacgcatcttgctatcattgccgtgttcaagatgtctcctggctacgttctgggggtgtttctcagaaaactgacaagccgggagaccgccctgatggtcatcggaatggctatgacaaccaccctttccattccgcacgacctgatggagctcatcgacggcatctctctggggctcattctgcttaagatcgtgacacagttcgataacacgcaagttggaaccctggccctcagcctgacatttattcgctccaccatgagcctggtgatggcgtggagaacaatcatggctgtccttttcgtggtcaccctgattcccctctgtcggacgtcttgcctgcagaaacagtcccattgggtggaaatcacagccctcattctgggcgcccaagctcttcctgtttatctgatgaccctcatgaagggggccagcagacgctcttggcccctgaatgagggaatcatggctgtgggcctggtctcccttctgggcagcgccctcctgaaaaacgacgtgcctctcgcggggcccatggttgccggaggcctgcttctggctgcctacgtgatgtctgggtccagcgctgatctgtccctcgaaaaggccgccaatgtccagtgggacgagatggctgatatcaccggaagctctcctattatcgaagtgaagcaggacgaggatggcagcttttccattcgggacgtggaggaaacaaacatgatcaccctgcttgttaaactggcgctcattacagtctctgggctgtaccccctcgccatcccgatcacgatgaccctgtggtatatgtggcaggtgaagacacaaagaagcggagctctttgggatgtgccttcccccgccgccacccagaaagctgccctgtctgagggcgtctaccgcattatgcagcggggcctgttcgggaagacacaggtgggagttggcatccacatggaaggggtgttccacaccatgtggcatgtcacgagaggaagcgtgatttgtcacgagaccggccgcctcgaaccttcctgggcggacgttcggaatgatatgatctcttatgggggaggctggagactgggcgacaaatgggataaggaggaggacgtgcaagtccttgctattgaacccgggaagaacccgaaacatgtgcagacaaagcctggactgtttaaaaccctcacaggcgagatcggggccgttaccctggacttcaagcccggaacaagcggctcccctatcattaatcgcaaagggaaggtgatcggcctctacggaaacggcgtcgtgacgaaaagcggggattatgtgtctgccattacccaggctgaacggatcggagagcccgactacgaggtcgatgaagacatttttagaaagaagcggctgacaatcatggatcttcaccccggcgccgggaaaaccaagcgcattctgccttccatcgttagagaggcgctgaaacggcgcctcagaaccctgatccttgctccgacacgggtggtggccgccgaaatggaggaagctctgagaggactccccattcgctatcagacgcctgccgtcaagagcgagcataccggccgggagatcgtggacctgatgtgccacgctacattcaccacaagactcctgtcttccacccgcgttcccaattacaaccttattgtgatggatgaagcccactttacggaccctagctccatcgcggcccgggggtacatttctacaagagtcgagatgggcgaagctgccgctatcttcatgaccgccaccccccctggagccacagatccgtttccccaaagcaattcccctatcgaggacattgaacgcgagatccccgagcggagctggaacaccggcttcgattggattacagactatcaggggaaaaccgtgtggtttgttccttctatcaaggctggaaatgacattgcgaactgcctgagaaagtccggcaaaaaggtgatccagctgagccgcaaaacgttcgatacagaataccccaagaccaaactcacagactgggattttgtcgtgaccacggacatctctgagatgggggccaacttcagagctggacgggtcattgatccgcgcagatgtctgaagcctgtgatccttaccgacggccccgaacgggttattctggccgggcccatccctgtgacacccgccagcgctgcccaacgcagaggccggattggaagaaatcctgcgcaggaggatgaccagtatgtgttctccggcgatccgctcaagaacgacgaagatcatgctcactggaccgaggccaaaatgctgctggacaatatctacacacccgaggggattatccctaccctctttggacccgaacgcgagaagacacaggccatcgatggcgaattccggcttagaggggagcaacgcaaaacctttgtcgagctgatgcggagaggagacctgcctgtttggctctcttataaggtggctagcgccggcatttcctacaaagaccgggaatggtgcttcacgggcgagcgcaacaatcagatcctggaagagaacatggaagtggagatttggacaagagagggggaaaagaagaaacttcggcccaagtggctggatgcgcgcgtctatgccgacccgatggctctcaaagattttaaggagttcgcctctggaagaaaaagcatcaccctggacattctgaccgaaatcgcttccctccctacataccttagctctcgggccaagctggctctggataatatcgtgatgctccataccacagagcgcggcgggagagcctaccagcacgcgctgaacgaacttcccgagtccctggagacgctcatgctggttgccctgctcggagctatgaccgccggcatttttcttttctttatgcaggggaagggaatcggcaaactgagcatgggcctgattacaatcgctgtggcctccgggctcctgtgggtcgccgaaattcaacctcagtggatcgctgcgtctatcattcttgagttctttctgatggtgctcctgatccccgaacctgagaagcagcggaccccccaggacaatcaactgatttatgtcatcctcacaattcttaccatcattggactgatcgccgctaacgaaatgggcctgatcgagaaaacgaagaccgatttcgggttttaccaggtgaaaacagagaccacaattctcgacgttgatctgcgcccggccagcgcctggaccctttatgctgtggccacgacaatcctgacccctatgctcagacacacaattgaaaatacctccgcgaacctgtctctggccgctatcgccaatcaggctgccgtcctcatgggacttggcaaggggtggcccctgcatcggatggacctgggagtgcccctcctggcgatgggctgttacagccaggttaaccctaccacacttacggcctccctggtgatgctcctggtccactatgctattatcggcccggggctgcaagccaaagctaccagagaggcccagaagcgcacagctgccggaatcatgaagaatcccaccgtggatggcattacagtgatcgacctcgaacctattagctacgatcccaaattcgagaagcagcttgggcaagttatgctgctggtcctctgcgcgggacagctgcttctgatgcggaccacgtgggccttctgtgaggtgctcacactggctaccggccctatcctgaccctctgggaagggaaccccggaagattttggaacacaaccattgccgtgtctacagctaatatcttccgcggctcctatcttgccggcgccgggctggcgtttagcctgatcaaaaacgctcagacgcctcggagaggaaccggcacagccggggagaccctcggagaaaagtggaaacgccagctgaattctcttgaccggaaggagttcgaagagtacaagagatccggcattctggaggtcgaccgcacagaagctaaaagcgccctcaaggatgggtctaaaatcaagcatgccgttagccggggatcctctaaaattagatggatcgtggagcgcggcatggtgaagccgaagggcaaagtcgtggacctggggtgcggacggggcgggtggagctactatatggctaccctgaagaacgttacggaagtgaaaggatacaccaagggcgggcccggacacgaggaacctattcccatggccacatatggctggaatctcgtcaaacttcattccggcgtggatgttttttacaagcctaccgagcaagtggacacactgctgtgtgatatcggggagagctcctctaaccccaccattgaagagggaagaacactccgcgtcctgaagatggtggaaccgtggcttagctccaaacctgagttctgcatcaaggtgctgaatccctatatgcccaccgtcatcgaagagctcgagaaactgcagagaaagcacggcgggaacctggttcggtgtcctctctctcgcaatagcacgcacgaaatgtactgggtgtccggagcgtctggcaacattgtgagctccgtcaatacaaccagcaaaatgcttctgaacagatttaccacacggcatagaaagcccacgtatgagaaagacgtggatctgggggccggaacccggtctgtttccacagaaatcgagaagcctgacatgaccattatcggccgcagactccagcggctgcaggaggaacacaaggagacatggcattacgatcaagaaaatccgtaccgcacctgggcttatcacggcagctacgaggccccctctacagggtccgctagctctatggtgaacggagtcgtgaaacttctgaccaagccttgggacgttattcccatggtgacgcagctcgccatgaccgatacaacccctttcggccagcagagagtctttaaagaaaaggtggacacacggaccccccaaccgaaacctgggacgcgcatggttatgacaaccacagcgaattggctgtgggccctgctcggaaagaagaaaaaccccagactgtgcacccgggaggagttcatctccaaggtgcgcagcaatgctgccatcggcgctgtctttcaggaagagcaggggtggacgtccgccagcgaagctgtgaacgactctagattctgggagcttgtcgataaagaacgggccctgcaccaagagggcaagtgtgagagctgcgtgtataacatgatgggaaaacgcgaaaagaagctcggcgagtttgggagagcgaaaggatcccgggccatttggtacatgtggctgggcgctcgcttccttgaattcgaggccctggggtttctcaatgaagaccattggttcggaagagagaactcttggagcggcgttgagggggaaggcctgcaccggctgggatatatcctcgaggaaattgataagaaagacggcgatctgatgtacgctgacgataccgccgggtgggacacaagaatcaccgaggatgaccttcagaatgaggaactgattacagagcagatggcccctcatcacaagatcctcgcgaaagctatctttaagctgacctatcagaacaaggtggtcaaagtgcttcgccccacacctcggggagccgtgatggatattatctccagaaaggaccaacgcggctctgggcaggttggaacctacggcctgaatacgttcacaaacatggaagtgcagctcattcggcagatggaggccgaaggggtcatcacccaagatgacatgcagaatcccaaaggcctgaaggagagagtggagaaatggctgcgcgaatgcggagttgaccggctcaagagaatggctattagcggcgatgactgtgtggtcaaaccgctggatgagcgctttgggacctcccttctgttcctcaacgacatgggaaaggtgcggaaggatatccctcagtgggaaccctctaaaggctggaagaattggcaggaggtccccttttgcagccatcacttccacaaaatctttatgaaggacgggagatccctggtggttccttgtcgcaaccaagatgaacttattggacgggccagaatcagccagggcgctgggtggtctctgcgggagacagcctgcctcggcaaagcgtacgcccagatgtggtccctgatgtatttccatagacgcgacctgcggctcgctagcatggccatttgttctgctgtgccgaccgagtggtttcccacatccagaacgacctggagcatccacgcccatcaccagtggatgacaaccgaagatatgctgaaggtctggaatcgcgtgtggattgaggacaaccctaatatgatcgataagacacccgttcactcctgggaagacattccttaccttggaaaaagagaggacctgtggtgcggctctctcatcgggctgagctcccgggcgacctgggccaagaacatccatacggctattacccaagtgcgcaatcttatcggaaaagaagagtatgtcgattacatgagcgtgatgaagagatattctgccccctccgagagcgaaggcgtgctgtga

SEQ ID NO: 21056 - RNA, 9867 nt, synthetic construct
  misc_feature 1..9867: note = derived and/or modified CDS sequence (opt5) from DENV-4__KJ579242__SS-prME
  source 1..9867: mol_type = other RNA
agcaccatcacactgctctgcctgattcccacggtgatggccttccacctttccaccagagacggcgagcctctgatgatcgtcgctaagcatgaacgggggcgcccgctcctgtttaaaacaaccgagggaattaacaagtgtacacttatcgccatggatctgggcgaaatgtgcgaggacaccgttacatacaaatgtcccctcctggtgaataccgaacctgaggatattgactgctggtgtaacctgacgtctacctgggtgatgtatgggacatgcacccagagcggagagagacggcgcgaaaagagatccgtcgcgctcacaccccactctggcatggggctggagacccgggctgaaacgtggatgagctccgagggagcctggaaacatgcccaacgcgtggagtcttggatccttagaaatcctggcttcgctctgctcgccggctttatggcttacatgatcgggcagacaggaattcagcggaccgttttctttgtgctgatgatgcttgtcgcccccagctatggcatgcgctgtgtgggggttggaaacagagatttcgtggaaggcgtctccgggggagcgtgggtggacctggtgctcgagcacggcggctgcgtcacaaccatggcccaggggaagcctaccctggattttgaactgacaaagacgaccgctaaagaggttgccctcctgcggacatactgtatcgaagctcttattagcaatatcaccacagccacccgctgcccgacgcaaggagagccctatctgaaggaggaacaggaccagcagtacatttgtagacgggatgtggtggaccgcggctgggggaacggatgcggcctcttcgggaaaggaggcgtcgtgacatgcgcgaagttttcttgttccggcaaaatcaccgggaatctggttcaaattgagaaccttgaatataccgtggtcgtgacagttcataatggagatacccacgccgtgggcaacgacacaagcaatcacggggtcacggctaccatcacacctagatctccctccgtggaggtcaagctgcctgattacggagaactcaccctggactgcgagccccggagcggcatcgacttcaacgagatgattctgatgaagatgaaaaagaaaacatggctcgtgcataagcagtggtttctggatcttccgctgccttggaccacgggggccgacacctctgaagttcactggaattacaaagagagaatggtgacattcaaggtcccccatgctaaacgccaggatgtgaccgttctcggctcccaggaaggagccatgcacagcgccctggctggcgcgacagaggtggactccggggatggaaaccacatgtttgccggccatcttaagtgtaaggtccggatggaaaaactgagaatcaaggggatgtcttataccatgtgcagcggaaaattctccattgacaaggagatggctgagacgcaacacggcacaaccgtggtgaaagttaagtacgaaggggccggcgccccttgtaaggtccccatcgagattcgcgatgtgaataaagaaaaggtggtcggacgggtgatcagcgctacacccctcgccgagaacaccaactctgttaccaatatcgagctggaacctccgttcggcgactcctatattgtgatcggggtcggaaacagcgcgctgacactccattggtttagaaaaggctctagcattgggaagatgttcgagtccacgtaccgcggagctaaacggatggccatcctgggcgaaaccgcctgggattttgggtctgtgggcggacttttcacaagcctgggcaaggctgttcaccaggtgtttgggtccgtctataccacaatgttcggaggcgtgagctggatgattagaatcctcatcgggtttctggttctgtggattggaaccaattctcgcaacacgtccatggccatgacatgcatcgctgtgggcgggattacccttttcctcggctttaccgtccaggccgacatgggatgtgtggtgagctggtctggccgggagctgaagtgcgggtccggaatcttcgtcgttgataatgtgcatacatggaccgaacaatacaaatttcagcccgagagccctgcgagactggcctccgctattctcaacgcccacaaggacggcgtgtgtgggatccgctctacaacgcggctggagaatgtcatgtggaaacagattaccaacgaacttaattatgtgctgtgggagggaggccacgacctcacagttgtggctggcgatgtcaagggggtgctgaccaaaggaaagagagccctgacaccccctgcgagcgaccttaagtactcctggaaaacctggggcaaggccaaaatcttcacgcccgaagctcggaactctacctttctcatcgatgggccggacacaagcgagtgccctaatgaacgcagagcctggaactccttcgaggttgaggattacggattcggcatgtttaccacaaatatttggatgaagttccgggaagggagctctgaggtgtgtgaccatagactgatgtccgctgccatcaaagatcagaaggccgtccacgctgacatgggatattggattgaaagctctaaaaaccaaacctggcagatcgagcgcgcgtccctgattgaagtgaagacatgcctctggcccaagacccatacgctgtggagcaatggcgttcttgagtctcagatgctgatccctaaaagctacgccggccccttttcccagcacaactatcggcaagggtacgctacacagaccgtgggaccttggcacctcggcaagctggagatcgatttcggggaatgccccggaaccacagtcaccattcaggagaactgtgaccatagaggcccgagcctgcgcacgacaaccgcctctgggaaacttgtgacacagtggtgctgtagatcctgcaccatgcctcccctccggtttctgggagaagatggctgttggtatggcatggagatccgccccctgagcgagaaggaagagaatatggtgaaatcccaagtcacagccgggcagggaacctctgaaacgttcagcatgggcctcctgtgccttaccctgtttgttgaggaatgtctcagacggcgcgtgacaagaaagcacatgattctggctgtggtcatcaccctgtgcgccattatccttgggggactcacatggatggacctgctgcgggcgctcatcattctgggcgataccatgtccgggcgcatcggaggccagacgcatcttgctattatggccgtgttcaagatgtctcctggctacgttctgggggtgtttctcagaaaactgacaagccgggagaccgccctgatggtcatcggaatggctatgacaaccaccctttccattccgcacgacctgatggagctcatcgacggcatctctctggggctcattctgcttaagatcgtgacacagttcgataacacgcaagttggaaccctggccctcagcctgacatttattcgctccaccatgagcctggtgatggcgtggagaacaatcatggctgtccttttcgtggtcaccctgattcccctctgtcggacgtcttgcctgcagaaacagtcccattgggtggaaatcacagccctcattctgggcgcccaagctcttcctgtttatctgatgaccctcatgaagggggccagcagacgctcttggcccctgaatgagggaatcatggctgtgggcctggtctcccttctgggcagcgccctcctgaaaaacgacgtgcctctcgcggggcccatggttgccggaggcctgcttctggctgcctacgtgatgtctgggtccagcgctgatctgtccctcgaaaaggccgccaatgtccagtgggacgagatggctgatatcaccggaagctctcctattatcgaagtgaagcaggacgaggatggcagcttttccattcgggacgtggaggaaacaaacatgatcaccctgcttgttaaactggcgctcattacagtctctgggctgtaccccctcgccatcccgatcacgatgaccctgtggtatatgtggcaggtgaagacacaaagaagcggagctctttgggatgtgccttcccccgccgccacccagaaagctgccctgtctgagggcgtctaccgcattatgcagcggggcctgttcgggaagacacaggtgggagttggcatccacatggaaggggtgttccacaccatgtggcatgtcacgagaggaagcgtgatttgtcacgagaccggccgcctcgaaccttcctgggcggacgttcggaatgatatgatctcttatgggggaggctggagactgggcgacaaatgggataaggaggaggacgtgcaagtccttgctattgaacccgggaagaacccgaaacatgtgcagacaaagcctggactgtttaaaaccctcacaggcgagatcggggccgttaccctggacttcaagcccggaacaagcggctcccctatcattaatcgcaaagggaaggtgatcggcctctacggaaacggcgtcgtgacgaaaagcggggattatgtgtctgccattacccaggctgaacggatcggagagcccgactacgaggtcgatgaagacatttttagaaagaagcggctgacaatcatggatcttcaccccggcgccgggaaaaccaagcgcattctgccttccatcgttagagaggcgctgaaacggcgcctcagaaccctgatccttgctccgacacgggtggtggccgccgaaatggaggaagctctgagaggactccccattcgctatcagacgcctgccgtcaagagcgagcataccggccgggagatcgtggacctgatgtgccacgctacattcaccacaagactcctgtcttccacccgcgttcccaattacaaccttattgtgatggatgaagcccactttacggaccctagctccgtcgcggcccgggggtacatctctacaagagtggagatgggcgaagctgccgctattttcatgaccgccaccccccctggagccacagatccgtttccccaaagcaattcccctatcgaggacatcgaacgcgagattcccgagcggagctggaacaccggcttcgattggatcacagactatcaggggaaaaccgtttggtttgtgccttctattaaggctggaaatgacatcgcgaactgcctgagaaagtccggcaaaaaggtcattcagctgagccgcaaaacgttcgatacagaataccccaagaccaaactcacagactgggattttgtggtcaccacggacatctctgagatgggggccaacttcagagctggacgggtgatcgatccgcgcagatgtctgaagcctgttattcttaccgacggccccgaacgggtgatcctggccgggcccattcctgtgacacccgccagcgctgcccaacgcagaggccggatcggaagaaatcctgcgcaggaggatgaccagtatgtcttctccggcgatccgctcaagaacgacgaagatcatgctcactggaccgaggccaaaatgctgctggacaatatttacacacccgaggggatcattcctaccctctttggacccgaacgcgagaagacacaggccatcgatggcgaattccggcttagaggggagcaacgcaaaacctttgttgagctgatgcggagaggagacctgcctgtgtggctctcttataaggtggctagcgccggcatctcctacaaagaccgggaatggtgcttcacgggcgagcgcaacaatcagattctggaagagaacatggaagtcgagatctggacaagagagggggaaaagaagaaacttcggcccaagtggctggatgcgcgcgtgtatgccgacccgatggctctcaaagattttaaggagttcgcctctggaagaaaaagcattaccctggacatcctgaccgaaattgcttccctccctacataccttagctctcgggccaagctggctctggataatatcgttatgctccataccacagagcgcggcgggagagcctaccagcacgcgctgaacgaacttcccgagtccctggagacgctcatgctggtggccctgctcggagctatgaccgccggcatctttcttttctttatgcaggggaagggaattggcaaactgagcatgggcctgatcacaattgctgtcgcctccgggctcctgtgggtggccgaaatccaacctcagtggattgctgcgtctatcatccttgagttctttctgatggtcctcctgattcccgaacctgagaagcagcggaccccccaggacaatcaactgatctatgtgattctcacaatccttaccattatcggactgattgccgctaacgaaatgggcctgatcgagaaaacgaagaccgatttcgggttttaccaggttaaaacagagaccacaatcctcgacgtggatctgcgcccggccagcgcctggaccctttatgctgtcgccacgacaattctgacccctatgctcagacacacaatcgaaaatacctccgcgaacctgtctctggccgctattgccaatcaggctgccgtgctcatgggacttggcaaggggtggcccctgcatcggatggacctgggagttcccctcctggcgatgggctgttacagccaggtgaaccctaccacacttacggcctccctggtcatgctcctggtgcactatgctatcattggcccggggctgcaagccaaagctaccagagaggcccagaagcgcacagctgccggaatcatgaagaatcccaccgtggatggcatcacagttattgacctcgaacctatcagctacgatcccaaattcgagaagcagcttgggcaagtcatgctgctggtgctctgcgcgggacagctgcttctgatgcggaccacgtgggccttctgtgaggtgctcacactggctaccggccctattctgaccctctgggaagggaaccccggaagattttggaacacaaccatcgccgtctctacagctaatattttccgcggctcctatcttgccggcgccgggctggtttttagcctgatcaaaaacgcgcagacgcctcggagaggaaccggcacagctggggagaccctcggagaaaagtggaaacgccagctgaattctcttgaccggaaggagttcgaagagtacaagagatccggcatcctggaggtggaccgcacagaagccaaaagcgctctcaaggatgggtctaaaattaagcatgccgtgagccggggatcctctaaaatcagatggattgtcgagcgcggcatggtgaagccgaagggcaaagttgtggacctggggtgcggacggggcgggtggagctactatatggccaccctgaagaacgtcacggaagtgaaaggatacaccaagggcgggcccggacacgaggaacctatccccatggctacatatggctggaatctcgttaaacttcattccggcgtggatgtcttttacaagcctaccgagcaagtggacacactgctgtgtgatattggggagagctcctctaaccccaccatcgaagagggaagaacaatgcgcgtgctcaagatggtcgaaccgtggctgagctccaaacctgagttctgcattaaggttcttaatccctatatgcccaccgtgatcgaagagctggagaaactccagagaaagcacggcgggaacctggtgcggtgtcctctgtctcgcaatagcacgcacgaaatgtactgggtctccggagcctctggcaacatcgtgagctccgttaatacaaccagcaaaatgctccttaacagatttaccacacggcatagaaagcccacgtatgagaaagacgtggatctgggggcgggaacccggtctgtctccacagaaaccgagaagcctgacatgacaattatcggccgcagactgcagcggctccaggaggaacacaaggagacctggcattacgatcaagaaaatccgtaccgcacatgggcctatcacggcagctacgaggctccctctaccgggtccgccagctctatggtgaacggagttgtgaaactgcttacgaagccttgggacgtcattcccatggtgacccagctggctatgacagataccacacctttcggccagcagagagtttttaaagaaaaggtggacacccggacgccccaaccgaaacctgggacacgcatggtcatgaccacaaccgccaattggctctgggcgctgctgggaaagaagaaaaaccccagactctgcacgcgggaggagttcatctccaaggtgcgcagcaatgccgctattggcgccgtctttcaggaagagcaggggtggacctccgctagcgaagccgtgaacgactctagattctgggagctggttgataaagaacgggctcttcaccaagagggcaagtgtgagagctgcgtgtataacatgatgggaaaacgcgaaaagaagctgggcgagtttgggagagccaaaggatcccgggcgatctggtacatgtggctcggcgcccgcttcctggaattcgaggctcttgggtttctgaatgaagaccattggttcggaagagagaactcttggagcggcgtcgagggggaaggcctccaccggctgggatatatcctggaggaaattgataagaaagacggcgatctcatgtacgccgacgatacagctgggtgggacaccagaatcacagaggatgacctgcagaatgaggaacttattaccgagcagatggcccctcatcacaagatcctggccaaagcgatttttaagctcacatatcagaacaaggtggtgaaagttctgcgccccacccctcggggagctgtgatggatatcatctccagaaaggaccaacgcggctctgggcaggtcggaacgtacggccttaatacattcaccaacatggaagtgcagctgattcggcagatggaggccgaaggggttatcacccaagatgacatgcagaatcccaaaggcctcaaggagagagtggagaaatggctgcgcgaatgcggagtcgaccggctgaagagaatggccattagcggcgatgactgtgtggtcaaaccgctcgatgagcgctttgggacatccctgcttttcctgaacgacatgggaaaggtgcggaaggatatccctcagtgggaaccctctaaaggctggaagaattggcaggaggttcccttttgcagccatcacttccacaaaatttttatgaaggacgggagatccctcgtggtcccttgtcgcaaccaagatgaactgatcggacgggctagaatcagccagggcgccgggtggtctcttcgggagaccgcttgcctgggcaaagcctacgcgcagatgtggtccctcatgtatttccatagacgcgacctgcggctggccagcatggctatttgttctgccgtgccgacagagtggtttcccacgtccagaaccacatggagcatccacgctcatcaccagtggatgaccacagaagatatgctcaaggtttggaatcgcgtgtggattgaggacaaccctaatatgatcgataagacccccgtccactcctgggaagacattccttacctgggaaaaagagaggacctttggtgcggctctctgatcgggctcagctcccgggccacgtgggcgaagaacattcataccgccatcacacaagtgcgcaatctgatcggaaaagaagagtatgtggattacatgcccgttatgaagagatatagcgctccttctgagtccgaaggcgtcctttga

SEQ ID NO: 21057 - RNA, 9867 nt, synthetic construct
  misc_feature 1..9867: note = derived and/or modified CDS sequence (opt5) from DENV-4__GQ398256__SS-prME
  source 1..9867: mol_type = other RNA
agcaccatgacactgctgtgcctgatccccacggtgatggccttccacctttccacccgggacggagaacctctgatgattgttgctaagcatgaacgggggagaccgctcctgtttaaaacaaccgaaggaatcaacaagtgtacacttattgccatggatctgggcgaaatgtgcgaagacaccgttacatacaaatgtcccctcctggtgaataccgaacctgaagatatcgactgctggtgtaacctgacgtctacctgggtgatgtatgggacatgcacccagaatggagagagacggcgcgaaaagagaagcgtggccctcacaccccactccggcatggggctggagacccgggctgaaacgtggatgtctagcgagggagcctggaaacatgcccagcgcgtggagtcctggattcttagaaaccctggcttcgctctgctcgccggctttatggcttacatgatcgggcagacaggaatccagcggaccgttttctttgtgctgatgatgcttgtcgccccctcttatggcatgcgctgtgtgggggttggaaatagagatttcgtggaaggcgtcagcgggggagcgtgggtggacctggtgctcgagcacggcggctgcgtcacaaccatggcccaggggaagcctaccctggattttgaactgacaaagacgaccgctaaagaggttgccctcctgcggacatactgtattgaggcttccatcagcaacattaccacagccacccgctgcccgacgcaaggagagccctatcttaaggaggaacaggaccagcagtacatctgtagacgggatgtggtggaccgcggctgggggaatggatgcggcctgttcgggaaaggaggcgtcgtgacatgcgcgaagtttctctgttctggcaaaattaccgggaacctggttcaaatcgagaatcttgaatataccgtggccgtcacagtgcataacggagatacccacgctgttggcaatgacacatccagccacggggtgacggccaccattacacctagatctccctccgtcgaggtgaagctgcctgattacggagaactcaccctggactgcgagccccggagcggcatcgacttcaacgagatgatcctgatgaagatgaaaaagaaaacatggctcgtccataagcagtggtttctggatcttccgctgccttggaccgctggggccgacacgtctgaagtgcactggaatcataaagagagaatggttaccttcaaggtgccccacgccaaacgccaggatgtcacagtgctcggctcccaggaaggagctatgcacagcgcgctggccggcgctaccgaggttgactccggggatggaaaccatatgtttgccggccaccttaagtgtaaggtgcggatggaaaaactgagaattaaggggatgtcttacacaatgtgcagcggaaaattctccatcgacaaggagatggccgagacccaacatggcacgacagtcgtgaaagtgaagtatgaaggggctggcgccccttgtaaggttcccattgagatccgcgatgtcaataaagaaaaggtggtgggacggattatcagctctacccccttcgcggagaacacaaactccgtcaccaatatcgagctcgaacctccgtttggcgacagctacattgtgatcggggttggagagtctgctctgaccctgcactggttcagaaaaggcagctccattgggaagatgtttgaatctacatatcgcggagccaaacggatggccatcctcggcgagacggcttgggatttcgggagcgtgggcggactgtttacctcccttggcaaggccgtccatcaggtgttcgggagcgtttacacaaccatgtttggaggcgtgtcttggatggtccgcattctgatcgggttcctcgtgctgtggatcggaacaaactcccgcaataccagcatggctatgacgtgcattgccgttggcgggatcacactgtttcttggcttcaccgtgcaggcggacatgggatgtgtcgtgtcttggaacggcaaggaactcaaatgcgggtccggaatttttgtggtcgataatgttcacacctggacagagcaatataagttccagcccgagagccctgcccggctggcttccgccatcctgaacgctcacaaagacggcgtgtgtgggattagatctaccacacgcctcgaaaatgtgatgtggaagcagatcacgaacgagctgaattacgtcctttgggaaggaggccatgacctgaccgtggttgccggcgatgtgaaaggggtcctcacaaagggaaagcgggcgctgacaccccctgtgaacgacctgaaatatagctggaagacatggggcaaagccaagatttttacccccgaggctagaaattccacgttccttatcgatgggccggacacctctgaatgccctaacgagcggcgcgcctggaatttctttgaggttgaagattacggattcggcatgtttacaaccaacatctggatgaaattcagagaggggagctccgaagtgtgtgaccaccggctcatgagcgctgccattaaggatcagaaagccgtccatgctgacatgggatactggatcgagtcttccaagaatcaaacatggcagattgaaaaggcgagcctgatcgaggtgaaaacctgcctgtggcccaagacacacaccctctggtctaacggcgttctggagtcccagatgcttattcctagaagctatgccggccccttttctcagcacaactaccgccaagggtatgctacgcagacagtgggaccttggcatctgggcaaactcgaaatcgatttcggggagtgccccggaaccaccgtcgccatccgggaagactgtgatcacagaggcccgagcctgcgcacaaccacggcctccgggaagctggtgacacagtggtgctgtagaagctgcaccatgcctccccttcggtttctcggagaggacggctgttggtacggcatggagattcgccccctgtctgaaaaagaggaaaatatggtgaagtcccaggtcacagctgggcaaggaaccagcgagacattctccatgggcctgctctgcctgaccctttttgttgaagagtgtctgagacggcgcgtgacgagaaagcatatgatcctcgtggtcgtgattaccttctgcgccatcattctcgggggactgacatggatggatcttctccgggcgctgatcatgctgggcgacaccatgtctgggcgcatcggaggccagattcacctcgctatcatggccgtttttaaaatgagccctggctatgtgctgggggtcttccttagaaagctgacatcccgggagaccgccctcatggtgattggaatggctatgacgacagtcttttctatcccgcatgacctgatggaactgattgatggcatcagccttgggctgatcctcctgaaaattgtgacccacttcgacaacacacaggtcggaaccctcgccctgtcccttaccttcctgcgctctacaatccccctcgtgatggcgtggagaacgattatggctgtctttttcgtggttaccctgatccctctgtgtcggacaagctgccttcagaagcaatcccactgggtggagattaccgccctgatcctcggcgcccaggctctgcccgtctacctcatgacactgatgaaaggggccagcagacgctcttggcctcttaatgaaggaattatggctgtgggcctggtttccctcctgggcagcgccctgcttaagaacgatgtgcccctggcggggcctatggtcgccggaggcctcctgctcgctgcctatgtgatgtctgggtccagcgctgacctgtctcttgagaaggccgccaatgtgcagtgggatgaaatggctgacatcaccggatccagccccatcattgaggttaaacaagatgaggacggctcctttagcatccgggatgtcgaagagacgaacatgattacactgctggtgaagctcgcgctgatcaccgtgtctgggctttacccgctggccattcctgtcaccatggctctctggtacatctggcaagtgaaaacacagagaagcggagccctgtgggacgttccctcccctgccgctacccagaaggccacactctctgaaggcgtgtatcgcatcatgcaacggggcctgttcgggaaaacgcaggtcggagtgggcattcatatggagggggtttttcacaccatgtggcatgtgacaagaggaagcgtcatctgtcacgaaaccggccgccttgagccctcctgggcggatgtgcggaatgacatgatttcttacgggggaggctggagactgggcgataagtgggacaaggaggaagacgttcaggtgctggctatcgagccggggaaaaaccctaagcatgtccagacaaaacccggactcttcaagaccctgacgggcgaaattggggccgtgacccttgattttaaacctggaacaagcggctcccccatcatcaataagaaagggaaggtgattggcctgtatggaaacggcgtcgttaccaagtctggggactacgtgagcgccatcacacaagctgagcgcattggagagcccgattatgaagtggacgaggatatcttccggaaaaagagactcaccattatggacctgcaccctggcgccgggaaaacaaagcggatcctcccgtccattgtccgcgaagcgctgaaaagacggcttcgcacgctgatcctggctcccaccagagtggttgccgccgagatggaagaggctctccggggactgcctatcagataccagacacccgccgtcaagagcgagcacaccggccgcgaaattgtcgatcttatgtgccatgctacctttacaacgcggctgctctcttccaccagagtgcctaattataacctgatcgttatggacgaggcccacttcacagatccctgcagcgtggcggcccgcgggtacatttctacccgggtcgaaatgggcgaggctgccgctatctttatgacagccacccctccgggagccacggaccccttccctcagtccaatagccccattgaagatatcgagagagagatccctgaacgctcctggaacacaggcttcgactggattaccgactaccaggggaagaccgtgtggtttgtcccctctatcaaagctggaaatgatattgcgaactgtctcagaaagagcggcaaaagagtgatccaactgtcccgcaagacattcgacaccgagtatccgaaaacaaaacttaccgattgggactttgttgtgacgacagatattagcgaaatgggggccaacttcagagctggacgggtgatcgaccctcgcagatgcctgaagcccgtcatcctgaccgatggccccgagcgggttattctcgccgggcctatccccgtgacccctgcctctgctgcccagcgcagaggccggattggaagaaatccggcgcaggaagacgatcaatacgtgttttccggcgaccccctgaaaaacgatgaggaccatgctcactggacagaggccaagatgcttctggataatatctatacgcctgaagggattatccccaccctcttcggacctgagcgcgagaagacccaggccattgacggcgagtttcggctgagaggggagcagcgcaagaccttcgtcgaactgatgaaacggggagacctccccgtgtggcttagctacaaggttgcttctgccggcatcagctataaggatagagagtggtgttttacaggcgaacggaacaatcagatcctggaggaaaacatggaggtggagatttggaccaaagaaggggagaagaaaaagctgcgcccgaaatggctcgacgcgagagtctacgccgatcctatggctctgaaggacttcaaggaatttgcctccggacggaaatctatcacacttgatattctgaccgagatcgctagcctccccacgtatctgtcctctaaggccaaactggctctcgacaatattgtgatgcttcacacaaccgaaaagggcgggcgcgcctaccaacatgcgctgaacgagctgcctgagagcctcgaaaccctgatgcttgtcgccctgctcggagctatgacagccggcatcttcctgtttttcatgcaggggaaaggaatcggcaagctgtccatgggcctcattgctatcgccgtggccagcgggcttctgtgggttgctgagattcagccccagtggatcgcggcctctattatcctggagttctttctcatggtgctgcttatccctgagcccgaaaaacaaagaaccccgcaggataatcagctgatttacgtcatcctcacaattctgacgatcattggactgatcgctgccaacgagatgggcctcattgagaagaccaagacagacttcgggttttatcaggtgaaaaccgaaacaaccatccttgatgttgacctgcggcctgcctccgcttggacgctgtacgccgtggcgaccacaatcctcacccccatgctgcgccacacaattgagaataccagcgccaacctttccctggctgccatcgctaatcaagccgcggtcctcatgggactgggcaaggggtggcccctgcatagaatggatctcggagtgcctcttctggccattggctgctattctcaggtgaacccgacgacactgaccgctagcctcgttatgctgcttgtccactacgccatcattggccccgggctgcaggctaaagccacacgggaagctcagaagcgcaccgccgcgggaatcatgaaaaatcctaccgtggacggcatcacagtgattgatctcgagcccatctcctatgaccctaagttcgagaagcaactggggcaggtcatgctgctcgttctttgtgtgggacagctgctgctcatgagaacgacctgggccctgtgcgaagtgcttacactggctaccggccccgccatgacactctgggaggggaaccctggacggttttggaacaccacgattgctgtctctacagccaatatcttcagaggcagctacctggccggcgcggggctggctttttccctcattaaaaacgcccaaaccccgcgccggggaaccggcacaaccggggaaacacttggagagaagtggaaaagacagctgaatagcctggaccgcaaggagttcgaggagtataaacggtctggcatcctcgaagtggatagaacggaggctaagtccgccctgaaggacgggagcaaaatcaagcatgccgtttctcgcggatccagcaaaattcggtggatcgtggaaagaggcatggtcaagcccaaaggcaaggtggttgatcttgggtgtggacgcggcgggtggtcttactacatggctaccctgaagaacgtgacagaggtcaaaggatataccaagggcgggcctggacacgaagaacccattcctatggccacatacggctggaatctcgtgaaactgcacagcggcgtggacgtcttttataagcccaccgagcaggttgatacgctgctctgcgacatcggggaatcctctagcaacccgaccattgaggaaggacggacacttagagtgctgaaaatggtggagccttggctgtccagcaagcccgagttctgtatcaaagtcctcaatccctacatgcctaccgtgattgaggagctggaaaaacttcagcgccggtatggcgggtccctggttagatgccccctctctcgcaacagcacacatgagatgtactgggtgtccggagcgtctggcaatatcgtcagctccgtgaacaccatctctaagatgctgctgaatagatttacaacccggcaccgcaaacctacgtatgaaaaggatgttgacctcggggccggaacaagaagcgtgtccaccgagaccgagaaaccggatatgacagtcattggccggagacttcaacggctgcaggaagaacataaggaaacgtggcactacgaccaggagaacccctaccgcacctgggcttatcacggcagctacgaagccccttctacagggtccgctagctctatggtgaatggaatcgttaaactgctcaccaagccctgggatgtgattcctatggtcacacagctggccatgaccgacacaacccccttcggccaacagagagtgtttaaggagaaagtcgacacgcggaccccgcagcctaagcccgggacacgcatgatcatgaccacaaccgcgaactggctttgggccctgctcggcaagaagaaatcccctagactgtgtacgcgggaggagttcattagcaaggtgcgctctaatgctgccatcggcgctgttttccaggaggaacaagggtggacatccgccagcgaggctgtgaacgattccagattttgggaactggtcaataaggagcgggccctccatcaggagggcaaatgcgaaagctgcgtgtataacatgatgggaaagcgcgagaaaaagctgggcgagttcgggagagcgaaaggatctcgggccatctggtacatgtggcttggcgctcgctttctggagttcgaagccctcgggtttctgaacgaggaccactggttcagcagagaaaattcctggtctggagtggaaggcgaggggcttcatcggctgggctatattctcgaagatatcgacaagcaggatggagacctgatttacgctgatgacaccgccggctgggatacacgcatcaccgaggacgatctgctcaacgaggaactgattacggagcaaatggcgccccaccataagacccttgcgaaagctatctttaagctgacatatcagaataaagttgtgaaggtcctcagacctacccccaaaggggccgtgatggacatcattagccggaaggatcagagaggatccggccaggttgggacatacggactgaacaccttcacaaatatggaagtgcaacttatccgccagatggaggccgaaggcgtcattacccaggacgacatgcagaacccgaaagggctgaaggagcgggtggagaagtggctcacggaatgtggcgtcgatagactgaaacgcatggctatctctggagacgattgcgtggttaagcctctggacgagcggtttagcgcctccctcctgttccttaatgatatgggcaaagtgagaaaggacattccccaatgggaaccctctaaagggtggaagaactggcaggaggtccctttttgtagccaccacttccataagatctttatgaaagatggacgctccctggtggttccgtgccggaatcaggacgaactcatcggcagagctcgcattagccagggggccggatggtctctgcgggagacagcgtgtcttggcaaggcctacgctcaaatgtggtccctgatgtatttccacagacgcgatctccggctggccagcatggctatctgctctgccgtgcccaccgagtggttccctacctccagaacaacctggagcattcatgcgcaccaccagtggatgacaacggaagacatgctgaaagtctggaaccgggtgtggatcgaggataatcccaacatgaccgacaagacacctgtgcattcctgggaagacattccctacctcgggaaaagagaggatctgtggtgtggctctcttatcggactgagctcccgcgccacctgggctaagaatattcacacagccatcacccaggttcggaacctcatcggcaaggaagagtatgtcgactacatgcctgtgatgaaaagatatagcgctccctctgagtccgaaggggtgctgtga

SEQ ID NO: 21058 - RNA, 9867 nt, synthetic construct
  misc_feature 1..9867: note = derived and/or modified CDS sequence (opt5) from DENV-4__KC333651__SS-prME
  source 1..9867: mol_type = other RNA
agcaccatgacactgctgtgcctgatccccacggtgatggccttccacctttccaccagagacggagaacctctgatgattgtcgctaagcatgaacgggggcgcccgctcctgtttaaaacaaccgaaggaatcaacaagtgtacacttattgccatggatctgggcgaaatgtgcgaagacaccgttacatacaaatgtcccctcctggtgaataccgaacctgaggatatcgactgctggtgtaacctgacgtctacctgggtgatgtatgggacatgcacccagaatggagagagacggcgcgaaaagagaagcgtcgccctcacaccccactccggcatggggctggagacccgggctgaaacgtggatgtctagcgagggagcctggaaacatgcccaacgcgtggagtcctggattcttagaaaccctggcttcgctctgctcgccggctttatggcttacatgatcgggcagacaggaatccagcggattgttttctttgtgctgatgatgcttgtcgccccctcttatggcatgcgctgtgtgggggttggaaatagagatttcgtggaaggcgtcagcgggggagcgtgggtggacctggtgctcgagcacggcggctgcgtcaccacaatggcccaggggaagcctaccctggattttgaactgaccaagacaacggctaaagaggttgccctcctgcggacctactgtatcgaggcttccattagcaacatcacaaccgccacacgctgcccgacccaaggagagccctatcttaaggaggaacaggaccagcagtacatttgtagacgggatgtggtggaccgcggctgggggaatggatgcggcctgttcgggaaaggaggcgtcgtgacgtgcgcgaagtttctctgttctggcaaaatcacagggaacctggttcaaattgagaatcttgaatataccgtggtcgtgaccgttcataacggagatacacacgccgtgggcaatgacacctccaaccacggggtcacagctacgatcacccctagaagcccctctgtggaggtcaagctgcctgattacggagaactcacactggactgcgagccccggtccggcatcgacttcaatgagatgattctgatgaagatgaaaaagaaaacctggctcgtgcataagcagtggtttctggatcttccgctgccttggacagccggggctgacaccagcgaagttcactggaaccataaagagagaatggtgacgttcaaggtcccccacgccaaacgccaggatgtgaccgttctcggctctcaggaaggagccatgcactccgctctggcgggcgccacagaggtggacagcggggatggaaatcatatgtttgctggccaccttaagtgtaaggtccggatggaaaaactgagaatcaaggggatgtcctacaccatgtgctctggaaaattcagcattgacaaggagatggccgagacacaacatggcaccacggtggtgaaagttaagtatgaaggggccggcgctccttgtaaggtccccatcgagattcgcgatgtgaacaaagaaaaggtggtcggacggatcatctccagcacacccttcgccgagaacaccaattctgtgacaaacattgagctcgaacctccgtttggcgactcctacatcgttattggggtgggagagagcgcgctgaccctgcactggttcagaaaaggctctagcatcgggaagatgtttgaatccacctatcgcggagctaaacggatggccattctcggcgagacagcctgggatttcgggtctgtcggcggactgtttacgagccttggcaaggctgtgcatcaggttttcgggtccgtgtacaccacaatgtttggaggcgtcagctggatggtgagaatcctgatcgggttcctcgttctgtggattggaaccaattctcgcaacacatccatggccatgacctgcatcgctgtgggcgggattacgctgtttcttggcttcacagtccaggccgacatgggatgtgtggtgagctggaatggcaaggaactcaaatgcgggtctggaatctttgtcgttgataacgtgcacacctggaccgagcaatataagttccagcccgagtcccctgcgcggctggccagcgctattctgaatgcccacaaagacggcgtgtgtgggatcagatccacaacccgcctcgaaaacgtcatgtggaagcagattacaaatgagctgaactacgtgctttgggaaggaggccatgacctgacggttgtggctggcgatgtcaaaggggtgctcaccaagggaaagcgggccctgacaccccctgttaatgacctgaaatattcttggaagacctggggcaaagcgaagatctttacacccgaggccagaaacagcaccttccttatcgatgggccggacacgtccgaatgccctaatgagcggcgcgcttggaacttctttgaggtggaagattacggattcggcatgtttaccacaaatatttggatgaaattcagagaggggtctagcgaagtctgtgaccaccggctcatgtccgccgctatcaaggatcagaaagccgtgcatgccgacatgggatactggattgagagctctaagaaccaaacctggcagatcgaaaaggcttccctgattgaggttaaaacatgcctgtggcccaagacccacacactctggagcaacggcgtgctggagtctcagatgcttatccctagatcctatgcgggcccctttagccagcacaattaccgccaagggtatgccacccagacggtcggaccttggcatctgggcaaactcgaaatcgatttcggggagtgccccggaacaaccgtggctattcgggaagactgtgatcacagaggcccgtctctgcgcaccacaaccgccagcgggaagctggtgacgcagtggtgctgtagatcctgcacaatgcctccccttcggtttctcggagaggacggctgttggtacggcatggagatccgccccctgagcgaaaaagaggaaaacatggtcaagtctcaggttaccgccgggcaaggaacatccgagaccttcagcatgggcctgctctgcctgacactttttgtggaagagtgtctgagacggcgcgtgaccagaaagcatatgattctcgtcgtggttatcacgttctgcgctattatcctcgggggactgacctggatggatcttctccgggccctgatcatgctgggcgacacaatgtccgggcgcattggaggccagatccacctcgcgattatggctgtgtttaaaatgtctcctggctatgtcctgggggtgttccttagaaagctgaccagccgggagacagccctcatggttatcggaatggccatgaccacggtgttttccattccgcatgacctgatggaactgatcgatggcatctctcttgggctgattctcctgaaaatcgtcacacacttcgacaatacccaggtgggaacactcgctctgagccttaccttcctgcgctccaccattcccctcgtcatggcctggagaacaatcatggcggtgtttttcgttgtgacgctgattcctctgtgtcggacctcttgccttcagaagcacagccattgggtcgagatcacagctctgattctcggcgcccaagccctgcccgtgtacctcatgaccctgatgaaaggggcttccagacgcagctggcctcttaacgaaggaatcatggccgttggcctggtgtctctcctgggctccgctctgcttaagaatgatgtccccctggccgggcctatggtggcgggaggcctcctgctcgccgcttatgtgatgagcgggtcttccgccgacctgcttctggagaaggctgccaacgttcagtgggatgaaatggccgacatcacaggaagctctcccattatcgaggtcaaacaggatgaggacggctcctttagcattcgggatgtggaagagaccaatatgatgacgctgctcgtgaagctggctcttatcacagtctccgggctgtacccgctcgcgattcctgtgaccatggccctgtggtacatctggcaagttaaaacccagagaagcggagctctctgggacgtgccctctcctgccgccacacagaaggctaccctgagcgaaggcgtctatcgcatcatgcagcggggccttttcgggaaaacacaagtgggagttggcattcacatggagggggtgtttcatacgatgtggcacgtcaccagaggatccgtgatctgtcatgaaacaggccgcctggagccctcttgggccgatgttcggaacgacatgattagctacgggggaggctggagactgggcgataagtgggacaaggaggaagacgtgcaggtcctcgcgatcgagccggggaaaaatcctaagcacgtgcagaccaaacccggactgttcaagacacttaccggcgaaattggggctgtgacgctggattttaaacctggaacctccggctctcccatcatcaacaagaaagggaaggtcattggcctctatggaaatggcgttgtgacaaagagcggggactacgtgtccgccatcacccaggccgagcgcattggagagcccgattatgaagtcgacgaggatatcttccggaaaaagagactgacaattatggacctccaccctggcgctgggaaaaccaagcggatcctgccgtctattgtgcgcgaagcccttaaaagacggctgcgcacactgatcctcgcgcccacgagagttgtggctgccgagatggaagaggccctgcggggacttcctatcagataccaaacccccgctgtcaagagcgagcatacaggccgcgaaattgtggatctgatgtgccacgccacctttaccacacggctcctgtccagcacgagagttcctaactataatctcatcgtgatggacgaggctcatttcaccgatccctgctctgtcgccgcgcgcgggtacatttccacacgggtggaaatgggcgaggccgctgccatctttatgaccgctacacctccgggagccaccgaccccttccctcagagcaactctcccattgaagatatcgagagagagatccctgaacgctcctggaatacgggcttcgactggattacagactaccaggggaagaccgtctggtttgtgcccagcatcaaagccggaaacgatattgctaactgtctgcggaagtccggcaaaagagttatccagctttctcgcaagaccttcgacacagagtatccgaaaaccaagctgacagattgggactttgtggtgaccacggatattagcgaaatgggggcgaatttcagagccggacgggtcatcgaccctcgcagatgcctgaagcccgttatcctcacagatggccccgagcgggtgattctggctgggcctatccccgtgacccctgcctccgccgctcaacgcagaggccggattggaagaaacccggcccaggaagacgatcagtacgtctttagcggcgacccccttaaaaatgatgaggaccacgcgcactggacagaggctaagatgctgctcgataacatctatacccctgaagggattatccccacgctgttcggacctgagcgcgagaagacccaagccattgacggcgagtttcggctgagaggggagcagcgcaagacattcgtggaactcatgaaacggggagaccttcccgtttggctgtcttacaaggtggcctccgctggcatcagctataaggatagagagtggtgttttaccggcgaacggaataaccagatcctggaggaaaatatggaggtcgagatttggacaaaagaaggggagaagaaaaagctccgcccgaaatggctggacgccagagtgtacgcggatcctatggcccttaaggacttcaaggaatttgcttctggacggaaaagcatcaccctggatattctcacagagatcgcctccctgcccacctatctgtctagcaaggctaaactcgcccttgacaacattgtcatgctgcatacgacagaaaagggcgggcgcgcttaccagcacgccctgaatgagctccctgagtccctggaaacccttatgctggtggcgctcctgggagccatgaccgctggcatcttcctgtttttcatgcaagggaaaggaatcggcaagctctctatgggccttattgccatcgctgttgccagcgggctgctgtgggtggccgagattcagccccagtggatcgctgcgtccattatcctcgagttctttctgatggtccttctgatccctgagcccgaaaaacagagaacaccgcaagataaccagctcatttacgtgatcctgaccattctgacaatcattggactcatcgccgctaatgagatgggccttattgagaagacgaagaccgacttcgggttttatcaggttaaaacagaaaccacaatcctggatgtggacctgcggcctgccagcgcctggaccctctacgctgtcgccacgaccatcctgacacccatgcttcgccataccattgagaacacatctgcgaatctgtccctcgccgctatcgccaaccaggctgccgtgctgatgggactgggcaaggggtggcccctccacagaatggatcttggagtgcctctgctggcgattggctgctatagccaagttaatccgaccacgctcacagcctccctggtcatgcttctggtgcattacgctatcattggccccgggctccaggccaaagctacccgggaagcccagaagcgcacagctgccggaatcatgaaaaaccctaccgtggacggcatcaccgtcattgatctggagcccatctcttatgaccctaagttcgagaagcagctggggcaagttatgctccttgtgctgtgtgcgggacagctgctcctgatgagaacaacgtgggccctttgcgaagtgctgaccctcgctacaggccccgccatgaccctgtgggaggggaaccctggacggttttggaatacaaccattgctgtcagcacggccaacatcttcagaggctcctacctggccggcgcggggctcgctttttctcttattaaaaatgcccagacaccgcgccggggaaccggcaccacaggggaaaccctgggagagaagtggaaaagacaactgaacagcctcgaccgcaaggagttcgaggagtataaacggtccggcatcctggaagtggatagaacagaggctaagagcgcccttaaggacgggtctaaaatcaagcacgccgtttcccgcggaagctctaaaattcggtggatcgtggaaagaggcatggtcaagcccaaaggcaaggtggttgatctggggtgtggacgcggcgggtggtcctactacatggctacgctcaagaatgtgaccgaggtcaaaggatatacaaagggcgggcctggacacgaagaacccattcctatggccacctacggctggaacctggtgaaactgcatagcggcgtggacgtcttttataagcccacagagcaggttgataccctcctttgcgacatcggggaatctagctccaatccgacgattgaggaaggacggaccctgagagtgctgaaaatggtggagccttggctctctagcaagcccgagttctgtatcaaagtcctgaacccctacatgcctacagtgattgaggagcttgaaaagctgcagcgccggtatggcgggtccctcgttagatgccccctgagccgcaattccacccacgagatgtactgggtgtctggagcgagcggcaacatcgtctcctctgtgaatacaatcagcaagatgctgctcaacagatttaccacacggcatcgcaaacctacctatgaaaaggatgttgaccttggggccggaacgagatccgtgtctacagagaccgagaaaccggatatgaccgtcattggccggagactgcagcggctgcaagaagaacacaaggaaacatggcactacgaccaggagaatccctaccgcacgtgggcttatcatggcagctacgaagccccttccaccgggagcgcttcttccatggtgaacggagttgtgaaactcctgacaaagccctgggatgtcatccctatggtgacccagcttgccatgacagacaccacacccttcggccagcaaagagtctttaaggagaaagtggacacccggacgccgcagcctaagcccgggacccgcatgattatgacaaccacagcgaattggctgtgggccctcctgggcaaaaagaaaagccctagactgtgtacccgggaggagttcatctctaaggttcgctccaacgctgccattggcgctgtgttccaggaggaacaggggtggacgagcgcctctgaggctgtcaatgattccagattttgggaactcgtggacaaggagcgggccctgcaccaagagggcaaatgcgaaagctgcgtgtataacatgatgggaaagcgcgagaagaaacttggcgagttcgggagagcgaaaggatcccgggccatctggtacatgtggctgggcgctcgctttctcgagttcgaagccctggggtttcttaacgaggatcattggttcagcagagaaaattcttggagcggagttgaaggcgaggggctgcaccggctcggctatatcctggaagacattgataaacaggagggagacctgatctacgctgatgacacagccggctgggatacccgcattacagaggacgatctcctgaacgaagaacttatcaccgaacagatggcgccccatcacaagacgctggcgaaagctatttttaagctcacctatcaaaataaagtggtcaaggtgctgagacctacacccaaaggggccgttatggacatcatctcccggaaggatcagagaggatctggccaggtggggacctacggacttaacacattcaccaatatggaggtccagctgattcgccaaatggaagccgagggcgtgatcacacaggacgacatgcagaacccgaaagggctcaaggagcgggtcgaaaagtggctgaccgagtgtggcgtggatagactgaaacgcatggctattagcggagacgattgcgttgtgaagcctctcgacgaacggttttccacgtctctgcttttcctgaatgatatgggcaaagtcagaaaggacatcccccagtgggagcccagcaaagggtggaagaactggcaagaagtgcctttttgttcccaccatttccacaagatttttatgaaagatggacgctctctcgttgtgccgtgccggaatcaggacgagctgatcggcagagcccgcatcagccagggggctggatggtcccttcgggagacagcctgtctgggcaaggcgtacgcccagatgtggagcctcatgtatttccatagacgcgatctgcggctggcttctatggccatttgctccgctgtccccaccgaatggttccctaccagcagaacaacctggtctatccacgcccaccatcaatggatgacaacggaggacatgctcaaagtgtggaaccgggtgtggattgaagataatcccaacatgaccgacaagacacctgttcactcctgggaggacatcccctacctggggaaaagagaagatctttggtgtggcagcctgattggactctcctctcgcgcgacctgggccaagaatatccatacagctattacccaggtccggaacctgatcggcaaggaggactatgtggattacatgcctgtgatgaaaagatatagcgccccctccgagagcgaaggggtcctttga

SEQ ID NO: 21059 - RNA, 9867 nt, synthetic construct
  misc_feature 1..9867: note = derived and/or modified CDS sequence (opt5) from DENV-4__JN559740__SS-prME
  source 1..9867: mol_type = other RNA
agcaccatcacactgctctgcctgattcccacggtgatggccttccacctttccaccagagacggagagcctctgatgatcgtcgctaagcatgaacgggggcgcccgctcctgtttaaaaccaccgagggaattaacaagtgtacacttatcgccatggatctgggagaaatgtgcgaggacaccgttacatacaaatgtcccctcctggtgaataccgaacctgaggatattgactgctggtgtaacctgacgtctacctgggtgatgtatgggacatgcacccagagcggagagagacggcgcgaaaagagatccgtcgcgctcacaccccactctggcatggggctggagacccgggctgaaacgtggatgagctccgagggagcctggaaacatgcccagcgcgtggagtcttggatccttagaaatcctggcttcgctctgctcgccggctttatggcttacatgatcgggcagacaggcattcagcggaccgttttctttgtgctgatgatgcttgtcgcccccagctatggcatgcgctgtgtgggggttggaaacagagatttcgtggaaggcgtctccgggggagcgtgggtggacctggtgctcgagcacggcggctgcgtcacaaccatggcccaggggaagcctaccctggattttgaactgacaaagacgaccgctaaagaggttgccctcctgcggacatactgtatcgaagctagcatttctaatatcaccacagccacccgctgcccgacgcaaggagagccctatcttaaggaggaacaggaccagcagtacatttgtagacgggatgtggtggaccgcggctgggggaacggatgcggcctgttcgggaaaggaggcgtcgtgacatgcgcgaagttttcctgtagcggcaaaatcaccgggaatctcgttcaaattgagaacctggaatataccgtggtcgtgacagttcataatggagataccagagccgtgggcaacgacatctctaatcacggggtcacagctatgatcacgcctcggtcccccagcgtggaggtcaaacttcctgattacggagaactgaccctcgactgcgagcccagatctggcattgacttcaacgagatgatcctgatgaagatgaaaaagaaaacatggctggtgcacaagcagtggtttctcgatctgccgcttccttggaccgccggggctgacacatccgaagttcattggaattacaaagagcgcatggtgaccttcaaggtcccccacgccaaacggcaggatgtgacggttctgggcagccaggaaggagccatgcattccgctctcgcgggcgccaccgaggtggactctggggatggaaaccacatgtttgctggccacctgaagtgtaaggtcagaatggaaaaacttcgcattaaggggatgagctatacaatgtgctccggaaaattcagcatcgacaaggagatggccgagacccaacatggcacaaccgtggtgaaagttaagtacgaaggggccggcgctccttgtaaggtccccattgagatccgggatgtgaataaagaaaaggtggtcggaagaatcatttcttccacgcccctggccgagaacacaaacagcgtgaccaatatcgagctcgaacctccgttcggcgactcttatattgttatcggggtgggaaacagcgcgctgacactgcactggtttcgcaaaggctcctctattgggaagatgttcgagagcacctaccggggagctaaaagaatggccatcctcggcgaaaccgcctgggattttgggtccgtcggcggactgttcacaagccttggcaaggctgtgcatcaggtttttgggtctgtgtatacgaccatgttcggaggcgtctcctggatgatccgcattctgatcgggtttctcgtgctgtggattggaacaaatagccggaacacctctatggccatgacatgcatcgctgttggcgggattaccctgttccttggctttacggtgcaggccgacatgggatgtgtcgtgtcctggagcggcaaggagctcaaatgcgggtccggaatcttcgtggtcgataatgttcacacatggaccgaacaatacaagtttcagcccgagtctcctgcgagactggccagcgctattctgaacgcccataaagacggcgtgtgtgggatccgctccaccacacggctcgagaatgtgatgtggaagcagatcaccaacgaactgaattatgtcctttgggagggaggccacgacctgacagtggttgctggcgatgtgaaaggggtcctcacgaagggaaagagagccctgacaccccctgtgtctgacctgaaatacagctggaagacatggggcaaagcgaagattttcacccccgaagcccggaactccacatttcttatcgatgggccggacaccagcgagtgccctaatgaacgcagagcttggaactctctcgaggttgaggattacggattcggcatgttcacgaccaatatttggatgaaatttcgggaagggtccagcgaggtgtgtgaccacagactgatgtctgccgctatcaaggatcagaaagccgtccatgccgacatgggatattggattgaatccagcaagaaccaaacatggcagatcgagaaggcttctctgatcgaagtgaaaacctgcctctggcccaagacacacaccctgtggagcaatggcgttcttgagtcccagatgctgattcctaaaagctacgcgggccccttctctcagcataactatcgccaagggtacgccacacagaccgtgggaccttggcacctcggcaagctggagatcgattttggggaatgccccggaacgacagtcaccattcaggaggactgtgatcaccggggcccgtccctgagaaccacaaccgctagcgggaaacttgtgacgcagtggtgctgtcgctcctgcacaatgcctcccctcagattcctgggagaagacggctgttggtatggcatggagatccggcccctgtctgagaaggaagagaacatggtgaaaagccaagtcaccgccgggcagggaacatccgaaaccttttctatgggcctcctgtgccttacactgttcgttgaggaatgtctccgcagacgggtgacccgcaaacatatgattctggtggtcgtgatcacgctgtgcgccatcattcttgggggactcacctggatggatctgctgagagctctcatcatgctgggcgacacaatgagcgggcggattggaggccagatccaccttgccattatggcggtttttaagatgtcccctggctacgtgctgggggtcttcctccgcaaactgacctctagagagacagctctgatggtgatcggaatggccatgaccacggttcttagcatcccgcatgacctgatggagctcattgatggcatctccctggggctcattctgcttaagatcgtgacacagtttgacaatacccaagtcggaacactggccctcagcctgaccttcattcggtctaccatgcccctggtgatggcttggcgcacaatcatggccgtcctttttgtggttacgctgattcctctctgtagaacctcctgcctgcagaaacagagccactgggtggaaatcacagcgctcatcctgggcgctcaagcccttcccgtctatctgatgaccctcatgaagggggcctctcggagatcctggcctctgaacgagggaattatggctgtgggcctggttagccttctgggctctgccctcctgaagaatgatgtgcccctcgctgggcctatggtcgccggaggcctgcttctggcggcctacgtgatgtccgggagctccgctgacctgagcctcgaaaaagccgctaacgtgcagtgggatgagatggccgacatcacaggatctagccccattatcgaagttaagcaggatgaggacggctccttctctattcgcgatgtcgaggaaaccaatatgatcacgctgcttgtgaaactggccctcatcacagtgagcgggctgtacccgctcgctattcctgtcaccatgaccctgtggtatatgtggcaagtgaagacacaacggtccggagcgctttgggacgttccctctcctgccgctacccagaaagccgccctgagcgagggcgtgtacagaatcatgcagcgcggcctgtttgggaagacacaggtcggagtgggcattcatatggaaggggttttccacacgatgtggcacgtgacccggggatccgtcatctgtcatgagacaggcagactcgaaccctcttgggctgatgtgcgcaacgacatgattagctatgggggaggctggcggctgggcgataagtgggacaaagaggaggacgttcaagtgcttgccatcgaaccggggaagaatcctaaacacgtccagaccaagcccggactgttcaaaacactcaccggcgagatcggggcggtgacgctggattttaagcctggaacctccggcagccccattatcaacagaaaagggaaggtgattggcctctacggaaatggcgtcgttacaaagtctggggactatgtgtccgctatcacccaggccgaacgcattggagagcccgattacgaggtggacgaagatatcttccggaaaaagagactgacaattatggaccttcatcctggcgccgggaaaaccaagcggatcctgccgagcatcgtccgcgaggctctgaaaagacggctccgcacactgattcttgcccccacgagagtggttgcggctgaaatggaggaagccctgcggggactccctatcagatatcagacccccgccgtgaagtctgagcacacaggccgcgagattgtcgatctgatgtgccatgctacctttaccacacggctcctgtccagcacgagagtgcctaactacaatcttatcgttatggacgaagcccacttcaccgatccctcctctgtggctgcccgcgggtacattagcacacgggtcgagatgggcgaagcggccgctatctttatgaccgccacacctccgggagctaccgaccccttccctcaatccaacagccccatcgaggatattgaaagagagatccctgagcgctcttggaatacgggctttgactggattacagactatcaggggaagaccgtgtggttcgtcccctccatcaaagccggaaacgatattgccaattgcctgagaaagagcggcaaaaaggtgatccagctgtctagaaaaacctttgacacagaatacccgaagaccaagctcacagattgggacttcgttgtgaccacggatatcagcgagatgggggctaactttcgcgcgggaagagtgattgaccctcggcgctgtctgaaacccgtcatccttacagatggccccgaaagagttattctggccgggcctatccccgtgacccctgcttccgccgcccaacggcgcggcagaattggacggaacccggctcaggaggacgatcagtatgtgttctctggcgaccccctcaagaatgatgaagaccacgcccattggacagaggcgaaaatgctgctggataacatctacacccctgaggggattatccccaccctcttcggacctgaaagagagaagacgcaggctatcgacggcgaatttcgccttagaggggaacaacggaaaacattcgtcgagctgatgcgccggggagacctgcccgtgtggctcagctataaggttgcctccgccggcatttcttacaaggatagagaatggtgctttaccggcgagcggaataaccagatcctggaagagaatatggaagtggagatttggacacgcgagggggagaagaagaaacttagaccgcggtggctggacgctcgcgtctatgccgatcctatggcgctcaaggacttcaaagagtttgccagcggaagaaagtccatcaccctggatattctgacagaaatcgctagcctccccacctacctttcttcccgggccaagctggctctggacaacatcgtgatgctccacacgacagagcgcggcgggagagcctaccagcatgctctgaatgaacttcctgagagcctggagaccctcatgctggtcgccctgctcggagcgatgaccgccggcattttcctctttttcatgcaggggaaaggaatcggcaagctgtccatgggcctgattacaatcgctgtggcctctgggctcctgtgggttgctgaaattcaaccccagtggatcgccgccagcatcattcttgagtttttcctgatggtgctcctgatccctgaacccgagaaacagcggaccccgcaggataaccaactgatttatgtcatcctcacaattcttacgatcattggactgatcgctgcgaatgaaatgggcctgatcgagaagaccaaaacagactttgggttctaccaggtgaagaccgagacaaccattctcgatgttgacctgaaacctgcctccgcttggacgctttatgccgtggccaccacaatcctgacccccatgctccgccacacaattgaaaacacctctgctaatctgagcctggccgcgatcgccaaccaggctgccgtcctcatgggacttggcaaggggtggcccctgcacagaatggatctgggagtgcctctcctggctatgggctgttactcccaggtgaatccgattacgcttacagccagcctggttatgctcctggtccattatgcgatcatcggccccgggctgcaagccaaggctacccgggaggcccagaaaagaacagctgccggaattatgaagaaccctaccgtggacggcatcaccgtgattgatctcgaacccatctcttacgaccctaaatttgagaagcagcttgggcaagtcatgctgctggttctctgcgctggacagctgcttctgatgcgcacaacgtgggccttctgtgaggtgctcaccctggcgacaggccccattctgaccctctgggaagggaatcctggacggttctggaacacaaccatcgccgtgtccacggctaacatctttagaggcagctatcttgccggcgctgggctggccttctctctgattaaaaatgtccagacaccgcgccggggaaccggcaccacaggggagaccctcggagaaaagtggaagagacagctgaactcccttgaccgcaaagagtttgaagagtacaagcggagcggcatcctggaggtggatagaacagaagccaaatctgcgctcaaggacgggagcaaaattaagcacgctgtttcccgcggatctagcaagatccggtggattgtggagagaggcatggtcaaacccaagggcaaagtggttgatctggggtgcggacgcggcgggtggtcctactatatggccacgctgaagaatgtgaccgaagtcaaaggatacacaaagggcgggcctggacatgaggaacccatccctatggctacctatggctggaacctcgtgaaacttcacagcggcgtggacgtcttctacaaacccacagagcaagttgataccctgctgtgtgacattggggagtcctctagcaatccgacgatcgaagagggacggaccctcagagtgctgaagatggtggaaccttggctttcctctaaacccgagttttgcatcaaggtcctgaacccctatatgcctacagtgattgaagaacttgagaaactgcagcgcaagcatggcgggaatctggttagatgtcccctcagccggaactccacccacgaaatgtactgggtgtctggagccagcggcaatatcgtctccagcgtgaacacaacctctaaaatgcttctgaatcgcttcacaaccagacaccggaagcctacgtatgagaaggatgttgacctgggggccggaacaagatccgtgagcaccgaaaccgagaaaccggatatgacaattatcggccggcgcctccagagactgcaggaggaacataaggagacgtggcactacgaccaagaaaacccctaccggacctgggcttatcatggctcttacgaggccccttccacagggagcgcgtcttccatggtcaatggagtggttaaacttctgaccaagccctgggatgtgattcctatggtcacacagctcgccatgaccgacacaaccccctttggccagcagcgcgtgttcaaagaaaaggtcgacacgagaaccccgcaacctaagcccgggacacggatggtgatgaccacaaccgctaactggctgtgggccctgctcggcaagaagaaaaatcctcgcctgtgcacgagagaggagtttatcagcaaggttcggtccaacgctgccatcggcgcggtgttccaggaagaacaggggtggacaagcgcctctgaagctgtcaatgatagccgcttttgggagcttgtggacaaagaaagagccctgcaccaagagggcaagtgtgagtcctgcgtgtataacatgatgggaaagcgggagaaaaagctcggcgagttcgggcgcgctaaaggatctagagccatttggtacatgtggctgggcgctcggtttcttgagttcgaggccctggggttcctcaacgaagatcactggtttggacgcgagaatagctggtccggcgttgagggggaaggcctgcatagactgggatatatcctcgaggaaattgacaagaaagatggcgacctgatgtacgcggatgacaccgccgggtgggatacacggatcaccgaggacgatcttcagaacgaggaactgattacggagcagatggctccccaccataagatcctcgccaaggctatcttcaaactgacctatcagaataaggtggtcaaagtgcttagacctacaccccgcggagccgttatggacattatctctcggaaggatcaaagaggcagcggacaggtgggaacctacggcctgaacacatttaccaatatggaagtccagctcattcgccagatggaggccgaaggggtgatcacacaagacgacatgcagaacccgaaaggcctgaaggagcgggtcgagaaatggctgaaggaatgcggagtggatagactcaagcgcatggcgatttccggcgacgattgtgttgtgaaacctctggacgagcggttcgggacctctcttctgtttctcaatgatatgggaaaggtcagaaaagacatcccccagtgggaacccagcaagggctggaaaaactggcaggaggtgcctttctgctcccaccattttcacaagatcttcatgaaggatgggcgcagcctggttgtgccgtgtcggaatcaagacgaacttattgggcgggctcgcatctctcagggcgccgggtggtccctgcgggagacggcctgcctcggcaaggcttacgcccagatgtggagcctgatgtattttcacagacgggatctgagactcgcttctatggccatttgttccgcggtccccacagagtggttccctaccagccgcaccacatggtccatccatgcccaccatcagtggatgaccacagaagacatgctgaaggtgtggaaccgggtgtggattgaggataatcccaacatgacggacaaaacccctgttcactcttgggaagacatcccctaccttggaaagagagaggatctgtggtgcggcagcctcattgggctgtccagccgcgctacatgggccaaaaatatccacaccgctatcacacaagtcagaaaccttattggaaaggaagagtatgtggactacatgcctgtgatgaagcggtattctgccccctccgagagcgaaggcgtcctgtga

SEQ ID NO: 21060 - RNA, 9867 nt, synthetic construct
  misc_feature 1..9867: note = derived and/or modified CDS sequence (opt5) from DENV-4__JN559741__SS-prME
  source 1..9867: mol_type = other RNA
agcaccatcacactgctctgcctgattcccacggtgatggccttccacctttccaccagagacggcgagcctctgatgatcgtcgctaagcatgaacgggggcgcccgctcctgtttaaaacaaccgagggaattaacaagtgtacacttatcgccatggatctgggcgaaatgtgcgaggacaccgttacatacaaatgtcccctcctggtgaataccgaacctgaggatattgactgctggtgtaacctgacgtctacctgggtgatgtatgggacatgcacccagagcggagagagacggcgcgaaaagagatccgtcgcgctcacaccccactctggcatggggctggagacccgggctgaaacgtggatgagctccgagggagcctggaaacatgcccaacgcgtggagtcttggatccttagaaatcctggcttcgctctgctcgccggctttatggcttacatgatcgggcagacaggaattcagcggaccgttttctttgtgctgatgatgcttgtcgcccccagctatggcatgcgctgtgtgggggttggaaacagagatttcgtggaaggcgtctccgggggagcgtgggtggacctggtgctcgagcacggcggctgcgtcacaaccatggcccaggggaagcctaccctggattttgaactgacaaagacgaccgctaaagaggttgccctcctgcggacatactgtatcgaagctcttattagcaatatcaccacagccacccgctgcccgacgcaaggagagccctatctgaaggaggaacaggaccagcagtacatttgtagacgggatgtggtggaccgcggctgggggaacggatgcggcctcttcgggaaaggaggcgtcgtgacatgcgcgaagttttcttgttccggcaaaatcaccgggaatctggttcaaattgagaaccttgaatataccgtggtcgtgacagttcataatggagatacccacgccgtgggcaacgacacaagcaatcacggggtcacggctaccatcacacctagatctccctccgtggaggtcaagctgcctgattacggagaactcaccctggactgcgagccccggagcggcatcgacttcaacgagatgattctgatgaagatgaaaaagaaaacatggctcgtgcataagcagtggtttctggatcttccgctgccttggaccacgggggccgacacctctgaagttcactggaattacaaagagagaatggtgacattcaaggtcccccatgctaaacgccaggatgtgaccgttctcggctcccaggaaggagccatgcacagcgccctggctggcgcgacagaggtggactccggggatggaaaccacatgtttgccggccatcttaagtgtaaggtccggatggaaaaactgagaatcaaggggatgtcttataccatgtgcagcggaaaattctccattgacaaggagatggctgagacgcaacacggcacaaccgtggtgaaagttaagtacgaaggggccggcgccccttgtaaggtccccatcgagattcgcgatgtgaataaagaaaaggtggtcggacgggtgatcagcgctacacccctcgccgagaacaccaactctgttaccaatatcgagctggaacctccgttcggcgactcctatattgtgatcggggtcggaaacagcgcgctgacactccattggtttagaaaaggctctagcattgggaagatgttcgagtccacgtaccgcggagctaaacggatggccatcctgggcgaaaccgcctgggattttgggtctgtgggcggacttttcacaagcctgggcaaggctgttcaccaggtgtttgggtccgtctataccacaatgttcggaggcgtgagctggatgattagaatcctcatcgggtttctggttctgtggattggaaccaattctcgcaacacgtccatggccatgacatgcatcgctgtgggcgggattacccttttcctcggctttaccgtccaggccgacatgggatgtgtggtgagctggtctggccgggagctgaagtgcgggtccggaatcttcgtcgttgataatgtgcatacatggaccgaacaatacaaatttcagcccgagagccctgcgagactggcctccgctattctcaacgcccacaaggacggcgtgtgtgggatccgctctacaacgcggctggagaatgtcatgtggaaacagattaccaacgaacttaattatgtgctgtgggagggaggccacgacctcacagttgtggctggcgatgtcaagggggtgctgaccaaaggaaagagagccctgacaccccctgcgagcgaccttaagtactcctggaaaacctggggcaaggccaaaatcttcacgcccgaagctcggaactctacctttctcatcgatgggccggacacaagcgagtgccctaatgaacgcagagcctggaactccttcgaggttgaggattacggattcggcatgtttaccacaaatatttggatgaagttccgggaagggagctctgaggtgtgtgaccatagactgatgtccgctgccatcaaagatcagaaggccgtccacgctgacatgggatattggattgaaagctctaaaaaccaaacctggcagatcgagcgcgcgtccctgattgaagtgaagacatgcctctggcccaagacccatacgctgtggagcaatggcgttcttgagtctcagatgctgatccctaaaagctacgccggccccttttcccagcacaactatcggcaagggtacgctacacagaccgtgggaccttggcacctcggcaagctggagatcgatttcggggaatgccccggaaccacagtcaccattcaggagaactgtgaccatagaggcccgagcctgcgcacgacaaccgcctctgggaaacttgtgacacagtggtgctgtagatcctgcaccatgcctcccctccggtttctgggagaagatggctgttggtatggcatggagatccgccccctgagcgagaaggaagagaatatggtgaaatcccaagtcacagccgggcagggaacctctgaaacgttcagcatgggcctcctgtgccttaccctgtttgttgaggaatgtctcagacggcgcgtgacaagaaagcacatgattctggctgtggtcatcaccctgtgcgccattatccttgggggactcacatggatggacctgctgcgggcgctcatcatgctgggcgataccatgtccgggcgcattggaggccagacgcatcttgctatcatggccgtgttcaagatgtctcctggctacgttctgggggtgtttctcagaaaactgacaagccgggagaccgccctgatggtcattggaatggctatgacaaccaccctttccatcccgcacgacctgatggagctcattgacggcatctctctggggctcatcctgcttaagattgtgacacagttcgataacacgcaagttggaaccctggccctcagcctgacatttatccgctccaccatgagcctggtgatggcgtggagaacaattatggctgtccttttcgtggtcaccctgatccccctctgtcggacgtcttgcctgcagaaacagtcccattgggtggaaattacagccctcatcctgggcgcccaagctcttcctgtttatctgatgaccctcatgaagggggccagcagacgctcttggcccctgaatgagggaattatggctgtgggcctggtctcccttctgggcagcgccctcctgaaaaacgacgtgcctctcgcggggcccatggttgccggaggcctgcttctggctgcctacgtgatgtctgggtccagcgctgatctgtccctcgaaaaggccgccaatgtccagtgggacgagatggctgatatcaccggaagctctcctatcattgaagtgaagcaggacgaggatggcagcttttccatccgggacgtggaggaaacaaacatgattaccctgcttgttaaactggcgctcatcacagtctctgggctgtaccccctcgccattccgatcacgatgaccctgtggtatatgtggcaggtgaagacacaaagaagcggagctctttgggatgtgccttcccccgccgccacccagaaagctgccctgtctgagggcgtctaccgcatcatgcagcggggcctgttcgggaagacacaggtgggagttggcattcacatggaaggggtgttccacaccatgtggcatgtcacgagaggaagcgtgatctgtcacgagaccggccgcctcgaaccttcctgggcggacgttcggaatgatatgatttcttatgggggaggctggagactgggcgacaaatgggataaggaggaggacgtgcaagtccttgctatcgaacccgggaagaacccgaaacatgtgcagacaaagcctggactgtttaaaaccctcacaggcgagattggggccgttaccctggacttcaagcccggaacaagcggctcccctatcatcaatcgcaaagggaaggtgattggcctctacggaaacggcgtcgtgacgaaaagcggggattatgtgtctgccatcacccaggctgaacggattggagagcccgactacgaggtcgatgaagacatctttagaaagaagcggctgacaattatggatcttcaccccggcgccgggaaaaccaagcgcatcctgccttccattgttagagaggcgctgaaacggcgcctcagaaccctgatccttgctccgacacgggtggtggccgccgaaatggaggaagctctgagaggactccccatccgctatcagacgcctgccgtcaagagcgagcataccggccgggagattgtggacctgatgtgccacgctacattcaccacaagactcctgtcttccacccgcgttcccaattacaaccttatcgtgatggatgaagcccactttacggaccctagctccgtcgcggcccgggggtacatttctacaagagtggagatgggcgaagctgccgctatcttcatgaccgccaccccccctggagccacagatccgtttccccaaagcaattcccctattgaggacatcgaacgcgagatccccgagcggagctggaacaccggcttcgattggattacagactatcaggggaaaaccgtttggtttgtgccttctatcaaggctggaaatgacattgcgaactgcctgagaaagtccggcaaaaaggtcatccagctgagccgcaaaacgttcgatacagaataccccaagaccaaactcacagactgggattttgtggtcaccacggacatttctgagatgggggccaacttcagagctggacgggtgatcgatccgcgcagatgtctgaagcctgttatccttaccgacggccccgaacgggtgattctggccgggcccatccctgtgacacccgccagcgctgcccaacgcagaggccggattggaagaaatcctgcgcaggaggatgaccagtatgtcttctccggcgatccgctcaagaacgacgaagatcatgctcactggaccgaggccaaaatgctgctggacaatatctacacacccgaggggattatccctaccctctttggacccgaacgcgagaagacacaggccattgatggcgaattccggcttagaggggagcaacgcaaaacctttgttgagctgatgcggagaggagacctgcctgtgtggctctcttataaggtggctagcgccggcatctcctacaaagaccgggaatggtgcttcacgggcgagcgcaacaatcagatcctggaagagaacatggaagtcgagatttggacaagagagggggaaaagaagaaacttcggcccaagtggctggatgcgcgcgtgtatgccgacccgatggctctcaaagattttaaggagttcgcctctggaagaaaaagcatcaccctggacattctgaccgaaatcgcttccctccctacataccttagctctcgggccaagctggctctggataatattgttatgctccataccacagagcgcggcgggagagcctaccagcacgcgctgaacgaacttcccgagtccctggagacgctcatgctggtggccctgctcggagctatgaccgccggcatctttcttttctttatgcaggggaagggaatcggcaaactgagcatgggcctgattacaatcgctgtcgcctccgggctcctgtgggtggccgaaattcaacctcagtggatcgctgcgtctattatccttgagttctttctgatggtcctcctgatccccgaacctgagaagcagcggaccccccaggacaatcaactgatttatgtgatcctcacaattcttaccatcattggactgatcgccgctaacgaaatgggcctgattgagaaaacgaagaccgatttcgggttttaccaggttaaaacagagaccacaatcctcgacgtggatctgcgcccggccagcgcctggaccctttatgctgtcgccacgacaatcctgacccctatgctcagacacacaattgaaaatacctccgcgaacctgtctctggccgctatcgccaatcaggctgccgtgctcatgggacttggcaaggggtggcccctgcatcggatggacctgggagttcccctcctggcgatgggctgttacagccaggtgaaccctaccacacttacggcctccctggtcatgctcctggtgcactatgctattatcggcccggggctgcaagccaaagctaccagagaggcccagaagcgcacagctgccggaattatgaagaatcccaccgtggatggcatcacagttatcgacctcgaacctattagctacgatcccaaattcgagaagcagcttgggcaagtcatgctgctggtgctctgcgcgggacagctgcttctgatgcggaccacgtgggccttctgtgaggtgctcacactggctaccggccctatcctgaccctctgggaagggaaccccggaagattttggaacacaaccattgccgtctctacagctaatatcttccgcggctcctatcttgccggcgccgggctggcgtttagcctgattaaaaacgctcagacgcctcggagaggaaccggcacagccggggagaccctcggagaaaagtggaaacgccagctgaattctcttgaccggaaggagttcgaagagtacaagagatccggcatcctggaggttgaccgcacagaagctaaaagcgccctcaaggatgggtctaaaatcaagcatgccgtgagccggggatcctctaaaattagatggatcgtggagcgcggcatggtcaagccgaagggcaaagtggttgacctggggtgcggacggggcgggtggagctactatatggctaccctgaagaacgtgacggaagtcaaaggatacaccaagggcgggcccggacacgaggaacctattcccatggccacatatggctggaatctcgtgaaacttcattccggcgttgatgtgttttacaagcctaccgagcaagtcgacacactgctgtgtgatatcggggagagctcctctaaccccaccattgaagagggaagaacactccgcgtgctgaagatggtggaaccgtggcttagctccaaacctgagttctgcatcaaggtcctgaatccctatatgcccaccgttattgaagagctcgagaaactgcagagaaagcacggcgggaacctggtgcggtgtcctctctctcgcaatagcacgcacgaaatgtactgggtgtccggagcgtctggcaacatcgtcagctccgtgaatacaaccagcaaaatgcttctgaacagatttaccacacggcatagaaagcccacgtatgagaaagacgttgatctgggggccggaacccggtctgtgtccacagaaaccgagaagcctgacatgacaatcattggccgcagactccagcggctgcaggaggaacacaaggagacctggcattacgatcaagaaaatccgtaccgcacatgggcttatcacggcagctacgaggccccctctaccgggtccgctagctctatggtcaacggagtggttaaacttctgacgaagccttgggacgtgatccccatggtcacccagctcgccatgacagataccacacctttcggccagcagagagtgtttaaagaaaaggttgacacccggacgccccaaccgaaacctgggacacgcatggtgatgaccacaaccgcgaattggctgtgggccctgctcggaaagaagaaaaaccccagactgtgcacgcgggaggagttcatttccaaggtccgcagcaatgctgccatcggcgctgtgtttcaggaagagcaggggtggacctccgccagcgaagctgtcaacgactctagattctgggagcttgtggataaagaacgggccctgcaccaagagggcaagtgtgagagctgcgtttataacatgatgggaaaacgcgaaaagaagctcggcgagtttgggagagcgaaaggatcccgggccatttggtacatgtggctgggcgctcgcttccttgaattcgaggccctggggtttctcaatgaagaccattggttcggaagagagaactcttggagcggcgtggagggggaaggcctgcaccggctgggatatatcctcgaggaaatcgataagaaagacggcgatctgatgtacgctgacgatacagccgggtgggacaccagaattacagaggatgaccttcagaatgaggaactgatcaccgagcagatggcccctcatcacaagattctcgcgaaagctatctttaagctgacatatcagaacaaggtcgtgaaagtgcttcgccccacccctcggggagccgttatggatattatctccagaaaggaccaacgcggctctgggcaggtgggaacgtacggcctgaatacattcaccaacatggaagtccagctcatccggcagatggaggccgaaggggtgattacccaagatgacatgcagaatcccaaaggcctgaaggagagagttgagaaatggctgcgcgaatgcggagtggaccggctcaagagaatggctatcagcggcgatgactgtgtcgtgaaaccgctggatgagcgctttgggacatcccttctgttcctcaacgacatgggaaaggtccggaaggatattcctcagtgggaaccctctaaaggctggaagaattggcaggaggtgcccttttgcagccatcacttccacaaaatctttatgaaggacgggagatccctggttgtgccttgtcgcaaccaagatgaacttattggacgggccagaatcagccagggcgctgggtggtctctgcgggagaccgcctgcctcggcaaagcgtacgcccagatgtggtccctgatgtatttccatagacgcgacctgcggctcgctagcatggccatctgttctgctgtcccgacagagtggtttcccacgtccagaaccacatggagcattcacgcccatcaccagtggatgaccacagaagatatgctgaaggtgtggaatcgcgtttggatcgaggacaaccctaatatgattgataagacccccgtgcactcctgggaagacatcccttaccttggaaaaagagaggacctgtggtgcggctctctcattgggctgagctcccgggcgacgtgggccaagaacatccataccgctattacacaagtccgcaatcttatcggaaaagaagagtatgtggattacatgcccgtgatgaagagatatagcgccccttctgagtccgaaggcgttctgtga

SEQ ID NO: 21061 - RNA, 9867 nt, synthetic construct
  misc_feature 1..9867: note = derived and/or modified CDS sequence (opt5) from DENV-4__JQ513334__SS-prME
  source 1..9867: mol_type = other RNA
agcaccatcaccctgctctgcctgattcccacggtgatggccttccacctttccacccgggacggagagcctctgatgatcgtggctaagcatgaacgggggcgcccgctcctgtttaaaaccaccgagggaattaacaagtgtacacttatcgccatggatctgggagaaatgtgcgaggacaccgttacatacaaatgtcccctcctggtgaataccgaacctgaggatattgactgctggtgtaacctgacgtctacctgggtgatgtatgggacatgcacccagagcggagagcggcggcgcgaaaagagatccgtcgcgctcacaccccactctggcatggggctggagacccgggctgaaacgtggatgagctccgagggagcctggaaacatgcccaacgcgtggagtcttggatccttagaaatcctggcttcgctctgctcgccggctttatggcttacatgatcgggcagacaggcattcagcggaccgttttctttgtgctgatgatgcttgtcgcccccagctatggcatgcgctgtgtgggggttggaaacagagatttcgtggaaggcgtctccgggggagcgtgggtggacctggtgctcgagcacggcggctgcgtcacaaccatggcccaggggaagcctaccctggattttgaactgacaaagacgaccgctatggaggttgccctcctgcggacatactgtatcgaagctagcatttctaatatcaccacagccacccgctgcccgacgcaaggagagccctatcttaaagaggaacaggaccagcagtacatttgtagacgggatgtggtggaccgcggctgggggaacggatgcggcctgttcgggaagggaggcgtcgtgacatgcgcgaaattttcctgtagcgagaagatcaccggcaatctcgttcaaattgaaaacctggagtataccgtggtcgtgacagttcataatggggatacccacgccgtgggaaacgacacatctaatcacggcgtcacggctaccatcacacctagatcccccagcgtggaagtcgagcttcctgattacggggagctgaccctcgactgcgaaccccggtctggaatcgacttcaacgagatgattctgatgaaaatgaagaagaaaacatggctggtgcataagcagtggtttctcgatctgccgcttccttgggccgctggcgccgacacctccgaagttcactggaattacaaagagagaatggtgacgttcaaggtcccccatgccaaacgccaggatgtgaccgttctggggagccaggaaggcgctatgcactccgcgctcgccggagctacagaggtggactctggcgatgggaaccacatgtttgccggacatctgaagtgtaaagtccggatggagaaacttagaatcaagggcatgagctataccatgtgctccgggaaattcagcattgacaaggaaatggccgagacacaacacggaaccacggtggtgaaagttaagtacgaaggcgctggggccccttgtaaagtccccatcgagattcgcgatgtgaataaggagaaggtggtcggccgggtgatctcttccatccccctggcggaaaacacaaacagcgttaccaatattgagctcgaacctccgttcggagactcttatatcgtgattggcgtcgggaacagcgctctgacactgcattggtttagaaaaggatcctctatcggcaagatgttcgagagcacctaccgcggggccaaacgggtggccattctcggagaaaccgcttgggattttggctccgttgggggcctgttcacaagccttggaaaggccgtgcaccaggtctttggctctgtgtatacgaccatgttcgggggagtttcctggatggtgagaatcctgatcggcctcctggtcctgtggattgggacaaatagccgcaacacctctatggctatgacatgcatcgccgtgggaggcattaccctttttctcgggttcacggtgcaggcggacatgggctgtgtcgtttcctggagcggacgggagctgaaatgcggctccgggatctttgtggtggataatgtccatacatggaccgagcaatacaagttccagcccgaatctcctgccagactggctagcgccattctcaacgctcacaaggacggagtgtgtggcatccgctccaccacacggctggagaatgttatgtggaaacagattaccaacgaacttaattatgtgctgtgggaaggcgggcacgacctcacagtcgtggccggggatgttaagggcgtgctgacgaaagggaagagagcgctgacaccccctgtctctgaccttaaatacagctggaagacatggggaaaggccaaaatctttacccccgaagctcggaactccacattcctcatcgatggcccggacaccagcgagtgccctaatgagcgcagagcctggaactctctggaagtggaggattacgggtttggaatgttcacgaccaatatttggatgaagttccgggaaggctccagcgaggtttgtgaccatagactgatgtctgctgccatcaaagatcagaaggccgtgcacgctgacatggggtattggattgaatccagcaaaaaccaaacatggcagatcgagaaggcgtctctcattgaggtcaaaacctgcctgtggcccaagacacataccctttggagcaatggagtgctggaatcccagatgctcatccctaagagctacgccggccccttttctcagcacaactatcgccaaggctacgctacacagaccgtggggccttggcacctgggaaaactggagatcgatttcggcgaatgccccgggacgacagtcaccattcaggaggactgtgatcatcggggaccgtcccttagaaccacaaccgccagcggcaagctcgttacgcagtggtgctgtcgctcctgcacaatgcctcccctgagatttctgggggaggacggatgttggtatggcatggaaatccggcccctctctgagaaagaagagaacatggtcaagagccaagtggccgctggccaggggacctccgaaacattctctatgggactgctttgcctgaccctctttgtcgaggagtgtctgcgcagacgggtgacacgcaaacacatgattctggccgttgtgatcaccctttgcgcgattatcctcggcgggctgacgtggatggatctgctcagagctctgatcatgcttggagacaccatgagcggccggattgggggacagacacatctggccatcatggccgtcttcaagatgtcccctggctacgtgctcggcgtttttctgcgcaagctgacctctagagaaacagctcttatggtgattgggatggccatgaccacgacactgagcatcccgcacgacctcatggagctgattgatggaatctccctcggcctgatccttctgaaaattgtcacccagttcgacaatacacaagtggggaccctcgcgctgagcctgacctttatccggtctacaatgtcccttgtcatggcttggcgcacgattatggccgtgctgttcgttgtgaccctcatccccctgtgtagaacaagctgcctccagaagcagtctcattgggtcgaaattaccgccctgatccttggagctcaagccctgcctgtgtatctcatgacactgatgaaaggcgcttcccggagaagctggcccctgaacgaggggattatggccgttggacttgtgtctctgctcggctccgcgctgctcaagaatgatgtccctctggccggccccatggtggctgggggacttctgctggccgcttacgtgatgagcggctccagcgccgacctctctctggaaaaagccgctaacgttcagtgggatgagatggcggacatcaccgggagctcccctatcattgaggtcaagcaggatgaagacggatcttttagcatccgcgatgtggaggaaacgaatatgattacacttctggtgaagctcgccctgatcaccgtctccggcctctaccccctggctattccggtgaccatgacactttggtatatgtggcaggttaaaacccaacggtctggggccctgtgggacgtgcctagccccgccgctacacagaaggccgcgctgtccgagggagtctacagaatcatgcagcgcggcctcttcggcaaaacacaggtgggggttggaatccacatggaaggcgtgtttcacaccatgtggcatgtcacacgggggtctgtgatttgtcacgagaccggaagactggagcctagctgggctgatgttcgcaacgacatgatctcctatggcgggggatggcggcttggcgataagtgggacaaagaagaggacgtgcaagtcctggccattgaacccggcaagaatccgaagcatgtgcagacaaaacctggactcttcaagaccctgacgggagagatcggcgccgtgaccctcgatttcaaacccgggacaagcggatctcctattatcaacagaaagggcaaagtcatcgggctgtacggcaatggagttgtgaccaagtccggcgactatgtgagcgctattacacaggccgagcgcatcggggaacccgattacgaggtcgacgaagatatttttcggaaaaagagacttaccatcatggacctgcaccccggagcgggcaagacaaaacggattctgccttctatcgtgcgcgaggctctcaagagacggctgcgcacgcttattctggccccgaccagagttgtggccgctgaaatggaggaggccctccgggggctgcccatcagatatcagacgcctgctgtcaaatccgaacataccggacgcgagatcgtggatctcatgtgccacgccaccttcacaacgcggctgcttagctccaccagagttcccaactacaatctgattgtgatggacgaagcgcactttacagatccttctagcgtcgccgctcgcggctacatctccacccgggtggagatgggggaagccgctgccattttcatgacagccacaccccctggcgctacggacccgtttccccaaagcaactctcctatcgaggatattgagagagaaatccccgagcgctcctggaatacaggattcgactggatcaccgactatcagggcaagaccgtctggtttgtgcctagcattaaagcggggaacgatatcgccaattgcctgcggaagtctggaaagaaagttattcagctcagcagaaagacattcgacaccgaataccccaaaacaaagctgaccgattgggactttgtggtgacgacagatatctccgagatgggcgctaacttccgcgccgggagagtcattgacccgcggcgctgtcttaaacctgttatcctgaccgatggacccgaaagagtgatcctcgccggccccattcctgtgacacccgcttctgccgcgcaacggcgcgggagaatcggccggaaccctgctcaggaggacgatcagtatgtctttagcggagacccgctgaagaatgatgaggaccatgcccactggaccgaagccaagatgctgctcgataacatttacacgcccgagggcatcattcctacccttttcgggcccgaaagagagaaaacacaggctatcgacggagagttccgcctgcggggcgaacaaagaaagacctttgtggagctgatgcgcagaggggacctccctgtttggctgtcctataaagtggcctctgcgggaattagctacaaggatagagaatggtgcttcacaggcgagcggaataaccagatccttgaagagaatatggaggtcgaaatctggacccgcgagggcgagaagaagaagctgagaccccggtggctcgacgcccgcgtgtatgctgatccgatggccctgaaagactttaaggagttcgcttccgggagaaaaagcattacactggatatcctcaccgaaattgcctctcttcctacgtacctgtccagccgggctaagctggccctcgacaacatcgtcatgctgcatacaaccgagcgcggaggcagagcgtaccagcacgcccttaatgagctgcccgaatccctcgagaccctgatgctggtggctctccttggggccatgacagctggaatttttctgttctttatgcagggcaaagggatcggaaagctgtctatgggcctcatcaccattgccgttgccagcggcctgctttgggtggctgaaatccaacctcagtggattgcggcctccatcattctggagttctttctcatggtcctgctgatccccgaacctgagaagcagcggacaccccaggataaccaactcatctatgtgattcttgctatcctgacgattatcgggctgattgccgccaatgagatgggactcatcgagaagaccaagacagacttcggcttttaccaggttaaaaccgagacaaccattctggatgtggaccttcgcccggcttctgcctggacgctgtatgcggtcgccaccacaatcctcacccctatgctgagacacacaatcgaaaacaccagcgctaatctgtccctcgccgctattgccaaccaggcggccgtgcttatggggctgggaaagggctggcccctgcatcggatggatctcggggtgcccctgcttgctatgggatgttacagccaggttaatcctacgacactgaccgcctctctcgtcatgctgctggtgcactatgctatcattggcccgggcctccaagccaaagctacaagagaggcccagaagcgcaccgcggccgggatcatgaaaaaccccaccgtggacggaattacagtcatcgatcttgagcctatctcctacgaccccaagttcgaaaagcagctgggccaagttatgctgctcgtgctgtgcgctgggcagcttctgctcatgcggacgacctgggccttttgtgaggtgctgacactggctaccggacctattctcacactttgggaaggcaatcccgggagattctggaacaccacgatcgccgtcagcacagccaacattttccgcggatcttatctggcgggcgctggcctggccttttccctcatcaaaaatgctcagacccctcggagagggaccggaacaaccggcgagacactgggggaaaagtggaaacgccagcttaacagcctggaccggaaggagttcgaggaatacaaaagatctggcattctcgaggtggatcgcacggaagccaagagcgccctgaaggacggctccaaaatcaagcatgctgtttctcgggggagctccaaaatcagatggattgtggagcgcggaatggtcaagccgaaaggcaaggtggttgatctgggctgcgggcggggaggctggagctactatatggccaccctcaagaatgtgacagaagtcaaagggtacaccaagggaggccccgggcacgaggagcctatccccatggcgacatatggatggaaccttgtgaaactgcattccggcgtggacgtcttttacaagcctaccgaacaagttgatacgctgctctgtgacattggcgagtctagctccaatcccaccatcgaagaggggagaacactgcgcgtgcttaaaatggtggaaccgtggctgtctagcaagcctgagttctgcattaaggtcctcaacccctatatgcccaccgtgatcgaggaactggagaaactgcagagaaagcacggaggcaatctcgttcggtgtcctctttcccgcaactctacacacgaaatgtactgggtgagcggggcctccggaaatattgtcagctctgtgaacaccacatccaaaatgctgctgaatagatttaccacgcggcatagaaagcccacatatgagaaagatgttgacctcggcgctgggacccggagcgtgtctaccgagacagaaaagcctgatatgacgatcatcggacgcagactgcagcggcttcaggaggaacacaaagagacctggcattacgaccaagaaaacccgtaccgcacatgggcctatcacggctcctacgaggctcccagcaccggctctgcctccagcatggtcaatggggtggttaagctgctcacaaagccttgggatgtgattcccatggtcacccagctggcgatgacagacaccacgcctttcggacagcagagagtgtttaaagagaaggtcgacacccggacaccccaaccgaaacctggcacccgcatggtgatgacaaccacggccaactggctgtgggctctcctggggaagaaaaagaatcccagactttgcacacgggaagagttcatctccaaggttcgcagcaacgccgctattggagccgtgtttcaggaagaacagggctggacctctgctagcgaagccgtcaatgattccagattctgggagctggtggacaaagagcgggcgctccaccaagaagggaagtgtgagtcttgcgtgtataacatgatgggcaaacgcgaaaagaaactgggagagtttggcagagccaaggggagccgggctatctggtacatgtggcttggagcccgcttcctggaatttgaggctctcggcttcctgaacgaggatcattggttcgggagagaaaattcctggtctggagttgagggcgaagggctgcaccggctcggctatattctggaggagatcgacaagaaagatggagaccttatgtacgccgatgacacagccggctgggataccagaatcacggaagacgatctgcagaacgaggaactcattaccgagcagatggcgcctcatcacaagatcctggctaaagccatttttaaacttacatatcagaataaagtggtcaaggtgctgcgccccacccctagaggggccgttatggacatcattagcagaaaggatcaacgcggatccggccaggtggggacatacggactcaacaccttcacaaatatggaagtccagctgatccggcagatggaggctgagggcgtgatcacccaagacgacatgcagaaccccaaagggctgaaggaaagagtcgagaaatggctccgcgaatgcggcgtggatcggctgaagagaatggccatttctggagacgattgtgttgtgaaaccgcttgacgagcgctttggcacgagcctcctgttcctgaatgatatggggaaggtccggaaagacatccctcagtgggaaccctccaagggatggaagaactggcaggaggtgcccttttgcagccatcacttccacaaaatttttatgaaggatggcagatctcttgttgtgccttgtcgcaatcaagacgagctgatcgggcgggctagaatttcccagggagccggctggagcctccgggaaacagcgtgcctggggaaagcctacgctcagatgtggtctctgatgtatttccatagacgcgatctccggctggcctccatggctatctgtagcgccgtcccgaccgagtggtttcccacctccagaacaacctggtctatccacgcgcatcaccagtggatgacaacggaagacatgcttaaggtgtggaaccgcgtgtggattgaggataatcctaacatgatcgacaaaacccccgttcacagctgggaagacattccttacctgggcaagagagaggatctctggtgcggatccctgatcggccttagctctcgggccacatgggctaagaatattcataccgccatcacacaagtccgcaacctgattgggaaagaggaatatgtggactacatgcccgtgatgaagagatattccgctcctagcgagtctgaaggagtcctctga

SEQ ID NO: 21062 - RNA, 9867 nt, synthetic construct
  misc_feature 1..9867: note = derived and/or modified CDS sequence (opt5) from DENV-4__JQ513336__SS-prME
  source 1..9867: mol_type = other RNA
agcaccatcaccctgctctgcctgattcccacggtgatggccttccacctttccacccgggacggagagcctctgatgatcgtcgctaagcatgaacgggggcgcccgctcctgtttaaaaccaccgagggaattaacaagtgtacacttatcgccatggatctgggagaaatgtgcgaggacaccgttacatacaaatgtcccctcctggtgaataccgaacctgaggatattgactgctggtgtaacctgacgtctacctgggtgatgtatgggacatgcacccagagcggagagcggcggcgcgaaaagagatccgtcgcgctcacaccccactctggcatggggctggagacccgggctgaaacgtggatgagctccgagggagcctggaaacatgcccagcgcgtggagtcttggatccttagaaatcctggcttcgctctgctcgccggctttatggcttacatgatcgggcagacaggcattcagcggaccgttttctttgtgctgatgatgcttgtcgcccccagctatggcatgcgctgtgtgggggttggaaacagagatttcgtggaaggcgtctccgggggagcgtgggtggacctggtgctcgagcacggcggctgcgtcacaaccatggcccaggggaagcctaccctggattttgaactgacaaagacgaccgctaaagaggttgccctcctgcggacatactgtatcgaagctagcatttctaatatcaccacagccacccgctgcccgacgcaaggagagccctatcttaaggaggaacaggaccagcagtacatttgtagacgggatgtggtggaccgcggctgggggaacggatgcggcctgttcgggaaaggaggcgtcgtgacatgcgcgaagttttcctgtagcgagaaaatcaccggcaatctcgttcaaattgaaaacctggagtataccgtggtcgtgacagttcataatggggatacccacgccgtgggaaacgacacatctaatcacggcgtcacggctaccatcacacctagatcccccagcgtggaagtcgagcttcctgattacggggagctgaccctcgactgcgaaccccggtctggaatcgacttcaacgagatgattctgatgaagatgaagaaaaagacatggctggtgcataaacagtggtttctcgatctgccgcttccttgggccgctggcgccgacacctccgaagttcactggaattacaaggagagaatggtgacgttcaaagtcccccatgccaagcgccaggatgtgaccgttctggggagccaggaaggcgctatgcactccgcgctcgccggagctacagaggtggactctggcgatgggaaccacatgtttgccggacatctgaaatgtaaggtccggatggagaaacttagaatcaaaggcatgagctataccatgtgctccgggaagttcagcattgacaaagaaatggccgagacacaacacggaaccacggtggtgaaggttaaatacgaaggcgctggggccccttgtaaggtccccatcgagattcgcgatgtgaataaggagaaagtggtcggccgggtgatctcttccatccccctggcggaaaacacaaacagcgttaccaatattgagctcgaacctccgttcggagactcttatatcgtgattggcgtcgggaacagcgctctgacactgcattggtttagaaagggatcctctatcggcaaaatgttcgagagcacctaccgcggggccaagcggatggccattctcggagaaaccgcttgggattttggctccgttgggggactgttcacaagccttggaaaagccgtgcaccaggtgtttggctctgtctatacgaccatgttcgggggagtgtcctggatggttagaatcctgatcggcctcctggtgctgtggattgggacaaatagccgcaacacctctatggctatgacatgcatcgccgtcggaggcattaccctttttctcgggttcacggtgcaggcggacatgggctgtgtggtctcctggagcggacgggagctgaagtgcggctccgggatctttgttgtggataatgtgcatacatggaccgagcaatacaagttccagcccgaatctcctgccagactggctagcgccattctcaacgctcacaaagacggagtctgtggcatccgctccaccacacggctggagaatgtgatgtggaagcagattaccaacgaacttaattatgttctgtgggagggcgggcacgacctcacagtggtcgccggggatgtgaaaggcgttctgacgaaggggaaaagagcgctgacaccccctgtgtctgaccttaagtacagctggaagacatggggaaaagccaagatctttacccccgaagctcggaactccacattcctcatcgatggcccggacaccagcgagtgccctaatgagcgcagagcctggaactctctggaagtcgaggattacgggtttggaatgttcacgaccaatatttggatgaaattccgggaaggctccagcgaggtgtgtgaccatagactgatgtctgctgccatcaaggatcagaaagccgttcacgctgacatggggtattggattgaatccagcaagaaccaaacatggcagatcgagaaagcgtctctcattgaggtgaagacctgcctgtggcccaagacacataccctttggagcaatggagtcctggaatcccagatgctcatccctaaaagctacgccggccccttttctcagcacaactatcgccaaggctacgctacacagaccgtggggccttggcacctgggaaagctggagatcgatttcggcgaatgccccgggacgacagtgaccattcaggaggactgtgatcatcggggaccgtcccttagaaccacaaccgccagcggcaaactcgtcacgcagtggtgctgtcgctcctgcacaatgcctcccctgagatttctgggggaggacggatgttggtatggcatggaaatccggcccctctctgagaaggaagagaacatggttaaaagccaagtggccgctggccaggggacctccgaaacattctctatgggactgctttgcctgaccctctttgtggaggagtgtctgcgcagacgggtcacacgcaagcacatgattctggccgtggttatcaccctttgcgcgattatcctcggcgggctgacgtggatggatctgctcagagctctgatcatgcttggagacaccatgagcggccggattgggggacagacacatctggccatcatggccgtgttcaagatgtcccctggctacgtcctcggcgtgtttctgcgcaaactgacctctagagaaacagctcttatggttattgggatggccatgaccacgacactgagcatcccgcacgacctcatggagctgattgatggaatctccctcggcctgatccttctgaagattgtgacccagttcgacaatacacaagtcgggaccctcgcgctgagcctgacctttatccggtctacaatgtcccttgtgatggcttggcgcacgattatggccgtcctgttcgtggttaccctcatccccctgtgtagaacaagctgcctccagaaacagtctcattgggtggaaattaccgccctgatccttggagctcaagccctgcctgtctatctcatgacactgatgaagggcgcttcccggagaagctggcccctgaacgaggggattatggccgtgggacttgtttctctgctcggctccgcgctgctcaaaaatgatgtgcctctggccggccccatggtcgctgggggacttctgctggccgcttacgtgatgagcggctccagcgccgacctctctctggaaaaggccgctaacgtgcagtgggatgagatggcggacatcaccgggagctcccctatcattgaggttaagcaggatgaagacggatcttttagcatccgcgatgtcgaggaaacgaatatgattacacttctggtgaaactcgccctgatcaccgtgtccggcctctaccccctggctattccggtcaccatgacactttggtatatgtggcaagtgaagacccaacggtctggggccctgtgggacgttcctagccccgccgctacacagaaagccgcgctgtccgagggagtgtacagaatcatgcagcgcggcctcttcggcaagacgcaggtcggggtgggaatccacatggaaggcgtttttcacaccatgtggcatgtgacacgggggtctgtcatttgtcacgagaccggaagactggagcctagctgggctgatgtgcgcaacgacatgatctcctatggcgggggatggcggcttggcgataaatgggacaaggaagaggacgttcaagtgctggccattgaacccggcaagaatccgaaacatgtccagacaaagcctggactgttcaaaaccctgacgggagagatcggcgccgtgaccctcgatttcaagcccgggacaagcggatctcctattatcaacagaaaaggcaaggtgatcgggctgtacggcaatggagtcgttaccaaatccggcgactatgtgagcgctattacacaggccgagcgcatcggggaacccgattacgaggtggacgaagatatttttcggaagaagagacttaccatcatggacctgcaccccggagcgggcaaaacaaagcggattctgccttctatcgtccgcgaggctctcaaaagacggctgcgcacgcttattctggccccgaccagagtggttgccgctgaaatggaggaggccctccgggggctgcccatcagatatcagacccctgctgtgaagtccgaacatacaggacgcgagatcgtcgatctcatgtgccacgccaccttcacaacgcggctgcttagctccaccagagtgcccaactacaatctgattgttatggacgaagcgcactttacagatccttctagcgtggccgctcgcggctacatctccacccgggtcgagatgggggaagccgctgccattttcatgacagccacaccccctggcgctacggacccgtttccccaaagcaactctcctatcgaggatattgagagagaaatccccgagcgctcctggaatacaggattcgactggatcaccgactatcagggcaaaaccgtgtggtttgtccctagcattaaggcggggaacgatatcgccaattgcctgcggaagtctggcaagaaggtgattcagctcagcagaaaaacattcgacaccgaataccccaagacaaaactgaccgattgggactttgttgtgacgacagatatctccgagatgggcgctaacttccgcgccgggagagtgattgacccgcggcgctgtcttaagcctgtcatcctgaccgatggacccgaaagagttatcctcgccggccccattcctgtgacacccgcttctgccgcgcaacggcgcgggagaatcggccggaaccctgctcaggaggacgatcagtatgtgtttagcggagacccgctgaagaatgatgaggaccatgcccactggaccgaagccaaaatgctgctcgataacatttacacgcccgagggcatcattcctacccttttcgggcccgaaagagagaagacacaggctatcgacggagagttccgcctgcggggcgaacaaagaaaaacctttgtcgagctgatgcgcagaggggacctccctgtgtggctgtcctataaggttgcctctgcgggaattagctacaaagatagagaatggtgcttcacaggcgagcggaataaccagatccttgaagagaatatggaggtggaaatctggacccgcgagggcgaaaagaagaaactgagaccccggtggctcgacgcccgcgtctatgctgatccgatggccctgaaggactttaaagagttcgcttccgggagaaagagcattacactggatatcctcaccgaaattgcctctcttcctacgtacctgtccagccgggctaaactggccctcgacaacatcgtgatgctgcatacaaccgagcgcggaggcagagcgtaccagcacgcccttaatgagctgcccgaatccctcgagaccctgatgctggtcgctctccttggggccatgacagctggaatttttctgttctttatgcagggcaaggggatcggaaagctgtctatgggcctcatcaccattgccgtggccagcggcctgctttgggttgctgaaatccaacctcagtggattgcggcctccatcattctggagttctttctcatggtgctgctgatccccgaacctgagaaacagcggacaccccaggataaccaactcatctatgtcattcttgctatcctgacgattatcgggctgattgccgccaatgagatgggactcatcgaaaagaccaaaacagacttcggcttttaccaggtgaagaccgagacaaccattctggatgttgaccttcgcccggcttctgcctggacgctgtatgcggtggccaccacaatcctcacccctatgctgagacacacaatcgaaaacaccagcgctaatctgtccctcgccgctattgccaaccaggcggccgtccttatggggctgggaaaaggctggcccctgcatcggatggatctcggggtgcccctgcttgctatgggatgttacagccaggtgaatcctacgacactgaccgcctctctcgttatgctgctggtccactatgctatcattggcccgggcctccaagccaaggctacaagagaggcccagaaacgcaccgcggccgggatcatgaagaaccccaccgtggacggaattacagtgatcgatcttgagcctatctcctacgaccccaagttcgaaaaacagctgggccaagtcatgctgctcgttctgtgcgctgggcagcttctgctcatgcggacgacctgggccttttgtgaggtgctgacactggctaccggacctattctcacactttgggaaggcaatcccgggagattctggaacaccacgatcgccgtgagcacagccaacattttccgcggatcttatctggcgggcgctggcctggccttttccctcatcaagaatgctcagacccctcggagagggaccggaacaaccggcgagacactgggggaaaaatggaagcgccagcttaacagcctggaccggaaagagttcgaggaatacaagagatctggcattctcgaggtcgatcgcacggaagccaagagcgccctgaaagacggctccaagatcaaacatgctgtgtctcgggggagctccaagatcagatggattgttgagcgcggaatggtgaaaccgaagggcaaggtcgtggatctgggctgcgggcggggaggctggagctactatatggccaccctcaaaaatgttacagaagtgaaggggtacaccaaaggaggccccgggcacgaggagcctatccccatggcgacatatggatggaaccttgtcaagctgcattccggcgtggacgtgttttacaaacctaccgaacaagtcgatacgctgctctgtgacattggcgagtctagctccaatcccaccatcgaagaggggagaacactgcgcgttcttaagatggtggaaccgtggctgtctagcaagcctgagttctgcattaaagtgctcaacccctatatgcccaccgtcatcgaggaactggagaagctgcagagaaaacacggaggcaatctcgtgcggtgtcctctttcccgcaactctacacacgaaatgtactgggttagcggggcctccggaaatattgtgagctctgtcaacaccacatccaagatgctgctgaatagatttaccacgcggcatagaaaacccacatatgagaaggatgtggacctcggcgctgggacccggagcgtttctaccgagacagaaaaacctgatatgacgatcatcggacgcagactgcagcggcttcaggaggaacacaaggagacctggcattacgaccaagaaaacccgtaccgcacatgggcctatcacggctcctacgaggctcccagcaccggctctgcctccagcatggtgaatggggtcgtgaagctgctcacaaaaccttgggatgttattcccatggtgacccagctggcgatgacagacaccacgcctttcggacagcagagagtctttaaggagaaagtggacacccggacaccccaaccgaagcctggcacccgcatggtcatgacaaccacggccaactggctgtgggctctcctggggaaaaagaagaatcccagactttgcacacgggaagagttcatctccaaagtgcgcagcaacgccgctattggagccgtttttcaggaagaacagggctggacctctgctagcgaagccgtgaatgattccagattctgggagctggtcgacaaggagcgggcgctccaccaagaagggaaatgtgagtcttgcgtgtataacatgatgggcaagcgcgagaaaaagctgggagagtttggcagagccaaggggagccgggctatctggtacatgtggcttggagcccgcttcctggaatttgaggctctcggcttcctgaacgaggatcattggttcgggagagaaaattcctggtctggagtggagggcgaagggctgcaccggctcggctatattctggaggagatcgacaaaaaggatggagaccttatgtacgccgatgacacagccggctgggataccagaatcacggaagacgatctgcagaacgaggaactcattaccgagcagatggcgcctcatcacaaaatcctggctaaggccatttttaaacttacatatcagaataaggttgtgaaggtcctgcgccccacccctagaggggccgtgatggacatcattagcagaaaagatcaacgcggatccggccaggttgggacatacggactcaacaccttcacaaatatggaagtgcagctgatccggcagatggaggctgagggcgtcatcacccaagacgacatgcagaaccccaaggggctgaaagaaagagtggagaagtggctccgcgaatgcggcgtcgatcggctgaaaagaatggccatttctggagacgattgtgtggttaagccgcttgacgagcgctttggcacgagcctcctcttcctgaatgatatggggaaagtgcggaaggacatccctcagtgggaaccctccaagggatggaaaaactggcaggaggtccccttttgcagccatcacttccacaagatttttatgaaagatggcagatctcttgtggttccttgtcgcaatcaagacgagctgatcgggcgggctagaatttcccagggagccggctggagcctccgggaaacagcgtgcctggggaaggcctacgctcagatgtggtctctgatgtatttccatagacgcgatctccggctggcctccatggctatctgtagcgccgtgccgaccgagtggtttcccacctccagaacaacctggtctatccacgcgcatcaccagtggatgacaacggaagacatgcttaaagtctggaaccgcgtgtggattgaggataatcctaacatgatcgacaagacccccgtgcacagctgggaagacattccttacctgggcaagagagaggatctctggtgcggatccctgatcggccttagctctcgggccacatgggctaaaaatattcataccgccatcacacaagttcgcaacctgattgggaaggaggaatatgtcgactacatgcccgtgatgaaaagatattccgctcctagcgagtctgaaggagtgctctga

SEQ ID NO: 21063 - RNA, 9867 nt, synthetic construct
  misc_feature 1..9867: note = derived and/or modified CDS sequence (opt5) from DENV-4__JQ513338__SS-prME
  source 1..9867: mol_type = other RNA
agcaccatcaccctgctctgcctgattcccacggtgatggccttccacctttccaccagagacggagaacctctgatgatcgttgctaagcatgaacgggggcgcccgctcctgtttaaaacaaccgagggaattaacaagtgtacacttatcgccatggatctgggagaaatgtgcgaggacaccgttacatacaaatgtcccctcctggtgaataccgaacctgaggatattgactgctggtgtaacctgacgtctacctgggtgatgtatgggacatgcacccagagcggagagagacggcgcgaaaagagatccgtcgcgctcacaccccactctggcatggggctggagacccgggctgaaacgtggatgagctccgagggagcctggaaacatgcccagcgcgtggagtcttggatccttagaaatcctggcttcgctctgctcgccggctttatggcttacatgatcgggcagacaggcattcagcggaccgttttctttgtgctgatgatgcttgtcgcccccagctatggcatgcgctgtgtgggggttggaaacagagatttcgtggaaggcgtctccgggggagcgtgggtggacctggtgctcgagcacggcggctgcgtcacaaccatggcccaggggaagcctaccctggattttgaactgacaaagacgaccgctaaagaggttgccctcctgcggacatactgtatcgaagctcttattagcaatatcaccacagccacccgctgcccgacgcaaggagagccctatctgaaggaggaacaggagcagcagtacatttgtagacgggacgtggtggatcgcggctgggggaacggatgcggcctcttcgggaaaggaggcgtcgtgacatgcgcgaagttttcttgttccggcaaaatcaccgggaatctggttcaaattgaaaaccttgagtataccgtggtcgtgacagttcataatggaaacacccctgccgtgggcaatgacacaagcaaccacggggtcacggctcccatcacccctagatctccctccgtggaagtcaagctgccggattacggagagctcacactggactgcgagcctcggagcggcatcgatttcaatgaaatgattctgatgaagatgaaaaagaaaacctggctcgtgcacaagcagtggtttctggaccttcccctgccttggacaaccggggccgacacgtctgaggttcattggaactacaaagaaagaatggtgaccttcaaggtcccccacgctaaacgccaggatgtgacagttctcggctcccaggagggagccatgcatagcgccctggctggcgcgaccgaagtggactccggggatgagaatcacatgtttgccggacaccttaagtgtaaggtccggatgggcaaactgagaatcaaggggatgtcttatacaatgtgcagcggaaaattctccattgacaaggagatggctgaaacccaacatggcacgacagtggtgaaagttaagtacgagggggccggcgccccctgtaaggtccctatcgaaattcgcgatgtgaacaaagagaaggtggtcggacgggtgatcagcgctaccccgctcgccgagaacacaaattctgttaccaacatcgaactggagccccctttcggcgacagatatattgtgatcggggtcggaaattccgcgctgaccctccactggtttcgcaaaggcagctctattgggaagatgttcgaaagcacataccggggagctaaaagaatggccatcctgggcgagacggcctgggattttgggtccgtgggcggacttttcacctctctgggcaaggctgttcatcaggtgtttgggagcgtctatacaaccatgttcggaggcgtgtcctggatgattcgcatcctcatcgggtttctggttctgtggattggaacaaacagccggaatacctctatggccatgacgtgcatcgctgtgggcgggattacacttttcctcggctttaccgtccaggccgacatgggatgtgtggtgtcctggagcggcagagaactgaagtgcgggtctggaatcttcgtcgttgataacgtgcacacctggacagagcaatacaaatttcagcccgagtcccctgcgcgcctggccagcgctattctcaatgcccataaggacggcgtgtgtgggatccggtccaccacaagactggaaaacgtcatgtggaaacagattacgaatgagcttaactatgtgctgtgggaaggaggccacgatctcaccgttgtggctggcgacgtcaagggggtgctgacaaaaggaaagcgggccctgacacccccggcgtctgaccttaagtacagctggaaaacatggggcaaggccaaaatcttcacccctgaggctcgcaattccacgtttctcatcgatgggcccgacacctctgaatgccctaacgagagacgggcctggaatagcttcgaggttgaagattacggattcggcatgtttacaaccaacatttggatgaagttcagagaggggtccagcgaagtgtgtgaccaccgcctgatgtctgctgccatcaaagatcagaaggccgtccatgctgacatgggatattggattgagtccagcaaaaatcaaacatggcagatcgaacgggcgtctctgattgaggtgaagacctgcctctggcccaagacacacaccctgtggtccaacggcgttcttgagagccagatgctgatccctaaatcttacgccggcccctttagccagcataactatagacaagggtacgctacgcagacagtgggaccgtggcacctcggcaagctggaaatcgatttcggggagtgccctggaaccaccgtcacaattcaggaaaattgtgaccaccgcggcccctccctgagaaccacgacagccagcgggaaacttgtgacccagtggtgctgtcggtcttgcacaatgccccctctccgctttctgggagaggatggctgttggtatggcatggagatcagaccgctgtccgaaaaggaggaaaacatggtgaaaagccaagtcaccgccgggcagggaacatccgagaccttctctatgggcctcctgtgccttacgctgtttgttgaagagtgtctccggcgcagagtgacccggaagcatatgattctggctgtggtcatcacactgtgcgccattatccttgggggactcacctggatggacctgctgcgcgcgctcatcatgctgggcgatacaatgagcgggagaattggaggccagacccaccttgctatcatggccgtgttcaagatgtcccccggctacgttctgggggtgtttctccggaaactgacgtctcgcgagacagccctgatggtcattggaatggctatgaccacaacccttagcatccctcatgacctgatggaactcattgatggcatctccctggggctcatcctgcttaagattgtgacccagttcgacaatacacaagttggaacgctggccctctctctgacctttatcagaagcacaatgtccctggtgatggcgtggcggaccattatggctgtccttttcgtggtcacactgatccccctctgtagaaccagctgcctgcagaaacagtctcactgggtggagattacggccctcatcctgggcgcccaagcccttcctgtttatctgatgacactcatgaagggggcctcccgccggagctggcccctgaacgaaggaattatggctgtgggcctggtctctcttctgggctccgccctcctgaaaaatgacgtgcctctcgcggggcccatggttgccggaggcctgcttctggctgcctacgtgatgagcgggtcttccgctgatctgagcctcgagaaggccgccaacgtccagtgggacgaaatggctgatatcaccggatccagcccgatcattgaggtgaagcaggacgaggatggctcttttagcatcagagacgtggaagagaccaatatgattacactgcttgttaaactggcgctcatcaccgtctccgggctgtaccctctcgccattcccatcacaatgacgctgtggtatatgtggcaagtgaagacccaacgctctggagctctttgggatgtgcctagccccgccgccacacagaaagctgccctgtccgaaggcgtctaccggatcatgcagagaggcctgttcgggaagacccaggtgggagttggcattcatatggagggggtgttccacacaatgtggcacgtcacccgcggatctgtgatctgtcatgaaacgggccggctcgagccgagctgggcggacgttagaaacgatatgatttcctatgggggaggctggcgcctgggcgacaaatgggataaggaggaagacgtgcaagtccttgctatcgagcctgggaagaatcccaaacacgtgcagaccaagcctggactgtttaaaacactcaccggcgaaattggggccgttacactggatttcaagcccggaacctctggcagccccatcatcaaccggaaagggaaggtgattggcctctacggaaatggcgtcgtgacaaaatccggggactatgtgagcgccatcacgcaggctgagagaattggagagcctgactacgaagtcgatgaggacatctttcggaagaagcgcctgaccattatggatcttcatccgggcgccgggaaaacaaagagaatcctgccctctattgttcgggaagcgctgaaacgcagactccggaccctgatccttgctcctaccagagtggtggccgccgagatggaagaggctctgcgcggactccccatccggtatcagacgcctgctgtcaagtccgagcacacaggcagagaaattgtggacctgatgtgccatgctaccttcacaacccgcctcctgagctctacacgggttcccaactacaatcttatcgtgatggatgaggcccactttaccgacccttccagcgtcgcggccagagggtacatttccacgcgcgtggaaatgggcgaggctgccgctatcttcatgacagccaccccgcccggagccaccgatccttttccccaatctaacagccctattgaagacatcgagcgggagatccccgaaagatcctggaatacaggcttcgattggattaccgactatcaggggaaaacagtttggtttgtgccgagcatcaaggctggaaacgatattgcgaactgcctgcgcaagtctggcaaaaaggtcatccagctgtccagaaaaaccttcgacacggagtaccctaagacaaaactcaccgactgggattttgtggtcacaaccgacattagcgaaatgggggccaatttccgggctggacgcgtgatcgatcccagacggtgtctgaagcccgttatccttacggacggccctgagcgcgtgattctggccgggcccatccctgtgaccccggcctctgctgcccaaagacggggcagaattggacgcaaccccgcgcaggaagatgaccagtatgtcttcagcggcgatcctctcaagaatgacgaggatcacgctcattggacagaggccaaaatgctgctggacaacatctacacccccgaagggattatccctacactctttggacccgagcgggaaaagacccaggccattgatggcgagttcagacttcgcggggagcaacggaaaacatttgttgaactgatgagacggggagacctgccggtgtggctctcctataaggtggcttctgccggcatcagctacaaagatcgcgagtggtgcttcaccggcgaaagaaataaccagatcctggaggaaaatatggaggtcgagatttggacgcgggaaggggagaagaagaaacttcgccctaagtggctggacgcgagagtgtatgccgaccccatggctctcaaagattttaaggagttcgcctccggacggaaatctatcacactggacattctgaccgagatcgctagcctccctacctacctttccagccgcgccaagctggctctggataacattgttatgctccacacaaccgaaagaggcgggcgggcctaccagcatgcgctgaatgagcttcccgagtctctggaaacactcatgctggtggccctgctcggagctatgacggccggcatctttcttttctttatgcaggggaagggaatcggcaaactgtccatgggcctgattaccatcgctgtcgccagcgggctcctgtgggtggccgagattcaacctcagtggatcgctgcgtccattatccttgagttctttctgatggtcctcctgatccccgagccggaaaagcagcgcacacctcaggacaaccaactgatttatgtgatcctcaccattcttacaatcattggactgatcgccgctaatgagatgggcctgattgagaaaaccaagacggatttcgggttttaccaggttaaaaccgaaacaaccatcctcgacgtggatctgagacccgcctctgcctggacactttatgctgtcgccaccacgatcctgacacccatgctccggcacaccattgagaacacaagcgcgaatctgtccctggccgctatcgccaaccaggctgccgtgctcatgggacttggcaaggggtggcctctgcacagaatggacctgggagttccgctcctggcgatgggctgttactctcaggtgaatcccaccacccttacagccagcctggtcatgctcctggtgcattatgctattatcggccctgggctgcaagccaaagctacgcgcgaagcccagaagcggaccgctgccggaattatgaagaaccccacagtggatggcatcaccgttatcgacctcgagcctatttcctacgatcccaaattcgagaagcagcttgggcaagtcatgctgctggtgctctgcgcgggacagctgcttctgatgagaacaacctgggccttctgtgaagtgctcacgctggctacaggccctatcctgaccctctgggaggggaacccgggacgcttttggaataccacaattgccgtcagcaccgctaacatcttccggggctcttatcttgccggcgccgggctggcgttttccctgattaaaaatgctcagacacccagacgcggaacgggcaccacaggggaaaccctcggagagaagtggaaacggcagctgaacagccttgacagaaaggagttcgaggagtacaagcgctctggcatcctggaagttgatcggacagaggccaaatccgctctcaaggacgggagcaaaatcaagcacgccgtgtctagaggaagctccaaaattcgctggatcgtggaacggggcatggtcaagcctaagggcaaagtgattgacctggggtgcggaagaggcgggtggtcttactatatggccaccctgaagaatgttacggaggtgaaaggatacaccaagggcgggcccggacatgaagaacctatccccatggctacatatggctggaacctcgtcaaacttcacagcggcgtggatgtcttttacaagccgaccgagcaagtggacacactgctgtgtgatattggggaatccagctccaatcctaccatcgaggaaggacgcacactcagagtcctgaagatggtggagccctggctttctagcaaacccgagttctgcattaaggtgctgaacccttatatgcccaccgtcatcgaggagctcgaaaaactgcagcggaagcatggcgggaatctggttcgctgtcctctctccagaaactctacgcacgagatgtactgggtgagcggagcctccggcaatatcgtgtctagcgtcaacacaacctccaaaatgcttctgaatcggtttaccacaagacaccggaagccgacgtatgaaaaagacgtggatctgggggcgggaacccgcagcgtttctacagagaccgagaagcccgacatgacaattatcggcagacggctccagcgcctgcaggaagaacataaggaaacctggcactacgatcaagagaacccttacagaacatgggcctatcatggctcctacgaagctcccagcaccgggtctgcctccagcatggtgaatggagtcgtgaaacttctgacgaagccttgggacgttattcccatggtgacccagctcgctatgacagataccacaccgttcggccagcagcgggtctttaaagagaaggtggacacccgcacgcctcaacccaaacctgggacaagaatggttatgaccacaaccgccaactggctgtgggcgctgctcggaaagaagaaaaatccccggctgtgcacgcgcgaggagttcatctctaaggtgagatccaacgccgctattggcgccgtctttcaggaggaacaggggtggaccagcgcttccgaggccgtgaacgatagccggttctgggaacttgtcgacaaagagcgcgctctgcaccaagagggcaagtgtgaatcttgcgtgtataatatgatgggaaaaagagagaagaagctcggcgaatttgggcgggccaaaggaagccgcgcgatctggtacatgtggctgggcgccagattccttgagttcgaagctctggggtttctcaacgaggaccactggttcggacgggaaaattcctggtctggcgttgaaggggagggcctgcatagactgggatatatcctcgaagagattgataagaaagacggcgatctgatgtacgccgacgatacagctgggtgggacacccgcatcacagaggatgaccttcagaacgaagaactgattaccgaacagatggcccctcaccataagatcctcgccaaagcgatttttaagctgacatatcagaataaggtggtcaaagtgcttcggcccaccccgagaggagctgtgatggatatcatcagccgcaaggaccaacggggctccgggcaggttggaacgtacggcctgaacacattcaccaatatggaggtgcagctcattagacagatggaagccgagggggtcatcacccaagatgacatgcagaaccctaaaggcctgaaggagcgcgtggaaaaatggctgcgggagtgcggagttgatagactcaagcgcatggccatttctggcgacgactgtgtggtcaaacccctggatgaacggtttgggacaagccttctgttcctcaatgacatgggaaaggtgagaaaggatatcccccagtgggagccttccaaaggctggaagaactggcaggaagtcccgttttgctctcaccatttccacaaaatttttatgaaggacgggcgcagcctggtggttccctgtcggaatcaagatgagcttatcggcagagctcggatctcccagggcgccgggtggagcctgagagagaccgcttgcctcggcaaagcctacgcgcagatgtggtctctgatgtatttccaccgccgggacctgagactcgcctccatggctatttgtagcgccgtgcctacagaatggtttcccacgtctcgcaccacatggtccatccatgctcaccatcagtggatgaccacagaggatatgctgaaggtctggaacagagtgtggattgaagacaatcctaacatgatcgataagacccccgttcacagctgggaggacattccttaccttggaaaacgggaagatctgtggtgcggctccctcatcgggctgtctagccgcgccacgtgggcgaagaatattcacaccgccatcacacaagtgagaaaccttatcggaaaagaggagtatgtcgactacatgcccgtgatgaagcggtattccgctccgagcgaatctgagggcgtgctgtga

SEQ ID NO: 21064 - RNA, 9867 nt, synthetic construct
  misc_feature 1..9867: note = derived and/or modified CDS sequence (opt5) from DENV-4__JQ513339__SS-prME
  source 1..9867: mol_type = other RNA
agcaccatcaccctgctgtgcctgattcccacggtgatggctttccacctttccacccgggacggagagcctctgatgatcgtggctaagcatgaacgggggcgcccgctgctgtttaagaccaccgagggaattaacaagtgtacgcttatcgccatggatctgggcgaaatgtgcgaggacaccgttacatacaagtgtcccctcctggtgaataccgaacctgaggatattgactgctggtgtaacctgacgtctacctgggtgatgtatgggacatgcacccagagcggagagagacggcgcgaaaagagatccgtcgcgctcacaccccactctggcatggggctggagacccgggctgaaacgtggatgagctccgagggagcctggaaacatgcccaacgcgtggagtcttggatccttagaaatcctggcttcgctctgctcgccggctttatggcttacatgatcgggcagacaggcattcagcggaccgttttctttgtgctgatgatgcttgtcgcccccagctatggcatgcgctgtgtgggggttggaaacagagatttcgtggaaggcgtctccgggggagcgtgggtggacctggtgctcgagcacggcggctgcgtcacaaccatggcccaggggaagcctaccctggattttgaactgacaaagacgaccgctaaagaggttgccctcctgcggacatactgtatcgaagctcttattagcaatatcaccacagccacccgctgcccgacgcaaggagagccctatctgaaggaggaacaggaccagcagtacatttgtagacgggatgtggtggaccgcggctgggggaacggatgcggcctcttcgggaaaggaggcgtcgtgacatgcgcgaagttttcttgttccggcaaaatcaccgggaatctggttcaaattgagaaccttgaatataccgtggtcgtgacagttcataatggagatacccacgccgtgggcaacgacacaagcaatcacggggtcacggctaccatcacacctagatctccctccgtggaggtcaagctgcctgattacggagaactcaccctggactgcgagccccggagcggcatcgacttcaacgagatgattctgatgaagatgaaaaagaaaacatggctcgtgcataagcagtggtttctggatcttccgctgccttggaccacgggggccgacacctctgaagttcactggaattacaaagagagaatggctacattcaaggtgccccatgccaaacgccaggatgtcaccctcctgggctcccaggaaggagccatgcacagcgctcttgcgggcgccacagaggtggactccggggatgaaaaccacatgtttgctggacatctgaagtgtaaggttcggatgggcaaactcagaatcaaggggatgtcttataccatgtgcagcggaaaattctccattgacaaggagatggccgagacgcaacacggcacaaccgtggtcaaagtgaagtacgaaggggccggcgctccttgtaaggtgcccatcgagattcgcgatgttaataaagaaaaggtcgtgggacgggtgctgagcgccacacccctggcggagaacaccaactctgtcaccaatatcgagctcgaacctccgttcggcgactcctatatcgtgattggggttggaaacagcgctctgacacttcattggtttacgaaaggctctagcatcgggaagatgttcgagtccacctacagaggagccaaacgcatggccattctgggcgaaacagcttgggattttgggtctgtgggcggactcttcaccagcctgggcaaggccgtccaccaggtgtttgggtccgtttatacaaccatgttcggaggcgtgagctggatgatccggattctgatcgggtttcttgtcctctggatcggaacaaattctagaaacacatccatggctatgacctgcattgccgtgggcgggatcaccctgttcctgggctttacagttcaggcggacatgggatgtgtggtcagctggtctggccgcgagctcaagtgcgggtccggaattttcgtggtggataatgtccatacctggacagaacaatacaaatttcagcccgagagccctgcccggctggcttccgccatccttaacgctcacaaggacggcgtttgtgggattagatctacgacccgcctggagaatgtgatgtggaaacagatcacaaacgaactcaattatgtgctgtgggagggaggccacgacctgaccgtcgtggccggcgatgttaagggggtgcttacaaaaggaaagcgggcgctcacaccccctgccagcgacctgaagtactcctggaaaacgtggggcaaggctaaaattttcacccccgaagccagaaactctacatttctgatcgatgggccggacaccagcgagtgccctaatgaacggcgcgcttggaactccttcgaggtcgaggattacggattcggcatgtttacaaccaatatctggatgaagttcagagaagggagctctgaggtgtgtgaccatcggctcatgtccgccgccattaaagatcagaaggctgttcacgcggacatgggatattggatcgaaagctctaaaaaccaaacatggcagattgagagagcctccctgatcgaagtgaagacctgcctttggcccaagacgcatacactgtggagcaatggcgtcctcgagtctcagatgctgattcctaaaagctacgctggccccttttcccagcacaactatcgccaagggtacgccacccagaccgtgggaccttggcacctgggcaaacttgagatcgatttcggggaatgccccggaacaaccgttacgatccaggagaactgtgaccatcggggcccgagcctcagaacaaccacagcctctgggaaactggtgacccagtggtgctgtcgctcctgcacaatgcctcccctgagatttctcggagaagatggctgttggtatggcatggagattcggcccctgagcgagaaggaagagaatatggtcaaatcccaagtgaccgctgggcagggaacgtctgaaaccttcagcatgggccttctgtgcctcacactgtttgtggaggaatgtctgcgcagacgggtcacccgcaagcacatgatccttgccgttgtgattacactctgcgcgatcattctcggcgggctgacctggatggacctcctgagagctcttatcatgctgggggatacgatgtccgggcggatcggaggccagacacatctcgccattatggccgtgttcaagatgtctcctggctacgtcctgggggtgtttctgcgcaaacttaccagcagagagacagctctgatggttatcggaatggccatgaccaccacactctccattccgcacgacctgatggagctcatcgacggcatttctctggggcttatcctgctcaagatcgtgacgcagttcgataacacccaagtcggaacactggcgctgagccttacctttattcggtccacaatgagcctggtgatggcttggcgcaccatcatggccgttctcttcgtggtcacgctgattcccctctgtagaacatcttgcctgcagaaacagtcccattgggtggaaatcaccgcccttattctgggcgctcaagccctccctgtctatctgatgaccctgatgaagggggctagccggagatcttggccccttaatgagggaatcatggccgtgggcctggtttccctcctgggcagcgcgctcctgaaaaacgacgtgcctcttgccgggcccatggtcgctggaggcctgctgctcgccgcttacgtgatgtctgggtccagcgccgatctgtcccttgaaaaggccgctaatgttcagtgggacgagatggcggatattacaggaagctctcctatcatcgaagtgaagcaggacgaggatggcagcttttccattcgcgacgtcgaggaaaccaacatgatcacactgctcgtgaaactggccctcattacggtgtctgggctgtacccccttgctatcccgattaccatgacactgtggtatatgtggcaggttaagacccaacggagcggagccctgtgggatgtcccttcccccgccgctacacagaaagccgcgctctctgagggcgtgtacagaatcatgcagcgcggcctgttcgggaagacccaggtgggagtcggcatccacatggaaggggtgttccacacgatgtggcatgttacccggggaagcgtgatttgtcacgagacaggcagacttgaaccttcctgggctgacgtccgcaatgatatgatctcttatgggggaggctggcggctgggcgacaaatgggataaggaggaggacgtgcaagttctcgccattgaacccgggaagaacccgaaacatgtgcagaccaagcctggactgtttaaaacactcaccggcgagatcggggccgtcacactggacttcaagcccggaacgagcggctcccctattatcaatagaaaagggaaggtgatcggcctttacggaaacggcgttgtgaccaaaagcggggattatgtctctgctattacacaggccgaacgcatcggagagcccgactacgaggtggatgaagacatttttcggaagaagagactgaccatcatggatctgcaccccggcgcggggaaaaccaagcggattctcccttccatcgtgcgcgaggctctgaaaagacggcttcgcacactgattctcgccccgacgagagtcgttgccgctgaaatggaggaagccctgcggggactccccatcagatatcagacccctgctgtcaagagcgagcatacaggccgcgagatcgtggacctgatgtgccacgccaccttcacaacccggcttctgtcttccacgagagtccccaattacaacctgattgtgatggatgaagcgcactttacagaccctagctccgttgccgctcgcgggtacatctctacccgggtggagatgggcgaagccgctgccattttcatgaccgccacaccccctggagctaccgatccgtttccccaaagcaattcccctatcgaggacattgaaagagagatccccgagcgcagctggaacacaggcttcgattggatcaccgactatcaggggaaaacggtctggtttgtgccttctattaaggcgggaaatgacatcgccaactgcctccggaagtccggcaaaaaggttattcagctgagcagaaaaacattcgataccgaataccccaagacaaaacttaccgactgggattttgtggtcacgaccgacatctctgagatgggggctaacttccgcgccggaagagtgattgatccgcggcgctgtctgaagcctgtcatcctcacagacggccccgaaagagtgatcctggccgggcccattcctgttacccccgctagcgccgcgcaacggcgcggcagaatcggacggaatcctgctcaggaggatgaccagtatgtgttctccggcgatccgctgaagaacgacgaagatcatgcccactggacagaggccaaaatgctccttgacaatatttacacccccgaggggatcattcctacactgtttggacccgaaagagagaagacccaggctatcgatggcgagttccgcctgagaggggaacaaagaaaaacgtttgtggagctcatgcgccggggagacctgcctgtctggctttcttataaggttgccagcgcgggcatttcctacaaagacagagaatggtgcttcacaggcgagcggaacaatcagatcctggaagagaacatggaagtggagatctggacccgcgagggggaaaagaagaaactcagacccaagtggctggatgcccgggtgtatgctgacccgatggccctgaaagattttaaggagttcgcttctggacgcaaaagcattaccctcgacatccttacagaaattgcctccctgcctacctacctgagctctagagctaagctcgccctggataatatcgtcatgcttcatacaacggagcggggcgggcgcgcgtaccagcacgccctgaacgaactccccgagtccctggagaccctgatgctcgtggcccttctgggagccatgacagctggcatttttctgttctttatgcaggggaagggaatcggcaaactcagcatgggcctgatcaccattgccgttgcctccgggcttctgtgggtggctgaaatccaacctcagtggattgcggcctctatcattctcgagttctttctgatggtcctgctcatccccgaacctgagaagcagagaacaccccaggacaatcaacttatctatgtgattctgaccatcctgacgattatcggactcattgctgccaacgaaatgggcctgatcgagaaaaccaagacagatttcgggttttaccaggtcaaaaccgagacaaccattcttgacgtggatctgcggccggccagcgcttggacgctctatgccgttgcgacaaccatcctgacacctatgctgcgccacaccatcgaaaatacctccgccaacctctctcttgctgccattgctaatcaggccgcggtgctgatgggactgggcaaggggtggcccctccatagaatggacctgggagtcccccttctggccatgggctgttacagccaggtgaaccctacaacgctcaccgcttccctggttatgctgctcgtgcactatgccatcattggcccggggcttcaagctaaagccacacgggaggctcagaagagaaccgccgcgggaatcatgaagaatcccacagtcgatggcattaccgtgatcgacctggaacctatcagctacgatcccaaattcgagaagcagctggggcaagtgatgctcctggttctttgcgccggacagctgctcctgatgcgcacgacatgggctttctgtgaggtcctgaccctcgccaccggccctattcttacactgtgggaagggaaccccggacggttttggaacaccacaatcgctgtgtctacggccaatattttcagaggctcctatctggccggcgcggggctcgcttttagcctgatcaaaaacgcccagacccctcgccggggaacaggcaccacaggggagacccttggagaaaagtggaaaagacagctcaattctctcgaccgcaaggagttcgaagagtacaagcggtccggcattctggaggtggacagaacggaagctaaaagcgccctgaaggatgggtctaaaatcaagcatgccgtcagccgcggatcctctaaaatccggtggattgttgagagaggcatggtgaagccgaagggcaaagtgatcgacctcgggtgcggacgcggcgggtggagctactatatggctacccttaagaacgtcacagaagtgaaaggatacaccaagggcgggcccggacacgaggaacctattcccatggccacatatggctggaatctggttaaactgcattccggcgtggatgtcttttacaagcctaccgagcaagtggacacactcctgtgtgatatcggggagagctcctctaaccccaccattgaagagggacggacgcttagagttctgaagatggtggaaccgtggctcagctccaaacctgagttctgcatcaaggtcctgaatccctatatgcccacagtgattgaagaactggagaaactccagcgcaagcacggcgggaaccttgtgagatgtcctctgtctcggaatagcacccacgaaatgtactgggtctccggagcgtctggcaacatcgttagctccgtgaataccacaagcaaaatgctgctcaaccgctttacgaccagacatcggaagcccacatatgagaaagacgtggatctgggggccggaaccagatctgtctccacagaaaccgagaagcctgacatgacaatcattggccggcgccttcagagactgcaggaggaacacaaggagacctggcattacgatcaagaaaatccgtaccggacgtgggcttatcacggcagctacgaggccccctctaccgggtccgctagctctatggtgaacggagttgtgaaactcctgacaaagccttgggacgtcatccccatggtgacccagctggccatgacagataccacgcctttcggccagcagcgcgtttttaaagaaaaggtggacacaagaacaccccaaccgaaacctgggacacggatggtcatgaccacgaccgcgaattggctctgggccctgcttggaaagaagaaaaacccccgcctgtgcacaagagaggagttcatttccaaggtgcggagcaatgctgccatcggcgctgtttttcaggaggaacaggggtggacctccgccagcgaagctgtgaacgactctcgcttctgggagctcgtcgataaagaaagagccctgcaccaagagggcaagtgtgagagctgcgtgtataacatgatgggaaaacgggaaaagaaacttggcgagtttgggcgcgcgaaaggatccagagccatttggtacatgtggctgggcgctcggttcctcgagttcgaggccctggggtttctgaatgaagaccattggttcggacgcgagaactcttggagcggcgtcgagggggaaggcctccacagactgggatatatccttgaggaaatcgataagaaagacggcgatctgatgtacgctgacgatacagccgggtgggacacccggattacagaggatgacctccagaatgaggaactgatcaccgagcagatggcccctcatcacaagattcttgcgaaagctatctttaagctgacgtatcagaacaaggtggttaaagtgctcagacccacacctcgcggagccgtcatggatattatctcccggaaggaccaaagaggctctggacaggtgggaacctacggcctgaataccttcacaaacatggaagtgcagctgatccgccagatggaggccgaaggggttattacccaagatgacatgcagaatcccaaaggcctcaaggagcgggtggagaaatggctgagagaatgcggagtcgaccgccttaagcggatggctatcagcggcgatgactgtgtggttaaaccgctggatgagagatttgggacatccctcctgttccttaacgacatgggaaaggtgcgcaaggatattcctcagtgggaaccctctaaaggctggaagaattggcaggaggtccccttttgcagccatcacttccacaaaatctttatgaaggacgggcggtccctggtggtcccttgtagaaaccaagatgaactcattggacgcgcccggatcagccagggcgctgggtggtctctgagagagacggcctgcctgggcaaagcgtacgcccagatgtggtccctcatgtatttccatcggagagacctgcgccttgctagcatggccatctgttctgctgtgccgaccgagtggtttcccacatcccggaccacatggagcattcacgcccatcaccagtggatgaccacggaagatatgctgaaggtttggaatagagtgtggatcgaggacaaccctaatatgattgataagacccccgtccactcctgggaagacatcccttacctcggaaaacgcgaggacctgtggtgcggctctcttattgggctgagctccagagcgacatgggccaagaacatccataccgctattacacaagtgcggaatctcatcggaaaagaagagtatgttgattacatgcccgtgatgaagcgctatagcgccccttctgagtccgaaggcgtcctgtga

SEQ ID NO: 21065 - RNA, 9867 nt, synthetic construct
  misc_feature 1..9867: note = derived and/or modified CDS sequence (opt5) from DENV-4__JQ513343__SS-prME
  source 1..9867: mol_type = other RNA
agcaccatcaccctgctctgcctgattcccacggtgatggccttccacctttccacccgggacggagagcctctgatgatcgtggctaagcatgaacgggggcgcccgctcctgtttaaaaccaccgagggaattaacaagtgtacacttatcgccatggatctgggagaaatgtgcgaggacaccgttacatacaaatgtcccctcctggtgaataccgaacctgaggatattgactgctggtgtaacctgacgtctacctgggtgatgtatgggacatgcacccagagcggagagagacggcgcgaaaagagatccgtcgcgctcacaccccactctggaatggggctggagacccgggctgaaacgtggatgagctccgagggagcctggaaacatgcccaacgcgtggagtcttggatccttagaaatcctggcttcgctctgctcgccggctttatggcttacatgatcgggcagacaggcattcagcggaccgttttctttgtgctgatgatgcttgtcgcccccagctatggcatgcgctgtgtgggggttggaaacagagatttcgtggaaggcgtctccgggggagcgtgggtggacctggtgctcgagcacggcggctgcgtcacaaccatggcccaggggaagcctaccctggattttgaactgacaaagacgaccgctaaagaggttgccctcctgcggacatactgtatcgaagctcttattagcaatatcaccacagccacccgctgcccgacgcaaggagagccctatctgaaggaggaacaggaccagcagtacatttgtagacgggatgtggtggaccgcggctgggggaacggatgcggcctcttcgggaaaggaggcgtcgtgacatgcgcgaagttttcttgttccggcaaaatcaccgggaatctggttcaaattgagaaccttgaatataccgtggtcgtgacagttcataatggagatacccacgccgtgggcaacgacacaagcaatcacggggtcacggctaccatcacacctagatctccctccgtggaggtcaagctgcctgattacggagaactcaccctggactgcgagccccggagcggcatcgacttcaacgagatgattctgatgaagatgaaaaagaaaacatggctcgtgcataagcagtggtttctggatcttccgctgccttggaccacgggggccgacacctctgaagttcactggaattacaaagagagaatggaaacattcaaggtgccccatgctaaacgccaggatgtcaccctcctgggctcccaggagggagccatgcacagcgcccttgctggcgcgacagaagtggactccggggatgagaaccacatgtttgccggacatctgaagtgtaaggttcggatggagaaactcagaatcaagggcatgtcttataccatgtgcagcgggaaattctccattgacaaggaaatggctgagacgcaacacggaacaaccgtggtcaaagtgaagtacgaaggcgccggggccccttgtaaggtgcccatcgagattcgcgatgttaataaagagaaggtcgtgggccgggtgatcagcgctacacccctggccgaaaacaccaactctgtcaccaatatcgagctggaacctccgttcggagactcctatattgtgatcggcgttgggaacagcgcgctcacactgcattggtttagaaaaggatctagcattggcaagatgttcgagtccacgtaccgcggggctaaacggatggccatccttggagaaaccgcctgggattttggctctgtcgggggactgttcacaagcctcggaaaggctgtgcaccaggtgtttggctccgtttataccacaatgttcgggggagtgagctggatgattagaatcctgatcggctttctggtcctttggattgggaccaattctcgcaacacgtccatggccatgacatgcatcgctgtgggaggcattaccctcttcctggggtttaccgttcaggccgacatgggctgtgtggtcagctggtctggacgggagctgaagtgcggctccgggatcttcgtggtggataatgtccatacatggaccgagcaatacaaatttcagcccgaaagccctgcgagactcgcctccgctattctgaacgcccacaaggacggagtttgtggcatccgctctacaacgcggcttgagaatgtgatgtggaaacagattaccaacgaactgaattatgtgctctgggaagggggacacgacctgacagtcgtggctggcgatgttaagggcgtgctgaccaaagggaagagagcccttacaccccctgcgagcgacctcaagtactcctggaaaacctggggaaaggccaaaatcttcacgcccgaagctcggaactctacctttctgatcgatggcccggacacaagcgagtgccctaatgagcgcagagcctggaactccttcgaagtcgaggattacgggttcggaatgtttaccacaaatatttggatgaagttccgggaaggcagctctgaggtgtgtgaccatagactgatgtccgctgccatcaaagatcagaaggccgttcacgctgacatggggtattggattgaaagctctaaaaaccaaacctggcagatcgagcgcgcgtccctcattgaggtgaagacatgcctgtggcccaagacccatacgctttggagcaatggagtcctggaatctcagatgctcatccctaaaagctacgccggccccttttcccagcacaactatcggcaaggctacgctacacagaccgtggggccttggcacctgggaaagctggagatcgatttcggcgaatgccccgggaccacagttaccattcaggagaactgtgaccatagaggaccgagccttcgcacgacaaccgcctctggcaaactcgtgacacagtggtgctgtagatcctgcaccatgcctcccctgcggtttctgggggaggatggatgttggtatggcatggaaatccgccccctcagcgagaaggaagagaatatggtcaaatcccaagtgacagccggccaggggacctctgaaacgttcagcatgggactgctttgcctgaccctctttgtggaggagtgtctgagacggcgcgtcacaagaaagcacatgattctggctgttgtgatcaccctttgcgccattatcctcggcgggctgacatggatggacctgctccgggcgctgatcatgcttggagataccatgtccggccgcattgggggacagacgcatctggctatcatggccgtgttcaagatgtctcctggctacgtcctcggcgtgtttctgagaaaactgacaagccgggaaaccgcccttatggttattgggatggctatgacaaccaccctgtccatcccgcacgacctcatggagctgattgacggaatctctctcggcctgatccttctgaagattgtgacacagttcgataacacgcaagtcgggaccctcgccctgagcctgacatttatccgctccaccatgagccttgtgatggcgtggagaacaattatggctgttctgttcgtggtcaccctcatccccctgtgtcggacgtcttgcctccagaaacagtcccattgggtggaaattacagccctgatccttggagcccaagctctgcctgtctatctcatgaccctgatgaagggcgccagcagacgctcttggcccctgaatgaggggattatggctgtgggacttgtttccctgctcggcagcgccctgctcaaaaacgacgtgcctctggcgggccccatggtcgccgggggacttctgctggctgcctacgtgatgtctggctccagcgctgatctctccctggaaaaggccgccaatgttcagtgggacgagatggctgatatcaccgggagctctcctatcattgaggtgaagcaggacgaagatggcagcttttccatccgggacgtcgaggaaacaaacatgattacccttctggtgaaactcgcgctgatcacagtgtctggcctctaccccctggccattccgatcacgatgaccctttggtatatgtggcaggttaagacacaaagaagcggggctctgtgggatgtcccttcccccgccgccacccagaaagctgccctgtctgagggagtgtaccgcatcatgcagcggggcctcttcggcaagacacaggtgggggtcggcattcacatggaaggcgtgttccacaccatgtggcatgttacgagagggagcgtgatctgtcacgagaccggacgcctggagccttcctgggcggacgtccggaatgatatgatttcttatggcgggggatggagacttggcgacaaatgggataaggaagaggacgtgcaagttctggctatcgaacccggcaagaacccgaaacatgtgcagacaaagcctgggctctttaaaaccctgacaggagagattggcgccgtcaccctcgacttcaagcccgggacaagcggatcccctatcatcaatcgcaaaggcaaggtgattgggctgtacggcaacggagttgtgacgaaaagcggcgattatgtctctgccatcacccaggctgagcggattggggaacccgactacgaggtggatgaagacatctttagaaagaagcggcttacaattatggatctgcaccccggagccggcaaaaccaagcgcatcctgccttccattgtgagagaggcgctcaaacggcgcctgagaacccttatcctggctccgacacgggtcgttgccgccgaaatggaggaggctctcagagggctgcccatccgctatcagacgcctgccgtcaagagcgaacataccggacgggagattgtggacctcatgtgccacgctacattcaccacaagactgctttcttccacccgcgtccccaattacaacctgatcgtgatggatgaagcccactttacggaccctagctccgttgcggcccggggctacatttctacaagagtggagatgggggaagctgccgctatcttcatgaccgccacaccccctggcgccacagatccgtttccccaaagcaattcccctattgaggacatcgagcgcgaaatccccgagcggagctggaacaccggattcgattggattacagactatcagggcaaaaccgtctggtttgtgccttctatcaaggctgggaatgacattgcgaactgcctgagaaagtccggcaagaaggttatccagctcagccgcaaaacgttcgatacagaataccccaagaccaaactgacagactgggattttgtggtcaccacggacatttctgagatgggcgccaacttcagagctgggcgggtgatcgatccgcgcagatgtcttaagcctgtcatcctgaccgacggacccgaacgggtgattctcgccggccccatccctgttacacccgccagcgctgcccaacgcagagggcggattggcagaaatcctgcgcaggaggatgaccagtatgtgttctccggagatccgctgaagaacgacgaggatcatgctcactggaccgaagccaaaatgctgctcgacaatatctacacacccgagggcattatccctaccctttttgggcccgaacgcgagaagacacaggccattgatggagagttccggctgagaggcgaacaacgcaaaacctttgtggagctgatgcggagaggggacctccctgtctggctgtcttataaggttgctagcgccggaatctcctacaaagaccgggaatggtgcttcacgggcgagcgcaacaatcagatccttgaagagaacatggaggtggaaatttggacaagagagggcgaaaagaagaaactgcggcccaagtggctcgatgcgcgcgtgtatgccgacccgatggctctgaaagattttaaggagttcgcctctgggagaaaaagcatcaccctggacattctcaccgaaatcgcttcccttcctacatacctgagctctcgggccaagctggctctcgataatattgtcatgctgcataccacagagcgcggaggcagagcctaccagcacgcgcttaacgagctgcccgaatccctcgagacgctgatgctggtggccctccttggggctatgaccgccggaatctttctgttctttatgcagggcaaggggatcggaaaactgagcatgggcctcattacaatcgctgttgcctccggcctgctttgggtggccgaaattcaacctcagtggatcgctgcgtctattatcctggagttctttctcatggtcctgctgatccccgaacctgagaagcagcggacaccccaggacaatcaactcatttatgtgatccttacaattctgaccatcattgggctgatcgccgctaacgagatgggactcattgagaaaacgaagaccgatttcggcttttaccaggtcaaaacagagaccacaatcctggacgtggatcttcgcccggccagcgcctggaccctgtatgctgttgccacgacaatcctcacccctatgctgagacacacaattgaaaatacctccgcgaacctgtctctcgccgctatcgccaatcaggctgccgtgcttatggggctgggaaagggctggcccctgcatcggatggacctcggggtccccctgcttgcgatgggatgttacagccaggtgaaccctaccacactgacggcctccctcgttatgctgctggtgcactatgctattatcggcccgggcctccaagccaaagctaccagagaggcccagaagcgcacagctgccgggattatgaagaatcccaccgtcgatggaatcacagtgatcgaccttgagcctattagctacgatcccaaattcgaaaagcagctgggccaagtgatgctgctcgttctgtgcgcggggcagcttctgctcatgcggaccacgtgggccttctgtgaggtcctgacactggctaccggacctatcctcaccctttgggaaggcaaccccgggagattttggaacacaaccattgccgtgtctacagctaatatcttccgcggatcctatctggccggcgccggcctggcgtttagcctcattaaaaacgctcagacgcctcggagagggaccggaacaaccggcgagacactgggggaaaagtggaaacgccagcttaattctctggaccggaaggagttcgaggaatacaagagatccggaatcctcgaggtggaccgcaccgaagccaaaagcgctctgaaggatggctctaaaatcaagcatgccgtcagccgggggtcctctaaaattagatggatcgttgagcgcggaatggtgaagccgaagggcaaagtgattgacctgggctgcgggcggggaggctggagctactatatggccacgctcaagaacgtcaccgaagtgaaagggtacacaaagggaggccccgggcacgaggagcctatccccatggctacctatggatggaatcttgttaaactgcattccggcgtggatgtcttttacaagcctacagaacaagtggacaccctgctctgtgatattggcgagagctcctctaaccccacaatcgaagaggggagaaccctgcgcgttcttaagatggtggaaccgtggctgagctccaaacctgagttctgcattaaggtcctcaatccctatatgcccacggtgatcgaggaactggagaaactgcagagaaagcacggaggcaacctcgtgcggtgtcctctttctcgcaatagcacacacgaaatgtactgggtctccggggcctctggaaacatcgttagctccgtgaataccaccagcaaaatgctgctgaacagatttacaacgcggcatagaaagcccacctatgagaaagacgtggatctcggcgcggggacacggtctgtctccaccgagacagaaaagcctgacatgaccattatcggacgcagactgcagcggcttcaggaggaacacaaggagacatggcattacgatcaagaaaatccgtaccgcacctgggcctatcacggcagctacgaggctccctctacgggctccgccagctctatggtgaacggggttgtgaaactgctcaccaagccttgggacgtcattcccatggtgacacagctggctatgaccgatacaacccctttcggacagcagagagtttttaaagagaaggtggacacgcggacaccccaaccgaaacctggcacccgcatggtcatgacaaccacggccaattggctgtgggcgctcctggggaagaagaaaaaccccagactttgcacccgggaagagttcatctccaaggtgcgcagcaatgccgctattggagccgtttttcaggaagaacagggctggacatccgctagcgaagccgtgaacgactctagattctgggagctggtcgataaagagcgggctctccaccaagaagggaagtgtgagagctgcgtgtataacatgatgggcaaacgcgaaaagaagctgggagagtttggcagagccaaagggtcccgggcgatctggtacatgtggcttggagcccgcttcctggagttcgaggctctcggctttctgaatgaggaccattggttcgggagagaaaactcttggagcggagtcgagggcgaagggctgcaccggctcggctatatcctggaggagattgataagaaagacggagatcttatgtacgccgacgataccgctggctgggacacaagaatcaccgaagatgacctgcagaatgaggaactcattacagagcagatggcccctcatcacaagatcctggccaaagcgatttttaaacttacctatcagaacaaggtggttaaagtgctgcgccccacgcctagaggggctgtcatggatatcatctccagaaaggaccaacgcggatctggccaggtggggacatacggactcaataccttcaccaacatggaagtgcagctgattcggcagatggaggccgagggcgttatcacacaagatgacatgcagaatcccaaagggctgaaggaaagagtggagaaatggctccgcgaatgcggcgtcgaccggctgaagagaatggccattagcggagatgactgtgtggttaaaccgcttgatgagcgctttggcacctccctcctgttcctgaacgacatggggaaggtgcggaaggatatccctcagtgggaaccctctaaaggatggaagaattggcaggaggtccccttttgcagccatcacttccacaaaatttttatgaaggacggcagatcccttgtggtcccttgtcgcaaccaagatgagctgatcgggcgggctagaatcagccagggagccggctggtctctccgggaaacagcttgcctggggaaagcctacgcgcagatgtggtccctgatgtatttccatagacgcgacctccggctggccagcatggctatttgttctgccgtgccgacggagtggtttcccacctccagaacaacctggagcatccacgctcatcaccagtggatgacaaccgaagatatgcttaaggtttggaatcgcgtgtggattgaggacaaccctaatatgatcgataagacgcccgtccactcctgggaagacattccttacctgggcaaaagagaggacctctggtgcggatctctgatcggccttagctcccgggccacctgggcgaagaacattcatacagccatcacccaagtgcgcaatctgatcgggaaagaggaatatgttgattacatgcccgtgatgaagagatatagcgctccttctgagtccgaaggagtcctctga

SEQ ID NO: 21066 - RNA, 9867 nt, synthetic construct
  misc_feature 1..9867: note = derived and/or modified CDS sequence (opt5) from DENV-4__KT276273__SS-prME
  source 1..9867: mol_type = other RNA
agcaccatcacactgctctgcctgattcccacggtgatggccttccacctttccaccagagacggcgagcctctgatgatcgtcgctaagcatgaacgggggcgcccgctcctgtttaaaacaaccgagggaattaacaagtgtacacttatcgccatggatctgggcgaaatgtgcgaggacaccgttacatacaaatgtcccctcctggtgaataccgaacctgaggatattgactgctggtgtaacctgacgtctacctgggtgatgtatgggacatgcacccagagcggagagagacggcgcgaaaagagatccgtcgcgctcacaccccactctggcatggggctggagacccgggctgaaacgtggatgagctccgagggagcctggaaacatgcccaacgcgtggagtcttggatccttagaaatcctggcttcgctctgctcgccggctttatggcttacatgatcgggcagacaggaattcagcggaccgttttctttgtgctgatgatgcttgtcgcccccagctatggcatgcgctgtgtgggggttggaaacagagatttcgtggaaggcgtctccgggggagcgtgggtggacctggtgctcgagcacggcggctgcgtcacaaccatggcccaggggcggcctaccctggattttgaactgacaaagacgaccgctaaggaggttgccctcctgcgcacatactgtatcgaagctagcatttctaatatcaccacagccaccagatgcccgacgcaaggagagccctatcttaaagaggaacaggaccagcagtacatttgtcggcgcgatgtggtggacagaggctgggggaacggatgcggcctgttcgggaagggaggcgtcgtgacatgcgcgaaattttcctgtagcggcaagatcaccgggaatctcgttcaaattgagaacctggaatataccgtggtcgtgacagttcataatggagatacccacgccgtgggcaacgacacatctaatcacggggtcacggctaccatcacacctcggtcccccagcgtggaggtcgaacttcctgattacggagagctgaccctcgactgcgagcccagatctggcatcgacttcaacgaaatgattctgatgaaaatgaataagaagacatggctggtgcataaacagtggtttctcgatctgccgcttccttggaccgccggggctgacacgtccgaggttcactggaacaataaggaacgcatggtgaccttcaaagtcccccatgccaagcggcaggatgtgacagttctgggcagccaggagggagccatgcactccgctctcgcgggcgccaccgaagtggactctggggatggaaaccacatgtttgctggccatctgaaatgtaaggtcagaatggagaaacttcgcatcaaggggatgagctacacaatgtgctccggaaagttcagcattgacaaagagatggccgaaacccaacacggcacgacagtggtgaaggttaaatatgagggggccggcgctccttgtaaggtccccatcgaaattcgggatgtgaacaaagagaaggtgatcggaagagtcatctcttccattcccctggccgagaataccaacagcgtgacaaatatcgaactcgagcctccgttcggcgactcttacattgttatcggggtgggaaacagcgcgctgaccctgcattggtttcgcaagggctcctctattgggaaaatgttcgaaagcacctatcggggagctaagagaatggccatcctcggcgagacagcctgggattttgggtccgtcggcggactgttcacgagccttggcaaagctgtgcaccaggtttttgggtctgtgtacaccacaatgttcggaggcgtctcctggatgatccgcattctgatcgggtttctcgtgctgtggattggaaccaatagccggaacacatctatggccatgacctgcatcgctgttggcgggattacgctgttccttggctttacagtgcaggccgacatgggatgtgtcgtgtcctggagcggcagagaactcaagtgcgggtccggaatcttcgtgattgataatgtccatacctggaccgagcaatataaatttcagcccgagtctcctgcgcgcctggccagcgctatcctgaacgcccacaaggacggcgtttgtgggatccggtccacaaccagactcgaaaatgtgatgtggaagcagattacaaacgagctgaattacgtgctttgggaaggaggccacgacctgacggtcgtggctggcgatgttaaaggggtgctcaccaagggaaaacgggccctgacaccccctgcgtctgacctgaagtatagctggaaaacctggggcaaggccaagatcttcacacccgaggctcgcaactccacctttcttattgatgggccggacacgagcgaatgccctaatgagagacgggcctggaactctctcgaggtcgaagattacggattcggcatgttcaccacaaatatctggatgaaatttagagaggggtccagcgaaatgtgtgaccatcgcctgatgtctgctgccattaaggatcagaaagccgtgcacgctgacatgggatactggatcgagtccagcaagaaccaaacctggcagatcgaaaaagcgtctctgattgaggttaagacatgcctctggcccaaaacccatacactgtggagcaacggcgtgcttgagtcccagatgctgatccctaagagctatgccggccccttctctcagcacaattaccggcaagggtatgctacccagattgccggaccttggcacctcggcaagctggaaatcgattttggggagtgccccggaacgacagtcaccattcaggaagactgtgatcatagaggcccgtccctgcgcaccacaaccgccagcgggaaacttgtgacgcagtggtgctgtagatcctgcacaatgcctcccctccggttcctgggagaggacggctgttggtacggcatggagatccgccccctgtctgaaaaggaggaaaacatggttaaaagccaagtggctgccgggcagggaacctccgagacattttctatgggcctcctgtgccttaccctgttcgtcgaagagtgtctcagacggcgcgtgacaagaaagcacatgatcctggtggtcgttattaccttttgcgcgatcattctggggggacttacgtggatggatctcctgcgggctctgatcatgctcggcgacaccatgagcgggcgcattggaggccagatccatctggccatcatggccgtgttcaaaatgtcccctggctatgtgcttggggtctttctgagaaagctcacatctcgggagaccgctctgatggtgattggaatggccatgacaaccgttctgagcatcccgtacgaccttatggaactgattgatggcatctccctcgggctgattctcctgaagatcgtgacgcagttcgacaatacacaagtcggaacccttgcgctgagcctcacatttattcgctctaccatgcccctggtgatggcttggagaaccatcatggccgttctgttcgtggtcacacttatccctctgtgtcggacgtcctgcctccagaaacagagccactgggtggagattaccgccctgatcctcggcgctcaagccctgcccgtctatcttatgacactgatgaagggggcttctagacgctcctggcctctcaacgaaggaattatggccgtgggcctggttagcctgcttggctctgcgctgctcaaaaatgatgtgcccctggccgggcctatggtcgctggaggcctcctgcttgccgcttacgtgatgtccgggagctccgccgacctgagcctggagaaggccgctaacgttcagtgggatgaaatggcggacatcaccggatctagccccattatcgaggtgaaacaggatgaggacggctccttttctatccgggatgtcgaagagacaaatatgattaccctcctggtgaagcttgccctgatcacggtgagcgggctctacccgctggctattcctgttacaatgaccctctggtatatgtggcaggtcaagacccaaagatccggagccctgtgggacgtgccctctcctgccgctacacagaaagccgcgcttagcgaaggcgtgtaccgcatcatgcagcggggcctgttcgggaagacccaggtcggagtgggcattcatatggagggggttttccacacaatgtggcacgtgacgagaggatccgtcatctgtcatgaaaccggccgcctggagccctcttgggctgatgtgcggaacgacatgatcagctatgggggaggctggagactcggcgataaatgggacaaggaggaagacgttcaagtgctggccattgagccggggaaaaatcctaagcacgtccagacaaagcccggactttttaaaaccctgacaggcgaaatcggggccgtgaccctcgatttcaagcctggaacgtccggcagccccattatcaaccgcaaagggaaggttattggcctgtacggaaatggcgtggtcaccaaatctggggactatgtgtccgctatcacacaggccgagcggattggagagcccgattacgaagtggacgaggatatctttagaaagaaacggctcaccatcatggacctgcatcctggcgcggggaagacaaagcgcattcttccgagcatcgtcagagaagctctgaaacggcgcctgagaaccctcattctggcccccacacgggttgtggccgctgagatggaagaggcccttagaggactgcctatccgctatcagacgcccgctgtgaagtctgagcacaccggccgggaaattgtcgatctcatgtgccatgccacattcaccaccagactgctctccagcacacgcgtgcctaactacaatctgatcgttatggacgaggcgcactttacggatccctcctctgtggccgctcgggggtacatcagcaccagagtcgaaatgggcgaggccgctgccattttcatgacagccacccctccgggagctacagacccctttcctcaatccaacagccccatcgaagatattgagcgcgagatccctgaacggtcttggaataccggcttcgactggattacggactatcaggggaaaacagtgtggtttgttccctccatcaaggcgggaaacgatatcgccaactgccttagaaaaagcggcaagaaggtgattcagctgtctcgcaaaaccttcgacaccgagtacccgaagacaaaactgaccgattgggactttgtcgtgacaaccgatatcagcgaaatgggggctaatttcagagccggacgggtcattgaccctcgcagatgtctcaagcccgtgatcctgacggatggccccgagcgggttattcttgccgggcctatccccgtgacacctgcttccgccgcgcaacgcagaggccggattggaagaaacccggctcaggaagacgatcagtatgtgttctctggcgaccccctgaaaaatgatgaggaccacgcccattggaccgaggccaagatgctcctggataacatctacacacctgaagggatcattcccaccctgtttggacctgagcgcgaaaagacgcaggctatcgacggcgagttccggctcagaggggagcaacgcaaaacctttgtcgaacttatgcggagaggagacctgcccgtttggctgagctataaggtggcctccgcgggcatttcttacaaagatcgggagtggtgcttcacaggcgaacgcaataaccagatcctcgaggaaaatatggaggtggagatttggaccagagaaggggagaagaaaaagctgcggccgcgctggcttgacgccagagtctatgctgatcctatggccctgaaggactttaaagaattcgctagcggacggaagtccatcacactcgatatcctgaccgagattgccagcctgcccacatacctctcttcccgcgctaaacttgccctggacaacatcgtgatgctgcacaccacggaaagaggcgggcgggcgtaccagcatgccctcaatgagctgcctgagagccttgaaacactgatgctcgttgctctgctgggagccatgaccgctggcatttttctcttctttatgcaggggaagggaatcggcaaactttccatgggcctgattaccatcgccgtggcctctgggctgctctgggtcgctgagatccaaccccagtggattgcggccagcatcattctggaattctttcttatggtgctgctcatccctgagcccgaaaagcagcgcacaccgcaggataaccaactgatttatgtcatcctgaccattctcacaatcatcggacttattgctgccaatgagatgggcctgatcgagaagacgaaaaccgacttcgggttttaccaggtgaagacagaaaccacaattctggatgttgacctcagacctgcctccgcttggaccctgtatgccgtggcgacgaccatccttacacccatgctgcggcacaccattgagaacacatctgccaatctcagcctggctgccatcgctaaccaggccgcggtcctgatgggactcggcaaagggtggccccttcacagaatggatctgggagtgcctctgctcgccatgggctgttactcccaggttaatccgaccacgctgacagctagccttgtgatgctgctcgtccattatgccatcattggccccgggctgcaagctaaggccacccgcgaagctcagaaacggacagccgcgggaatcatgaagaaccctaccgtggacggcattaccgtgatcgatctggagcccatttcttacgaccctaaattcgagaagcagctcgggcaagttatgcttctggtcctgtgcgccggacagctcctgcttatgagaacaacgtgggctttctgtgaagtgctgaccctcgccacaggccccatcctgaccctgtgggaggggaaccctggacgcttttggaatacaaccatcgctgtgtccacggccaacattttccggggcagctatctcgccggcgcggggcttgctttttctctgatcaagaatgcccagacaccgagacgcggaaccggcaccacaggggaaaccctgggagagaaatggaagcggcagctcaactccctggacagaaaagaattcgaggagtacaagcgcagcggcattcttgaagtcgatcggacagaggctaaatctgccctgaaggacgggagcaagatcaaacacgccgtttccagaggatctagcaagattcgctggatcgtggaacggggcatggtgaaacccaagggcaaagtcgtggatctcgggtgcggaagaggcgggtggtcctactatatggctacgctgaagaatgttaccgaggtgaagggatacacaaaaggcgggcctggacatgaagagcccattcctatggccacctatggctggaacctggtcaagctccacagcggcgtggacgttttttacaaacccacagagcaagtggatacccttctgtgtgacatcggggaatcctctagcaatccgacgatcgaggaaggacgcaccctgagagtcctcaagatggtggagccttggctgtcctctaaacccgaattctgcattaaggtgcttaacccctatatgcctacagtcatcgaggagctggaaaagctccagcggaaacatggcgggaatctggttcgctgtcccctgagcagaaactccacccacgagatgtactgggtgtctggagcgagcggcaatattgtgtccagcgtcaacacaacctctaagatgctccttaatcggtttacaaccagacaccggaaacctacgtatgaaaaggatgtggacctgggggccggaacacgctccgttagcaccgagaccgagaaaccggatatgacaatcattggcagacggctgcagcgcctccaggaagagcataaggaaacgtggcactacgaccaagagaacccctacagaacctgggcttatcatggctcttacgaagccccttccacagggagcgcttcttccatggtgaatggagtcgtgaaactgcttaccaagccctgggatgttatccctatggtgacacagctggccatgaccgacacaacccccttcggccagcagcgggtctttaaggagaaagtggacacgcgcaccccgcaacctaagcccgggacaagaatggttatgaccacaaccgcgaactggctctgggccctgctgggaaaaaagaaaaatcctcggctctgcacgaaggaggaattcatcagcaaggtgcgcgctaacgccgctattggcgccgtctttcaggaggaacaggggtggacatccgctagcgaggccgtgaacgattctagattctgggaactggtcgacaaagagcgggcgcttcaccaagagggcaagtgtgaaagctgcgtgtataatatgatgggaaaacgcgagaagaaactgggcgaatttgggagagccaagggatcccgggctatctggtacatgtggctcggcgcccgcttcctggagttcgaagctcttgggtttctgaacgaggatcactggttcggaagagagaattcttggagcggcgttgaaggggagggcctccatcggctgggatatattctggaagagatcgacaagaaagatggcgacctcatgtacgccgatgacaccgccgggtgggatacaagaattaccgaggacgatctgcagaacgaagagcttatcacggaacagatggcgccccaccataagatcctggctaaagccatttttaagctcacctatcagaataaagtggtcaaggtgctgcgccctacaccccggggagccgtgatggacatcatttccagaaaggatcaacgcggctctgggcaggttggaacctacggccttaacacattcaccaatatggaggtgcagctgatccggcagatggaagctgagggggtcattacacaagacgacatgcagaacccgaaaggcctcaaggagagagtggaaaaatggctgcgcgagtgcggagttgatcggctgaagagaatggccatcagcggcgacgattgtgtggtcaaacctctcgacgaacgctttgctacctccctgcttttcctgaatgatatggggaaggtgcggaaagacatcccccagtgggagccctctaagggatggaagaactggcaggaagtccctttttgcagccaccatttccacaaaatttttatgaaggatggcagatccctcgtggttccgtgtcgcaatcaagacgagctgatcgggcgggccagaattagccagggagcgggctggtctcttaaagagacggcctgcctggctaaggcctacgctcagatgtggtccctcatgtatttccaccggagagatctgcgcctggccagcatggcgatctgttctgccgtgcccacagaatggtttcctacctcccggaccacatggagcattcatgctcaccatcagtggatgaccacagaggacatgctcaaagtctggaacagagtgtggatcgaagataatcccaacatgattgacaagacgcctgttcactcctgggaggacatcccctacctggggaagcgcgaagatctttggtgcggctctctgatcggactcagctccagagccacctgggctaaaaatattcacacagccatcacccaagtgcggaacctgattggcaaggaggagtatatggactacatgcctgtcatgcgcagatatagcgctccctctgaatccgagggggtgctttga

SEQ ID NO: 21067 - RNA, 9867 nt, synthetic construct
  misc_feature 1..9867: note = derived and/or modified CDS sequence (opt5) from DENV-4__KU523872__SS-prME
  source 1..9867: mol_type = other RNA
agcaccatgaccctgctctgcctgatccccacggtgatggccttccacctttccaccagagacggcgagcctctgatgattgttgctaagcatgaacgggggcgcccgcttctgtttaagaccaccgaggggatcaacaagtgtacacttattgccatggatctgggcgaaatgtgcgaggacaccgttacatacaagtgtcccctcctggtgaataccgaacctgaggatatcgactgctggtgtaacctgacgtctacctgggtgatgtatgggacatgcacccagagcggagagagacggcgcgaaaagagatccgttgccctcacaccccactctggcatggggctggagacccgggctgaaacgtggatgagctccgagggagcctggaaacatgcccaacgcgtggagtcttggattcttagaaatcctggcttcgctctgctcgccggctttatggctcacatgatcgggcagacaggaatccagcggaccgttttctttgtgctgatgatgcttgtcgcccccagctacggcatgcgctgtgtgggggttggaaacagagatttcgtggaaggcgtctccgggggagcgtgggtggacctggtgctcgagcatggcggctgcgtcacaaccatggcccaggggaagcctaccctggattttgaactgacaaagacgaccgctaaagaggttgccctcctgcggacatattgtattgaagctagcatctctaatattaccacagccacccgctgcccgacgcaaggagagccctaccttaaggaggaacaggaccagcagtatatctgtagacgggatgtggtggaccgcggctgggggaacggatgcggcctgttcgggaaaggaggcgtcgtgacatgcgcgaagttttcctgtagcggcaaaattaccgggaatctcgttcaaatcgagaacctggaatacaccgtggtcgtgacagttcacaatggagatacccacgccgtgggcaacgacacatctaatcatggggtcacggctaccattacacctagatcccccagcgtggaggtcaaacttcctgattatggagaactgaccctcgactgcgagccccggtctggcatcgacttcaacgagatgatcctgatgaagatgaaaaagaaaacatggctggtgcacaagcagtggtttctcgatctgccgcttccttggaccgccggggctgacacgtccgaagttcattggaattacaaagagagaatggtgaccttcaaggtcccccacgccaaacgccaggatgtgacagttctgggcagccaggaaggagccatgcactccgctctcgcgggcgccaccgaggtggactctggggatggaaaccatatgtttgctggccacctgaagtgtaaggtccggatggaaaaacttagaattaaggggatgagctacacaatgtgctccggaaaattcagcatcgacaaggagatggccgagacccaacatggcacgacagtggtgaaagttaagtatgaaggggccggcgctccttgtaaggtccccattgagatccgcgatgtgaataaagaaaaggtggtcggacggattatctcttccacccccttcgccgagaacacaaacagcgtgaccaatatcgagctggaacctccgtttggcgactcttacattgttatcggggtgggagatagcgcgctcaccctgcactggttcagaaaaggctcctctattgggaagatgtttgagagcacatatcgcggagctaaacggatggccatcctgggcgaaacggcctgggacttcgggtccgtcggcggactctttaccagcctgggcaaggctgtgcatcaggttttcgggtctgtgtacacaaccatgtttggaggcgtctcctggatgattagaatccttatcgggttcctggtgctctggattggaacaaacagccgcaatacctctatggccatgacgtgcatcgctgttggcgggattacactgtttctgggcttcaccgtgcaggccgatatgggatgtgtcgtgtcctggaacggcaaggagcttaaatgcgggaatggaatctttgtggtcgacaacgttcacacctggacagaacaatataagttccagcccgagagccctgcgcggctcgcctccgctattctgaatgcccacaaagacggcgtgtgtgggatcagatctaccacacgcctggagaacgtgatgtggaagcagattacgaatgaactcaactacgtcctgtgggagggaggccatgatcttaccgtggttgctggcgacgtgaaaggggtcctgacaaagggaaagcgggccctcacaccccctgtgaatgatctgaaatatagctggaagacatggggcaaagcgaagatctttacccccgaagccagaaactccacgttcctgatcgacgggccggatacctctgagtgccctaatgaacggcgcgcttggaacttctttgaggttgaggactacggattcggcatgtttacaaccaatatttggatgaaattcagagaagggagctccgaggtgtgtgatcaccggcttatgagcgccgctatcaaggaccagaaagccgtccatgccgatatgggatactggattgaatcttccaagaaccaaacatggcagatcgagaaggctagcctcattgaagtgaaaacctgcctgtggcccaagacacacaccctgtggtctaacggcgttctcgagtcccagatgctgatccctagaagctatgcgggccccttttctcagcacaattaccgccaagggtatgccacgcagacagctggaccttggcatcttggcaaactggagatcgacttcggggaatgccccggaaccaccgtgacaattcaggaggattgtgaccaccggggcccgagcctcagaaccacgacagcctccgggaagctggtcacccagtggtgctgtcgcagctgcacaatgcctcccctgagatttcttggagaagatggctgttggtacggcatggagatccggcccctctctgagaaagaagagaacatggtgaagtcccaagtgaccgccgggcagggaacaagcgaaaccttctccatgggcctgctgtgcctcacgctgtttgtcgaggaatgtcttcgcagacgggttacccgcaagcatatgattctggtggtggtcatcacattctgcgctattatcctcgggggactgacctgggtggacctgcttagagccctcatcatgctgggcgacacaatgtctgggcggattggaggccagatccacctggcgattatggctgtttttaaaatgagccctggctatgtgctcggggtcttcctgcgcaaacttacctccagagagacggccctgatggtgatcggaatggccatgacaaccgtcttttctattccgcatgatctcatggagctgatcgacggcatcagcctggggcttattctgctcaaaatcgtgacacacttcgataatacccaggtcggaaccctggctctctccctgacattcattcggtctacgacaccccttgtgatggcctggcgcacaatcatggcggtctttttcgtggttaccctgattcctctctgtagaacaagctgcctgcaaaagcagtcccactgggtggaaatcaccgctctgattcttggcgcccaggccctgcccgtctacctcatgacgctgatgaaaggggctagccggagatcttggcctctcaacgagggaatcatggccgtgggcctggtttcccttctgggcagcgctctcctgaagaatgacgtgcccctggccgggcctatggtcgcgggaggccttctgctcgccgcttatgtgatgtctgggtccagcgccgatctgtctctcgaaaaggctgccaacgtgcaatgggacgagatggccgatatcacaggatccagccccgttattgaagtcaaacaggacgaggatggctcctttagcatccgcgacgtggaggaaaccaatatgattaccctgcttgtgaagctggctctgatcacagtctctgggctctacccgctggcgattcctgtgaccatggccatctggtacatctggcaggttaaaacacagcggagcggagctctttgggatgtgccctcccctgccgccacgcaaaaggctaccctgtctgagggcgtctatagaattatgcagcgcggcctcttcgggaaaacacaggtgggagttggcatccatatggaaggggtgtttcacaccatgtggcatgtcacacggggaagcgtgatttgtcacgagaccggcagactggaaccctcctgggccgacgttcgcaacgatatgatctcttacgggggaggctggaagctcggcgacaagtgggacaaagaggaggatgtgcaggtcctggcgattgaaccggggaagaatcctaaacatgtgcaaacgaagcccggacttttcaaaaccctgacaggcgagatcggggctgtgaccctggactttaagcctggaacaagcggctcccccatcattaacaaaaaggggaaggtcatcggcctctatggaaatggcgttgtgaccaaatctggggattacgtgagcgccattacacaggccgaacggatcggagagcccgactatgaggtcgatgaagacattttcagaaagaaacgcctgacgatcatggatcttcaccctggcgctgggaagaccaaacggattctgccgtccatcgtgagagaggccctcaagcggcgcctgagaacactcatcctggcgcccacccgggttgtggctgccgaaatggaggaagcccttcgcggactgcctattagataccagacccccgctgtcaagagcgagcacacaggccgggagatcgtggacctgatgtgccatgccacgtttaccacaagactcctgtcttccacccgcgttcctaactataatcttattgtgatggatgaagctcacttcacagacccctgcagcgtcgccgcgcgggggtacatctctaccagagtggagatgggcgaagccgctgccatttttatgacggctacacctccgggatccatcgatcccttccctcagagcaactcccccatcgaggacattgaacgcgagatccctgagcggtcttggaataccggcttcgactggattaccgattaccaagggaaaacagtctggtttgtgcccagcatcaaggccggaaacgacattgccaactgtctgagaaaatccggcaagcgcgttatccagctcagccggaaaaccttcgatacagaatatccgaagaccaagctgacggactgggattttgtggtgacaaccgacatctctgagatgggggctaatttcagagcgggacgcgtcattgatcctagacggtgcctcaaacccgttatcctgacagacggccccgaacgcgtgattcttgccgggcctatccccgtgacccctgcttccgccgcccagagacggggccgcattggaagaaacccggctcaagaggatgaccagtacgtctttagcggcgatcccctgcggaatgacgaagatcatgcccactggacggaggcgaagatgctgctcgacaacatctatacccctgaggggattatccccacactgttcggacctgaaagagagaaaacccaggctatcgacggcgaatttcgccttagaggggaacagcggaagacattcgtggagctgatgcgccggggagatctccccgtttggctgtcttacaaagtggccagcgccggcatttcctataaggacagagaatggtgttttaccggcgagcggaataaccaaatcctggaagagaatatggaagtcgagatttggacacgcgagggggaaaagaaaaagctcagaccgaaatggcttgatgctcgggtgtacgccgaccctatggcgctgaaggatttcaaagagtttgcctctggacgcaagagcatcaccctggacattctcacggaaatcgctacactgcccacctatctttcctctaaggccaaactggctctcgataacatcgtcatgctgcacaccacagagaagggcgggagagcctaccagcatgctctgaatgaactccctgagagccttgagaccctgatgctggtggccctcctgggagcgatgacagccggcattttcctctttttcatgcaggggaaaggaatcggcaagctgtccatgggcctcattgctatcgccgttgctagcgggctgctgtgggtggccgaaattcagccccaatggatcgccgcttctatcattctcgagttctttcttatggtcctgctgatccctgaacccgagaaacagcggacgccgcaggacaaccagctcatttacgtgatcctgaccattcttacaatcattggactggttgcggccaatgaaatgggcctcatcgagaagaccaaaacagatttcgggttttatcaagtgaagaccgagacgaccatcctggacgtcgatctgcgccctgcttccgcctggacactctacgccgtggctaccacaattcttacccccatgctgagacacacgatcgaaaacacaagcgccaatctgtccctcgcggccattgctaaccaggccgctgtgctgatgggacttggcaaggggtggcccctgcatcggatggacctcggagttcctctgctggccatcggctgctattctcaggtcaatccgaccacactcaccgcgagccttgtgatgctgctggtgcactacgccattatcggccccgggctccaggctaaagccacccgcgaggctcaaaagagaacagccgctggaatcatgaaaaaccctacggtcgatggcattaccgttatcgacctggaacccatttcctatgaccctaagttcgagaaacagcttggacaggtgatgctgctcgtgctgtgtgtcggacaactgctccttatgcggacaacctgggccctgtgcgaggtgctgacactcgcgaccggccccatcatgacgctgtgggaagggaaccctggaagattttggaatacaaccattgccgtttctaccgctaacatcttccgcggcagctaccttgccggcgctgggctggccttttccctcatcaagaatgcccagacaccgcggagaggaaccggcacaacgggggagaccctgggagaaaagtggaaacgccagctgaacagcctcgatcggaaggagttcgaagagtataaaagatctggcattcttgaggtggaccgcacagaagcgaagtccgctctgcgggatgggagcaaaaccaagcatgccgtctctagaggatccagcaagatccgctggattgtggagcggggcatgatcaaacccaagggcaaagttgtggacctggggtgtggaagaggcgggtggtcttactacatggctacactcaagaatgtcaccgaagtgaaaggatatacgaagggcgggcctggacacgaggaacccattcctatggccacctacggctggaacctggtgaaacttcacagcggcgtcgatgtcttttataaacccacagaacaggtggacaccctgctctgcgatatcggggagtcctctagcaatccgacaattgaagagggaaagaccctgcgcgtgctgaaaatggtcgaaccttggctctccagcaagcccgagttctgtatcaaagtgcttaacccctacatgcctacagttatcgaggaactggagaagctgcaacggagacatggcgggtccctcgtgcgctgccccctgtctagaaatagcacccacgaaatgtattgggtctccggagcctctggcaacattgtgagctccgttaatacgatctctaaaatgcttctgaaccggtttacaacccgctacagaaagcctacctatgagaaggacgtggatctcggggctggaacacggagcgtctccacggaaaccgagaaaccggacatgacaattatcggcagacggctgcagcgcctgagagaggaacataaggagacctggcactacgatcaggaaaatccctaccggacatgggcctatcacggcagctacgaggcgccttctaccgggtccgccagctctatggtgaacggagttgtgaaactccttacaaagccctgggacgtcgtgcctatggtcacccagctggctatgacggacaccacacccttcggccaacagcgcgtgtttaaagaaaaggttgataccagaacaccgcagcctaagcccgggacccggaaaattatgacgacaaccgccaattggctgtgggctctcctgggaaagaaaaagtcccctcgcctttgtacaagagaggagttcatcagcaaagtgcggtctaacgccgcgatcggcgccgtcttccaggaggagcaagggtggacctccgctagcgaagccgtgaatgactcccgcttttgggagctggtggataaggaaagagctctccatcaggagggccggtgcgagagctgcgtttataacatgatgggaaagcgcgagaagaagctgggcgagttcgggagagccaaaggatctcgggctatttggtacatgtggctgggcgcccgctttctcgagttcgaggcgctggggtttcttaacgaagaccactggttcagcagagaaaattcctggtctggagtggagggcgaagggctgcatcggctcggctatatcctggaggatattgacaagaaagatggagaccttatctacgccgatgacacggctggctgggataccagaattacagaagacgatctgctcaacgaggagctgatcaccgaacagatggcgccccaccataagacactggctaaggccatctttaaactcacctatcaaaataaggtcgtgaaagttctgcgccctacacccaagggggccgtgatggacattatcagccggaaagaccagagaggatccggccaggtcgggacctacggacttaacacgttcacaaatatggaggtgcagctgattcgccaaatggaagcggagggcgtcatcacccaggatgacatgcagaacccggaagggctcaaggagcgggtggagaaatggctgaaggaatgtggcgttgatagacttaagcgcatggctatttctggagacgattgcgtggtcaaacctctggacgagcggtttagcacctccctcctgttcctgaatgatatgggcaaggtgagaaaagacatcccccagtgggaaccctctaaggggtggaaaaactggcaagaggttcctttttgtagccaccacttccataagatctttatgaaggatggacgctccctcgtggtcccgtgccggaatcaggacgaactgattggcagagcccgcatcagccagggggccggatggtctcttcgggagacagcttgtctgggcaaagcctacgctcagatgtggtccctcatgtatttccacagacgggatctgagacttgccagcatggcgatttgctctgccgtgcccaccgagtggttccctacatcccgcacgacctggagcatccatgctcaccaccaatggatgacaaccgaagacatgctgaaggtgtggaaccgggtttggattgaggacaatcccaacatgacagataaaacccctgtccattcctgggaagacatcccctacctcgggaagagagaggatctgtggtgtggctctctgattggactcagctcccgcgccacgtgggctaaaaatatccacaccgccatcacacaggtgagaaacctgattggcaaggaagagtatgtggactacatgcctgcgatgaagcggtatagcgccccctttgagtctgaaggggtcctttga

SEQ ID NO: 21068 - RNA, 9867 nt, synthetic construct
  misc_feature 1..9867: note = derived and/or modified CDS sequence (opt5) from DENV-4__KP140942__SS-prME
  source 1..9867: mol_type = other RNA
agcaccatcacgctgctctgcctgattcccacggtgatggccttccacctttccaccagagacggagagcctctgatgatcgtcgctaaacatgaacgggggcgcccgctcctgtttaaaacaaccgaggggattaacaagtgtacacttatcgccatggatctgggcgaaatgtgcgaggacaccgttacatacaaatgtcccctcctggtgaataccgaacctgaggatattgactgctggtgtaacctgacgtctacctgggtgatgtatgggacatgcacccagagcggagagagacggcgcgaaaagagatccgtcgcgctcacaccccactctggcatggggctggagacccgggctgaaacgtggatgagctccgagggagcctggaaacatgcccaacgcgtggagtcttggatccttagaaatcctggcttcgctctgctcgccggctttatggcttacatgatcgggcagacaggcattcagcggaccgttttctttgtgctgatgatgcttgtcgcccccagctatggcatgcgctgtgtgggggttggaaacagagatttcgtggaaggcgtctccgggggagcgtgggtggacctggtgctcgagcacggcggctgcgtcacaaccatggcccaggggcggcctaccctggattttgaactgacaaagacgaccgctaaggaggttgccctcctgcgcacatactgtatcgaagctagcatttctaatatcaccacagccaccagatgcccgacgcaaggagagccctatcttaaagaggaacaggaccagcagtacatttgtcggcgcgatgtggtggacagaggctgggggaacggatgcggcctgttcgggaagggaggcgtcgtgacatgcgcgaaattttcctgtagcggcaagatcaccgggaatctcgttcaaattgagaacctggaatataccgtggtcgtgacagttcataatggagatacccacgccgtgggcaacgacacatctaatcacggggtcacggctaccatcacacctcggtcccccagcgtggaggtcgaacttcctgattacggagagctgaccctcgactgcgagcccagatctggcatcgacttcaacgaaatgattctgatgaaaatgaataagaagacatggctggtgcataaacagtggtttctcgatctgccgcttccttggaccgccggggctgacacgtccgaggttcactggaacaataaggaacgcatggtgaccttcaaagtcccccatgccaagcggcaggatgtgacagttctgggcagccaggagggagccatgcactccgctctcgcgggcgccaccgaagtggactctggggatggaaaccacatgtttgctggccatctgaaatgtaaggtcagaatggagaaacttcgcatcaaggggatgagctacacaatgtgctccggaaagttcagcattgacaaagagatggccgaaacccaacacggcacgacagtggtgaaggttaaatatgagggggccggcgctccttgtaaggtccccatcgaaattcgggatgtgaacaaagagaaggtgatcggaagagtcatctcttccattcccctggccgagaataccaacagcgtgacaaatatcgaactcgagcctccgttcggcgactcttacattgttatcggggtgggaaacagcgcgctgaccctgcattggtttcgcaagggctcctctattgggaaaatgttcgaaagcacctatcggggagctaagagaatggccatcctcggcgagacagcctgggattttgggtccgtcggcggactgttcacgagccttggcaaagctgtgcaccaggtttttgggtctgtgtacaccacaatgttcggaggcgtctcctggatgatccgcattctgatcgggtttctcgtgctgtggattggaaccaatagccggaacacatctatggccatgacctgcatcgctgttggcgggattacgctgttccttggctttacagtgcaggccgacatgggatgtgtcgtgtcctggagcggcagagaactcaagtgcgggtccggaatcttcgtgattgataatgtccatacctggaccgagcaatataaatttcagcccgagtctcctgcgcgcctggccagcgctatcctgaacgcccacaaggacggcgtttgtgggatccggtccacaaccagactcgaaaatgtgatgtggaagcagattacaaacgagctgaattacgtgctttgggaaggaggccacgacctgacggtcgtggctggcgatgttaaaggggtgctcaccaagggaaaacgggccctgacaccccctgcgtctgacctgaagtatagctggaaaacctggggcaaggccaagatcttcacacccgaggctcgcaactccacctttcttattgatgggccggacacgagcgaatgccctaatgagagacgggcctggaactctctcgaggtcgaagattacggattcggcatgttcaccacaaatatctggatgaaatttagagaggggtccagcgaaatgtgtgaccatcgcctgatgtctgctgccattaaggatcagaaagccgtgcacgctgacatgggatactggatcgagtccagcaagaaccaaacctggcagatcgaaaaagcgtctctgattgaggttaagacatgcctctggcccaaaacccatacactgtggagcaacggcgtgcttgagtcccagatgctgatccctaagagctatgccggccccttctctcagcacaattaccggcaagggtatgctacccagattgccggaccttggcacctcggcaagctggaaatcgattttggggagtgccccggaacgacagtcaccattcaggaagactgtgatcatagaggcccgtccctgcgcaccacaaccgccagcgggaaacttgtgacgcagtggtgctgtagatcctgcacaatgcctcccctccggttcctgggagaggacggctgttggtacggcatggagatccgccccctgtctgaaaaggaggaaaacatggttaaaagccaagtggctgccgggcagggaacctccgagacattttctatgggcctcctgtgccttaccctgttcgtcgaagagtgtctcagacggcgcgtgacaagaaagcacatgatcctggcggtggtcattaccctgtgcgctatcattcttgggggactcacgtggatggatctgctgcgggccctcatcatgctgggcgacaccatgagcgggcgcatgggaggccagacacatcttgccattatggctgtttttaaaatgtcccctggctatgtgctgggggtgttcctcagaaagctgacctctcgggagacagccctgatggtcatcggaatggcgatgaccacgacacttagcatcccgcacgacctgatggaactcattgatggcatctccctggggctcattctgcttaagatcgtgacccagtttgacaatacacaagttggaaccctggctctcagcctgaccttcattcgctctacaatgtccctggtgatggcctggagaacgatcatggccgtcctttttgtggttaccctgattcccctctgtcggacaagctgcctgcagaaacagtctcattgggtggagatcaccgctctcatcctgggcgcccaagcccttcctgtctacctgatgacactcatgaagggggcctccaaaagaagctggcccctgaacgaaggaattatggcggtgggcctggtctctcttctgggctccgccctcctgaagaatgatgtgcctctcgctgggcccatggttgccggaggcctgcttctggctgcctatgtgatgagcgggtccagcgccgacctgtctctcgagaaagctgcgaacgtccagtgggatgaaatggccgacatcaccggaagctcccctattatcgaggtgaagcaggatgaggacggctctttcagcattcgcgatgttgaagagacgaatatgatcacactgcttgtgaagctggctctcatcaccgtctccgggctgtaccccctcgccattccggtgaccatgacactgtggtacatgtggcaagtgaaaacccaacggtctggagccctttgggacgttcctagccccgctgccacacagaaggcggctctgtccgaaggcgtctatagaatcatgcagcgcggcctgtttgggaaaacacaggtgggagtgggcattcacatggagggggtcttccacaccatgtggcatgtgacacggggatctgttatctgtcacgaaaccggcagactcgagcctagctgggccgatgtgcgcaacgacatgatttcctacgggggaggctggcggctgggcgataagtgggacaaagaggaagacgtccaagtgcttgccatcgagcccgggaagaatccgaagcatgttcagacaaaacctggactgttcaagaccctcacgggcgaaatcggggctgtgaccctggattttaaacccggaacaagcggctctcctattatcaacagaaaggggaaagtcattggcctctatggaaatggcgtggttaccaagtccggggactacgtgagcgccatcacacaggcggagcgcattggagagcccgattatgaagtcgacgaggatatcttccggaaaaagagactgaccattatggaccttcaccccggcgctgggaagacaaaacggatcctgccttctatcgtgcgcgaagccctgaagagacggctccgcacgctgattcttgccccgaccagagtggtcgctgccgagatggaagaggctctgcggggactccccatcagataccagacccctgctgttaaatccgagcataccggccgcgaaattgtggatctgatgtgccacgcgacctttacaacgcggctcctgagctccaccagagtgcccaactataatcttatcgtcatggacgaggcccacttcacagatccttctagcgtggctgcccgcgggtacatttccacccgggttgaaatgggcgaggctgccgccatctttatgacagctacaccccctggagcgacggacccgttcccccaaagcaactctcctatcgaagatattgagagagagatccccgaacgctcctggaatacaggctttgactggattaccgactaccaggggaagaccgtgtggttcgtccctagcatcaaagccggaaacgatattgctaactgcctgcggaagtctggcaagaaagtgatccagctgagcagaaagacatttgacaccgagtatcccaaaacaaagctcaccgattgggacttcgttgtgacgacagatatctccgaaatgggggccaattttcgcgccggaagagtcattgacccgcggcgctgtctgaaacctgtgatccttaccgatggccccgagagagtcattctggctgggcccatccctgtgacacccgcctctgcggctcaacggcgcggcagaattggacggaaccctgcccaggaagacgatcagtacgttttcagcggcgacccgctcaagaatgatgaggaccatgcccactggaccgaggctaagatgctgctggataacatctatacgcccgaagggattatccctaccctcttcggacccgagagagagaagacccaggccatcgacggcgagtttcgccttagaggggaacaacggaagaccttcgtggaactgatgcgccggggagacctgcctgtgtggctctcctacaaagtcgcgtctgccggcattagctataaggatagagagtggtgctttacaggcgaacggaataaccagatcctggaggaaaatatggaggttgagatttggacccgcgaaggggagaaaaagaaacttagaccccggtggctggacgctcgcgtgtacgccgatccgatggctctcaaagacttcaaggaatttgcctccggaagaaaaagcctgacactggatatcctcaccgagattgcttctcttcctacgtatctgtccagccgggccaagctggcgctcgacaacatcgtgatgctgcatacaaccgaacgcggcgggagagcctaccagcacgctcttaatgagctgcccgagtccctcgaaaccctgatgctggtcgccctccttggagctatgacagccggcatcttcctgtttttcatgcaggggaaaggaattggcaagctgtctatgggcctcatcaccattgccgtggctagcgggctgctttgggttgcggagatccaacctcagtggattgccgcttccatcatcctggaatttttcctcatggtgctgctgattcccgagcctgaaaagcagcggacaccccaggataaccaactcatctacgtcattcttacgatcctgaccattatcggactgattgccgccaatgagatgggcctcatcgagaaaacaaagaccgactttgggttctatcaggtgaaaacagaaaccacgatcctggatgtcgaccttcgcccggcttctgcctggaccctgtacgcggtggccacaaccattctcacacctatgctgagacacaccatcgagaacacgagcgctaatctgtccctcgccgctattgccaaccaggcggccgttcttatgggactgggcaaggggtggcccctgcatcggatggatctcggagtgcccctgcttgctatgggctgttatagccaggtcaatcctacaaccctgacagcctctctcgtgatgctgctggttcactacgctatcattggcccggggctccaagccaaagctaccagagaagcccagaagcgcaccgcggccggaatcatgaaaaaccccacagtggacggcatcacggtcattgatcttgagcctatctcctatgaccccaagtttgagaagcagctggggcaagtgatgctgctcgtgctgtgcgctggacagcttctgctcatgcggaccacatgggccttctgtgaagttctgaccctggctacaggccctattctcaccctttgggaggggaaccccggaagattctggaatacgacaatcgccgtcagcaccgccaacatttttcgcggctcttacctggcgggcgctgggctggccttctccctcatcaaaaatgctcagacccctcggagaggaacaggcaccacaggggaaacgctgggagagaagtggaaacgccagcttaacagcctggaccggaaggaatttgaggagtataaaagatctggcatcctcgaagtggatcgcaccgaggccaagagcgccctgaaggacgggtccaaaattaagcatgctgtgtctcggggaagctccaaaatcagatggattgtcgaacgcggcatggttaagccgaaaggcaaggtggtggatctggggtgcggacggggcgggtggagctactacatggccacactcaagaatgtcaccgaggtgaaaggatatacaaagggcgggcccggacacgaagaacctatccccatggcgacctacggctggaaccttgttaaactgcattccggcgtggacgtcttctataagcctacggagcaagtggataccctgctctgtgacattggggaatctagctccaatcccacaatcgaggaaggaagaaccctgcgcgttcttaaaatggtggagccgtggctgtctagcaagcctgaattttgcattaaggtcctcaacccctacatgcccacagtgatcgaggagctggaaaaactgcagagaaagcacggcgggaatctcgtgcggtgtcctctttcccgcaactctacccacgagatgtattgggtcagcggagcctccggcaatatcgttagctctgtgaacacaacctccaaaatgctgctgaatagattcacgacacggcatagaaagcccacctacgaaaaagatgtggacctcggggctggaacccggagcgtctctacagagacggagaagcctgatatgaccattatcggccgcagactgcagcggcttcaggaggaacacaaagaaacatggcattatgaccaagagaacccgtaccgcacctgggcctaccacggctcctatgaagctcccagcacagggtctgcctccagcatggtgaatggagttgtgaagctgctcaccaagccttgggatgtcattcccatggtgacacagctggcgatgaccgacacgaccccttttggccagcagagagttttcaaagagaaggtggacacacggacaccccagccgaaacctgggacacgcatggtcatgaccacgacagccaactggctgtgggctctcctgggaaagaaaaagaatcccagactttgcaccaaggaggaatttatctccaaagtgcgggccaacgctgccattggcgctgttttccaggaggaacaggggtggacaagcgcctctgaggcggtgaacgatagccgcttttgggaactggtcgacaaggagagagccctccaccaagagggcaaatgtgaatcctgcgtgtacaatatgatgggaaagcgggagaaaaagctgggcgagttcgggcgcgctaagggatctagagccatctggtatatgtggcttggcgctcggtttctggagttcgaagccctcgggttcctgaacgaggatcattggtttggacgcgagaatagctggtccggcgtcgaaggggagggcctgcacagactcggatacatcctggaagagattgacaaaaaggatggcgaccttatgtatgccgatgacaccgcggggtgggatacgcggatcaccgaggacgatctgcagaacgaggaactcattacagaacagatggctcctcatcacaaaatcctggccaaggccattttcaaacttacctaccagaataaggtggttaaggtgctgagacccacacctcgcggagctgtcatggacatcatctctcggaaagatcaaagaggcagcggacaggtgggaacctatggcctcaacacatttaccaatatggaggtgcagctgattcgccagatggaagccgagggggttatcacgcaagacgacatgcagaaccccaagggcctgaaagagcgggtggaaaagtggctcagagagtgcggagtcgatcgcctgaaacggatggctatttccggcgacgattgtgtggttaagccgcttgacgaaagattcgccacatctctgctctttctgaatgatatggggaaagtgcgcaaggacatccctcagtgggagcccagcaagggatggaaaaactggcaggaagtccccttctgctcccatcactttcacaagattttcatgaaagatggccggagccttgtggtcccttgtagaaatcaagacgagctgatcgggcgcgcgcggatctctcagggagccggctggtccctcaaggagaccgcttgcctggccaaggcttacgcccagatgtggagcctgatgtactttcatagacgggatctcagactggcgtctatggccatttgttccgctgtgccgaccgaatggttccccacaagccgcaccacatggtccatccacgcccatcaccagtggatgacgaccgaggacatgcttaaggtttggaaccgggtgtggattgaagataatcctaacatgatcgacaagacacccgtccactcttgggaggacattccttatctggggaaaagagaagatctctggtgcggcagcctgatcggactttccagccgcgctacctgggccaagaatattcatacagctatcacccaagtgagaaacctgatcggcaaagaggagtacatggactatatgcccgttatgcggcgctactctgccccttccgaaagcgagggggtgctctga

SEQ ID NO: 21069 - RNA, 9867 nt, synthetic construct
  misc_feature 1..9867: note = derived and/or modified CDS sequence (opt5) from DENV-4__KU523871__SS-prME
  source 1..9867: mol_type = other RNA
agcacaatgacactgctctgcctgatccccacggtgatggccttccacctttccacccgggacggcgaacctctgatgattgtcgctaagcatgaacgggggcgcccgctcctgtttaagacaaccgaagggatcaacaagtgtacacttattgccatggatctgggcgaaatgtgcgaggacaccgttacatacaagtgtcccctcctggtgaataccgaacctgaggatatcgactgctggtgtaacctgacgtctacctgggtgatgtatgggacatgcacccagaatggagagagacggcgcgaaaagagaagcgtcgccctcacaccccactccggcatggggctggagacccgggctgaaacgtggatgtctagcgagggagcctggaaacatgcccagcgcgtggagtcctggattcttagaaaccctggcttcgctctgctcgccggctttatggcttacatgatcgggcagacaggaatccagcggattgttttctttgtgctgatgatgcttgtcgccccctcttatggcatgcgctgtgtgggggttggaaatagagatttcgtggaaggcgtcagcgggggagcgtgggtggacctggtgctcgagcacggcggctgcgtcaccacaatggcccaggggaagcctaccctggattttgaactgaccaagacaacggctaaagaggttgccctcctgcggacctactgtatcgaggcttccattagcaacatcacaaccgccacacgctgcccgacccaaggagagccctatcttaaggaggaacaggaccagcagtacatttgtagacgggatgtggtggaccgcggctgggggaatggatgcggcctgttcgggaaaggaggcgtcgtgacgtgcgcgaagttttcttgttccggcaaaatcacagggaacctcgttcaaattgagaatctggaatataccgtggtcgtgaccgttcataacggagatacacacgccgtgggcaatgacaccagcaaccacggggtcacagctacgatcacccctagatctccctccgtggaggtcaaacttcctgattacggagaactgacactcgactgcgagccccggagcggcatcgacttcaatgagatgattctgatgaagatgaaaaagaaaacctggctggtgcataagcagtggtttctcgatctgccgcttccttggacagccggggctgacacctctgaagttcactggaaccataaagagagaatggtgacgttcaaggtcccccacgccaaacgccaggatgtgaccgttctgggctcccaggaaggagccatgcacagcgctctcgcgggcgccacagaggtggactccggggatggaaatcatatgtttgctggccacctgaagtgtaaggtccggatggaaaaacttagaatcaaggggatgtcttacaccatgtgcagcggaaaattctccattgacaaggagatggccgagacacaacatggcaccacggtggtgaaagttaagtatgaaggggccggcgctccttgtaaggtccccatcgagattcgcgatgtgaacaaagaaaaggtggtcggacggatcatcagctctacacccttcgccgagaacaccaattccgtgacaaacattgagctggaacctccgtttggcgacagctacatcgttattggggtgggagagtctgcgctcaccctgcactggttcagaaaaggcagctccatcgggaagatgtttgaatctacctatcgcggagctaaacggatggccattctgggcgagacagcctgggatttcgggagcgtcggcggactctttacgtccctgggcaaggctgtgcatcaggttttcgggagcgtgtacaccacaatgtttggaggcgtctcttggatggtgagaatccttatcgggttcctggttctctggattggaaccaattcccgcaacacaagcatggccatgacctgcatcgctgtgggcgggattacgctgtttctgggcttcacagtccaggccgacatgggatgtgtggtgtcttggtccggcaaggaacttaaatgcgggagcggaatctttgtcgttgataatgtgcacacctggaccgagcaatataagttccagcccgagtcccctgcgcggctcgcctctgctattctgaacgcccacaaagacggcgtgtgtgggatcagaagcacaacccgcctggaaaatgtcatgtggaagcagattacaaacgagctcaattacgtgctgtgggaaggaggccatgaccttacggttgtggctggcgatgtcaaaggggtgctgacccggggaaagagagccctcacaccccctgttaacgacctgaagtattcctggaaaacctggggcaaggcgaaaatctttacacccgaggccagaaattctaccttcctgatcgatgggccggacacgagcgaatgccctaacgagcgcagagcttggaatttctttgaggtggaagattacggattcggcatgtttaccacaaacatttggatgaagttccgggaggggtccagcgaagtctgtgaccacagacttatgtctgccgctatcaaagatcagaaggccgtgcatgccgacatgggatactggattgagtccagcaaaaatcaaacctggcagatcgaaaaggcttctctcattgaggttaagacatgcctgtggcccaaaacccacacactgtggtccaacggcgtgctcgagagccagatgctgatccctcgctcttatgcgggcccctttagccagcacaactaccggcaagggtatgccacccagacggtcggaccttggcatcttggcaagctggaaatcgatttcggggagtgccccggaacaaccgtggctattagagaagactgtgatcaccgcggcccgtccctcagaaccacaaccgccagcgggaaactggtgacgcagtggtgctgtcggtcttgcacaatgcctcccctgcgctttcttggagaggacggctgttggtacggcatggagatcagacccctctccgaaaaggaggaaaatatggtcaaaagccaggccaccgctgggcaaggaacatccgagaccttctctatgggcctgctgtgcctcacactgtttgttgaagagtgtcttcggcgcagagtgacccggaagcatatgattctggtggtcgtgatcacgttctgcgccattatcctcgggggactgacctggatggatctgcttcgcgcgctcatcatgctgggcgacacaatgagcgggagaattggaggccagatccacctggctattatggccgtttttaagatgtcccctggctatgtgctcggggtcttcctgcggaaacttacctctcgcgagacagccctgatggtgatcggaatggctatgaccacggtttttagcattccgcatgacctcatggaactgatcgatggcatctccctggggcttattctgctcaagatcgtgacacacttcgacaacacccaggtcggaacactggccctctctctgaccttccttagaagcaccacacccctggtgatggcgtggcggacgattatggctgtctttttcgtggttaccctcatccctctgtgtagaacatcctgcctgcagaaacaaagccactgggtggagattaccgcccttatcctgggcgcccaggctctccccgtctacctgatgacactcatgaagggggcctctcgccggtcctggcctctgaatgaaggaattatggctgtgggccttgttagcctgctcggctctgccctgctgaaaaacgatgtgccccttgcggggcctatggtcgccggaggcctgctcctggctgcctatgtgatgtccgggagctctgctgacctctccctggagaaggccgccaatgtgcagtgggatgaaatggctgacatcaccggaagctcccccatcattgaggttaagcaagatgaggacggcagcttttctatcagagatgtcgaagagacgaacatgatgacacttctggtgaaactggcgctcattaccgtgagcgggctgtacccgcttgccatccctgtcaccatggctctgtggtacatttggcaagtgaagacacagcgctccggagccctctgggacgttccctctcctgccgctacccagaaagccacactgagcgaaggcgtgtatcggatcatgcaaagaggcctcttcgggaagacgcaggtcggagtgggcatccatatggagggggtttttcacaccatgtggcatgtgacacgcggatccgtcatttgtcacgaaaccggccggctggagccctcttgggcggatgtgagaaatgacatgatcagctacgggggaggctggcgccttggcgataaatgggacaaggaggaagacgttcaggtgctggctattgagccggggaagaaccctaaacatgtccagacaaagcccggactgttcaaaaccctcacgggcgaaatcggggccgtgaccctggattttaagcctggaacatccggctctcccattatcaataaaaaggggaaagtgatcggcctttatggaaacggcgtcgttaccaagagcggggactacgtgtccgccattacacaagctgagcggatcggagagcccgattatgaagtggacgaggatattttcagaaagaaacggctgaccatcatggacctccaccctggcgccgggaagacaaaacgcattctgccgagcatcgtcagagaagcgctcaagcggcgcctgagaacgcttattctggctcccacccgggtggttgccgccgagatggaagaggctctgagaggactccctatccgctaccagacacccgccgtgaaatctgagcacaccggccgggaaatcgtcgatctgatgtgccatgctacctttacaacgagacttctgtccagcacccgcgtgcctaattataacctcattgttatggacgaggcccacttcacagatccctgctctgtggcggcccgggggtacatctccaccagagtcgaaatgggcgaggctgccgctatttttatgacagccacccctccgggagccacggaccccttccctcagagcaattcccccatcgaagatattgagcgcgagatccctgaacggtcttggaacacaggcttcgactggatcaccgactaccaggggaagaccgtgtggtttgtccccagcattaaggctggaaatgatatcgcgaactgtctgagaaaatccggcaagcgcgtgattcaactcagcagaaaaacattcgacaccgagtatccgaagacaaaactgaccgattgggactttgttgtgacgacagatatctctgaaatgggggccaacttccgggctggacgcgtgattgaccctagacggtgccttaagcccgtcatcctgaccgatggccccgagcgcgttatcctggccgggcctattcccgtgacccctgcctccgctgcccagagacggggcagaatcggacgcaatccggcgcaggaagacgatcaatacgtgtttagcggcgaccccctcaagaacgatgaggaccatgctcactggaccgaggccaaaatgctgcttgataatatttatacgcctgaagggatcattcccaccctgttcggacctgagcgggaaaagacacaggccatcgacggcgagtttagactccgcggggagcagcggaaaaccttcgtcgaactgatgaagagaggagacctgcccgtgtggctctcttacaaagttgctagcgccggcatttcctataaggatcgggagtggtgttttacaggcgaacgcaacaatcagatccttgaggaaaacatggaggtggagatctggaccaaggaaggggagaaaaagaaactgagaccgaagtggctggacgcgcgggtctacgccgatcctatggctctcaaagacttcaaggaatttgcctctggacgcaagagcattacactggatatccttaccgagattgcttccctgcccacgtatctctctagcaaagccaagctggctctggacaatatcattatgctccacacaaccgaaaaaggcgggagagcctaccaacatgcgcttaacgagctgcctgagtccctggaaaccctcatgctggtggcccttctgggagctatgacagccggcatcttcctctttttcatgcaggggaagggaatcggcaaactgagcatgggcctgattgctatcgccgtcgcctctgggctcctttgggtggctgagattcagccccagtggatcgcggcctccattatcctggagttctttctgatggttctcctgatccctgagcccgaaaagcaacggaccccgcaggataatcagcttatttacgtgatcctgacaattctcacgatcattggactgatcgctgccaacgagatgggcctgattgagaaaaccaagacagacttcgggttttatcaggtcaagaccgaaacaaccatcctcgatgtggaccttcgccctgccagcgcttggacgctgtacgccgttgcgaccacaatcctgacccccatgctcagacacacaattgagaatacctccgccaacctgtctcttgctgccatcgctaatcaagccgcggtgctgatgggactcggcaaagggtggcccctgcatcggatggatctgggagtccctctccttgccattggctgctatagccaggtgaacccgacgacactgaccgcttccctggtgatgctcctggttcactacgccatcattggccccgggcttcaggctaaggccacacgcgaagctcagaaaagaaccgccgcgggaatcatgaagaatcctaccgtcgacggcatcacagtgattgatctggagcccatctcttatgaccctaaattcgagaagcaactcggacaggtgatgctgctggtcctctgtgccggacagcttctgctgatgcggacgacctgggctctctgcgaagttctgacacttgccaccggccccgctatgacactgtgggaggggaaccctggaagattttggaacaccacgattgccgtgagcacagccaatatcttccgcggctcctacctcgcgggcgctgggctggcctttagcctgattaagaacgctcaaaccccgcggagaggaaccggcacaaccggggaaacactcggagagaaatggaagcgccagcttaattctctggaccggaaagagttcgaagagtataagagatccggcatcctggaagtggatcgcacggaggccaaaagcgccctcaaggacgggtctaagatcaaacatgctgtctcccggggaagctctaagattagatggatcgtggaacgcggcatggttaaacccaagggcaaagtggtcgatctggggtgtggacggggcgggtggagctactacatggccacccttaagaacgtgacagaggttaagggatataccaaaggcgggcctggacacgaagaacccattcctatggcgacatacggctggaatctggtgaagctccactccggcgtcgacgtgttttataaacccaccgaacaggtggatacgctgctgtgcgacatcggggaatctagctccaacccgaccattgaggaaggaagaacactccgcgtccttaagatggttgagccttggctgagctccaaacccgagttctgtatcaaggtgctgaatccctacatgcctaccgtgattgaggagctcgaaaaactgcagcggagacatggcgggtctcttgtccgctgccccctgagcagaaactccacacacgagatgtattgggtgtctggagccagcggcaatatcgtttcctctgtgaacaccatcagcaagatgctcctgaatcggtttacaacccgccatagaaagcctacgtacgaaaaagatgtcgacctgggggctggaacacggtccgtgagcaccgagaccgagaagccggatatgacaattatcggcagacggctccaacgccttagagaagaacacaaagaaacgtggcactatgaccaggagaacccctaccggacctgggcctaccatggctcttatgaagctccttccacagggagcgcctcttccatggttaatggagtggtcaagctgctgaccaaaccctgggatgtggttcctatggtgacacagctcgcgatgaccgacacaacccccttcggccagcaacgcgtctttaaggagaaggtggacacgagaaccccgcagcctaaacccgggacacggatgattatgaccacaaccgccaactggctgtggacgcttctgggaaagaaaaagagccctcgcctctgtacaagagaggagttcatctctaaagtccggtccaatgctgccattggcgctgtgttccaggaggaacaggggtggaccagcgcctccgaggctgttaacgatagccgcttttgggaactggtggacaaggagagagccctgcaccaagagggcaagtgcgaatcttgcgtctacaatatgatgggaaaacgggagaagaaactcggcgagttcgggcgcgcgaagggaagcagagccatgtggtatatgtggctgggcgctcggtttcttgagttcgaagccctggggtttctcaacgaggatcattggttctcccgcgagaactcttggagcggagtggaaggcgaggggctgcacagacttggctacatcctggaagacatcgataaaaaggacggagatctcatttatgctgacgatacagccggctgggacacccggatcacggaggatgacctgctgaatgaggaactcattaccgagcagatggcgccccatcacaagacactggcgaaagctatctttaaacttacctaccagaacaaagtggttaaggtgctgagacctacacccaaaggggccgtcatggatattatctcccgcaaggaccaacggggatctggccaggtggggacctatggactcaatacattcaccaacatggaagttcagctgatcagacagatggaggccgaaggcgtgattacgcaagacgatatgcagaatccgaaagggcttaaggagcgcgtcgagaagtggctgacagaatgtggcgtggaccggctcaaaagaatggctatcagcggagatgactgcgtcgtgaagcctctggatgagcgcttttccacctctctcctgttcctgaacgacatgggcaaagttcggaaggatattccccagtgggaacccagcaaagggtggaagaattggcaggaggtgcctttttgttcccaccatttccacaagatctttatgaaagacggaagaagccttgtcgtgccgtgccgcaaccaagatgaactgattggccgggccagaatctctcagggggctggatggtccctccgcgagaccgcctgtctgggcaaggcgtacgcccagatgtggagccttatgtacttccatcggagagacctgcggctcgcttctatggccatctgctccgctgttcccacagagtggttccctaccagcagaacaacgtggtccattcacgcccaccatcagtggatgaccacagaagatatgctgaaagtgtggaatcgcgtctggatcgaggacaaccccaatatgaccgacaagacacctgtgtattcttgggaagatattccctacctggggaaacgggaggacctctggtgtggcagcctgatcggactttccagcagagcgacctgggccaagaacattcacacggctatcacccaagtgcgcaatctgattggcaaggaagattatgttgactacatgcctatcatgaaaagatattctgccccctccgagagcgagggggtcctctga

SEQ ID NO: 21070 - RNA, 9867 nt, synthetic construct
  misc_feature 1..9867: note = derived and/or modified CDS sequence (opt5) from DENV-4__HQ332175__SS-prME
  source 1..9867: mol_type = other RNA
agcaccatcacactgctctgcctgattcccacggtgatggccttccacctttccaccagagacggcgagcctctgatgatcgtcgctaagcatgaacgggggcgcccgctcctgtttaaaacaaccgagggaattaacaagtgtacacttatcgccatggatctgggcgaaatgtgcgaggacaccgttacatacaaatgtcccctcctggtgaataccgaacctgaggatattgactgctggtgtaacctgacgtctacctgggtgatgtatgggacatgcacccagagcggagagagacggcgcgaaaagagatccgtcgcgctcacaccccactctggcatggggctggagacccgggctgaaacgtggatgagctccgagggagcctggaaacatgcccaacgcgtggagtcttggatccttagaaatcctggcttcgctctgctcgccggctttatggcttacatgatcgggcagacaggaattcagcggaccgttttctttgtgctgatgatgcttgtcgcccccagctatggcatgcgctgtgtgggggttggaaacagagatttcgtggaaggcgtctccgggggagcgtgggtggacctggtgctcgagcacggcggctgcgtcacaaccatggcccaggggaagcctaccctggattttgaactgacaaagacgaccgctaaagaggttgccctcctgcggacatactgtatcgaagctcttattagcaatatcaccacagccacccgctgcccgacgcaaggagagccctatctgaaggaggaacaggaccagcagtacatttgtagacgggatgtggtggaccgcggctgggggaacggatgcggcctcttcgggaaaggaggcgtcgtgacatgcgcgaagttttcttgttccggcaaaatcaccgggaatctggttcaaattgagaaccttgaatataccgtggtcgtgacagttcataatggagatacccacgccgtgggcaacgacacaagcaatcacggggtcacggctaccatcacacctagatctccctccgtggaggtcaagctgcctgattacggagaactcaccctggactgcgagccccggagcggcatcgacttcaacgagatgattctgatgaagatgaaaaagaaaacatggctcgtgcataagcagtggtttctggatcttccgctgccttggaccacgggggccgacacctctgaagttcactggaattacaaagagagaatggtgacattcaaggtcccccatgctaaacgccaggatgtgaccgttctcggctcccaggaaggagccatgcacagcgccctggctggcgcgacagaggtggactccggggatggaaaccacatgtttgccggccatcttaagtgtaaggtccggatggaaaaactgagaatcaaggggatgtcttataccatgtgcagcggaaaattctccattgacaaggagatggctgagacgcaacacggcacaaccgtggtgaaagttaagtacgaaggggccggcgccccttgtaaggtccccatcgagattcgcgatgtgaataaagaaaaggtggtcggacgggtgatcagcgctacacccctcgccgagaacaccaactctgttaccaatatcgagctggaacctccgttcggcgactcctatattgtgatcggggtcggaaacagcgcgctgacactccattggtttagaaaaggctctagcattgggaagatgttcgagtccacgtaccgcggagctaaacggatggccatcctgggcgaaaccgcctgggattttgggtctgtgggcggacttttcacaagcctgggcaaggctgttcaccaggtgtttgggtccgtctataccacaatgttcggaggcgtgagctggatgattagaatcctcatcgggtttctggttctgtggattggaaccaattctcgcaacacgtccatggccatgacatgcatcgctgtgggcgggattacccttttcctcggctttaccgtccaggccgacatgggatgtgtggtgagctggtctggccgggagctgaagtgcgggtccggaatcttcgtcgttgataatgtgcatacatggaccgaacaatacaaatttcagcccgagagccctgcgagactggcctccgctattctcaacgcccacaaggacggcgtgtgtgggatccgctctacaacgcggctggagaatgtcatgtggaaacagattaccaacgaacttaattatgtgctgtgggagggaggccacgacctcacagttgtggctggcgatgtcaagggggtgctgaccaaaggaaagagagccctgacaccccctgcgagcgaccttaagtactcctggaaaacctggggcaaggccaaaatcttcacgcccgaagctcggaactctacctttctcatcgatgggccggacacaagcgagtgccctaatgaacgcagagcctggaactccttcgaggttgaggattacggattcggcatgtttaccacaaatatttggatgaagttccgggaagggagctctgaggtgtgtgaccatagactgatgtccgctgccatcaaagatcagaaggccgtccacgctgacatgggatattggattgaaagctctaaaaaccaaacctggcagatcgagcgcgcgtccctgattgaagtgaagacatgcctctggcccaagacccatacgctgtggagcaatggcgttcttgagtctcagatgctgatccctaaaagctacgccggccccttttcccagcacaactatcggcaagggtacgctacacagaccgtgggaccttggcacctcggcaagctggagatcgatttcggggaatgccccggaaccacagtcaccattcaggagaactgtgaccatagaggcccgagcctgcgcacgacaaccgcctctgggaaacttgtgacacagtggtgctgtagatcctgcaccatgcctcccctccggtttctgggagaagatggctgttggtatggcatggagatccgccccctgagcgagaaggaagagaatatggtgaaatcccaagtcacagccgggcagggaacctctgaaacgttcagcatgggcctcctgtgccttaccctgtttgttgaggaatgtctcagacggcgcgtgacaagaaagcacatgattctggctgtggtcatcaccctgtgcgccattatccttgggggactcacatggatggacctgctgcgggcgctcatcatgctgggcgataccatgtccgggcgcattggaggccagacgcatcttgctatcatggccgtgttcaagatgtctcctggctacgttctgggggtgtttctcagaaaactgacaagccgggagaccgccctgatggtcattggaatggctatgacaaccaccctttccatcccgcacgacctgatggagctcattgacggcatctctctggggctcatcctgcttaagattgtgacacagttcgataacacgcaagttggaaccctggccctcagcctgacatttatccgctccaccatgagcctggtgatggcgtggagaacaattatggctgtccttttcgtggtcaccctgatccccctctgtcggacgtcttgcctgcagaaacagtcccattgggtggaaattacagccctcatcctgggcgcccaagctcttcctgtttatctgatgaccctcatgaagggggccagcagacgctcttggcccctgaatgagggaattatggctgtgggcctggtctcccttctgggcagcgccctcctgaaaaacgacgtgcctctcgcggggcccatggttgccggaggcctgcttctggctgcctacgtgatgtctgggtccagcgtcgatctgtccctcgaaaaggctgccaatgtgcagtgggacgagatggccgatatcaccggaagctctcctatcattgaagtgaagcaggacgaggatggcagcttttccatccgggacgttgaggaaacaaacatgattaccctgcttgtcaaactggctctcatcacagtgtctgggctgtaccccctcgcgattccgatcacgatgaccctgtggtatatgtggcaggtgaagacacaaagaagcggagccctttgggatgtcccttcccccgctgccacccagaaagccgctctgtctgagggcgtgtaccgcatcatgcagcggggcctgttcgggaagacacaggttggagtgggcattcacatggaaggggtcttccacaccatgtggcatgtgacgagaggaagcgttatctgtcacgagaccggccgcctcgaaccttcctgggccgacgtgcggaatgatatgatttcttatgggggaggctggagactgggcgacaaatgggataaggaggaggacgtccaagtgcttgcgatcgaacccgggaagaacccgaaacatgttcagacaaagcctggactgtttaaaaccctcacaggcgagattggggctgtgaccctggacttcaagcccggaacaagcggctcccctatcatcaatcgcaaagggaaggtcattggcctctacggaaacggcgtggtgacgaaaagcggggattatgtctctgccatcacccaggccgaacggattggagagcccgactacgaggttgatgaagacatctttagaaagaagcggctgacaattatggatcttcaccccggcgctgggaaaaccaagcgcatcctgccttccattgtgagagaggccctgaaacggcgcctcagaaccctgatccttgcgccgacacgggtggtcgctgccgaaatggaggaagccctgagaggactccccatccgctatcagacgcctgctgtgaagagcgagcataccggccgggagattgttgacctgatgtgccacgccacattcaccacaagactcctgtcttccacccgcgtgcccaattacaaccttatcgtcatggatgaagctcactttacggaccctagctccgtggccgcgcgggggtacatttctacaagagttgagatgggcgaagccgctgccatcttcatgaccgctaccccccctggagccacagatccgtttccccaaagcaattcccctattgaggacatcgaacgcgagatccccgagcggagctggaacaccggcttcgattggattacagactatcaggggaaaaccgtgtggtttgtcccttctatcaaggccggaaatgacattgctaactgcctgagaaagtccggcaaaaaggtgatccagctgagccgcaaaacgttcgatacagaataccccaagaccaaactcacagactgggattttgtcgtgaccacggacatttctgagatgggggcgaacttcagagccggacgggttatcgatccgcgcagatgtctgaagcctgtgatccttaccgacggccccgaacgggtgattctggctgggcccatccctgtcacacccgccagcgccgctcaacgcagaggccggattggaagaaatcctgcccaggaggatgaccagtatgttttctccggcgatccgctcaagaacgacgaagatcatgcgcactggaccgaggctaaaatgctgctggacaatatctacacacccgaggggattatccctaccctctttggacccgaacgcgagaagacacaggccattgatggcgaattccggcttagaggggagcaacgcaaaacctttgtggagctgatgcggagaggagacctgcctgtgtggctctcttataaggtcgccagcgctggcatctcctacaaagaccgggaatggtgcttcacgggcgagcgcaacaatcagatcctggaagagaacatggaagtggagatttggacaagagagggggaaaagaagaaacttcggcccaagtggctggatgcccgcgtttatgcggacccgatggccctcaaagattttaaggagttcgcttctggaagaaaaagcatcaccctggacattctgaccgaaatcgcctccctccctacataccttagctctcgggctaagctggccctggataatattgtgatgctccataccacagagcgcggcgggagagcttaccagcacgccctgaacgaacttcccgagtccctggagacgctcatgctggtcgcgctgctcggagccatgaccgctggcatctttcttttctttatgcaggggaagggaatcggcaaactgagcatgggcctgattacaatcgccgtggcttccgggctcctgtgggtcgccgaaattcaacctcagtggatcgccgcttctattatccttgagttctttctgatggtgctcctgatccccgaacctgagaagcagcggaccccccaggacaatcaactgatttatgttatcctcacaattcttaccatcattggactgatcgcggccaacgaaatgggcctgattgagaaaacgaagaccgatttcgggttttaccaggtgaaaacagagaccacaatcctcgacgtcgatctgcgcccggctagcgcctggaccctttatgccgtggctacgacaatcctgacccctatgctcagacacacaattgaaaatacctccgccaacctgtctctggcggccatcgctaatcaggccgctgttctcatgggacttggcaaggggtggcccctgcatcggatggacctgggagtgcccctcctggccatgggctgttacagccaggtcaaccctaccacacttacggcgtccctggtgatgctcctggtgcactatgccattatcggcccggggctgcaagctaaagccaccagagaggctcagaagcgcacagccgctggaattatgaagaatcccaccgttgatggcatcacagtcatcgacctcgaacctattagctacgatcccaaattcgagaagcagcttgggcaagtgatgctgctggtgctctgcgccggacagctgcttctgatgcggaccacgtgggcgttctgtgaggtcctcacactggccaccggccctatcctgaccctctgggaagggaaccccggaagattttggaacacaaccattgctgtttctacagccaatatcttccgcggctcctatcttgctggcgccgggctggcctttagcctgattaaaaacgcgcagacgcctcggagaggaaccggcacaaccggggagacactcggagaaaagtggaaacgccagctgaattctcttgaccggaaggagttcgaagagtacaagagatccggcatcctggaggtggaccgcaccgaagctaaaagcgccctcaaggatgggtctaaaatcaagcatgctgtgagccggggatcctctaaaattagatggatcgtcgagcgcggcatggtgaagccgaagggcaaagttgtggacctggggtgcggacggggcgggtggagctactatatggccacgctgaagaacgtcaccgaagtgaaaggatacacaaagggcgggcccggacacgaggaacctattcccatggccacctatggctggaatctcgttaaacttcattccggcgtggatgtcttttacaagcctacagagcaagtggacaccctgctgtgtgatatcggggagagctcctctaaccccacaattgaagagggaagaaccctccgcgtgctgaagatggtcgaaccgtggcttagctccaaacctgagttctgcatcaaggttctgaatccctatatgcccacggtgattgaagagctcgagaaactgcagagaaagcacggcgggaacctggtgcggtgtcctctctctcgcaatagcacacacgaaatgtactgggtctccggagcttctggcaacatcgtgagctccgttaataccaccagcaaaatgcttctgaacagatttacaacgcggcatagaaagcccacctatgagaaagacgtggatctgggggccggaacacggtctgtctccaccgaaacagagaagcctgacatgaccatcattggccgcagactccagcggctgcaggaggaacacaaggagacatggcattacgatcaagaaaatccgtaccgcacctgggcgtatcacggcagctacgaggccccctctacggggtccgctagctctatggtgaacggagttgtgaaacttctgaccaagccttgggacgtcatccccatggtgacacagctcgccatgaccgatacaacccctttcggccagcagagagtttttaaagaaaaggtggacacgcggacaccccaaccgaaacctgggacccgcatggtcatgacaaccacggctaattggctgtgggccctgctcggaaagaagaaaaaccccagactgtgcacccgggaggagttcatttccaaggtgcgcagcaatgcggccatcggcgctgtctttcaggaagagcaggggtggacatccgccagcgaagctgtgaacgactctagattctgggagcttgttgataaagaacgggccctgcaccaagagggcaagtgtgagagctgcgtgtataacatgatgggaaaacgcgaaaagaagctcggcgagtttgggagagctaaaggatcccgggccatttggtacatgtggctgggcgcgcgcttccttgaattcgaggccctggggtttctcaatgaagaccattggttcggaagagagaactcttggagcggcgtcgagggggaaggcctgcaccggctgggatatatcctcgaggaaatcgataagaaagacggcgatctgatgtacgctgacgataccgccgggtgggacacaagaattaccgaggatgaccttcagaatgaggaactgatcacagagcagatggctcctcatcacaagattctcgccaaagccatctttaagctgacctatcagaacaaggtggtgaaagttcttcgccccacgcctcggggagcggtgatggatattatctccagaaaggaccaacgcggctctgggcaggtcggaacatacggcctgaataccttcaccaacatggaagtgcagctcatccggcagatggaggctgaaggggttattacacaagatgacatgcagaatcccaaaggcctgaaggagagagtggagaaatggctgcgcgaatgcggagtcgaccggctcaagagaatggccatcagcggcgatgactgtgtggtcaaaccgctggatgagcgctttgggacctcccttctgttcctcaacgacatgggaaaggtgcggaaggatattcctcagtgggaaccctctaaaggctggaagaattggcaggaggttcccttttgcagccatcacttccacaaaatctttatgaaggacgggagatccctggtggtcccttgtcgcaaccaagatgaacttattggacgggccagaatcagccagggcgctgggtggtctctgcgggagacagcctgcctcggcaaagcttacgcccagatgtggtccctgatgtatttccatagacgcgacctgcggctcgcgagcatggccatctgttctgctgtgccgacggagtggtttcccacctccagaacaacctggagcattcacgcccatcaccagtggatgacaaccgaagatatgctgaaggtttggaatcgcgtgtggatcgaggacaaccctaatatgattgataagacgcccgtccactcctgggaagacatcccttaccttggaaaaagagaggacctgtggtgcggctctctcattgggctgagctcccgggctacctgggccaagaacatccatacagcgattgcccaagtgcgcaatcttatcggaaaagaagagtatgtggattacatgcccgttatgaagagatatagcgctccttctgagtccgaaggcgtcctgtga

SEQ ID NO: 21071 - RNA, 9867 nt, synthetic construct
  misc_feature 1..9867: note = derived and/or modified CDS sequence (opt5) from DENV-4__HQ332172__SS-prME
  source 1..9867: mol_type = other RNA
agcaccatcacactgctctgcctgattcccacggtgatggccttccacctttccaccagagacggcgagcctctgatgatcgtcgctaagcatgaacgggggcgcccgctcctgtttaaaacaaccgagggaattaacaagtgtacacttatcgccatggatctgggcgaaatgtgcgaggacaccgttacatacaaatgtcccctcctggtgaataccgaacctgaggatattgactgctggtgtaacctgacgtctgcgtgggtgatgtatgggacctgcacacagagcggagagagacggcgcgaaaagagatccgtcgctctcaccccccactctggcatggggctggagacacgggccgaaacctggatgagctccgagggagcctggaaacatgctcaacgcgtggagtcttggatccttagaaatcctggcttcgccctgctcgctggctttatggcctacatgatcgggcagacgggaattcagcggacagttttctttgtgctgatgatgcttgtcgcgcccagctatggcatgcgctgtgtgggggttggaaacagagatttcgtggaaggcgtctccgggggagcctgggtggacctggtgctcgagcacggcggctgcgtcaccacaatggctcaggggaagcctaccctggattttgaactgaccaagacaacggccaaagaggttgctctcctgcggacctactgtatcgaagcccttattagcaatatcacaaccgcgacacgctgcccgacccaaggagagccctatctgaaggaggaacaggaccagcagtacatttgtagacgggatgtggtggaccgcggctgggggaacggatgcggcctcttcgggaaaggaggcgtcgtgacgtgcgccaagttttcttgttccggcaaaatcacagggaatctggttcaaattgagaaccttgaatataccgtggtcgtgaccgttcataatggagatacacacgctgtgggcaacgacaccagcaatcacggggtcacagccacgatcacccctagatctccctccgtggaggtcaagctgcctgattacggagaactcacactggactgcgagccccggagcggcatcgacttcaacgagatgattctgatgaagatgaaaaagaaaacctggctcgtgcataagcagtggtttctggatcttccgctgccttggacaaccggggctgacacgtctgaagttcactggaattacaaagagagaatggtgaccttcaaggtcccccatgccaaacgccaggatgtgacagttctcggctcccaggaaggagccatgcacagcgctctggcgggcgccaccgaggtggactccggggatggaaaccacatgtttgctggccatcttaagtgtaaggtccggatggaaaaactgagaatcaaggggatgtcttatacaatgtgcagcggaaaattctccattgacaaggagatggccgagacccaacacggcacgacagtggtgaaagttaagtacgaaggggccggcgctccttgtaaggtccccatcgagattcgcgatgtgaataaagaaaaggtggtcggacgggtgatcagcgccacccccctcgcggagaacacaaactctgttaccaatatcgagctggaacctccgttcggcgactcctatattgtgatcggggtcggaaacagcgctctgaccctccattggtttagaaaaggctctagcattgggaagatgttcgagtccacataccgcggagccaaacggatggccatcctgggcgaaacggcttgggattttgggtctgtgggcggacttttcaccagcctgggcaaggccgttcaccaggtgtttgggtccgtctatacaaccatgttcggaggcgtgagctggatgattagaatcctcatcgggtttctggttctgtggattggaacaaattctcgcaacacctccatggctatgacgtgcatcgccgtgggcgggattacacttttcctcggctttaccgtccaggcggacatgggatgtgtggtgagctggtctggccgggagctgaagtgcgggtccggaatcttcgtcgttgataatgtgcatacctggacagaacaatacaaatttcagcccgagagccctgccagactggcttccgccattctcaacgctcacaaggacggcgtgtgtgggatccgctctaccacacggctggagaatgtcatgtggaaacagattacgaacgaacttaattatgtgctgtgggagggaggccacgacctcaccgttgtggccggcgatgtcaagggggtgctgacaaaaggaaagagagcgctgaccccccctgccagcgaccttaagtactcctggaaaacatggggcaaggctaaaatcttcacccccgaagcccggaactctacgtttctcatcgatgggccggacaccagcgagtgccctaatgaacgcagagcttggaactccttcgaggttgaggattacggattcggcatgtttacaaccaatatttggatgaagttccgggaagggagctctgaggtgtgtgaccatagactgatgtccgccgccatcaaagatcagaaggctgtccacgcggacatgggatattggattgaaagctctaaaaaccaaacatggcagatcgagcgcgcctccctgattgaagtgaagacctgcctctggcccaagacacataccctgtggagcaatggcgttcttgagtctcagatgctgatccctaaaagctacgctggccccttttcccagcacaactatcggcaagggtacgccacgcagacagtgggaccttggcacctcggcaagctggagatcgatttcggggaatgccccggaaccaccgtcacaattcaggagaactgtgaccatagaggcccgagcctgcgcaccacgacagcctctgggaaacttgtgacccagtggtgctgtagatcctgcacaatgcctcccctccggtttctgggagaagatggctgttggtatggcatggagatccgccccctgagcgagaaggaagagaatatggtgaaatcccaagtcaccgctgggcagggaacatctgaaaccttcagcatgggcctcctgtgccttacgctgtttgttgaggaatgtctcagacggcgcgtgaccagaaagcacatgattctggccgtggtcatcacactgtgcgcgattatccttgggggactcacctggatggacctgctgcgggctctcatcatgctgggcgatacaatgtccgggcgcattggaggccagacccatcttgccatcatggccgtgttcaagatgtctcctggctacgttctgggggtgtttctcagaaaactgacgagccgggagacagctctgatggtcattggaatggccatgaccacaaccctttccatcccgcacgacctgatggagctcattgacggcatctctctggggctcatcctgcttaagattgtgacccagttcgataacacacaagttggaacgctggcgctcagcctgacctttatccgctccacaatgagcctggtgatggcttggagaaccattatggccgtccttttcgtggtcacactgatccccctctgtcggacctcttgcctgcagaaacagtcccattgggtggaaattacggccctcatcctgggcgctcaagcccttcctgtttatctgatgacactcatgaagggggctagcagacgctcttggcccctgaatgagggaattatggccgtgggcctggtctcccttctgggcagcgcgctcctgaaaaacgacgtgcctctcgccgggcccatggttgctggaggcctgcttctggccgcttacgtgatgtctgggtccagcgccgatctgtccctcgaaaaggccgctaatgtccagtgggacgagatggcggatatcaccggaagctctcctatcattgaagtgaagcaggacgaggatggcagcttttccatccgggacgtggaggaaaccaacatgattacactgcttgttaaactggccctcatcaccgtctctgggctgtaccccctcgctattccgatcacaatgacgctgtggtatatgtggcaggtgaagacccaaagaagcggagccctttgggatgtgccttcccccacagccacccagaaagctgccctgtctgagggcgtctaccgcatcatgcagcggggcctgttcgggaagacacaggtgggagttggcattcacatggaaggggtgttccacaccatgtggcatgtcacgagaggaagcgtgatctgtcacgagaccggccgcctcgaaccttcctgggcggacgttcggaatgatatgatttcttatgggggaggctggagactgggcgacaaatgggataaggaggaggacgtgcaagtccttgctatcgaacccgggaagaacccgaaacatgtgcagacaaagcctggactgtttaaaaccctcacaggcgagattggggccgttaccctggacttcaagcccggaacaagcggctcccctatcatcaatcgcaaagggaaggtgattggcctctacggaaacggcgtcgtgacgaaaagcggggattatgtgtctgccatcacccaggctgaacggattggagagcccgactacgaggtcgatgaagacatctttagaaagaagcggctgacaattatggatcttcaccccggcgccgggaaaaccaagcgcatcctgccttccattgttagagaggcgctgaaacggcgcctcagaaccctgatccttgctccgacacgggtggtggccgccgaaatggaggaagctctgagaggactccccatccgctatcagacgcctgccgtcaagagcgagcataccggccgggagattgtggacctgatgtgccacgctacattcaccacaagactcctgtcttccacccgcgttcccaattacaaccttatcgtgatggatgaagcccactttacggaccctagctccgtcgcggcccgggggtacatttctacaagagtggagatgggcgaagctgccgctatcttcatgaccgccaccccccctggagccacagatccgtttccccaaagcaattcccctattgaggacatcgaacgcgagatccccgagcggagctggaacaccggcttcgattggattacagactatcaggggaaaaccgtttggtttgtgccttctatcaaggctggaaatgacattgcgaactgcctgagaaagtccggcaaaaaggtcatccagctgagccgcaaaacgttcgatacagaataccccaagaccaaactcacagactgggattttgtggtcaccacggacatttctgagatgggggccaacttcagagctggacgggtgatcgatccgcgcagatgtctgaagcctgttatccttaccgacggccccgaacgggtgattctggccgggcccatccctgtgacacccgccagcgctgcccaacgcagaggccggattggaagaaatcctgcgcaggaggatgaccagtatgtcttctccggcgatccgctcaagaacgacgaagatcatgctcactggaccgaggccaaaatgctgctggacaatatctacacacccgaggggattatccctaccctctttggacccgaacgcgagaagacacaggccattgatggcgaattccggcttagaggggagcaacgcaaaacctttgttgagctgatgcggagaggagacctgcctgtgtggctctcttataaggtggctagcgccggcatctcctacaaagaccgggaatggtgcttcacgggcgagcgcaacaatcagatcctggaagagaacatggaagtcgagatttggacaagagagggggaaaagaagaaacttcggcccaagtggctggatgcgcgcgtgtatgccgacccgatggctctcaaagattttaaggagttcgcctctggaagaaaaagcatcaccctggacattctgaccgaaatcgcttccctccctacataccttagctctcgggccaagctggctctggataatattgttatgctccataccacagagcgcggcgggagagcctaccagcacgcgctgaacgaacttcccgagtccctggagacgctcatgctggtggccctgctcggagctatgaccgccggcatctttcttttctttatgcaggggaagggaatcggcaaactgagcatgggcctgattacaatcgctgtcgcctccgggctcctgtgggtggccgaaattcaacctcagtggatcgctgcgtctattatccttgagttctttctgatggtcctcctgatccccgaacctgagaagcagcggaccccccaggacaatcaactgatttatgtgatcctcacaattcttaccatcattggactgatcgccgctaacgaaatgggcctgattgagaaaacgaagaccgatttcgggttttaccaggttaaaacagagaccacaatcctcgacgtggatctgcgcccggccagcgcctggaccctttatgctgtcgccacgacaatcctgacccctatgctcagacacacaattgaaaatacctccgcgaacctgtctctggccgctatcgccaatcaggctgccattctcatgggacttggcaaggggtggcccctgcatcggatggacctgggagtgcccctcctggcgatgggctgttacagccaggttaaccctaccacacttacggcctccctggtgatgctcctggtccactatgctatcattggcccggggctgcaagccaaagctaccagagaggcccagaagcgcacagctgccggaatcatgaagaatcccaccgtggatggcatcacagtgattgacctcgaacctatcagctacgatcccaaattcgagaagcagcttgggcaagttatgctgctggcgctctgcgccggacagctgcttctgatgcggaccacgtgggctttctgtgaggtcctcacactggccaccggccctattctgaccctctgggaagggaaccccggaagattttggaacacaaccatcgctgtgtctacagccaatattttccgcggctcctatcttgccggcgcggggctggcttttagcctgatcaaaaacgcccagacgcctcggagaggaaccggcacaaccggggagacactcggagaaaagtggaaacgccagctgaattctcttgaccggaaggagttcgaagagtacaagagatccggcatcctggaggtggaccgcaccgaagctaaaagcgccctcaaggatgggtctaaaattaagcatgccgtcagccggggatcctctaaaatcagatggattgttgagcgcggcatggtgaagccgaagggcaaagtggtcgacctggggtgcggacggggcgggtggagctactatatggctacgctgaagaacgtgaccgaagttaaaggatacacaaagggcgggcccggacacgaggaacctatccccatggccacctatggctggaatctcgtgaaacttcattccggcgtcgatgtgttttacaagcctacagagcaagttgacaccctgctgtgtgatattggggagagctcctctaaccccacaatcgaagagggaagaaccctccgcgtgctgaagatggtcgaaccgtggcttagctccaaacctgagttctgcattaaggtgctgaatccctatatgcccacggtgatcgaagagctcgagaaactgcagagaaagcacggcgggaacctggtccggtgtcctctctctcgcaatagcacacacgaaatgtactgggtttccggagcgtctggcaacatcgtgagctccgtgaataccaccagcaaaatgcttctgaacagatttacaacgcggcatagaaagcccacctatgagaaagacgtcgatctgggggccggaacacggtctgtgtccaccgaaacagagaagcctgacatgaccattatcggccgcagactccagcggctgcaggaggaacacaaggagacatggcattacgatcaagaaaatccgtaccgcacctgggcttatcacggcagctacgaggccccctctacggggtccgctagctctatggttaacggagtggtcaaacttctgaccaagccttgggacgtgattcccatggttacacagctcgccatgaccgatacaacccctttcggccagcagagagtgtttaaagaaaaggtcgacacgcggacaccccaaccgaaacctgggacccgcatggtgatgacaaccacggcgaattggctgtgggccctgctcggaaagaagaaaaaccccagactgtgcacccgggaggagttcatctccaaggttcgcagcaatgctgccattggcgctgtgtttcaggaagagcaggggtggacatccgccagcgaagctgtcaacgactctagattctgggagcttgtggataaagaacgggccctgcaccaagagggcaagtgtgagagctgcgtctataacatgatgggaaaacgcgaaaagaagctcggcgagtttgggagagcgaaaggatcccgggccatctggtacatgtggctgggcgctcgcttccttgaattcgaggccctggggtttctcaatgaagaccattggttcggaagagagaactcttggagcggcgtggagggggaaggcctgcaccggctgggatatatcctcgaggaaattgataagaaagacggcgatctgatgtacgctgacgataccgccgggtgggacacaagaatcaccgaggatgaccttcagaatgaggaactgattacagagcagatggcccctcatcacaagatcctcgcgaaagctatttttaagctgacctatcagaacaaggttgtgaaagtccttcgccccacgcctcggggagccgtgatggatatcatctccagaaaggaccaacgcggctctgggcaggtgggaacatacggcctgaataccttcaccaacatggaagttcagctcattcggcagatggaggccgaaggggtgatcacacaagatgacatgcagaatcccaaaggcctgaaggagagagtcgagaaatggctgcgcgaatgcggagtggaccggctcaagagaatggctattagcggcgatgactgtgttgtgaaaccgctggatgagcgctttgggacctcccttctgttcctcaacgacatgggaaaggtccggaaggatatccctcagtgggaaccctctaaaggctggaagaattggcaggaggtgcccttttgcagccatcacttccacaaaatttttatgaaggacgggagatccctggtcgtgccttgtcgcaaccaagatgaacttatcggacgggccagaatcagccagggcgctgggtggtctctgcgggagacagcctgcctcggcaaagcgtacgcccagatgtggtccctgatgtatttccatagacgcgacctgcggctcgctagcatggccatttgttctgctgttccgacggagtggtttcccacctccagaacaacctggagcatccacgcccatcaccagtggatgacaaccgaagatatgctgaaggtgtggaatcgcgtctggattgaggacaaccctaatatgatcgataagacgcccgtgcactcctgggaagacattccttaccttggaaaaagagaggacctgtggtgcggctctctcatcgggctgagctcccgggcgacctgggccaagaacattcatacagctatcacccaagttcgcaatcttatcggaaaagaagagtatgtggattacatgcccgtcatgaagagatatagcgccccttctgagtccgaaggcgtgctgtga

SEQ ID NO: 21072 - RNA, 9867 nt, synthetic construct
  misc_feature 1..9867: note = derived and/or modified CDS sequence (opt5) from DENV-4__HQ332176__SS-prME
  source 1..9867: mol_type = other RNA
agcaccatcacactgctctgcctgattcccacggtgatggccttccacctttccaccagagacggcgagcctctgatgatcgtcgctcggcatgaacgcgggagaccgctcctgtttaagacaaccgagggaattaacaaatgtacacttatcgccatggatctgggcgaaatgtgcgaggacaccgttacatacaagtgtcccctcctggtgaataccgaacctgaggatattgactgctggtgtaacctgacgtctacctgggtgatgtatgggacatgcacccagagcggagagcggcgcagagaaaaacggtccgtcgcgctcacaccccactctggcatggggctggagacccgcgctgaaacgtggatgagctccgagggagcctggaagcatgcccaaagagtggagtcttggatccttcggaatcctggcttcgctctgctcgccggctttatggcttacatgatcgggcagacaggaattcagcgcaccgttttctttgtgctgatgatgcttgtcgcccccagctatggcatgagatgtgtgggggttggaaaccgggatttcgtggaaggcgtctccgggggagcgtgggtggacctggtgctcgagcacggcggctgcgtcacaaccatggcccaggggaaacctaccctggattttgaactgacaaagacgaccgctaaggaggttgccctcctgcgcacatactgtatcgaagctcttattagcaatatcaccacagccaccagatgcccgacgcaaggagagccctatctgaaagaggaacaggaccagcagtacatttgtcggcgcgatgtggtggacagaggctgggggaacggatgcggcctcttcgggaagggaggcgtcgtgacatgcgcgaaattttcttgttccggcaagatcaccgggaatctggttcaaattgagaaccttgaatataccgtggtcgtgacagttcataatggagatacccacgccgtgggcaacgacacaagcaatcacggggtcacggctaccatcacacctcggtctccctccgtggaggtcaaactgcctgattacggagaactcaccctggactgcgagcccagaagcggcatcgacttcaacgagatgattctgatgaagatgaagaaaaagacatggctcgtgcataaacagtggtttctggatcttccgctgccttggaccacgggggccgacacctctgaagttcactggaattacaaggagcgcatggtgacattcaaagtcccccatgctaagcggcaggatgtgaccgttctcggctcccaggaaggagccatgcacagcgccctggctggcgcgacagaggtggactccggggatggaaaccacatgtttgccggccatcttaaatgtaaggtcagaatggaaaagctgcgcatcaaagggatgtcttataccatgtgcagcggaaagttctccattgacaaagagatggctgagacgcaacacggcacaaccgtggtgaaggttaaatacgaaggggccggcgccccttgtaaggtccccatcgagattcgggatgtgaataaggaaaaagtggtcggaagagtgatcagcgctacacccctcgccgagaacaccaactctgttaccaatatcgagctggaacctccgttcggcgactcctatattgtgatcggggtcggaaacagcgcgctgacactccattggtttcgcaagggctctagcattgggaaaatgttcgagtccacgtaccggggagctaagagaatggccatcctgggcgaaaccgcctgggattttgggtctgtgggcggacttttcacaagcctgggcaaagctgttcaccaggtgtttgggtccgtctataccacaatgttcggaggcgtgagctggatgattcgcatcctcatcgggtttctggttctgtggattggaaccaattctcggaacacgtccatggccatgacatgcatcgctgtgggcgggattacccttttcctcggctttaccgtccaggccgacatgggatgtgtggtgagctggtctggcagagagctgaagtgcgggtccggaatcttcgtcgttgataatgtgcatacatggaccgaacaatacaagtttcagcccgagagccctgcgcgcctggcctccgctattctcaacgcccacaaagacggcgtgtgtgggatccggtctacaacgagactggagaatgtcatgtggaagcagattaccaacgaacttaattatgtgctgtgggagggaggccacgacctcacagttgtggctggcgatgtcaaaggggtgctgaccaagggaaaacgggccctgacaccccctgcgagcgaccttaagtactcctggaagacctggggcaaagccaagatcttcacgcccgaagctcgcaactctacctttctcatcgatgggccggacacaagcgagtgccctaatgaaagacgggcctggaactccttcgaggttgaggattacggattcggcatgtttaccacaaatatttggatgaaattcagagaagggagctctgaggtgtgtgaccatcgcctgatgtccgctgccatcaaggatcagaaagccgtccacgctgacatgggatattggattgaaagctctaagaaccaaacctggcagatcgagcgggcgtccctgattgaagtgaaaacatgcctctggcccaagacccatacgctgtggagcaatggcgttcttgagtctcagatgctgatccctaagagctacgccggccccttttcccagcacaactatagacaagggtacgctacacagaccgtgggaccttggcacctcggcaaactggagatcgatttcggggaatgccccggaaccacagtcaccattcaggagaactgtgaccatcgcggcccgagcctgagaacgacaaccgcctctgggaagcttgtgacacagtggtgctgtcggtcctgcaccatgcctcccctccgctttctgggagaagatggctgttggtatggcatggagatcagacccctgagcgagaaagaagagaatatggtgaagtcccaagtcacagccgggcagggaacctctgaaacgttcagcatgggcctcctgtgccttaccctgtttgttgaggaatgtctccggcgcagagtgacacggaaacacatgattctggctgtggtcatcaccctgtgcgccattatccttgggggactcacatggatggacctgctgcgcgcgctcatcatgctgggcgataccatgtccgggagaattggaggccagacgcatcttgctatcatggccgtgttcaagatgtctcctggctacgttctgggggtgtttctccggaagctgacaagccgcgagaccgccctgatggtcattggaatggctatgacaaccaccctttccatcccgcacgacctgatggagctcattgacggcatctctctggggctcatcctgcttaaaattgtgacacagttcgataacacgcaagttggaaccctggccctcagcctgacatttatcagatccaccatgagcctggtgatggcgtggcggacaattatggctgtccttttcgtggtcaccctgatccccctctgtagaacgtcttgcctgcagaagcagtcccattgggtggaaattacagccctcatcctgggcgcccaagctcttcctgtttatctgatgaccctcatgaaaggggccagccgccggtcttggcccctgaatgagggaattatggctgtgggcctggtctcccttctgggcagcgccctcctgaagaacgacgtgcctctcgcggggcccatggttgccggaggcctgcttctggctgcctacgtgatgtctgggtccagcgctgatctgtccctcgaaaaagccgccaatgtccagtgggacgagatggctgatatcaccggaagctctcctatcattgaagtgaagcaggacgaggatggcagcttttccatcagagacgtggaggaaacaaacatgattaccctgcttgttaagctggcgctcatcacagtctctgggctgtaccccctcgccattccgatcacgatgaccctgtggtatatgtggcaggtgaaaacacaacgcagcggagctctttgggatgtgccttcccccgccgccacccagaaggctgccctgtctgagggcgtctaccggatcatgcagagaggcctgttcgggaaaacacaggtgggagttggcattcacatggaaggggtgttccacaccatgtggcatgtcacgcgcggaagcgtgatctgtcacgagaccggccggctcgaaccttcctgggcggacgttagaaatgatatgatttcttatgggggaggctggcgcctgggcgacaagtgggataaagaggaggacgtgcaagtccttgctatcgaacccgggaagaacccgaagcatgtgcagacaaaacctggactgtttaagaccctcacaggcgagattggggccgttaccctggacttcaaacccggaacaagcggctcccctatcatcaatcggaaggggaaagtgattggcctctacggaaacggcgtcgtgacgaagagcggggattatgtgtctgccatcacccaggctgaaagaattggagagcccgactacgaggtcgatgaagacatctttcggaaaaagcgcctgacaattatggatcttcaccccggcgccgggaagaccaaaagaatcctgccttccattgttcgggaggcgctgaagcgcagactccggaccctgatccttgctccgacaagagtggtggccgccgaaatggaggaagctctgcgcggactccccatccggtatcagacgcctgccgtcaaaagcgagcataccggcagagagattgtggacctgatgtgccacgctacattcaccacacgcctcctgtcttccacccgggttcccaattacaaccttatcgtgatggatgaagcccactttacggaccctagctccgtcgcggccagagggtacatttctacacgcgtggagatgggcgaagctgccgctatcttcatgaccgccaccccccctggagccacagatccgtttccccaaagcaattcccctattgaggacatcgaacgggagatccccgagagaagctggaacaccggcttcgattggattacagactatcaggggaagaccgtttggtttgtgccttctatcaaagctggaaatgacattgcgaactgcctgcgcaagtccggcaagaaagtcatccagctgagcagaaagacgttcgatacagaataccccaaaaccaagctcacagactgggattttgtggtcaccacggacatttctgagatgggggccaacttccgggctggacgcgtgatcgatccgagacggtgtctgaaacctgttatccttaccgacggccccgaacgcgtgattctggccgggcccatccctgtgacacccgccagcgctgcccaaagacggggcagaattggacgcaatcctgcgcaggaggatgaccagtatgtcttctccggcgatccgctcaagaacgacgaagatcatgctcactggaccgaggccaagatgctgctggacaatatctacacacccgaggggattatccctaccctctttggacccgaacgggagaaaacacaggccattgatggcgaattcagacttcgcggggagcaacggaagacctttgttgagctgatgagacggggagacctgcctgtgtggctctcttataaagtggctagcgccggcatctcctacaaggaccgcgaatggtgcttcacgggcgagagaaacaatcagatcctggaagagaacatggaagtcgagatttggacacgggagggggaaaaaaagaagcttcgccccaaatggctggatgcgagagtgtatgccgacccgatggctctcaaggattttaaagagttcgcctctggacggaagagcatcaccctggacattctgaccgaaatcgcttccctccctacataccttagctctcgcgccaaactggctctggataatattgttatgctccataccacagagagaggcgggcgggcctaccagcacgcgctgaacgaacttcccgagtccctggagacgctcatgctggtggccctgctcggagctatgaccgccggcatctttcttttctttatgcaggggaagggaatcggcaagctgagcatgggcctgattacaatcgctgtcgcctccgggctcctgtgggtggccgaaattcaacctcagtggatcgctgcgtctattatccttgagttctttctgatggtcctcctgatccccgaacctgagaaacagcgcaccccccaggacaatcaactgatttatgtgatcctcacaattcttaccatcattggactgatcgccgctaacgaaatgggcctgattgagaagacgaaaaccgatttcgggttttaccaggttaagacagagaccacaatcctcgacgtggatctgagaccggccagcgcctggaccctttatgctgtcgccacgacaatcctgacccctatgctccggcacacaattgaaaatacctccgcgaacctgtctctggccgctatcgccaatcaggctgccgtgctcatgggacttggcaaagggtggcccctgcatagaatggacctgggagttcccctcctggcgatgggctgttacagccaggtgaaccctaccacacttacggcctccctggtcatgctcctggtgcactatgctattatcggcccggggctgcaagccaaggctacccgcgaggcccagaaacggacagctgccggaattatgaagaatcccaccgtggatggcatcacagttatcgacctcgaacctattagctacgatcccaagttcgagaaacagcttgggcaagtcatgctgctggtgctctgcgcgggacagctgcttctgatgagaaccacgtgggccttctgtgaggtgctcacactggctaccggccctatcctgaccctctgggaagggaaccccggacgcttttggaacacaaccattgccgtctctacagctaatatcttccggggctcctatcttgccggcgccgggctggcgtttagcctgattaagaacgctcagacgcctagacgcggaaccggcacaaccggggagacactcggagaaaaatggaagcggcagctgaattctcttgacagaaaagagttcgaagagtacaagcgctccggcatcctggaggttgaccggaccgaagccaagagcgctctcaaagatgggtctaagatcaaacatgccgtgagcagaggatcctctaagattcgctggatcgtggagcggggcatggtcaaaccgaagggcaaggtggttgacctggggtgcggaagaggcgggtggagctactatatggccacgctgaaaaacgtgaccgaagtcaagggatacacaaaaggcgggcccggacacgaggaacctattcccatggctacctatggctggaatctcgtgaagcttcattccggcgttgatgtgttttacaaacctacagagcaagtcgacaccctgctgtgtgatatcggggagagctcctctaaccccacaattgaagagggacgcaccctcagagtgctgaagatggtggaaccgtggcttagctccaagcctgagttctgcatcaaagtcctgaatccctatatgcccacggttattgaagagctcgagaagctgcagcggaaacacggcgggaacctggtgcgctgtcctctctctagaaatagcacacacgaaatgtactgggtgtccggagcctctggcaacatcgtcagctccgtgaataccaccagcaagatgcttctgaaccggtttacaacgagacatcggaaaccctcttatgagaaggacgttgatctgggggcgggaacccgctccgtgagcacagaaaccgagaaacctgacatgacaatcattggcagacggctccagcgcctgcaggaggaacacaaggagacctggcattacgatcaagaaaatccgtacagaacatgggcctatcacggctcttacgaggctccctccaccgggagcgcctcttccatggtcaacggagtggttaagcttctgacgaaaccttgggacgtgatccccatggtcacccagctcgctatgacagataccacacctttcggccagcagcgggtgtttaaggaaaaagttgacacccgcacgccccaaccgaagcctgggacaagaatggtgatgaccacaaccgccaattggctgtgggcgctgctcggaaaaaagaagaacccccggctgtgcacgcgcgaggagttcattagcaaagtcagatccaatgccgctatcggcgccgtgtttcaggaagagcaggggtggaccagcgcttctgaagccgtcaacgacagccggttctgggagcttgtggataaggaacgcgctctgcaccaagagggcaaatgtgagtcctgcgtttataacatgatgggaaagagagaaaaaaagctcggcgagtttgggcgggccaagggatctcgcgcgatttggtacatgtggctgggcgccagattccttgaattcgaggctctggggtttctcaatgaagaccattggttcggacgggagaacagctggtccggcgtggagggggaaggcctgcacagactgggatatatcctcgaggaaatcgataaaaaggacggcgatctgatgtacgccgacgatacagctgggtgggacacccgcattacagaggatgaccttcagaatgaggaactgatcaccgagcagatggcccctcatcacaaaattctcgccaaggcgatctttaaactgacatatcagaacaaggtcgtgaaggtgcttcggcccacccctagaggagctgttatggatattatctctcgcaaagaccaacggggcagcgggcaggtgggaacgtacggcctgaatacattcaccaacatggaagtccagctcatcagacagatggaggccgaaggggtgattacccaagatgacatgcagaatcccaagggcctgaaagagcgcgttgagaagtggctgcgggaatgcggagtggacagactcaaacgcatggccatctccggcgatgactgtgtcgtgaagccgctggatgagcggtttgggacatctcttctgttcctcaacgacatgggaaaagtcagaaaggatattcctcagtgggaacccagcaagggctggaaaaattggcaggaggtgcccttttgctcccatcacttccacaagatctttatgaaagacgggcgcagcctggttgtgccttgtcggaaccaagatgaacttattggaagagctcggatctctcagggcgccgggtggtccctgagagagaccgcttgcctcggcaaggcctacgcgcagatgtggagcctgatgtatttccatcgccgggacctgagactcgcctctatggctatctgttccgccgtcccgacagagtggtttcccacgagccgcaccacatggtccattcacgctcatcaccagtggatgaccacagaagatatgctgaaagtgtggaatagagtttggatcgaggacaaccctaatatgattgataagacccccgtgcactcttgggaagacatcccttaccttggaaagcgggaggacctgtggtgcggcagcctcattgggctgtccagccgcgccacgtgggcgaaaaacatccataccgccattacacaagtcagaaatcttatcggaaaggaagagtatgtggattacatgcccgtgatgaaacggtattctgctccttccgagagcgaaggcgttctgtga

SEQ ID NO: 21073 - RNA, 9867 nt, synthetic construct
  misc_feature 1..9867: note = derived and/or modified CDS sequence (opt5) from DENV-4__HQ332174__SS-prME
  source 1..9867: mol_type = other RNA
agcaccatcaccctgctctgcctgattcccacggccatggctttccacctttccaccagagacggagagcctctgatgatcgtggccaagcatgaacgggggcgcccgctcctgtttaaaacaaccgaggggattaacaagtgtacacttatcgcgatggatctgggcgaaatgtgcgaggacaccgtcacatacaaatgtcccctcctggttaataccgaacctgaggatattgactgctggtgtaacctgacgtctacctgggtgatgtatgggacatgcacccagagcggagagagacggcgcgaaaagagatccgtggctctcacaccccactctggcatggggctggagacccgggccgaaacgtggatgagctccgagggagcctggaaacatgctcaacgcgtcgagtcttggatccttagaaatcctggcttcgccctgctcgctggctttatggcctacatgatcgggcagacaggcattcagcggaccgtgttctttgttctgatgatgcttgtggcgcccagctatggcatgcgctgtgtcggggtgggaaacagagatttcgttgaaggcgtgtccgggggagcctgggtcgacctggtgctcgagcacggcggctgcgtgacaaccatggctcaggggaagcctaccctggattttgaactgacaaagacgaccgccaaagaggtcgctctcctgcggacatactgtatcgaagcccttattagcaatatcaccacagcgacccgctgcccgacgcaaggagagccctatctgaaggaggaacaggaccagcagtacatttgtagacgggatgttgtggaccgcggctgggggaacggatgcggcctcttcgggaaaggaggcgtggtcacatgcgccaagttttcttgttccggcaaaatcaccgggaatctggtgcaaattgagaaccttgaatataccgttgtggtcacagtgcataatggagatacccacgctgttggcaacgacacaagcaatcacggggtgacggccaccatcacacctagatctccctccgtcgaggtgaagctgcctgattacggagaactcaccctggactgcgagccccggagcggcatcgacttcaacgagatgattctgatgaagatgaaaaagaaaacatggctcgtccataagcagtggtttctggatcttccgctgccttggaccacgggggctgacacctctgaagtgcactggaattacaaagagagaatggttacattcaaggtgccccatgccaaacgccaggatgtcaccgtgctcggctcccaggaaggagccatgcacagcgctctggcgggcgccacagaggttgactccggggatggaaaccacatgtttgctggccatcttaagtgtaaggtgcggatggaaaaactgagaatcaaggggatgtcttataccatgtgcagcggaaaattctccattgacaaggagatggccgagacgcaacacggcacaaccgtcgtgaaagtgaagtacgaaggggccggcgctccttgtaaggttcccatcgagattcgcgatgtcaataaagaaaaggtggtgggacgggtcatcagcgccacacccctcgcggagaacaccaactctgtgaccaatatcgagctggaacctccgttcggcgactcctatattgttatcggggtgggaaacagcgctctgacactccattggtttagaaaaggctctagcattgggaagatgttcgagtccacgtaccgcggagccaaacggatggccatcctgggcgaaaccgcttgggattttgggtctgtcggcggacttttcacaagcctgggcaaggccgtgcaccaggtttttgggtccgtgtataccacaatgttcggaggcgtcagctggatgattagaatcctcatcgggtttctggtgctgtggattggaaccaattctcgcaacacgtccatggctatgacatgcatcgccgttggcgggattacccttttcctcggctttaccgtgcaggcggacatgggatgtgtcgtgagctggtctggccgggagctgaagtgcgggtccggaatcttcgtggtcgataatgttcatacatggaccgaacaatacaaatttcagcccgagagccctgccagactggcttccgccattctcaacgctcacaaggacggcgtgtgtgggatccgctctacaacgcggctggagaatgtgatgtggaaacagattaccaacgaacttaattatgtcctgtgggagggaggccacgacctcacagtggttgccggcgatgtgaagggggtcctgaccaaaggaaagagagcgctgacaccccctgccagcgaccttaagtactcctggaaaacctggggcaaggctaaaatcttcacgcccgaagcccggaactctacctttctcatcgatgggccggacacaagcgagtgccctaatgaacgcagagcttggaactccttcgaggtggaggattacggattcggcatgtttaccacaaatatttggatgaagttccgggaagggagctctgaggtttgtgaccatagactgatgtccgccgccatcaaagatcagaaggctgtgcacgcggacatgggatattggattgaaagctctaaaaaccaaacctggcagatcgagcgcgcctccctgattgaagtcaagacatgcctctggcccaagacccatacgctgtggagcaatggcgtgcttgagtctcagatgctgatccctaaaagctacgctggccccttttcccagcacaactatcggcaagggtacgccacacagaccatgggaccttggcacctcggcaagctggagatcgatttcggggaatgccccggaaccacagttaccattcaggagaactgtgaccatagaggcccgagcctgcgcacgacaaccgcctctgggaaacttgtgacacagtggtgctgtagatcctgcaccatgcctcccctccggtttctgggagaagatggctgttggtatggcatggagatccgccccctgagcgagaaggaagagaatatggtcaaatcccaagtgacagctgggcagggagcctctgaaaccttcagcatgggcctcctgtgccttacgctgtttgtggaggaatgtctcagacggcgcgtcaccagaaagcacatgattctggcggttgtgatcacactgtgcgctattatccttgggggactcacctggatggacctgctgcgggccctcatcatgctgggcgatacaatgtccgggcgcattggaggccagacccatcttgccatcatggctgtgttcaagatgtctcctggctacgtcctgggggtgtttctcagaaaactgacgagccgggagacagccctgatggttattggaatggcgatgaccacaaccctttccatcccgcacgacctgatggagctcattgacggcatctctctggggctcatcctgcttaagattgtgacccagttcgataacacacaagtcggaacgctggctctcagcctgacctttatccgctccacaatgagcctggtgatggcctggagaaccattatggccgttcttttcgtggtcacactgatccccctctgtcggacctcttgcctgcagaaacagtcccattgggtggaaattacggctctcatcctgggcgcccaagcccttcctgtctatctgatgacactcatgaagggggccagcagacgctcttggcccctgaatgagggaattatggcggtgggcctggtttcccttctgggcagcgccctcctgaaaaacgacgtgcctctcgctgggcccatggtcgccggaggcctgcttctggctgcctacgtgatgtctgggtccagcgccgatctgtccctcgaaaaggctgcgaatgttcagtgggacgagatggccgatatcaccggaagctctcctatcattgaagtgaagcaggacgaggatggcagcttttccatccgggacgtcgaggaaaccaacatgattacactgcttgtgaaactggctctcatcaccgtgtctgggctgtaccccctcgccattccgatcacaatgacgctgtggtatatgtggcaggttaagacccaaagaagcggagccctttgggatgtcccttcccccgctgccacacagaaagcggctctgtctgagggcgtgtaccgcatcatgcagcggggcctgttcgggaagacccaggtgggagtcggcattcacatggaaggggtgttccacacaatgtggcatgttaccagaggaagcgtgatctgtcacgagacgggccgcctcgaaccttcctgggccgacgtccggaatgatatgatttcttatgggggaggctggagactgggcgacaaatgggataaggaggaggacgtgcaagttcttgccatcgaacccgggaagaacccgaaacatgtgcagaccaagcctggactgtttaaaacactcaccggcgagattggggctgtcacactggacttcaagcccggaaccagcggctcccctatcatcaatcgcaaagggaaggtgattggcctctacggaaacggcgttgtgacaaaaagcggggattatgtctctgccatcacgcaggcggaacggattggagagcccgactacgaggtggatgaagacatctttagaaagaagcggctgaccattatggatcttcaccccggcgctgggaaaacaaagcgcatcctgccttccattgtgagagaggccctgaaacggcgcctcagaaccctgatccttgccccgacccgggtcgttgctgccgaaatggaggaagctctgagaggactccccatccgctatcagacgcctgctgtgaaaagcgagcatacaggccgggagattgtggacctgatgtgccacgcgaccttcacaaccagactcctgtcttccacacgcgtccccaattacaaccttatcgtgatggatgaagcccactttaccgaccctagctccgttgctgcccgggggtacatttctacgagagtggagatgggcgaagctgccgccatcttcatgacagctacaccccctggagcgaccgatccgtttccccaaagcaattcccctattgaggacatcgaacgcgagatccccgagcggagctggaacacaggcttcgattggattaccgactatcaggggaaaacagtctggtttgtgccttctatcaaggccggaaatgacattgctaactgcctgagaaagtccggcaaaaaggttatccagctgagccgcaaaaccttcgatacggaataccccaagacaaaactcaccgactgggattttgtggtcacaaccgacatttctgagatgggggccaacttcagagccggacgggtgatcgatccgcgcagatgtctgaagcctgtcatccttacggacggccccgaacgggtgattctggctgggcccatccctgttacccccgccagcgcggctcaacgcagaggccggattggaagaaatcctgcccaggaggatgaccagtatgtgttctccggcgatccgctcaagaacgacgaagatcatgcccactggacagaggctaaaatgctgctggacaatatctacacccccgaggggattatccctacactctttggacccgaacgcgagaagacccaggccattgatggcgagttccggcttagaggggagcaacgcaaaacatttgtggagctgatgcggagaggagacctgcctgtctggctctcttataaggttgcgagcgccggcatctcctacaaagaccgggaatggtgcttcaccggcgagcgcaacaatcagatcctggaagagaacatggaagtggagatttggacgagagagggggaaaagaagaaacttcggcccaagtggctggatgctcgcgtgtatgccgacccgatggctctcaaagattttaaggagttcgcctctggaagaaaaagcatcacactggacattctgaccgaaatcgcttccctccctacctaccttagctctcgggccaagctggcgctggataatattgtcatgctccatacaaccgagcgcggcgggagagcctaccagcacgctctgaacgaacttcccgagtccctggagacactcatgctggtggccctgctcggagctatgacggccggcatctttcttttctttatgcaggggaagggaatcggcaaactgagcatgggcctgattaccatcgccgttgcttccgggctcctgtgggtggcggaaattcaacctcagtggatcgccgcttctattatccttgagttctttctgatggtcctcctgatccccgaacctgagaagcagcggacaccccaggacaatcaactgatttatgtgatcctcaccattcttacaatcattggactgatcgccgccaacgaaatgggcctgattgagaaaaccaagacggatttcgggttttaccaggctaaaaccgagacaaccatcctcgacgtcgatctgcgcccggccagcgcgtggacactttatgccgtggctaccacgatcctgacacctatgctcagacacaccattgaaaatacatccgccaacctgtctctggctgccatcgcgaatcaggccgctgttctcatgggacttggcaaggggtggcccctgcatcggatggacctgggagtgcccctcctggccatgggctgttacagccaggtcaaccctaccacccttacagcttccctggtgatgctcctggttcactatgccattatcggcccggggctgcaagctaaagccacgagagaggcgcagaagcgcaccgccgctggaattatgaagaatcccacagtggatggcatcaccgtcatcgacctcgaacctattagctacgatcccaaattcgagaagcagcttgggcaagtgatgctgctggtgctctgcgccggacagctgcttctgatgcggacaacctgggctttctgtgaggttctcacgctggccacaggccctatcctgaccctctgggaagggaaccccggaagattttggaacaccacaattgccgtctctaccgcgaatatcttccgcggctcctatcttgctggcgccgggctggcttttagcctgattaaaaacgcccagacacctcggagaggaacgggcaccacaggggagaccctcggagaaaagtggaaacgccagctcaattctcttgaccggaaggagttcgaagagtacaagagatccggcatcctggaggtggaccgcacagaagccaaaagcgctctcaaggatgggtctaaaatcaagcatgccgtgagccggggatcctctaaaattagatggatcgtcgagcgcggcatggttaagccgaagggcaaagtggtggacctggggtgcggacggggcgggtggagctactatatggcgaccctgaagaacgtcacggaagtgaaaggatacaccaagggcgggcccggacacgaggaacctattcccatggccacatatggctggaatctcgttaaacttcattccggcgtggatgtcttttacaagcctaccgagcaagtggacacactgctgtgtgatatcggggagagctcctctaaccccaccattgaagagggaagaacactccgcgttctgaagatggtggaaccgtggcttagctccaaacctgagttctgcatcaaggtcctgaatccctatatgcccaccgtgattgaagaactggagaaactgcagagaaagcacggcgggaacctggtgcggtgtcctctctctcgcaatagcacgcacgaaatgtactgggtctccggagcttctggcaacatcgttagctccgtgaatacaaccagcaaaatgcttctgaacagatttaccacacggcatagaaagcccacgtatgagaaagacgtggatctgggggccggaacccggtctgtctccacagaaaccgagaagcctgacatgacaatcattggccgcagactccagcggctgcaggaggaacacaaggagacctggcattacgatcaagaaaatccgtaccgcacatgggcttatcacggcagctacgaggccccctctaccgggtccgcgagctctatggtgaacggagttgtgaaacttctgacgaagccttgggacgtcatccccatggtgacccagctcgccatgacagataccacacctttcggccagcagagagtttttaaagaaaaggtggacacccggacgccccaaccgaaacctgggacacgcaccgtcatgacaaccacggctaattggctgtgggccctgctcggaaagaagaaaaaccccagactgtgcacccgggaggagttcatttccaaggtgcgcagcaatgctgccatcggcgctgtttttcaggaagaacaggggtggacatccgccagcgaagcggtgaacgactctagattctgggagcttgtcgataaagaacgggccctgcaccaagagggcaagtgtgagagctgcgtgtataacatgatgggaaaacgcgaaaagaagctcggcgagtttgggagagctaaaggatcccgggccatttggtacatgtggctgggcgctcgcttccttgagttcgaggccctggggtttctcaatgaagaccattggttcggaagagagaactcttggagcggcgtcgagggggaaggcctgcaccggctgggatatatcctcgaggaaatcgataagaaagacggcgatctgatgtacgccgacgataccgcggggtgggacacaagaattaccgaggatgaccttcagaatgaggaactgatcacagagcagatggctcctcatcacaagattctcgccaaagccatctttaagctgacctatcagaacaaggtggttaaagtgcttcgccccacgcctcggggagctgtcatggatattatctccagaaaggaccaacgcggctctggacaggtgggaacatacggcctgaataccttcaccaacatggaagtgcagctcatccggcagatggaggccgaaggggttattacacaagatgacatgcagaatcccaaaggcctgaaggagagagtggagaaatggctgcgcgaatgcggagtcgaccggctcaagagaatggctatcagcggcgatgactgtgtggttaaaccgctggatgagcgctttgggacctcccttctgttcctcaacgacatgggaaaggtgcggaaggatattcctcagtgggaaccctctaaaggctggaagaattggcaggaggtccccttttgcagccatcacttccacaaaatctttatgaaggacgggagatccctggtggtcccttgtcgcaaccaagatgaacttattggacgggccagaatcagccagggcgcggggtggtctctgcgggagacagcctgcctcggcaaggcttacgcccagatgtggtccctgatgtatttccatagacgcgacctgcggctcgctagcatggccatctgttctgcggtgccgacggagtggtttcccacctccagaacaacctggagcattcacgcccatcaccagtggatgacaaccgaagatatgctgaaggtttggaatcgcgtgtggatcgaggacaaccctaatatgattgataagacgcccgtccactcctgggaagacatcccttaccttggaaaaagagaggacctgtggtgcggctctctcattgggctgagctcccgggctacctgggccaagaacatccatacagctattacccaagtgcgcaatcttatcggaaaagaagagtatgttgattacatgcccgtgatgaagagatatagcgccccttctgagtccgaaggcgtcctgtga

SEQ ID NO: 21074 - RNA, 9867 nt, synthetic construct
  misc_feature 1..9867: note = derived and/or modified CDS sequence (opt5) from DENV-4__KT026308__SS-prME
  source 1..9867: mol_type = other RNA
agcaccatcaccctgctgtgcctgattcccacggtgatggccttccacctttccaccagagacggagagcctctgatgatcgtggctaagcatgaacgggggagaccgctgctgtttaagacaaccgagggaattaacaagtgtacacttatcgccatggatctgggagaaatgtgcgaggacaccgttacatacaaatgtcccctcctggtgaataccgaacctgaggatattgactgctggtgtaacctgacgtctacctgggtgatgtatgggacatgcacccagagcggagagagacggcgcgaaaagagatccgtcgcgctcacaccccactctggcatggggctggagacccgggctgaaacgtggatgagctccgagggagcctggaaacatgcccagcgcgtggagtcttggatccttagaaatcctggcttcgctctgctcgccggctttatggcttacatgatcgggcagacaggcattcagcggaccgttttctttatcctgatgatgcttgtggcccccagctatggcatgcgctgtgtcggggtgggaaacagagatttcgttgaaggcgtgtccgggggagcgtgggtcgacctggtgctcgagcacggcggctgcgtgacaaccatggcccaggggaagcctaccctggattttgaactgattaagacaacggctaaagaggtcgccctcctgcggacctactgtatcgaagctagcatttctaatatcacaaccgccacacgctgcccgacccaaggagagccctatcttaaggaggaacaggaccagcagtacatttgtagacgggatatggttgaccgcggctgggggaacggatgcggcctgttcgggaaaggaggcgtggtgacgtgcgcgaagttttcctgtctcggcaaaatcacagggaatctggtccaaatcgagaaccttgaatataccgtggttgtgaccgtccataatggagatacacacgccgtgggcaacgacaccagcaatcacggggttacagctacgattacccctagatctccctccgtggaggtccagctgcctgattacggagaactcacactggactgcgagccccggagcggcatcgacttcaacgagatgattctgatgaagatgaagaccaaaacatggctcgtgcataagcagtggtttctggatcttccgctgccttggaccacgggggccgacaccctcgaagtccactggaatcataaagagagaatggtgacattcaaggttccccacgctaaacgccaggatgtgaccgtcctgggctctcaagaaggagccatgcactccgcccttgctggcgcgacagaggtggacagcggggatggaaaccatatgtttgccggccacctgaagtgtaaagttcggatggaaaagctcagaatcaaggggatgtcctacaccatgtgctctggaaaattcagcattgacaaggagatggctgagacgcagcatggcacaaccgtggtcaaagtgaagtatgaagggacaggcgccccttgtaaagtgcccatcgagatccgcgatgttaataaggaaaaggtcgtgggacggattatctccagcacccccttcgccgagaacaccaactctgtgacaaatattgagctggaacctccgtttggcgactcctacatcgtcattggggtgggagatagcgctctgacgctccactggttcagaaaaggctctagcatcgggaagatgtttgagtccacctatcgcggagccaaacggatggcgatcctgggcgaaacagcttgggacttcgggtctgttggcggacttctgaccagcctcggcaaggccgtgcatcaggtctttgggtccgtgtacacaaccatgttcggaggcgttagctggatggtgcgcattctgatcgggctgcttgtcctctggattggaacgaactctcgcaatacatccatggccatgagctgcatcgctgtgggcgggattaccctgtttctgggcttcaccgttcacgccgatatgggatgtgtggtctcttggtccggcaaagagctcaagtgcgggagcggaatctttgtgattgacaacgtgcacacatggaccgaacaatataagttccagcccgagtcccctgctcggctggcctctgcgatccttaatgcccataaagagggcgtctgtgggatcagaagcacaacgcgcctggaaaacgttatgtggaagcagattaccaatgagctcaactacgtgctgtgggaaggaggccacgacctgacagtggtcgctggcgatgtgaaaggggttctttccaagggaaaacgggccctcgctccccctgtgaatgacctgaagtattcttggaagacctggggcaaagccaagatctttacacccgagaccagaaacagcacgttcctggtcgatgggccggacacctccgaatgccctaatgagcggcgcgcgtggaactttctcgaggtggaagattacggattcggcatgttcacaaccaatatttggatgaaatttagagaggggagctctgaagtttgtgaccatcggctgatgtccgccgctatcaaggatcagaaagccgtgcacgctgacatgggatactggattgagagctctaagaaccaaacatggcagatcgaaaaagcctcccttatcgaggtcaagacctgcctgtggcccaagacacacaccctctggagcaatggcgtgctggagtctcagatgctgattcctaaagcctatgctggccccatcagccagcataactacagacaagggtatgcgacgcagacagccggaccttggcaccttggcaagctcgaaattgatttcggggagtgccccggaaccaccgttacagtgcaggaagactgtgatcatcgcggcccgtccctgcggaccacgacagctagcgggaaactggtcacccagtggtgctgtagatcttgcacaatgcctcccctccgctttctgggagaggacggctgttggtacggcatggagatcagaccccttaacgaaaaggaggaaaatatggtgaaatcccaagtgagcgccgggcacggaacctccgagacattctctatgggcctgctctgcctgaccctgtttgtcgaagagtgtcttcggcgcagagttacgcggaagcatatgattctcgtggtggtcaccacactgtgcgccatcatcctcgggggactcacctggatggatctgcttcgcgctctgattatgctcggcgacacaatgagcgggagaatgggaggccagatccacctggccattatggcggtgttcaagatgtcccctggctatgttctggggatctttcttcggaaactgacctctcgcgagacggctctcatggtgattggaatggccatgacaaccgtcctgagcatcccgcacgacctcatggagttcatcgatggcatttccctggggcttatcctgctcaagatggtgacacattttgacaacacccaggttggaaccctggccctggctcttacattcattaaatctacgatgcccctggtgatggcctggagaaccatcatggcggtcctctttgtggtcacactgattcctctctgtcggaccagctgcctgcagaagcaatcccactgggtggagatcacagctcttattctgggcgcccaggccctccccgtttacctgatgaccctgatgaaaggggctagcaagcgctcttggcctcttaatgaaggaatcatggccgtgggcctggtctccctcctgggcagcgctctcctgaagaacgatgtgccccttgccgggcctatggttgcgggaggcctgctgctcgccgcttatgtgatgtctgggtccagcgccgacctgtctcttgagaaagctgccaatgtccagtgggatgaaatggccgacatcacgggatccagccccattatcgaggtgaagcaagatgaggacggctccttcagcattagagatgtggaagagacaaacatgatcaccctgctcgttaaactggctctcattaccgtctctgggctgtacccgcttgcgatccctgtgacaatgaccctgtggtacatgtggcaagtgaagacacagcggagcggagccctgtgggacgtcccctcccctgctgccgcccagaaagctacgctcaccgaaggcgtgtatagaatcatgcaacgcggcctgtttgggaagacacaggttggagtgggcattcataccgagggggtcttccacacaatgtggcatgtgacccggggatctgttatctgtcacgaaagcggcagacttgagccctcctgggccgatgtgcgcaatgacatgatttcttacgggggaggctggcggctgggcgataagtgggacaaagaggaagacgtccaggtgctcgcgatcgagccggggaagaaccctaaacacgttcagacgaagcccggactgttcaaaaccctcacaggcgaaattggggctgtgaccctggattttaagcctggaacaagcggctcccccatcatcaatagaaaagggaaggtcattggcctttatggaaacggcgtggtgaccaagtctggggactacgtcagcgccatcacacaagccgagcgcattggagagcccgattatgaagttgacgaggatatcttccggaaaaagagactgacgattatggacctgcatcctggcgctgggaaaaccaagcgcatcctcccgtccattgtgcgggaagccctgaaaagacggcttcgcacactgatcctcgcgcccaccagagtggtcgctgccgagatggaagaggccctgcggggactccctatccgctaccagacccccgctgtcaagagcgagcacacaggcagagaaattgttgatctgatgtgccatgccacgtttaccacacggcttctgtcttccaccagagtgcctaattataacctgatcgtcatggacgaggctcacttcacagatcccagctctgtggccgcgcgcgggtacatttccacccgggttgaaatgggcgaggccgctgccgtgtttatgacggctacacctccgggaaccaccgaccccttccctcagagcaattcccccatcgaagatattgagagagagatccctgaacgctcttggaacacaggctttgactggatcaccgactaccaggggaagacagtctggttcgtgcccagcattaaagccggaaatgatatcgccaactgcctccggaagtccggcaaaaaggtcattcaactgagcagaaaaacctttgacacggagtatccgaagacaaaacttaccgattgggacttcgtgatcacaaccgatatttctgaaatgggggctaactttcgcgcgggacgggttatcgaccctagacgctgtctgaaacccgtgatcctcacggatggccccgagagagtgattctggccgggcctatccccgtcacccctgcttccgccgcccagcggcgcggcagaattggacggaatccggctcaggaagacgatcaatacgttttcagcggcgaccccctgcgcaacgatgaggaccacgcccattggacagaggcgaagatgctccttgataatatctatacccctgaagggattatccccacactgttcggacctgagagagagaagacccaggctattgacggcgagtttcggctgagaggggagcagcgcaagacattcgtggaactcatgcggagaggagacctgcccgtgtggctttctcacaaagtcgccagcgccggcatctcctacaaggatcgcgagtggtgctttaccggcgaacggaacaatcagatcctggaggaaaacatggaggtggagatttggacgagagaaggggagaagaaaaagctccggccgaaatggctggacgctcgcgtttatgccgatcctatggcgctgaaggacttcaaagaatttgcctctggaagaaagagcatcacactcgatattcttaccgagatcgcttccctgcccacctacctgtctagccgggccaagctcgctctggacaatattgtgatgcttcatacaaccgaacgcggcgggaaagcctatcaacacgctctgaacgagctccctgagtccctggaaacactgatgctcgtcgcccttctgggagcgatgacggccggcatcttcctgtttttcatgcaggggaagggaatgggcaaactcagcatgggcctgatcgctattgccgtggcttctgggcttctgtgggtcgccgagatccagccccagtggattgccgcttccatcattctcgaatttttcctgatggtgctgctcgttcctgagcccgaaaagcaaagaaccccgcaggataatcagcttatctacgtgatcctgacaattctgaccatcattgcgctcgtcgccgctaacgagatgggactgatcgagaaaacaaagaccgactttggcttctaccaggtgaaagccgaaacgaccattcttgatgttgacctgcggcctgccagcgcttggacactctatgccgtggcgaccacaatcctgacccccatgctgcgccatacgattgagaatacatccgccaacctctctcttgctgccatcgctaatcaagccgcggtcctgatggggctgggaaagggctggcccctccacagaatggatctgggggtgcctcttctggccatgggatgttacagccaggtgaacccgaccacactcaccgcttccctggttatgctgctcgtccactatgccatcattggccccggccttcaggctaaggccacccgggaagctcagaaacgcacagccgcggggatcatgaagaatcctacggtggacggaattaccgtgatcgatctggagcccatttcttacgaccctaaatttgagaagcaactgggccaggtcatgctcctggttctttgcgtggggcagctgctcctgatgagaacaacctgggccttctgtgaagtgctgacactcgctaccggacccatccttacgctgtgggagggcaaccctgggcggttctggaacacaaccatcgccgtcagcaccgctaatatttttagaggatcctatctggccggcgccggcctcgcgttcagcctgatcaaaaacgctcaaacaccgcgccgggggaccggaacaatgggcgaaacgcttggggagaagtggaagagacagctcaattctctcgaccgcaaagaatttgaggagtacaagcggtccggcattctggaagtggatagaaccgaggcccgcagcgctctgaaagacggctctaagatcaaatatgccgtttcccgggggacaagcaagattagatggatcgtggaacgcggaatggtcaagcccaaaggcaaggtggttgatctcggctgcgggcggggaggctggtcttactacatggccacccttaaaaacgtgacagaggtcaaggggtataccaaaggaggccctgggcatgaagaacccatccctatggctacgtacggatggaatctggtgaagctgcacagcggcgtggacgtcttctataagcccaccgagcaggttgatacactcctgtgtgacattggcgaatcctctagcaacccgaccatcgaggaagggagaacacttcgcgtgctgaaaatggtggagccttggctctccagcaagcccgaattttgcattaaagtcctgaatccctacatgcctaccgtgatcgaggagctggaaaagctccagcggagacatggaggctcccttgttcgctgtcccctgtctagaaacagcacacacgagatgtattgggtgtccggggtctctggaaatattgtgagctccgttaacaccacgtctaaaatgctgctcaatcggttcacaacccgccacagaaagcctacctacgaaaaagatgccgacctgggcgcggggacacggagcgtgtccacggagaccgagaagccggatatgacaatcattggaagacggcttcaacgcctgcaggaagaacataaggaaacctggcactatgaccatgagaacccctacagaacatgggcctaccacggcagctatgaagctccttctaccggctccgccagctctatggtcaatggggtggttaaactcctgacaaagccctgggatgtggtccctatggtgacccagctggctatgacggacaccacaccctttggacagcaacgggtcttcaaagagaaggtggacacccgcacaccgcagcctaaacccggcacccaggttgtgatgacgacaaccgccaactggctctggacactgcttgggagaaagaagaatcctcggctgtgcacccgcgaggaatttatctccaaagtcagaagcaacgcggccatcggagctgtgttccaggaggaacaaggctggacgtctgcctccgaggctgtgaatgatagccggttttgggaactcgttgacaaggagcgcgccctgcatcaggaggggaaatgtgaatcctgcgtgtacaacatgatgggcaagagagagaagaaacttggagagttcggccgggctaaagggagccgcgccatttggtatatgtggctgggagcgagatttctcgagttcgaagccctgggcttcctgaacgaggatcactggtttgggcgggaaaattcttggagcggagtcgaaggcgaggggctccaccgcctgggctacatccttgaagacattgataaaaaggacggagatctgatctatgctgacgataccgccggctgggacacaagaattaccgaggatgacctcctgaacgaggaacttatcacagagcagatgacaccccatcacaaaatcctggctaaggccattttcaaactcacataccaaaataaggtggttaaggtgctgcggcctacccccaaaggggccgtcatggatatcatttccagaaaggaccagcgcggatctggccaggtggggacgtatggactgaacacatttaccaatatggaagtccagctcatccggcaaatggaggcggaaggcgtgattaccagagacgatatgcataacccgaaagggctgaaggagcgcgttgagaaatggcttaaggaatgcggcgtggaccggctgaaaagaatggctatcagcggagatgactgtgtcgtgaagcctctcgatgagcgcttctccacatctctgctttttctgaatgacatgggcaaggttcggaaagatatcccccagtgggaacccagcaaggggtggaaaaactggcaggaggtgcctttctgctcccaccactttcataagattttcatgaaagacggaagatctctcgtcgtgccgtgtcgcaatcaggatgaactgatcggccgggccagaattagccaaggggccggatggtccctgcgcgagaccgcttgcctcggcaaggcctacgctcagatgtggagcctgatgtactttcaccggagagaccttcggctggcctctatggcgatctgttccgccgtgcccacagagtggttccctacgagcagaaccacatggtctattcatgctcaccatcagtggatgaccacagaagatatgctcaaggtttggaaccgcgtctggatcgaggacaatcccaacatgatcgacaaaacccctgtgcactcctgggaagatattccctatctggggaagcgggaggacctttggtgcggcagcctgatcggactctcctctagagccacgtgggctaaaaatattcacaccgccatcacacaggtgcgcaacctgattggcaaggaagagtacgtcgattatatgcctgcgatgagacggtacagcgcccattttgagtccgaaggggtgctgtga

SEQ ID NO: 21075 - RNA, 9867 nt, synthetic construct
  misc_feature 1..9867: note = derived and/or modified CDS sequence (opt5) from DENV-4__KT026309__SS-prME
  source 1..9867: mol_type = other RNA
agcaccatcaccctgctgtgcctgattcccacggtgatggccttccacctttccaccagagacggagagcctctgatgatcgtggctaagcatgaacgggggagaccgctgctgtttaagacaaccgagggaattaacaagtgtacacttatcgccatggatctgggcgaaatgtgcgaggacaccgttacatacaaatgtcccctcctggtgaataccgaacctgaggatattgactgctggtgtaacctgacgtctacctgggtgatgtatgggacatgcacccagagcggagagagacggcgcgaaaagagatccgtcgcgctcacaccccactctggcatggggctggagacccgggctgaaacgtggatgagctccgagggagcctggaaacatgcccagcgcgtggagtcttggatccttagaaatcctggcttcgctctgctcgccggctttatggcttacatgatcgggcagacaggcattcagcggaccgttttctttatcctgatgatgcttgtggcccccagctatggcatgcgctgtgtcggggtgggaaacagagatttcgttgaaggcgtgtccgggggagcgtgggtcgacctggtgctcgagcacggcggctgcgtgacaaccatggcccaggggaagcctaccctggattttgaactgattaagacaacggctaaagaggtcgccctcctgcggacctactgtatcgaagctagcatttctaatatcacaaccgccacacgctgcccgacccaaggagagccctatcttaaggaggaacaggaccagcagtacatttgtagacgggatatggttgaccgcggctgggggaacggatgcggcctgttcgggaaaggaggcgtggtgacgtgcgcgaagttttcctgtctcggcaaaatcacagggaatctggtccaaatcgagaaccttgaatataccgtggttgtgaccgtccataatggagatacacacgccgtgggcaacgacaccagcaatcacggggttacagctacgattacccctagatctccctccgtggaggtccagctgcctgattacggagaactcacactggactgcgagccccggagcggcatcgacttcaacgagatgattctgatgaagatgaagaccaaaacatggctcgtgcataagcagtggtttctggatcttccgctgccttggaccacgggggccgacaccctcgaagtccactggaatcataaagagagaatggtgacattcaaggttccccacgctaaacgccaggatgtgaccgtcctgggctctcaagaaggagccatgcactccgcccttgctggcgcgacagaggtggacagcggggatggaaaccatatgtttgccggccacctgaagtgtaaagttcggatggaaaagctcagaatcaaggggatgtcctacaccatgtgctctggaaaattcagcattgacaaggagatggctgagacgcagcatggcacaaccgtggtcaaagtgaagtatgaagggacaggcgccccttgtaaagtgcccatcgagatccgcgatgttaataaggaaaaggtcgtgggacggattatctccagcacccccttcgccgagaacaccaactctgtgacaaatattgagctggaacctccgtttggcgactcctacatcgtcattggggtgggagatagcgctctgacgctccactggttcagaaaaggctctagcatcgggaagatgtttgagtccacctatcgcggagccaaacggatggcgatcctgggcgaaacagcttgggacttcgggtctgttggcggacttctgaccagcctcggcaaggccgtgcatcaggtctttgggtccgtgtacacaaccatgttcggaggcgttagctggatggtgcgcattctgatcgggctgcttgtcctctggattggaacgaactctcgcaatacatccatggccatgagctgcatcgctgtgggcgggattaccctgtttctgggcttcaccgttcacgccgatatgggatgtgtggtctcttggtccggcaaagagctcaagtgcgggagcggaatctttgtgattgacaacgtgcacacatggaccgaacaatataagttccagcccgagtcccctgctcggctggcctctgcgatccttaatgcccataaagagggcgtctgtgggatcagaagcacaacgcgcctggaaaacgttatgtggaagcagattaccaatgagctcaactacgtgctgtgggaaggaggccacgacctgacagtggtcgctggcgatgtgaaaggggttctttccaagggaaaacgggccctcgctccccctgtgaatgacctgaagtattcttggaagacctggggcaaagccaagatctttacacccgagaccagaaacagcacgttcctggtcgatgggccggacacctccgaatgccctaatgagcggcgcgcgtggaactttctcgaggtggaagattacggattcggcatgttcacaaccaatatttggatgaaatttagagaggggagctctgaagtttgtgaccatcggctgatgtccgccgctatcaaggatcagaaagccgtgcacgctgacatgggatactggattgagagctctaagaaccaaacatggcagatcgaaaaagcctcccttatcgaggtcaagacctgcctgtggcccaagacacacaccctctggagcaatggcgtgctggagtctcagatgctgattcctaaagcctatgctggccccatcagccagcataactacagacaagggtatgcgacgcagacagccggaccttggcaccttggcaagctcgaaattgatttcggggagtgccccggaaccaccgttacagtgcaggaagactgtgatcatcgcggcccgtccctgcggaccacgacagctagcgggaaactggtcacccagtggtgctgtagatcttgcacaatgcctcccctccgctttctgggagaggacggctgttggtacggcatggagatcagaccccttaacgaaaaggaggaaaatatggtgaaatcccaagtgagcgccgggcacggaacctccgagacattctctatgggcctgctctgcctgaccctgtttgtcgaagagtgtcttcggcgcagagttacgcggaagcatatgattctcgtggtggtcaccacactgtgcgccatcatcctcgggggactcacctggatggatctgcttcgcgctctgattatgctcggcgacacaatgagcgggagaatgggaggccagatccacctggccattatggcggtgttcaagatgtcccctggctatgttctggggatctttcttcggaaactgacctctcgcgagacggctctcatggtgattggaatggccatgacaaccgtcctgagcatcccgcacgacctcatggagttcatcgatggcatttccctggggcttatcctgctcaagatggtgacacattttgacaacacccaggttggaaccctggccctggctcttacattcattaaatctacgatgcccctggtgatggcctggagaaccatcatggcggtcctctttgtggtcacactgattcctctctgtcggaccagctgcctgcagaagcaatcccactgggtggagatcacagctcttattctgggcgcccaggccctccccgtttacctgatgaccctgatgaaaggggctagcaagcgctcttggcctcttaatgaaggaatcatggccgtgggcctggtctccctcctgggcagcgctctcctgaagaacgatgtgccccttgccgggcctatggttgcgggaggcctgctgctcgccgcttatgtgatgtctgggtccagcgccgacctgtctcttgagaaagctgccaatgtccagtgggatgaaatggccgacatcacgggatccagccccattatcgaggtgaagcaagatgaggacggctccttcagcattagagatgtggaagagacaaacatgatcaccctgctcgttaaactggctctcattaccgtctctgggctgtacccgcttgcgatccctgtgacaatgaccctgtggtacatgtggcaagtgaagacacagcggagcggagccctgtgggacgtcccctcccctgctgccgcccagaaagctacgctcaccgaaggcgtgtatagaatcatgcaacgcggcctgtttgggaagacacaggttggagtgggcattcataccgagggggtcttccacacaatgtggcatgtgacccggggatctgttatctgtcacgaaagcggcagacttgagccctcctgggccgatgtgcgcaatgacatgatttcttacgggggaggctggcggctgggcgataagtgggacaaagaggaagacgtccaggtgctcgcgatcgagccggggaagaaccctaaacacgttcagacgaagcccggactgttcaaaaccctcacaggcgaaattggggctgtgaccctggattttaagcctggaacaagcggctcccccatcatcaatagaaaagggaaggtcattggcctttatggaaacggcgtggtgaccaagtctggggactacgtcagcgccatcacacaagccgagcgcattggagagcccgattatgaagttgacgaggatatcttccggaaaaagagactgacgattatggacctgcatcctggcgctgggaaaaccaagcgcatcctcccgtccattgtgcgggaagccctgaaaagacggcttcgcacactgatcctcgcgcccaccagagtggtcgctgccgagatggaagaggccctgcggggactccctatccgctaccagacccccgctgtcaagagcgagcacacaggcagagaaattgttgatctgatgtgccatgccacgtttaccacacggcttctgtcttccaccagagtgcctaattataacctgatcgtcatggacgaggctcacttcacagatcccagctctgtggccgcgcgcgggtacatttccacccgggttgaaatgggcgaggccgctgccgtgtttatgacggctacacctccgggaaccaccgaccccttccctcagagcaattcccccatcgaagatattgagagagagatccctgaacgctcttggaacacaggctttgactggatcaccgactaccaggggaagacagtctggttcgtgcccagcattaaagccggaaatgatatcgccaactgcctccggaagtccggcaaaaaggtcattcaactgagcagaaaaacctttgacacggagtatccgaagacaaaacttaccgattgggacttcgtgatcacaaccgatatttctgaaatgggggctaactttcgcgcgggacgggttatcgaccctagacgctgtctgaaacccgtgatcctcacggatggccccgagagagtgattctggccgggcctatccccgtcacccctgcttccgccgcccagcggcgcggcagaattggacggaatccggctcaggaagacgatcaatacgttttcagcggcgaccccctgcgcaacgatgaggaccacgcccattggacagaggcgaagatgctccttgataatatctatacccctgaagggattatccccacactgttcggacctgagagagagaagacccaggctattgacggcgagtttcggctgagaggggagcagcgcaagacattcgtggaactcatgcggagaggagacctgcccgtgtggctttctcacaaagtcgccagcgccggcatctcctacaaggatcgcgagtggtgctttaccggcgaacggaacaatcagatcctggaggaaaacattgaggtggagatctggacgagagaaggggagaagaaaaagctccggccgaaatggctggacgctcgcgtttatgccgatcctatggcgctgaaggacttcaaagaatttgcctctggaagaaagagcattacactcgatatccttaccgagattgcttccctgcccacctacctgtctagccgggccaagctcgctctggacaatatcgtgatgcttcatacaaccgaacgcggcgggaaagcctatcaacacgctctgaacgagctccctgagtccctggaaacactgatgctcgtcgcccttctgggagcgatgacggccggcatcttcctgtttttcatgcaggggaagggaatgggcaaactcagcatgggcctgattgctatcgccgtggcttctgggcttctgtgggtcgccgagattcagccccagtggatcgccgcttccattatcctcgaatttttcctgatggtgctgctcgttcctgagcccgaaaagcaaagaaccccgcaggataatcagcttatctacgtgattctgacaatcctgaccattatcgcgctcgtcgccgctaacgagatgggactgattgagaaaacaaagaccgactttggcttctaccaggtgaaagccgaaacgaccatccttgatgttgacctgcggcctgccagcgcttggacactctatgccgtggcgaccacaattctgacccccatgctgcgccatacgatcgagaatacatccgccaacctctctcttgctgccatcgctaatcaagccgcggtcctgatggggctgggaaagggctggcccctccacagaatggatctgggggtgcctcttctggccatgggatgttacagccaggtgaacccgaccacactcaccgcttccctggttatgctgctcgtccactatgccattatcggccccggccttcaggctaaggccacccgggaagctcagaaacgcacagccgcggggattatgaagaatcctacggtggacggaatcaccgtgattgatctggagcccatctcttacgaccctaaatttgagaagcaactgggccaggtcatgctcctggttctttgcgtggggcagctgctcctgatgagaacaacctgggccttctgtgaagtgctgacactcgctaccggacccatccttacgctgtgggagggcaaccctgggcggttctggaacacaaccattgccgtcagcaccgctaatatctttagaggatcctatctggccggcgccggcctcgcgttcagcctgattaaaaacgctcaaacaccgcgccgggggaccggaacaatgggcgaaacgcttggggagaagtggaagagacagctcaattctctcgaccgcaaagaatttgaggagtacaagcggtccggaatcctggaagtggatagaaccgaggcccgcagcgctctgaaagacggctctaagattaaatatgccgtttcccgggggacaagcaagatcagatggatcgtggaacgcggaatggtcaagcccaaaggcaaggtggttgatctcggctgcgggcggggaggctggtcttactacatggccacccttaaaaacgtgacagaggtcaaggggtataccaaaggaggccctgggcatgaagaacccattcctatggctacgtacggatggaatctggtgaagctgcacagcggcgtggacgtcttctataagcccaccgagcaggttgatacactcctgtgtgacatcggcgaatcctctagcaacccgaccattgaggaagggagaacacttcgcgtgctgaaaatggtggagccttggctctccagcaagcccgaattttgcatcaaagtcctgaatccctacatgcctaccgtgattgaggagctggaaaagctccagcggagacatggaggctcccttgttcgctgtcccctgtctagaaacagcacacacgagatgtattgggtgtccggggtctctggaaatatcgtgagctccgttaacaccacgtctaaaatgctgctcaatcggttcacaacccgccacagaaagcctacctacgaaaaagatgccgacctgggcgcggggacacggagcgtgtccacggagaccgagaagccggatatgacaattatcggaagacggcttcaacgcctgcaggaagaacataaggaaacctggcactatgaccatgagaacccctacagaacatgggcctaccacggcagctatgaagctccttctaccggctccgccagctctatggtcaatggggtggttaaactcctgacaaagccctgggatgtggtccctatggtgacccagctggctatgacggacaccacaccctttggacagcaacgggtcttcaaagagaaggtggacacccgcacaccgcagcctaaacccggcacccaggttgtgatgacgacaaccgccaactggctctggacactgcttgggagaaagaagaatcctcggctgtgcacccgcgaggaatttatctccaaagtcagaagcaacgcggccattggagctgtgttccaggaggaacaaggctggacgtctgcctccgaggctgtgaatgatagccggttttgggaactcgttgacaaggagcgcgccctgcatcaggaggggaaatgtgaatcctgcgtgtacaacatgatgggcaagagagagaagaaacttggagagttcggccgggctaaagggagccgcgccatctggtatatgtggctgggagcgagatttctcgagttcgaagccctgggcttcctgaacgaggatcactggtttgggcgggaaaattcttggagcggagtcgaaggcgaggggctccaccgcctgggctacattcttgaagacatcgataaaaaggacggagatctgatttatgctgacgataccgccggctgggacacaagaatcaccgaggatgacctcctgaacgaggaacttatcacagagcagatgacaccccatcacaaaattctggctaaggccatcttcaaactcacataccaaaataaggtggttaaggtgctgcggcctacccccaaaggggccgtcatggatattatctccagaaaggaccagcgcggatctggccaggtggggacgtatggactgaacacatttaccaatatggaagtccagctcattcggcaaatggaggcggaaggcgtgatcaccagagacgatatgcataacccgaaagggctgaaggagcgcgttgagaaatggcttaaggaatgcggcgtggaccggctgaaaagaatggctatcagcggagatgactgtgtcgtgaagcctctcgatgagcgcttctccacatctctgctttttctgaatgacatgggcaaggttcggaaagatattccccagtgggaacccagcaaggggtggaaaaactggcaggaggtgcctttctgctcccaccactttcataagatcttcatgaaagacggaagatctctcgtcgtgccgtgtcgcaatcaggatgaactgattggccgggccagaatcagccaaggggccggatggtccctgcgcgagaccgcttgcctcggcaaggcctacgctcagatgtggagcctgatgtactttcaccggagagaccttcggctggcctctatggcgatttgttccgccgtgcccacagagtggttccctacgagcagaaccacatggtctatccatgctcaccatcagtggatgaccacagaagatatgctcaaggtttggaaccgcgtctggatcgaggacaatcccaacatgattgacaaaacccctgtgcactcctgggaagatatcccctatctggggaagcgggaggacctttggtgcggcagcctgattggactctcctctagagccacgtgggctaaaaatatccacaccgccattacacaggtgcgcaacctgatcggcaaggaagagtacgtcgattatatgcctgcgatgagacggtacagcgcccattttgagtccgaaggggtgctgtga

SEQ ID NO: 21076 - RNA, 9867 nt, synthetic construct
  misc_feature 1..9867: note = derived and/or modified CDS sequence (opt5) from DENV-4__KF907503__SS-prME
  source 1..9867: mol_type = other RNA
agcaccatcacactgctctgcctgattcccacggtgatggccttccacctttccaccagagacggcgagcctctgatgatcgtcgctaagcatgaacgggggcgcccgctcctgtttaaaacaaccgagggaattaacaagtgtacacttatcgccatggatctgggcgaaatgtgcgaggacaccgttacatacaaatgtcccctcctggtgaataccgaacctgaggatattgactgctggtgtaacctgacgtctacctgggtgatgtatgggacatgcacccagagcggagagagacggcgcgaaaagagatccgtcgcgctcacaccccactctggcatggggctggagacccgggctgaaacgtggatgagctccgagggagcctggaaacatgcccaacgcgtggagtcttggatccttagaaatcctggcttcgctctgctcgccggctttatggcttacatgatcgggcagacaggaattcagcggaccgttttctttgtgctgatgatgcttgtcgcccccagctatggcatgcgctgtgtgggggttggaaacagagatttcgtggaaggcgtctccgggggagcgtgggtggacctggtgctcgagcacggcggctgcgtcacaaccatggcccaggggaagcctaccctggattttgaactgacaaagacgaccgctaaagaggttgccctcctgcggacatactgtatcgaagctagcatttctaatatcaccacagccacccgctgcccgacgcaaggagagccctatcttaaggaggaacaggaccagcagtacatttgtagacgggatgtggtggaccgcggctgggggaacggatgcggcctgttcgggaaaggaggcgtcgtgacatgcgcgaagttttcctgtagcggcaaaatcaccgggaatctcgttcaaattgagaacctggaatataccgtggtcgtgacagttcataatggagatacccacgccgtgggcaacgacacatctaatcacggggtcacggctatgatcacccctagatcccccagcgtggaggtcaagcttcctgattacggagaactgacactcgactgcgagccccggtctggcatcgacttcaacgagatgattctgatgaagatgaaaaagaaaacctggctggtgcataagcagtggtttctcgatctgccgcttccttggacagccggggctgacacctccgaagttcactggaattacaaagagagaatggtgacgttcaaggtcccccatgccaaacgccaggatgtgaccgttctgggcagccaggaaggagccatgcactccgctctcgcgggcgccacagaggtggactctggggatggaaaccacatgtttgctggccatctgaagtgtaaggtccggatggaaaaacttagaatcaaggggatgagctataccatgtgctccggaaaattcagcattgacaaggagatggccgagacacaacacggcaccacggtggtgaaagttaagtacgaaggggccggcgctccttgtaaggtccccatcgagattcgcgatgtgaataaagaaaaggtggtcggacggatcatctcttccacacccctggccgagaacaccaacagcgtgacaaatattgagctcgaacctccgttcggcgactcttatatcgttattggggtgggaaacagcgcgctgaccctgcattggtttagaaaaggctcctctatcgggaagatgttcgagagcacctaccgcggagctaaacggatggccattctcggcgaaacagcctgggattttgggtccgtcggcggactgttcacgagccttggcaaggctgtgcaccaggtttttgggtctgtgtataccacaatgttcggaggcgtctcctggatgatcagaatcctgattgggtttctcgtgctgtggatcggaaccaatagccgcaacacatctatggccatgacctgcattgctgttggcgggatcacgctgttccttggctttacagtgcaggccgacatgggatgtgtcgtgtcctggagcggcaaggagctcaaatgcgggtccggaattttcgtggtcgataatgttcatacctggaccgaacaatacaagtttcagcccgagtctcctgcgcggctggccagcgctatcctgaacgcccacaaagacggcgtgtgtgggattagatccacaacccgcctcgagaatgtgatgtggaagcagatcacaaacgaactgaattatgtcctttgggagggaggccacgacctgacggtggttgctggcgatgtgaaaggggtcctcaccaagggaaagcgggccctgacaccccctgtgtctgacctgaaatacagctggaagacctggggcaaagcgaagatcttcacacccgaagccagaaactccacctttcttattgatgggccggacacgagcgagtgccctaatgaacggcgcgcttggaactctctcgaggttgaggattacggattcggcatgttcaccacaaatatctggatgaaatttagagaagggtccagcgaggtgtgtgaccatcggctgatgtctgccgctattaaggatcagaaagccgtccacgccgacatgggatattggatcgaatccagcaagaaccaaacctggcagattgagaaggcttctctgatcgaagtgaaaacatgcctctggcccaagacccatacactgtggagcaatggcgttcttgagtcccagatgctgatccctaaaagctacgcgggccccttctctcagcacaactatagacaagggtacgccacccagacggtgggaccttggcacctcggcaagctggagattgattttggggaatgccccggaacaaccgtcaccatccaggaggactgtgatcatcgcggcccgtccctgcggacaagcaccgcttccgggaaacttgtgacgcagtggtgctgtagatcttgcacaatgcctcccctccgcttcctgggagaagacggctgttggtatggcatggagattagacccctgagcgagaaggaagagaacatggtgaagtcccaagtcaccgccgggcagggaacatctgaaacctttagcatgggcctcctgtgccttacactgttcgttgaggaatgtctccggcgcagagtgacccggaaacacatgatcctggtggtcgtgattacgctgtgcgccatcatccttgggggactcacctggatggatctgctgcgcgctctcattatgctgggcgacacaatgtccgggagaatcggaggccagattcatcttgccatcatggcggtttttaagatgtctcctggctacgtgctgggggtcttcctccggaaactgaccagccgcgagacagctctgatggtgattggaatggccatgaccacggttctttccatcccgcacgacctgatggagctcatcgatggcattagcctggggctcatcctgcttaagattgtgacacagtttgacaatacccaagtcggaacactggccctctctctgaccttcatcagatccaccatgcccctgattatggcttggcggacaatcatggccgtgctttttgtcgtgacgctgattcctctctgtcgcaccagctgcctgcagaaacagtctcattgggttgaaatcacagcgctcatcctgggcgctcaagcccttcccgtgtatctgatgaccctcatgaagggggcctccagacggagctggcctctgaacgagggaattatggctgtcggcctggtgtctcttctgggctccgccctcctgaagaatgatgttcccctcgctgggcctatggtggccggaggcctgcttctggcggcctacgtcatgagcgggtccagcgctgacctgtctctcgaaaaagccgctaacgtgcagtgggatgagatggccgacatcacaggaagctcccccattatcgaagtgaagcaggatgaggacggctctttcagcattagagatgttgaggaaaccaatatgatcacgctgcttgtcaaactggccctcatcacagtgtccgggctgtacccgctcgctattcctgtgaccatgaccctgtggtatatgtggcaggtcaagacacaacgctctggagcgctttgggacgtgcccagccctgccgctacccagaaagccgccctgtccgagggcgtttaccggatcatgcagagaggcctgtttgggaagacacaggtgggagtcggcattcacatggaaggggtgttccacacgatgtggcatgttacccgcggatctgtgatctgtcacgagacaggccggctcgaacccagctgggctgatgtcagaaacgacatgatttcctatgggggaggctggcgcctgggcgataagtgggacaaagaggaggacgtgcaagttcttgccatcgaaccggggaagaatcctaaacatgtgcagaccaagcccggactgttcaaaacactcaccggcgagatcggggcggtcacgctggattttaagcctggaaccagcggctctcccattatcaaccggaaagggaaggtgattggcctctacggaaatggcgtggtcacaaagtccggggactatgttagcgctatcacccaggccgaaagaattggagagcccgattacgaggtggacgaagatatcttccgcaaaaagcggctgacaattatggaccttcaccctggcgccgggaaaaccaagagaatcctgccgtctatcgtgcgggaggctctgaaacgcagactccggacactgattcttgcccccacgcgcgtcgtggcggctgaaatggaggaagccctgagaggactccctatccggtatcagacccccgccgttaagtccgagcatacaggcagagagattgtggatctgatgtgccacgctaccagcaccacacgcctcctgtcctctacgcgggtccctaactacaatcttatcgtgatggacgaagcccactttaccgatcccagctccgttgctgccagagggtacattagcacacgcgtggagatgggcgaagcggccgctatcttcatgaccgccacacctccgggagctaccgacccctttcctcaatctaactcccccatcgaggatattgaacgggagatccctgagagaagctggaatacgggcttcgactggattacagactatcaggggaagaccgtctggtttgtgccctctatcaaagccggaaacgatattgccaattgcctgcgcaagagcggcaaaaaggtcatccagctgtcccggaaaaccttcgacacagaatacccgaagaccaagctcacagattgggactttgtggttaccacggatatctctgagatgggggctaacttcagagcgggacgcgtgattgaccctagacggtgtctgaaacccgtgatccttacagatggccccgaacgcgtcattctggccgggcctatccccgttacccctgctagcgccgcccaaagacggggccgcattggaagaaacccggctcaggaggacgatcagtatgtgttttccggcgaccccctcaagaatgatgaagaccatgcccactggacagaggcgaaaatgctgctggataacatctacacccctgaggggattatccccacgctcttcggacctgaacgggagaagacccaggctatcgacggcgaattcagacttcgcggggagcaacggaaaacatttgtggagctgatgagacgcggagacctgcccgtctggctctcttataaggtggccagcgccggcatttcctacaaggatcgggaatggtgcttcaccggcgagagaaataaccagatcctggaagagaatatggaagttgagatttggacacgggagggggaaaaaaagaaacttcgcccgagatggctggacgctcgggtgtatgccgatcctatggcgctcaaggactttaaagagttcgccagcggacgcaagtctatcaccctggatattctgacagaaatcgcttccctccccacctaccttagctccagagccaagctggctctggacaacatcgtcatgctccatacgacagagcggggcgggcgcgcctaccagcacgctctgaatgaacttcctgagtctctggagaccctcatgctggtggccctgctcggagcgatgaccgccggcatttttcttttctttatgcaggggaaaggaatcggcaagctgagcatgggcctgattatcattgctgtcgcctccgggctcctgtgggtggctgaaatccaaccccagtggatcgccgcctctattatccttgagttctttctgatggttctcctgattcctgaacccgagaaacagagaacaccgcaggataaccaactgatctatgtgattctcaccatccttacaattatcggactgatcgctgcgaatgaaatgggcctgattgagaagacgaaaaccgacttcgggttttaccaggtcaagacagagaccacaatcctcgatgtggacctgcggcctgccagcgcttggaccctttatgccgttgccacgaccattctgacacccatgctccgccacaccatcgaaaacacatccgctaatctgagcctggccgcgattgccaaccaggctgccgtgctcatgggacttggcaaagggtggcccctgcatagaatggatctgggagtccctctcctggctatgggctgttactctcaggtgaatccgaccacgcttacagcctccctggtgatgctcagcgttcactatgcgatcatcggccccgggctgcaagccaaggctacccgggaggcccagaagagaacagctgccggaattatgaaaaaccctaccgtcgacggcatcaccgtgattgatctggaacccatctcttacgaccctaagttcgagaaacagctcgggcaagtgatgcttctggtcctgtgcgctggacagctcctgcttatgcgcacaacgtgggccttttgtgaggttctgaccctcgcgacaggccccattctgaccctgtgggaagggaatcctggacggttctggaacacaaccatcgccgtgtccacggctaacatcttcagaggcagctatctcgccggcgctgggcttgccttttctctgattaagaatgcccagacaccgcgccggggaaccggcaccacaggggagaccctgggagaaaaatggaagagacagctcaacagcctggaccgcaaggagttcgaagagtacaaacggtccggcatccttgaggtggatagaacagaagcgaagtctgctctgaaagacgggagcaagattaaacatgccgtctcccgcggaagctccaagatccggtggattgtggagagaggcatggttaagcccaaaggcaaggtggtcgatctcgggtgcggacgcggcgggtggtcttactatatggctacgctgaaaaatgtgaccgaagttaagggatacacaaaaggcgggcctggacacgaggaacccatccctatggccacctatggctggaacctggtgaagctccatagcggcgtcgacgtgttttacaagcccacagagcaagtggatacccttctgtgtgacattggggagtcctctagcaatccgacgatcgaagagggacggaccctgagagtcctcaaaatggttgaaccttggctgtcctctaagcccgagttctgcatcaaagtgcttaacccctatatgcctacagtgattgaagagctggagaagctccagcgcaaacacggcgggaatctggtcagatgtcccctgagccggaactccacccacgaaatgtactgggtgagcggagcctctggcaatatcgtttccagcgtgaacacaacctctaagatgctccttaatcgctttacaaccagacatcggaaacctacgtatgagaaggatgtcgacctgggggctggaacaagatccgtgagcaccgaaaccgagaagccggatatgacaattatcggccggcgcctgcagagactccaggaggaacacaaagagacgtggcattacgaccaagaaaacccctaccggacctgggcctatcacggctcttacgaggcgccttccacagggagcgcctccagcatggttaatggagtggtcaagctgcttaccaaaccctgggatgtgattcctatggttacacagctggctatgaccgacacaacccccttcggccagcagcgcgtgtttaaggaaaaagtcgacacgagaaccccgcaacctaagcccgggacacggatggtgatgaccacaaccgccaactggctctgggctctgctgggaaagaaaaagaatcctcgcctctgcacgagagaggagttcatctctaaagtccggagcaacgccgcgatcggcgccgtgtttcaggaagagcaggggtggacatccgcttctgaagccgttaatgatagccgcttctgggagctggtggacaaggaaagagctcttcaccaagagggcaaatgtgagtcctgcgtctataacatgatgggaaagcgggaaaagaaactgggcgagtttgggcgcgccaagggatctagagctatttggtacatgtggctcggcgcccggttcctggaatttgaggcgcttgggttcctgaacgaagatcattggttcggacgcgagaatagctggtccggcgtggagggggaaggcctccacagactgggatatatcctggaggaaattgacaaaaaggatggcgacctcatgtacgccgatgacaccgctgggtgggatacacggatcaccgaggacgatctgcagaacgaggaacttattacggagcagatggccccccatcacaaaatcctggctaaggccatctttaagctcacctatcagaataaagtggttaaggtgctgagacctacaccccgcggagccgtcatggacattatctctcggaaagatcaaagaggcagcgggcaggtgggaacctacggccttaacacattcaccaatatggaagttcagctgattcgccagatggaggcggaaggggtgatcacacaagacgacatgcagaacccgaagggcctcaaagagcgggtcgagaagtggctgaaagaatgcggagtggatagactgaagcgcatggctatttccggcgacgattgtgtcgtgaagcctctcgacgagcggtttgggaccagcctgcttttcctgaatgatatgggaaaagttagaaaggacatcccccagtgggaaccctctaaaggctggaagaactggcaggaggtgcctttttgctcccatcacttccacaaaatctttatgaaggatgggcgcagcctcgtcgtgccgtgtcggaatcaagacgaactgattggaagagcccgcatctctcagggcgccgggtggtcccttcgggagacggcttgcctgggcaaggcctacgctcagatgtggagcctcatgtatttccatagacgggatctgagactggcctccatggcgatttgttctgccgttcccacagagtggtttcctaccagccgcaccacatggtccatccacgctcatcaccagtggatgaccacagaagacatgctcaaagtgtggaaccgggtctggattgaggataatcccaacatgacggacaagacccctgtgcacagctgggaagacatcccctacctgggaaaaagagaggatctttggtgcggctctctgattgggctctccagccgcgccacatgggctaagaatatccataccgccatcacacaagtgagaaacctgattggaaaagaagagtatgttgactacatgcctgtcatgaagcggtattctgcgcccagcgagtccgaaggcgtgctttga

SEQ ID NO: 21077 - RNA, 9867 nt, synthetic construct
  misc_feature 1..9867: note = derived and/or modified CDS sequence (opt5) from DENV-4__AY947539__SS-prME
  source 1..9867: mol_type = other RNA
agcaccatgacactgctctgcctgatccccacggccatggctttccacctttccaccagagacggcgagcctctgatgattgtggcccggcatgaacgcgggagaccgctcctgtttaagacaaccgagggaatcaacaaatgtacacttattgcgatggatctgggcgaaatgtgcgaggacaccgtcacatacgaatgtcccctcctggttaataccgagcctgaggatatcgactgctggtgtaacctgacgtctgcttgggtgatgtatgggacctgcacacagagcggagaacggcgcagagagaagcggtccgtggccctcaccccccactctggcatggggctggaaacacgcgccgagacctggatgagctccgagggagcttggaaacatgcccaaagagtcgaatcttggattcttcggaatcctggcttcgctctgctcgccggctttatggcgtacatgatcgggcagacgggaatccagcgcacagtgttctttgttctgatgatgcttgtggcccccagctatggcatgagatgtgtcggggtgggaaaccgggatttcgttgagggcgtgtccgggggagcttgggtcgacctggtgctcgaacacggcggctgcgtgaccacaatggcccaggggaagcctaccctggattttgagctgattaaaaccacagctaaggaagtcgccctcctgcgcacgtactgtatcgaggcgagcatttctaatatcaccacagccaccagatgcccgacacaaggagagccctatcttaaggaagagcaggaccagcagtacatttgtcggcgcgatgttgtggacagaggctgggggaacggatgcggcctgttcgggaaaggaggcgtggtcacctgcgctaagttttcctgtagcggcaaaatcacggggaatctcgtgcaaattgaaaacctggagtatacagttgtggtcaccgtgcataatggagatacccacgccgttggcaacgacatccctaatcacggggtgacagctaccatcacaccccggtctccttccgtcgaagtgaagcttcccgattacggagagctgacgctcgactgcgagccgagaagcggcattgacttcaacgaaatgatcctgatgaaaatgaagaagaaaacctggctggtccataagcagtggtttctcgatctgcctcttccctgggccgccggggctgacacatctgaggtgcactggaattacaaagaacgcatggttaccttcaaggtgcctcatgcgaaacggcaggatgtcacagtgctgggctcccaggagggagccatgcacagcgctctcaccggcgccacggaagttgactccggggatggaaaccacatgtttgccggccatctgaagtgtaaagtgagaatggagaagcttcgcattaaggggatgtcttataccatgtgcagcggaaaattctccatcgacaaggagatggctgaaacacaacacggcaccacagtcgtgaaagtgaagtacgagggggccggcgcgccctgtaaagttcccattgaaatccgggatgtcaataaggagaaggtggtgggaagaatcattagctctacccctttcgctgagtatacgaactccgtcacaaacatcgaactggagccgccctttggcgacagctacattgtgatcggggttggagattctgccctcaccctgcattggttccgcaaaggcagctccattgggaagatgctggaatctacatatcggggagccaaaagaatggctatcctcggcgagaccgcctgggactttgggagcgtgggcggactgcttacctccctgggcaaggctgtccaccaggtgttcgggagcgtttacacaacgatgtttggaggcgtgtcttggatggtccgcatcctcattgggttcctggtgctgtggatcggaaccaattcccggaacacaagcatggccatgacctgcattgcggttggcgggatcacactttttctcggcttcaccgtgcatgccgatacgggatgtgctgtctcttggtccggcaaagaactgaagtgcgggagcggaatttttgtgatcgacaatgtgcacacatggaccgagcagtataagttccaacctgagtcccccgccagactggcttctgccattctcaacgcgcacgaagacggcgtctgtgggatccgcagcaccacacggctggagaatatcatgtggaaacagattaccaacgaacttaattacgttctgtgggagggaggccatgatctcacagtggtggccggcgacgtcaagggggtgctgtccaaaggaaagagagctctggcccctcccgttaacgatcttaaatactcttggaagacgtggggcaaggctaaaatctttaccccggaagccaagaatagcacattcctcattgacgggcctgatacctccgagtgccccaacgagcggcgcgcctggaattttctggaagtggaggactatggattcggcatgttcacaaccaacatctggatgaaatttagagaagggagctctgaggtctgtgatcaccggctgatgtccgctgcgattaaggaccagaaagccgtgcatgctgatatgggatactggatcgaaagctctaagaatcagacgtggcaaatcgagaaagcctccctcattgaggttaagacctgcctgtggcctaagacacacaccctttggagcaacggcgtgctggaatctcagatgctcatccccaaagcctatgctggccctttcagccagcacaattacagacaggggtatgccacacaaaccgtcggaccctggcatctgggcaagctggagattgactttggggaatgcccgggaacaaccgtgacgatccaggaggattgtgaccaccgcggcccttcccttcggacaaccaccgcgagcgggaaactcgttacacagtggtgctgtagatcttgcaccatgccccccctgcgcttcctgggagaggatggctgttggtacggcatggaaattagacctctctccgagaaggaagagaacatggtgaaaagccaggtctccgctgggcaaggaacgtctgaaacatttagcatgggcctgctttgcctgaccctcttcgtggaggagtgtctgcggcgcagagtgacacggaagcatatgatcctggtcgttgtgaccacactttgcgccatcattctcgggggactgacctggatggacctgctccgcgccctgatcatgcttggcgacacgatgtccgggagaatgggaggccagattcacctggctatcatggccgtgtttaagatgtctccgggctatgtcctcgggattttcctgcggaaactgaccagccgcgaaacagcgcttatggtgatcggaatggctatgaccacagttctgtccatcccccatgatctcatggagtttattgacggcatctctctggggctcattctgcttaagatggtgacccacttcgataacacgcaggtcggaacactggccctcagcctgacctttatcagatccacaatgcctctggtgatggcctggcggaccattatggctgttcttttcgtggtcaccctgatccccctctgtcgcacaagctgcctgcagaaacaatctcactgggtggaaattacggccctcatcctgggcgctcaggcccttcctgtctacctgatgaccctcatgaagggggcgtccaaaagaagctggcccctgaatgagggaatcatggccgtgggcctggtttctcttctgggctccgctctcctgaagaacgacgtgcctctcgccgggcccatggtcgctggaggcctgcttctggccgcctacgtgatgagcgggtcttccgctgatctgagcctcgaaaaggcggccaatgttcagtgggacgagatggctgatattacaggatccagcccgatcattgaggtgaaacaagacgaagatggctcttttagcatccgggacattgaggaaaccaacatgatcacactgcttgtcaagctggccctcatcaccgtgtccgggctgtatcctctcgccattcccgtgacgatgacactgtggtacatgtggcaggttaaaacccagagatctggagctctttgggatgtccctagccccgccgcggctcagaaggccaccctgacagagggcgtgtatcgcatcatgcaacggggcctgttcgggaaaacccaggtgggagtcggcattcatatggaaggggtgttccacacaatgtggcatgttacgagaggatccgtgatctgtcacgagaccggccgcctcgagccgtcttgggccgacgtccggaatgatatgattagctacgggggaggctggagactgggcgacaagtgggacaaggaagaggatgtgcaggttcttgctatcgaacctgggaaaaaccccaagcatgtgcagacaaaacctggactgtttaagaccctcacaggcgagatcggggccgtcaccctggacttcaaacccggaacgtccggctctcccattatcaatcgcaaggggaaagtgattggcctctatggaaacggcgttgtgaccaagagcggggattacgtctccgcgatcacacaagctgagcggaccggagaacctgactatgaggtggatgaagacatttttagaaagaaacgcctgacaatcatggatcttcacccgggcgccgggaagaccaaacggattctgcccagcatcgtgagagaggccctgaagcggcgcctcagaacactgatccttgctcctacgcgggtcgttgccgctgaaatggaggaggccctgcgcggactccccattagataccagacccctgcggtgaaatctgaacacacaggccgggagatcgtggacctgatgtgccatgccaccttcaccacaagactcctgtccagcacgcgcgtccccaattacaaccttattgtgatggatgaagctcactttaccgacccttcttccgttgccgctcgggggtatatcagcacaagagtggagatgggcgaagccgccgctattttcatgaccgcgacaccgcccggagccaccgatccttttccccagtccaattctcctatcgaggacatcgagcgcgaaattcccgagcggagctggaacacgggcttcgactggatcacagattaccaggggaagaccgtctggtttgtgccgtccattaaggctggaaatgacatcgccaactgcctgagaaaaagcggcaagaaagttattcaactgtctcgcaagaccttcgatacagaatatcctaaaaccaagctcacagactgggattttgtggtcaccacggacatctccgagatgggggccaatttccgggctggaagagtgatcgatccccgcagatgtctgaagcccgtcattagcacagacggccctgaacgggtgatccttgccgggcccattcctgttaccccggcgtctgctgcccagcgcagaggccggatcggacgcaaccccgcccaggaggatgaccaatacgtgttcagcggcgatcctctgaaaaacgacgaggatcatgctcactggacagaagccaagatgctcctggacaatatttatacccccgaggggatcattcctacgctgtttggacccgaaagagagaaaaaccaggcgatcgacggcgagttccggctcagaggggaacagcgcaagacctttgtggagcttatgcggagaggagatctgccggtctggctgtcctacaaagttgcctctgctggcatcagctataaggaccgcgaatggtgcttcacaggcgagcggaataaccagattctcgaagagaatatggaggtggaaatctggaccagagagggggaaaagaaaaagctgcggcctaaatggcttgatgcccgcgtgtacgctgaccccatggccctgaaggattttaaagagttcgcttccggaagaaagtctattacactcgacatcctgaccgaaattgccagcctgcctacatacctctccagccgggcgaagcttgccctggataacatcgtcatgctgcacaccacggagcgcggcgggaaagcttatcaacatgccctcaatgagctgcccgaatctcttgagacactgatgctcgtggctctgctgggagccatgaccgccggcatctttctcttctttatgcaggggaagggaattggcaaactttccatgggcctgatcgctattgcggttgccagcgggctgctctgggtggctgaaatccagcctcagtggattgccgcctccatcatcctggagttctttcttatggtcctgctcattcccgaaccggagaagcaaagaacccctcaggacaaccagctgatctacgtgattctgacaatcctcaccattatcggacttattgctgccaatgagatgggcctgatcgaaaaaacaaagacggatttcgggttttatcaggtcaaaaccgagacaaccatcctggacgtggatctccggcccgcgtctgcctggacactgtacgctgttgccaccacgattcttacccccatgctgcgccacacaatcgaaaacaccagcgctaatctctccctggccgcgattgccaaccaagctgccgtgctgatgggactcggcaaggggtggcctcttcatagaatggacctgggagtcccgctgctcgctatgggctgttattctcaggtgaatcccacaaccctgatcgccagccttgttatgctgctcgtgcactacgctattatcggccctgggctgcaggccaaggcgacgcgggaggcccagaaacgcacagctgccggaatcatgaagaaccccaccgtcgatggcattacagtgatcgacctggagcctatttcctatgaccccaaattcgaaaagcaactcgggcaggtgatgcttctggttctgtgcgctggacagctcctgcttatgagaaccacctgggccttctgtgaggtcctgacactcgccacgggccctgtgctgaccctgtgggaagggaatccgggacggttttggaacacaaccatcgcggtgagcacagctaacattttcagaggctcttacctcgccggcgctgggcttgccttttccctgatcaaaaatgcccaaaccccccgccggggaacgggcacaaccggggagaccctgggagaaaagtggaagagacagctcaacagcctggatcgcaaagagttcgaggaatacaagcggtctggcatccttgaggtcgacagaacagaagctaaatccgccctgaaggatgggagcaaaattaagcatgcggtttctcgcggaagctccaagatccggtggattgtggagagaggcatggtgaaacctaagggcaaagtcgtggacctcgggtgcggacgcggcgggtggtcttattacatggccaccctgaagaatgttacagaagtgaaaggatatacgaagggcgggcccggacacgaggagcctatccccatggctacctacggctggaacctggtcaagctccacagcggcgtggatgttttttataaaccgacagaacaggtggacacccttctgtgtgatattggggagtccagctccaatcctacaatcgaagagggacggaccctgagagtcctcaagatggtggaaccctggctgtctagcaaacccgagttctgcattaaggtgcttaacccttacatgcccacggtcatcgaggaactggagaaactccagcgcaagcatggcgggtccctggttcggtgtcctctgtctagaaatagcacccacgaaatgtattgggtgtccggagtgtctggcaacatcgtcagctccgtgaatacaaccagcaaaatgctccttaaccgctttacaaccagacatcggaagccgacatacgagaaggacgttgatctgggggccggaacccgctctgtgtccacggagacagaaaaacccgacatgaccattatcggcagacggctgcaaagactccaggaggaacacaaggagacctggcactacgatcaggaaaatccttatcggacatgggcttaccatggcagctatgaggccccctctacggggtccgcgagctctatggtcaacggagtggttaaactgcttaccaagccttgggacgtgattcccatggtcacacagctggccatgaccgacacaaccccgttcggccaacagcgcgtgtttaaagagaaggttgatacaagaacccctcagcccaagcctgggacgcggatggtgatgaccacaaccgctaattggctctgggccctgctgggaaaaaagaaaaacccccgcctctgcacaagagaagagttcatctccaaggtccggagcaatgctgccattggcgctgtgtttcaggaagagcaagggtggacctccgccagcgaagcggtcaacgactctcgcttctgggagctggtggataaagagagagcccttcaccaggaaggcaagtgtgagagctgcgtttacaatatgatgggaaagcgggaaaaaaagctgggcgagtttgggcgcgctaaaggatccagagccatctggtatatgtggctcggcgctcggttcctggaattcgaggcccttgggtttctgaacgaggaccattggttcggacgcgaaaactcttggagcggcgtggagggggaaggcctccacagactgggatacatcctggaggatattgacaagaaagatggcgacctcatctatgccgatgacacggcggggtgggatacacggattaccgaggacgatctgcttaatgaagagctgatcacagaacagatggctcctcatcacaagattctcgccaaggccatctttaaactgacctaccaaaacaaggtcgtgaaagtgcttcgccccacgccgaagggagctgttatggacatcatttccagaaaagaccagcggggctctgggcaggtgggaacctacggcctgaatacattcaccaacatggaggtccagctcatcagacaaatggaagccgagggggtgattacacaggatgacatgcacaatcctaagggcctgaaagagcgcgttgaaaagtggctgaaggagtgcggagtggatcggctcaaaagaatggctatcagcggcgacgattgtgtcgtgaagcccctggacgaacgcttttccacctctcttctgttcctcaacgatatggggaaagtccggaaggacattccccagtgggagcctagcaaaggatggaagaattggcaggaagtgccgttttgctcccatcacttccataagatctttatgaaagatggcagaagcctggttgtgccctgtcgcaaccaagacgagcttatcgggcgggccagaatttctcagggagcgggctggtccctgcgcgagacagcctgcctcgggaaggcttatgcccagatgtggagcctgatgtacttccaccggagagatctgcgcctcgcttctatggccatctgttccgcggtccctaccgaatggtttcccacgagccggacaacctggtccattcacgcccatcaccagtggatgaccacagaggacatgctgaaagtgtggaatagagtttggatcgaagacaaccctaatatgaccgataagacacccgtgcattcttgggaggacattccttatcttggcaaacgggaagatctgtggtgcggaagcctcatcggcctgtccagcagagctacgtgggccaagaacattcacaccgctatcacacaagtccgcaatcttatcgggaaggaggagtacgtggactatatgcccgtgatgaaacggtactctgccccgttcgaatccgagggagttctgtga

SEQ ID NO: 21078 - RNA, 9879 nt, synthetic construct
  misc_feature 1..9879: note = derived and/or modified CDS sequence (opt6) from DENV-1__AB608789__SS-prME
  source 1..9879: mol_type = other RNA
agtgtaacgatgttattaatgctaatgccaacggcactagcctttcatttaactactcgagggggagaaccacatatgattgtcacaaagcaagaaagaggaaagagcttgctatttaaaacaagtgccggtgtgaatatgtgcacattgatagccatggatctaggagaactatgtgaagatacaatgacttacaaatgtccgagaataacagaagcagaaccagacgatatagattgctggtgtaacgcgactgatacctgggtcacatacgggacttgtagtcaaacaggtgaacatagacgtgataagagatcagttgcattggccccacatgtgggattgggactagaaacccgaacagaaacatggatgtcatcagaaggcgcttggaagcaaatacaaagagtggaaacatgggcattacgccatccaggtttcacggtcattgccttgtttttagcacatgctattgggacaagtataacacagaaaggaataatatttatattgttaatgctagtaacaccctcaatggctatgcgatgtgtgggtatcggaagtagggactttgttgaaggtttatcgggagcaacatgggtcgacgtagtccttgaacatggatcctgcgttactacaatggcaaaagataaacctacactagatatagagttattgaaaacggaagtcaccaatccagccgtactacgtaaattatgtattgaagccaaaatctccaacactacaaccgattccaggtgtccaacccaaggtgaagcaacattagtcgaagaacaggatgccaactttgtatgtagacgaacctttgtggacagaggatggggaaatgggtgtgggctttttggcaagggttcactcataacatgtgccaaattcaaatgcgttacaaagctagaaggaaagattgtacagtatgaaaatctaaaatattcagtcatagtgactgtacacacaggtgatcaacatcaagtgggtaatgagtcaacagaacatggaacgacagcaactataacaccacaagctccaacaagtgaaattcaactaacggactatggtgcacttacattagattgcagtccaaggacaggcttagacttcaacgaaatggttctactaacgatgaaagaaaagagttggctagttcataaacaatggttcttagatctaccccttccttggacatccggagcgtcaacgtcacaggaaacatggaatcgacaagatctccttgttacttttaagactgcacatgcgaagaaacaagaagtagttgtactaggttctcaagaaggtgcaatgcacacggcgttaacgggtgcaaccgagattcaaacatccgggaccactacgattttcgcaggacatctaaaatgtagactaaaaatggataaattgacactaaaaggaatgtcttacgtcatgtgtacaggctcttttaaacttgaaaaagaagtagcagaaactcagcatggaactgtattagtccaaataaaatatgaaggaactgatgctccatgcaagatcccattttccacgcaggacgaaaaaggtgtaacacaaaacggtaggttgattacggcgaatcccatagttactgacaaagaaaaacctgttaacatagaagccgaaccaccattcggggagtcatacatagttataggagccggtgaaaaagctctaaagctctcgtggttcaagagaggatcctccataggaaaaatgtttgaagcgacagctagaggagcgcgcaggatggctatcttgggagatacggcttgggacttcggttctataggaggggtatttactagcgttggaaagctggtacatcaaatatttggaacagcgtatggagtccttttctcgggcgtctcttggactatgaaaatcgggattggagtgttattgacctggttagggctaaattcaagatcaacaagtctctctatgacttgcatagcagtagggttagtaaccttgtacttaggcgtaatggtgcaagcagattcaggatgtgtgatcaattggaaaggccgcgaacttaaatgtggatctggaatatttgtgacgaacgaggtacatacgtggacggagcaatacaaattccaagcggactctcccaaacgactatctgcagccattggaaaggcttgggaagaaggagtatgcgggatccggtcagcaacaaggctagaaaacataatgtggaaacagatatcgaatgaactaaatcacatcttactcgaaaatgatatgaaattcacagttgtagtaggcgatgttgttggaatactcgcccaaggcaagaagatgataagaccacaaccaatggaatataaatattcctggaaaagttggggaaaagcgaagataattggagccgacgttcaaaacaccaccttcataatagatgggcccaatacaccagagtgccctgacgatcaaagggcatggaatatatgggaggtagaagactatggatttggaatattcacgacgaacatttggttgaaactaagggactcttacacacaggtatgtgaccatagacttatgtctgctgcaataaaagactctaaggcagtacatgctgatatgggctattggatagaaagtgagaaaaacgaaacatggaagctagcacgtgcatcttttatagaagttaaaacttgcatttggcctaagagtcacacactttggtcaaatggtgtacttgaatcggaaatgataataccaaaaatatacggtggtcccataagccaacataattatcgacccggatatttcacacagacggctgggccttggcatttgggaaaacttgaattagacttcgatttgtgcgaaggaacgacggtagtcgtagatgagcattgcggaaatagaggcccatcacttcgaacgacgaccgtaaccggcaaaattatacacgagtggtgttgtcgatcatgtacattgcccccattgcgattcaaaggtgaagatgggtgctggtacggtatggaaataaggccggtaaaagaaaaagaagagaacttagtaaaatctatggtcagtgcagggtctggcgaggttgacagcttttctttgggattactctgcatgtccataatgatagaagaagtcatgagatctcggtggtcaagaaagatgttgatgacaggaactcttgcagtatttttgctgctgattatgggacaattaacatggaacgatctaataaggttatgcataatggtaggtgctaatgcttctgatcgtatgggtatgggaacaacgtacctcgcgcttatggcaacatttaaaatgcgacctatgtttgcagtaggcttattatttaggcggttaacatccagggaagttttattactaacaataggactgtcactcgtagcatcagtagaactacccaattctctagaagaactaggagacggcctcgctatgggtataatgattctcaaattgctcacagactttcaatcccaccaactatgggcgacattattaagtttaaccttcataaagacaaccgttagtctccactacgcttggaagactatggcaatggtgctctctatagttagcttgtttcctctatgtctaagtaccacttctcagaaaacgacctggctacccgtattattaggaagtttaggctgcaaacctttgaccatgttcctcatcgcagaaaacaaaatctggggtagaaagtcatggccattaaacgagggtatcatggcagtaggtatcgtaagtatactcctgtcaagtcttctcaaaaacgacgtacccttagcaggtcctttaatcgctgggggcatgctaatagcatgttacgttatatctgggtcgagcgcagacctttccttagaaaaagctgcggaggtttcttgggaggaagaagcagagcactcaggggcttcgcataatatcttggtagaggtacaagatgatggcacaatgaaaattaaagacgaagaaagggacgacaccttgaccattttgcttaaggcaactctgcttgccgtatcaggtgtctaccctctaagcatccctgcaacattgtttgtgtggtacttttggcagaagaagaaacaaagaagtggagtactttgggataccccgagcccgcctgaagttgaacgagctgtcttagatgaagggatatatagaataatgcaaagaggattactagggcgctcacaagtcggcgtcggggtattccaggaaaatgtcttccacacgatgtggcatgtcacacggggcgcggtactcatgtatcaaggtaagagattagaaccaagctgggctagcgtcaagaaagacttaattagttacgggggcggttggaggcttcagggatcttggaacaccggagaagaggtgcaagtgatcgcagtagagcctggtaaaaatcccaaaaacgtccaaacagccccgggaacttttaaaactccggaaggagaagttggggcgatcgcattggattttaaaccgggaacatcagggtcaccaatagtaaatagagaaggtaaaatagtagggctttatgggaacggggtagtaaccacaagcggaacgtatgtatcagcaatcgcacaagctaaggcgtctcaggaaggtcctttaccagaaatagaggatgaggtattccggaagcgaaatttgacgattatggatttacaccccggatcaggaaaaacacgtcgatacctaccagcaatagtcagggaggcaatcaagagaaaattacgcacgctaattctagcaccaactcgtgttgtagccagcgagatggccgaagctcttaagggaatgcccattaggtaccaaactacggctgtaaaatcagaacatacaggtaaagaaatagtggacttaatgtgtcatgctacatttaccatgaggctgctttcaccagtcagagttccgaactataatatgataataatggacgaggctcactttacggacccgtcgagtattgcagctagggggtatatttcaacccgagtgggcatgggtgaagcggcggcgatattcatgacagctacaccacccggatcagttgaggcgttccctcaaagcaatgccgtaatccaagatgaagaaagagatatacctgaaagatcatggaactcaggatacgaatggattacagattttccaggtaagaccgtatggtttgtacccagtatcaaatccggaaatgacatcgccaattgtttgcgcaaaaacggtaaacgagtaatacaattatcacgaaagacattcgacacagaatatcagaaaacgaaaaacaatgattgggactacgtagttacgacggatataagtgagatgggtgctaactttcgtgctgatcgagttatagatccaagaagatgtttgaaacctgttattctgaaagatggaccagaacgcgttatcttggctggcccaatgcccgttacagttgcaagtgcagcacaacgccgaggacgcataggaagaaaccataataaagaaggtgaccaatatatttacatgggtcaacccttgaacaatgatgaggaccacgcacattggactgaagcaaagatgcttctagataacataaatacgccggaaggaataatacctgcattatttgaacctgaaagagaaaagtcagcagcgatagatggcgagtacaggttaagaggagaagcaagaaaaacattcgtggagttgatgagacgaggtgatttaccagtttggttatcatacaaagtagccagcgagggtttccagtattctgatcgtagatggtgttttgatggagagcgaaataatcaagtgctagaagaaaacatggacgttgaaatatggacgaaggagggagaaaggaagaaattacgacctcgatggttagacgctagaacgtattcagatccacttgcactcagagagttcaaagagtttgctgcaggcagaaggagcgtctcaggagatttgatattggagatcggaaaacttccgcaacatctgactcaacgggcacaaaacgcgctcgataatctagtcatgttacataatagtgaacagggaggtagggcttatagacacgcaatggaagaactgcctgatacaattgaaacattgatgttgcttgctctaatagctgttctgacaggaggcgtcacattattctttttaagtggaaggggtctaggtaaaaccagcataggattgctgtgtgttatggcaagtagtgttcttttgtggatggcttcagtggaaccccattggatcgcagcatcgataatacttgaatttttcctaatggtactactaattccagaaccagatagacaacgaacacctcaggacaatcagctagcatacgttgtaatcggtctgttatttatgatccttacggtagcagcaaatgagatgggactgcttgaaactacaaagaaagacctcggaataggtcacgttgccgtagaaaaccatcatcacgctacaatgcttgatgtagacttacatcctgcctcagcttggacattgtatgccgtagcaacaacgattatcacacctatgatgcgtcacactatagaaaacactaccgcaaatattagccttaccgcaatcgcaaatcaggctgcaatattaatgggcttagacaaaggatggccaatctcaaaaatggatataggtgtacccttattagcactaggttgctacagtcaggtaaatcctctcacccttacggccgcagtgcttatgttagttgcacattacgccattattggaccagggctacaagcaaaagcaacacgcgaagctcaaaaacgaacagcagctggaataatgaaaaatccaacagtagacggaatagtagcgattgatctcgacccggtagtgtatgacgcaaaattcgagaaacaactagggcaaataatgcttctaattctatgtactagccaaatattactcatgcggactacatgggcgttgtgtgagtctataacgttggctacaggcccattaaccacattgtgggagggaagcccggggaaattctggaacaccacaatagcggtaagcatggctaacatatttcgtggaagttatctagctggggcggggttggctttctcattaatgaaatcattaggagggggtcgtagagggacgggagcacaaggagagacccttggagaaaaatggaagcgtcaactcaatcaactcagtaaatcggagtttaacacgtacaagcgttcagggataatggaagtagatcgttcggaagccaaggaaggagtaaaacgtggggaaacaacaaaacacgccgtttcacggggaacagcaaaattgcgatggttcgttgagaggaatctggtaaagcccgaaggtaaagtcatagacttaggatgcggccgcggtggatggtcgtactattgtgcaggcctcaaaaaggtaacagaagtcaagggttataccaaaggtggacctggtcatgaggaaccgatccccatggcaacatatggatggaacttggtgaaattacactcgggcaaagacgtatttttcacacctccagaaaagtgtgacaccttactgtgtgatataggggaatcctcacccaatcctacgatcgaagaagggagaactctgcgagttttgaaaatggtagaaccatggttgcgaggtaatcaattttgtataaaaatacttaatccttatatgccctcagttgtagaaaccctcgaacaaatgcaaaggaaacatggcggtatgttggttagaaacccgttgagccgaaattcaactcatgaaatgtattgggtaagctgtggcaccgggaacatcgtcagtgctgtaaacatgacatctagaatgttattaaatagatttacaatggcgcacagaaaaccaacttatgaacgcgatgtcgatctaggggccggaacgcgccacgtggctgttgagccagaagtggccaatttagacataattggccaacgcattgagaatatcaaacacgaacataagtccacatggcattatgatgaagataatccctataaaacatgggcatatcatggatcatacgaagtgaaaccatccggttcagcatcaagcatggttaatggagtggtaaaattgttaaccaaaccatgggacgttatccctatggttacacagattgcgatgaccgatacaacaccgttcggacaacagagggttttcaaagaaaaagtagacacccggacgcctaaagcaaaaagaggaactgcacaaataatggaagtgacagcgaggtggttatggggtttcttaagtagaaacaaaaagcctaggatatgtacaagggaggagttcacacgaaaagtacggtccaatgcagctatcggagcagtgtttgtagatgaaaatcaatggaactctgctaaagaagcagtagaagacgaacgcttttgggatctagtacacagagagcgagaactacataaacaagggaaatgtgctacatgtgtatacaacatgatgggaaaacgggagaaaaagctaggtgagttcggtaaagcacccgaaagtagggcaatctggtacatgtggcttggcgcaagattcctagagttcgaagcactcggatttatgaatgaagaccattggttctccagagaaaacagcttaagcggcgtagaaggagagggactacacaaattaggttacatcttacgagatataagcaaaatacctggtggcaatatgtatgcagacgacactgcaggctgggataccaggataacagaagatgatctacaaaacgaagccaagattacggatattatggagccagaacacgctctcctagcaacctcaatattcaaactcacatatcaaaacaaagtggtgagagtgcaaagacccgcgaaaaacggaacagtaatggatgtaatatcgagacgagaccagcgcgggagcgggcaagtaggtacctatgggcttaacacatttacaaacatggaagcacaacttattcgacagatggaaagcgaaggcattttctcctcttctgagctagaaacacccaatcttgcagaaagagtactagactggcttgggaagtacggagtcgagagattgaaaagaatggccatatctggtgacgattgcgtagtaaaacctattgatgaccgatttgcaacagcattgactgcgctcaatgacgttggaaaggtcagaaaagacatcccacaatgggaaccctcgaagggatggaacgattggcaacaggtacccttttgctcgcatcacttccatcagctaattatgaaagatgggcgagaaatagtcgtcccatgtcgcaatcaagacgagctagttgggagggcacgagtgagccaaggcgccggctggtctctccgtgaaacagcctgtttgggtaaaagttatgcacagatgtggcaactgatgtactttcatagacgggatttgagactagctgcaaacgcgatctgttcagctgttccagtagattgggttcccacttctagaaccacttggtcaattcatgctcatcaccaatggatgacgaccgaagatatgttgagtgtttggaacagagtttggattgaagagaatccgtggatggaggacaaaacacatgtctcatcgtggggagatgttccatacctaggaaaaagggaagatcagtggtgcggatccttgataggattgacagctcgagcaacatgggccacgaatattcaagtagcaataaaccaggtcaggcgtttgattggtaatgaaaattacttagattatatgacttctatgaaacgatttaagaatgaatctgacccagaaggagcactctggtaa

SEQ ID NO: 21079 - RNA, 9879 nt, synthetic construct
  misc_feature 1..9879: note = derived and/or modified CDS sequence (opt6) from DENV-1__AB608788__SS-prME
  source 1..9879: mol_type = other RNA
tcagtaacgatgttgttaatgttattgccaacagtcttagcatttcatttaactactcgtggaggagaaccacacatgatagtaacgaaacaagaacgcggtaaaagtctactattcaaaacgtccgctggcgtaaatatgtgcacattgatagctatggacctgggtgaattgtgtgaagatactatgacttacaaatgccctagaataacagaagcagaacctgacgatgttgactgttggtgtaatgcaacagacacgtgggtgacgtacggaacctgtagtcaaacaggcgaacacagaagagacaaaaggagcgtagcgctagcaccacacgtgggactaggactagaaacacggacggaaacatggatgtctagtgaaggagcctggaaacaaatacaacgggtagaaacttgggctttacgccatcctggatttacagtaattgctttgttcctcgcgcatgcaataggaacaagtattacgcagaaaggtataatttttatattactaatgttagttacaccgagcatggcaatgagatgtgttggaataggaaatagagattttgttgaaggactgtctggagctacttgggttgacgttgtcttggaacacgggagctgcgtaaccaccatggctaaagacaaacctactttagatatagaactactaaaaacagaagtcaccaatccagcagtgttaaggaaattatgcatagaagcaaaaatttcaaataccaccacggattcacgctgccctactcagggtgaagcaacgctagtcgaggaacaggatgcaaatttcgtatgtcgtcgtacttttgtagaccggggatggggcaatggctgcgggttatttggaaaaggaagtctaataacgtgtgccaaattcaaatgtgtaacgaaacttgaaggaaaaatcgttcagtatgaaaatctcaaatattcagttatagtgaccgtccacacaggtgatcaacaccaagttgggaacgagagtacagaacacgggacaacagctacgatcacaccacaggcgccaacatcagaaatacagttaactgattatggcgctctcacactagattgttcgccacgcacaggccttgattttaatgaaatggtactactgacaatgaaagagaaaagttggttggttcataaacagtggttcttggacttgccacttccgtggacctctggggctactaccagtcaagaaacttggaacagacaagatctcttagttacttttaaaacagcacacgctaagaaacaagaagtggttgttctaggttcacaagaaggcgctatgcacacagcattaacaggggctacggaaatacaaacaagtggtacaacaactattttcgcagggcatttaaaatgtagactaaaaatggataaattaaccttgaaaggaatgtcgtatgtaatgtgtacaggctcatttaaactagaaaaagaagtagcagagacacaacacggtacagttttagtacaagtaaaatacgaagggaccgacgccccgtgcaaaataccgttctctactcaagatgaaaaaggtgttactcaaaacggaagggtaataaccgcaaatcctatagtaactgacaaagagaaaccagtcaacatcgaagctgaacccccttttggtgaaagttacatagtagtaggcgcaggcgaaaaggcactaaaactgagttggtttaagaaaggttctactataggaaaaatgttcgaggccacagcgcgcggtgctcgacggatggctatactgggcgataccgcttgggatttcggtagtataggaggcgtcttcacaagcgtcggaaaattagttcatcaaatatttggaactgcctacggggtattatttagtggtgtaagttggaccatgaaaataggtataggggtactcttgacgtggttaggccttaattcacgaagcactagcttaagcatgacgtgtatagcagtgggcctagttaccctttacttaggagtgatggtccaagcagatagcggctacgtcattaactggaaggggagagaacttaaatgcgggagtggcatttttgttacaaatgaggtccatacctggactgagcagtacaaattccaagctgactcgcccaaaagactatctgcggctataggaaaggcctgggaagaaggagtgtgtggcattcgatccgcaactcgacttgaaaatataatgtggaaacaaatttcgaatgaacttaatcacatactcctcgaaaatgatatgaaatttacagtagtcgtaggtgacgtatcaggaatcctggcgcagggtaagaaaatgattagaccacaacccatggaacataaatacagctggaaaagttggggtaaggcgaaaataataggtgcagatgtccaaaattcaacatttataattgatggaccaaacacgccagaatgtccggatgatcaacgtgcatggaacatatgggaagtggaagactatgggttcggaatctttactaccaatatttggctaaaattaagagactcatatacccaggtctgcgatcatcgcttaatgagtgcggcaataaaagacagtaaagcagttcatgcggatatgggatactggatagagtcagaaaagaacgaaacttggaaacttgctcgggcatcgttcatcgaagtaaaaacatgtgtgtggccaaaaagccatactctttggtctaatggtgtattagaatctgaaatgataatcccaaaaatatacgggggcccaatatcacagcacaactaccgtcctggatacttcacacaaacttcgggtccatggcatctgggaaaactagaactcgactttgacctatgtgaaggaaccaccgtagtagttgatgagcactgtggaaatcgcggcccgtcactaaggacaacaacagttactggcaaaattatacatgaatggtgctgtagatcatgtacattgccacctctgcggtttaagggagaagacggttgctggtatggcatggaaattcgcccagtaaaagaaaaagaagaaaatctagtgaaaagtatggtcagtgcaggaagtggagaggttgattctttttctctcggtctgttatgcatttctatcatgattgaggaggtcatgcgatctcgttggagccggaaaatgttaatgaccgggactttagcagtatttctactactcataatgggacaattaacatggaacgatcttataaggttatgcattatggttggagccaatgcatccgaccgaatgggaatgggaacaacttacttggcacttatggctacctttaaaatgagaccaatgttcgcagtaggattactcttcagacgattgacatcacgtgaagtcttactattaactataggcttaagcctagttgcatctgtagaacttcccaactctttagaggaactaggagatggattagcaatgggaataatgatactgaagctactcaccgatttccaaagtcatcagttatgggcagccctattgtccctaacgttcataaagacaacattttctctacattatgcgtggaaaactatggccatggtactaagcattgtttccttattcccgctctgtctaagcacaaccagtcaaaagactacttggttaccggtacttctaggttcgcttggctgcaaacccttaacgatgtttctaatagcagaaaataaaatatggggacgtaaatcctggcctctcaatgaaggaataatggccgttggaatagtttcgatacttcttagtagtttactcaaaaacgacgttccactagcgggaccattaatagctgggggaatgctaattgcatgttacgtcataagcggttcttcggcggatctaagtttggaaaaagcagccgaagtaagctgggaagaggaagcagaacattcgggcgcatcacataatatcctagttgaggtacaagatgacggaacaatgaagattaaagatgaagaacgtgacgacacacttacgatattactcaaggcaacgctccttgcagtctcaggagtatatcctctgtccatccccgcgaccctatttgtttggtatttctggcagaagaagaaacaacgaagcggggtcttatgggacaccccatcgcctcccgaagttgaacgcgccgtattagatgatggaatatacagaattatgcaaagaggattattaggtagatctcaagttggggtcggagtttttcaagaaaatgtatttcatacaatgtggcatgtaacaaggggagcggtactgatgtatcaaggaaagcgcctggaaccctcatgggccagcgtaaagaaagatttaatctcatacggtggcggctggcgacttcaaggtagttggaacacaggggaagaagttcaggttattgcagttgaacctggtaaaaatcccaaaaatgttcaaacggcaccgggaacttttaaaacccctgagggagaggtaggagctatagctctggacttcaaaccaggtacaagcgggagtcccatcgttaatagggaggggaaaatagtcgggctatatggtaacggcgttgttacaacaagcggtacatacgtaagtgcaattgcacaggctaaagctagtcaggaaggaccccttccagaaatagaagatgaagtttttaggaaaaggaatttaacaataatggatttacacccgggaagcggaaaaaccagacgatatttaccagcaatcgttagagaagcaataaaacgcaaactacgaacattgatcctagcacctacaagggtagttgccagtgagatggcagaagcactgaaaggtatgccaatccgatatcaaacgacggccgtgaaaagcgaacacactggaaaagagatagtagatttgatgtgccacgcaacgttcactatgagactcttgagtcccgtaagggtgcccaactataatatgattattatggacgaggcacactttaccgacccaagtagcatcgcagcgagagggtacattagcactagggttggtatgggggaagcagcagctatctttatgacagcaacaccacctggaagcgtagaagcattcccacaatcgaatgccgtaatacaagacgaagaaagggatataccagaaaggtcttggaatagcggttatgattggattacggatttcccagggaagacagtctggtttgtgccatctatcaaatcaggaaatgacatagcgaattgcctaaggaaaaatggaaaaagagtaatacaactatcccgaaagacatttgacactgaatatcagaaaactaaaaataacgactgggattatgtagtgacaactgatatatccgagatgggagctaacttcagagctgatagagtaatagatccgcgaagatgtctcaagccggtaatactaaaagatggacctgagcgagtaatattggctggaccaatgcctgtgacagtcgcgagtgctgcgcagcgtaggggtcgaataggccgtaatcaaaataaggagggcgatcaatatatatacatgggacaacctctaaacaatgacgaagatcacgctcattggaccgaagccaaaatgttattagataatataaacacacccgagggaataataccagcactttttgaaccagaacgtgaaaagtctgcagctattgacggggaatatagactcagaggtgaagcccgcaaaacattcgttgaattgatgcgacggggagatttaccagtttggctaagttacaaggtagcaagtgagggttttcagtacagtgatcgtagatggtgctttgacggtgaacgcaataatcaagttttagaagaaaacatggacgtagaaatctggaccaaagaaggagaacgtaaaaagttgcgaccacgatggttagacgcaagaacatatagcgatccacttgcactacgcgagttcaaggagttcgcggccgggcgccgatcagtgtcaggggatctcatactagaaataggaaaactacctcaacacctaacgcagagggcacaaaacgccctcgataacctcgttatgttacacaattcagaacaaggaggacgagcatacagacatgcaatggaagaactacccgatacaattgaaacattaatgcttctagctttaatagcagtacttacgggtggcgtaactctattctttctaagtggaagaggattaggaaaaacgtcaattggtctgttgtgtgttatggcatctagcgtactgttatggatggcgtctgttgagccccactggatagctgcgagcataatattagaatttttcctaatggttcttttgatacctgaaccagatagacaaaggactccccaagataatcaattggcatatgtagtgatcggacttctttttatgatcttgacggtagcggctaatgaaatgggtttactagaaacaactaagaaagacttggggatcggacacgtagccgtagaaaatcaccaccatgcaacaatgcttgatgtagatttgcatccagcttctgcttggaccttatatgcagtagctaccacaataatcaccccaatgatgagacatactatagaaaatactaccgctaacatatccctgaccgccatcgccaaccaagcggcaatattaatgggtttagacaaagggtggcctatatctaaaatggacataggggtacccctattggcactaggatgttatagccaggtaaatcccttaactttaaccgcggcggtattaatgttagtagcccactacgccattataggtcctggccttcaagctaaagcgacgagagaagcccagaaaagaaccgcggctggcataatgaaaaacccaacagtagatggaattgtagccatagatttggatccggtcgtgtatgacgctaagtttgaaaagcaattgggccagattatgttgttaattctatgtacttctcagattttattaatgcgaaccacctgggcactatgtgagtcaataactctagccacaggaccattaacaacgctatgggagggaagcccaggtaaattttggaacaccacaattgcagtatcaatggcaaacatcttccgggggagttatttagcaggagcaggacttgcctttagcctaatgaaatctctaggagggggtaggagaggaacgggggcgcaaggggaaacgctaggggagaagtggaagcgacaactaaatcaactaagcaaaagcgagtttaacacttacaaacggagcggaatcatagaagtggacaggtcggaagccaaggaaggattgaaacgtggtgaaacaactaaacatgcagtcagtagaggcacggcaaaattaagatggttcgtggaacgaaatttagttaagcccgagggaaaagtcatagatctagggtgcggaagaggtggttggagctattactgcgctggtcttaagaaagtaacagaagtaaaggggtacacaaaaggtggagcgggacacgaagaacccataccgatggcaacttatggttggaatctggttaaattatacagtggtaaagatgtattctttactcctcctgaaaaatgtgatactcttctttgtgacattggagaaagttcgcccaatccaacgatcgaggaaggcagaactttaagggtactcaaaatggtagaaccttggcttcgaggaaatcaattttgcataaaaatcctgaacccctatatgccgtcagtagtggagacgctagaacaaatgcagaggaagcatgggggtatgctagtcaggaatccactttcaagaaacagtacacatgagatgtattgggtaagttgcggtactggcaatatagtaagcgcggtaaatatgacaagccgaatgttactcaacagatttacaatggcacaccgcaagccgacctacgaacgtgatgtagatttaggggcaggaaccagacatgttgccgtggagccggaagtcgcaaatttagacattataggacaaagaatagaaaacatcaagcatgaacacaaatctacatggcattatgatgaagataatccttacaagacatgggcttaccatggctcgtatgaggttaagccgagcggtagcgcatcatcaatggtaaacggtgttgtgcgtctactcacgaaaccatgggatgttatcccaatggttacccaaatagcaatgacagatacaaccccatttggacaacaacgagtatttaaagagaaagtagacacacgtacgccaaaagctaagcaaggcacagctcaggtcatggaagtaactgcgaggtggctctggggctttttgagtaggaataagaaaccaagaatatgtactcgagaagagttcacgagaaaggtgaggagcaatgcagcaattggagccgttttcgtggacgaaaaccaatggaactctgcaaaggaggcagtggaagacgagagattctgggacttagtacacagagaaagagaattacataaacaaggtaaatgtgctacttgcgtctataacatgatgggaaagagggagaaaaagttaggagagttcggtaaggcaaaaggttccagggctatttggtatatgtggctaggagctcgttttctagagttcgaggcacttggttttatgaacgaagatcactggttctcaagagaaaatagtctaagtggagtcgaaggagaaggtttgcatcggctcggatacatactcagagatatttcaaaaatacctggaggaaacatgtatgctgatgatacagcaggatgggataccaggataactgaagacgatcttcaaaatgaagcaaaaataacggacattatggaacctgagcatgcgctgttggcaacgtcaatatttaaattaacttatcaaaacaaagttgtcagagtccagagaccagccaaaaatggtacagtaatggacgtgatctcgaggagagatcaaagaggatccggacaagtaggcacatacggtttgaacacatttacgaatatggaagcccaactaataagacagatggaatcagaagggatatttagcccaagcgagctcgagacaccgaatcttgcagaacgagttttagattggcttgaaaaatacggagttgagagacttaagagaatggccatatccggagatgattgtgttgtcaaacctattgatgacagattcgcaactgctttaacagccttgaacgatatgggaaaagtacgtaaggacatccctcagtgggaaccaagtaaaggttggaatgattggcaacaagtcccgttctgctcgcatcatttccaccaattaataatgaaagatggaagagaaatcgtcgtaccttgtagaaaccaagacgagttagtggggagagcacgagtctcacagggagcaggttggtcattacgggaaacggcatgtttagggaaaagctacgcgcaaatgtggcagttaatgtattttcaccgccgagacttacgactagcagctaacgcgatctgttcggctgtacctgtagattgggttcccaccagccgaactacttggtcaattcatgctcatcatcaatggatgacgacagagaatatgttatcggtatggaatagagtatggattgaagagaatccatggatggaagataagacgcatgtatccagctgggaggatgtaccatacctagggaaacgagaggatcaatggtgtggatctctaattggcttaacagcgagagcaacatgggctacaaatattcaggtggctatcaaccaagtgaggcgactaataggaaatgaaaactacctagattacatgacaagtatgaagaggttcaaaaatgactctgatcctgaaggcgctttatggtaa

SEQ ID NO: 21080 - RNA, 9879 nt, synthetic construct
  misc_feature 1..9879: note = derived and/or modified CDS sequence (opt6) from DENV-1__AB608786__SS-prME
  source 1..9879: mol_type = other RNA
agcgttacgatgttattgatgctcatgcctacagcactagcatttcatctgacaaccagaggaggggaacctcacatgatcgtctcaaaacaggaaagaggaaaatccttactcttcaaaacatctgctggtgtaaatatgtgcacattaattgcaatggatttgggagaattatgtgaagatacaatgacctacaagtgtccaagaataacggaaaccgaacccgacgacgtggactgctggtgtaatgcaacagacacctgggttacatatggaacatgtagtcaaacaggagaacacaggcgagataaaaggtccgttgcattagctccacacgttggactaggtctcgaaacaagaacagaaacttggatgtcctcggaaggagcctggaaacaaattcaaagagttgagacttgggccctcaggcacccaggatttaccgttatcgcgttatttctagcccacgtaataggaacgagtattacccaaaagggaataatattcatcttactaatgcttgtaactcccagtctagcgatgaggtgtgtaggaatcggatctagggatttcgtcgagggattgtctggagcgacctgggttgacgtagtactagaacacggttcatgtgtcacgacgatggcgaaggataagcctactctggatattgaattattaaaaactgaggtaaccaatccggccgttctaagaaagctctgcatagaagccaaaataagtaatactacaactgactcaagatgtcccactcaaggggaggccacgttggtcgaggagcaagacgcgaattttgtttgtagaagaacattcgtggacaggggatggggtaatggctgcggactatttggcaagggttcccttattacatgtgctaaatttaagtgcgttacaaaactcgaaggaaaaatagttcagtacgaaaacctcaaatactcagtcatagtcacagtgcacacaggtgatcaacatcaagtaggtaacgaaagtacagaacatggaaccaccgcgacaatcactcctcaagcaccaacaacagaaattcaactcactgattatggtgccttgactttagactgctcaccaagaactggtctagatttcaatgagatggttttgctaacaatgaaggagaaaagctggttggtccacaaacaatggtttttagatctaccccttccatggaccagcggggcttcgacttcacaggaaacttggaacagacaggatttactcgtgacatttaagaccgcgcacgccaagaaacaagaagtggtagtattgggcagtcaggaaggagcgatgcacaccgctctaacaggcgcaaccgaaatacaaacaagtggcaccactacaatatttgcagggcacttaaagtgcaggttgaagatggataagctcacactaaaaggaatgtcatacgtcatgtgtactggttccttcaaattagaaaaggaagtggctgaaacacaacacggcacagtattggtccaaattaaatacgaaggcactgatgcaccatgcaaaatacccttttcaacacaagacgaaaaaggcgtaacacaaaacggacgattaataacggcaaacccaatcgttaccgacaaagaaaaacctgtaaatattgaggccgagccgcccttcggagagtcgtacattattataggtgcgggtgaaaaggcattaaagctcagttggtttaagaaaggaagttctataggaaaaatgttcgaagccactgctagaggggcaaggcggatggcgatattaggagatacggcttgggactttgggagtattggaggagtatttacttccgtcggtaagttggtccatcaaatttttggaactgcgtacggggttctattttcaggtgtctcatggaccatgaagataggtataggagtattattaacttggctcggcttaaatagtagaagtacgagcttatccatgacctgcatcgcagtaggccttgtcacactgtacttgggagttatggttcaagcagactccgggtgcgtaatcaattggaagggtagagagctgaagtgtggtagtggcatatttgtcacgaacgaggttcatacatggacggaacagtataaatttcaggccgatagtccgaaacgcttatctgcagccataggcaaagcgtgggaagaaggtgtttgtggcattcgttcagctactcgactagagaatataatgtggaagcaaataagtaacgaactcaaccatatactattagagaacgatatgaagtttaccgtagtagttggagacgttgcaggcatcttagcgcaaggtaagaaaatgattaggccacagccaatggaatacaaatattcctggaagtcatggggtaaagcgaaaataattggagcggacgtacaaaacacaactttcattatcgatgggcccaatacccctgaatgccctgatgatcaaagggcttggaacatatgggaagtcgaagattatggcttcggtatctttactactaatatctggcttaaactacgcgattcttatactcaagtctgtgatcatcggcttatgagtgctgctataaaagacagtaaagcagttcacgccgatatgggctattggatagaatcagagaaaaatgaaacttggaagctagcacgggcgagcttcattgaagtgaaaacgtgcatttggccaaaaagtcacactctttggagcaatggggtacttgagtcagaaatgattatcccaaaaatatatggcgggccaatttctcaacacaattataggccaggatacttcacccaaaccgctggtccatggcacctgggtaaacttgaactagattttgatctgtgcgaagggaccacagtagtcgtcgacgagcattgtggtaatagagggccaagtttaaggacgacaacagtcaccggaaaaattatacatgaatggtgctgtagaagttgtacccttccacccttaagatttaggggtgaagacggatgttggtatggcatggaaataaggcctgtcaaagaaaaagaggaaaacttagtaaaatcaatggtctcagcagggtcaggcgaagtcgattccttttcgttggggttgttgtgcataagcatcatgatagaagaagttatgaggagcagatggagtcggaaaatgctaatgacgggtacactcgccgtgttctttctactcataatggggcagttgacttggaacgatttaatacgactgtgcataatggtaggtgcaaatgcaagcgatagaatgggaatgggaaccacgtacctcgcactaatggctacctttaagatgagaccaatgtttgccgttggtttactctttagaagactcacttctagagaagtattactattaacaataggccttagtttggtggcgtcagtagaactaccaaatagtttagaagaactcggagatggtctagctatggggataatgattttgaaattactaacggactttcaatcacatcaattatgggcaaccttactctcgctaacgtttataaaaactacattttcattacattatgcttggaagacgatggcaatggtattgagcatagtttctcttttcccattatgtttatcaacaacctcccaaaagactacttggttgcccgtattactaggatcacttggatgtaaaccccttacaatgttcctaatagcagaaaataaaatctggggacggaaatcatggcccttaaatgaaggaatcatggcggtgggcatagtaagtatattgctctcttcacttctaaagaatgacgttccactagccggccccttaatagccggtggaatgttaatcgcctgttatgtgatttccggatctagcgccgacctcagcctagaaaaagcagccgaagtttcatgggaggaggaagctgaacattcaggggcgtctcataatatcttagttgaagtacaggatgatggtacaatgaaaattaaggacgaagaacgcgacgacacactaacaatattactaaaagcaacactcttagccgtgtcaggcgtttatcctttaagtatacctgcaaccttgttcgtctggtacttctggcagaagaagaaacagcgctctggtgtattatgggatacgccgtcgccaccagaagttgaaagagctgtattagacgatggcatctatagaatcatgcaaagaggcttactaggacgcagccaagtaggtgtcggagtgttccaagagaacgtgtttcatacaatgtggcacgtaactagaggtgcagtacttatgtaccaaggtaaacgactagaaccttcatgggcttcagttaagaaagaccttatctcatatggcggagggtggagacttcaaggatcttggaatacaggagaagaagttcaggtaatcgccgtagaacccggcaaaaatcccaaaaatgtccagacagcgcccggaacctttaaaactccagagggagaagttggggcaattgcactggatttcaaacctggaacgagcgggtcacccatagttaatagggaaggaaaaatcgtcgggttatatggtaacggagtagtaacaaccagcggcacatacgttagcgcgatagctcaagcaaaagcatcacaagaaggtcctctaccggaaatcgaagacgaggtattcagaaaacgaaatctaacaatcatggatctgcacccaggatccggtaaaactagacggtatctacctgcgatcgtacgcgaagctattaaacggaaacttcggacactgattctagcaccaacgcgggtggtggcaagcgaaatggctgaagcattaaaaggaatgcctataagataccaaacaacagccgtaaaaagtgagcataccggcaaagaaatcgttgatttgatgtgccatgcaacatttactatgaggctactatctccggtcagggtaccaaactacaacatgattatcatggatgaagcccattttaccgatcctagttccattgcagcgagaggatatatatcgacgcgtgtagggatgggagaagcagcggccatatttatgacagcgacgcctcctggcagcgtggaggcatttcctcaatctaatgcggttatccaagatgaggaacgagacataccggagagatcatggaacagcggatacgaatggataactgactttcctggaaagacggtttggtttgtcccgtccattaaaagtggtaacgatatcgcgaattgcctgagaaagaacggtaaacgagtaatacaactcagtcgaaaaacatttgacacggagtatcagaaaactaaaaataacgactgggattacgtcgttaccacagacatcagcgaaatgggcgcaaacttccgcgctgacagggtgatagacccaaggcggtgtttaaagccagttatattaaaagatggtccagaacgggtaatattagccggtccgatgcctgtcacagttgcatcggcagcgcaaaggagaggaaggatagggcgtaaccacaacaaagagggagaccaatacatatatatggggcaacccttaaataatgatgaagatcatgcacactggacagaagcgaagatgttactggataatataaacacacctgaagggataattccagctctttttgaacccgaaagagagaaaagtgctgcaatagacggtgaatatcgattgagaggagaagccagaaaaacattcgttgaactaatgcgacgcggggatctcccagtatggctaagctacaaagtagctagtgaaggttttcaatacagtgaccgtaggtggtgtttcgatggtgagagaaataatcaagtactcgaggaaaacatggatgtagaaatatggactaaagaaggcgaaaggaagaaacttcgccccaggtggctagatgcaagaacatattcggatccattagctctaagagagtttaaagaatttgccgctggtcgaagatcagtttcgggtgacttgatattagaaatagggaaattgccccaacacttaacacaacgagcccaaaatgcactagataacttggttatgcttcacaattcagaacaaggtgggagagcataccgacatgctatggaagaattacccgatacaatcgaaacacttatgcttttagcgctaatagctgttctaacgggaggggttacattgttctttttaagtgggcgcggcttaggcaaaacctctataggcctgttgtgcgtcatggcgtcttctgtgctactttggatggcaagtgttgaaccgcattggatagcagctagcatcatcttagaatttttcttaatggttctattgattccggaaccagaccgccagcggacccctcaagataatcaactcgcttacgtagttataggattactgtttatgatcttaactgtagctgcaaacgagatgggtttgttagaaaccactaagaaagatctcggaataggccatgtagctgttgaaaatcaccaccatgccgcaatgcttgatgtcgacctgcatcccgctagcgcatggactctttatgcagtagcaaccaccataattacgcccatgatgagacatactattgaaaatactactgctaacatctccctaactgcaatagcaaatcaagcagcaatcttaatgggactcgataaaggctggcccattagcaaaatggatataggtgttccgctcttagcgctaggatgctattcgcaagtgaatccattgaccttgacagcggcagttctaatgttggtagcacactatgcaataataggccctggcctacaggctaaagcaacaagagaggcacaaaaacgaactgcggcgggaataatgaaaaaccctactgtagatggtatagtagcaatagatctggatcctgtagtgtatgacgcaaaatttgaaaaacaacttggacagataatgctattaatcttatgcacttcacagatcttactaatgcgaacaacttgggcactttgtgaatcaataactcttgccacgggaccattaacgacactctgggagggctcaccaggaaagttctggaatacaacaattgccgtcagtatggcaaacatattccgaggttcatacctagcaggcgcaggactggcattttctctgatgaaatcactaggtggagggagacgagggacgggagctcagggagaaactttaggcgaaaagtggaaacgacaactaaatcaattgtcaaagtcagaatttaatacgtataaaggcagcggaataatggaagtagaccgttcagaagcaaaagagggactaaaaagaggcgagacaacaaagcatgctgtaagtagaggaaccgcaaaactaagatggtttgtcgaacgtaatttggtgaagcctgaaggaaaagtaatagatttaggatgcggtagaggcggatggagttattattgcgctggtttgaagaaagttacggaagtgaaaggatacactaaaggagggccaggacatgaggaaccaattccgatggcgacatacgggtggaacctagtaaaattacacagtggaaaagatgtattctttatcccaccagaaaaatgcgacactttgttatgcgatataggagaaagcagcccgaatcctacaatagaagaaggaagaactttacgagtgttgaagatggtagaaccgtggttaagaggcaaccaattctgcataaaaatcctgaacccttacatgccctctgtggtcgagacactcgaacaaatgcagcgcaaacatggcgggatgttagttaggaacccactatcacgcaatagcacgcacgaaatgtactgggtatcgtgcggtacaggaaatatagttagtgctgttaatatgacctcaaggatgctcttaaatcgatttacaatggcacatcgaaaacctacgtacgaaagagatgtcgatttgggcgctggaacacgacatgtggctgtagaaccggaagtggcaaatcttgatataataggccaacgaatcgaaaatatcaaacatgaacataaatcgacctggcattacgacgaagacaatccatataaaacttgggcatatcacggttcctatgaagtaaaaccatccggtagcgcaagttcaatggtcaacggagtagtaaaattattaaccaaaccttgggacgtaataccaatggttacccagatagcgatgacagatacgacgccattcggtcagcaaagagtctttaaagaaaaagtcgatacccgcacaccgaaggcgaaaaggggaacagcacaaataatggaagttacagcgaaatggttatggggattcttgtcacgaaataaaaagcctagaatctgtactagggaagaatttactcgtaaagtacgaagtaacgcggctattggggccgtgtttgttgatgaaaaccaatggaactcagcgaaggaagcagtagaagacgaacggttctgggatcttgttcaccgggaaagggaactacacaagcaaggaaaatgcgcgacatgtgtgtataatatgatgggtaaaagagagaagaaactaggagaatttggaaaagctaaaggatctagagccatttggtatatgtggttaggagccagatttctcgagtttgaagcattgggattcatgaacgaggaccattggttttcacgcgaaaatagcttatctggagtggaaggtgaggggttgcataaactaggttatattctcagggacattagtaagatccctggaggaaatatgtatgctgacgatacagccggatgggatacaaggataacagaagatgatcttcaaaatgaagccaaaataactgacatcatggaacctgaacacgctttgttagctaaaagtatttttaaactaacgtaccaaaacaaagtagtaagagtgcagagacctgcgaagaatggcacggtgatggatgtaatttcgagaagagaccaacgaggtagcggccaagttggtacatacgggcttaacacatttaccaacatggaggcccaactaatccggcaaatggaatcagaaggaatattttctccttccgaattagaaacgcctaatttggctgaaagagtccttgattggttggaaaagtacggtgtagagcgacttaagcgcatggctatatcaggagatgactgcgtggtcaaaccaatagacgatcgattcgcaaccgctcttaccgctcttaatgatatgggcaaagtaagaaaagacatacctcagtgggagcctagtaaaggatggaatgattggcagcaagtcccgttctgtagtcaccatttccaccaactaatcatgaaagacgggcgtgaaatagtcgtaccgtgtcgaaatcaggacgaactcgtagggcgagctcgagtatcacagggtgcgggatggtctttaagagaaacagcatgtctaggaaaatcatatgcacagatgtggcaactgatgtactttcatagaagagatttaagattagctgctaatgcaatatgcagcgctgtccccgtcgactgggtacccacgtcccgcacgacatggagcatccacgcccaccatcaatggatgactaccgaagatatgctttccgtgtggaatagagtatggatagaggagaacccctggatggaggataaaacgcatattagttcctggggagatgtcccttatttaggaaaacgagaagatcaatggtgtggctcattaataggcttaacagctagagctacgtgggccaccaacattcaagtagcaattaatcaagtacgcagattaataggaaacgaaaactatctagattatatgacgtcaatgaaaagatttaaaaacgaatcagatcccgaaggagcgttatggtaa

SEQ ID NO: 21081 - RNA, 9879 nt, synthetic construct
  misc_feature 1..9879: note = derived and/or modified CDS sequence (opt6) from DENV-1__AB608787__SS-prME
  source 1..9879: mol_type = other RNA
agtgtaaccatgctattaatgctgatgccgacagcattagctttccatctcaccacacggggaggagaaccgcatatgatagttagcaaacaagaaagaggaaaatcactacttttcaaaacatcagctggtgtcaacatgtgcactttaatcgcaatggacttaggagaattatgcgaagatactatgacatataaatgtcctagaattacagaagcagaacccgatgatgtagattgctggtgcaatgccactgacacttgggtcacgtacggaacctgctcccaaacaggagaacatcgaagagacaaacggtccgtagctctcgctcctcatgttggacttgggctagaaacgcgtacagaaacatggatgagtagtgagggagcatggaaacaaatccaaagagtagaaacctgggcattgcgccatccaggatttacagtgatagctctgtttttagctcatgcgataggaactagcataacgcaaaaaggcataatatttattttactcatgttagttactccttcaatggcaatgagatgcgttgggataggatccagagattttgtagaaggattgtcaggagctacttgggttgatgttgtattagaacacggtagttgtgtaaccactatggccaaagacaaacctacactagatatagaacttttaaaaactgaggtgaccaatccggcggtattacgtaaactttgcatagaagcaaaaatatctaacacaactaccgacagtcgttgtccaactcaaggcgaagcaaccctggtagaagaacaagatgcgaatttcgtatgccgacgtaccttcgttgatagaggctggggaaatggctgcggtctatttggtaaaggatcattgcttacctgtgcaaaattcaaatgcgttactaaacttgaaggaaaaattgtacaatacgaaaatttaaaatattccgtaatagtgacggtgcatacaggagatcagcatcaggtaggtaatgaaagtacagaacacggtacaacggcaacaataactcctcaagcacctactacagagatacaactaaccgactatggtgcgctcacactagattgctccccacggacaggcttggactttaatgaaatggtattattaacaatgaaagaaaaatcatggctggtccacaaacagtggtttttagacctacccttaccttggacaagtggcgcatccacgagccaagaaacctggaatcgacaggacctcctagtaacatttaaaactgcccacgccaagaaacaagaagttgtagtattaggaagccaagaaggcgctatgcatacagcgctgacaggcgcaaccgaaattcagacatcaggcacaacgactatattcgccggacatttaaaatgtcggttaaaaatggacaaactaactctcaaaggtatgtcatatgtaatgtgtactggtagctttaaactggaaaaagaagttgcagagacgcaacacggaacggtacttgttcaaataaaatacgaaggaacagatgcaccatgtaaaataccattctcaactcaggacgaaaaaggtgtcactcaaaacggtcgattaataacagcaaaccccatcgttacagataaagaaaaaccagtaaacattgaagcagaaccccctttcggcgagagttatatagtaataggtgccggggaaaaagcgttgaagctctcctggtttaaaaagggctcatcaattgggaagatgttcgaagctactgcccgaggcgcgaggagaatggcaatactaggtgacaccgcgtgggatttcggaagtatcggcggggttttcacctcagtcgggaaactcgtccatcaaatattcggtactgcatacggggtactattcagtggtgtaagctggactatgaaaatagggataggagtactccttacatggttgggcttaaactcacggagtacttcattatctatgacctgtatagctgtcgggctagtaaccctatatttaggtgttatggttcaggcagattctggttgtgtaatcaactggaaggggagagaactaaaatgtggatctgggattttcgttacaaacgaagttcatacctggactgaacaatataagttccaagccgacagtccaaaacgattgtcagcggcaatcggaaaggcctgggaagaaggagtctgcggtataagaagcgctacgagattagagaacatcatgtggaaacagataagcaatgaactcaatcatatactcctagagaatgatatgaaattcacagtagtagttggagacgtagccggaatactagctcaaggcaagaaaatgatacggccacaaccaatggaacataaatattcttggaaaagctggggcaaagcgaaaataataggagcagatgtacaaaattcgaccttcataatagatggacctaacacccccgaatgcccggatgaccagagagcttggaatatctgggaggtagaggactatggattcggaatatttacaactaacatctggttaaaattacgtgatagctacactcaagtgtgtgatcacagactcatgagtgctgccataaaagacagtaaggctgtacatgctgatatgggatactggatagagtcagagaaaaacgaaacatggaagttagccagagccagttttattgaagtaaagacttgtatttggccaaagtctcatacgctatggagtaatggtgttctagaatcggaaatgattatccccaaaatatacggtggaccgatttctcaacacaattaccgacctggttatttcacgcaaacagcaggaccgtggcacttaggaaaactggaactagacttcgatttatgtgagggaacgaccgtagtggttgacgagcattgtggaaaccgaggacctagcttgcgcactacaacggtgactgggaaaattgttcacgaatggtgctgtagatcttgcacgctcccgcccctcaggttcaggggagaggatgggtgttggtacggtatggaaattagacctgtcaaagaaaaagaagaaaatttagtaaaaagcatggtatccgcagggtctggtgaggtagacagctttagtctagggctgttgtgcatttcaataattattgaagaagtgatgcgaagccgatggattcgaaaaatgttaatgactggaacactaggggttttcttcctacttataatgggtcagcttacgtggaacgatttaatacgtttgtgcataatggtaggggcaaatgcatcggacaggatgggtatgggtactacttatctcgcactaatggctacatttaaaatgagaccaatgtttgcagtaggtctcctgtttagacgattaacctccagggaagtcctgttattaacaatagggctatcacttgtagcatcagtcgagcttcctaactcattggaagaactaggggacggtttagcaatgggaataatgatactgaagctactaactgactttcaatcccatcagctatgggccacactattatcattaacttttataaagactacttttagtctacactatgcgtggaaaaccatggcaatggtattgtcaatcgtctctctgttcccactatgtttatcaaccacgtcgcagaaaacgacatggctacccgtattattaggatctctagggtgtaaaccattaacaatgttcctgattgcagaaaacaagatctggggtagaaagtcatggccattaaatgagggtattatggccgtaggtattgtaagtattctattgtcatcactgcttaaaaacgacgtcccgttagcaggcccgttaatcgccgggggtatgttaatcgcatgttacgtaattagtggatcaagtgccgacctcagtctagaaaaagcggcagaagtatcgtgggaggaggaagcagaacattccggggcttcacataatatcttagtggaagtacaagacgacggaactatgaaaataaaggatgaggaaagagatgatacactaacgattttactgaaagcaactctattagctgtttccggcgtttacccactaagcatcccagccactttatttgtatggtacttttggcagaaaaagaaacaaagaagcggagttctgtgggacacaccatctcctcctgaggtcgaacgcgctgtgctagatgacggcatttatcgcataatgcaaagaggtttgctaggaagaagtcaggtgggcgttggtgtgttccaggagaacgtatttcataccatgtggcatgtaaccagaggtgcagtcttaatgtaccaggggaaaaggttagaaccatcatgggcttcagtcaagaaagacttaataagttacggaggaggatggagattacaaggaagttggaatacaggcgaagaagtccaagttatagccgtagaaccaggcaaaaaccctaaaaatgtacagacggccccaggcacttttaagaccccagagggcgaggtaggcgcaattgcactagactttaaacccggaacatcagggtcccctattgtcaacagggaaggcaaaatcgtgggactatacgggaacggcgtagtcacaacatctggtacatacgtatctgcaatagctcaagcgaaagccagccaagaagggccactacccgaaatagaagatgaagtgtttcgaaagaggaatttaacaataatggacttacacccaggaagtggcaaaacgagaagatacctaccagctattgtaagagaagctatcaaacgtaaactccgaactcttatattagcaccgacaagagtggttgcgagcgagatggcagaagcattgaagggcatgccaataagataccaaacaactgccgtcaaatcagaacacaccggcaaggaaatcgtggacttaatgtgccacgccacttttacgatgcgactattgtcaccagtaagagttccaaattacaacatgattattatggacgaagcacattttacagacccctcatcaatcgcggccagaggctatataagtactcgagtcggtatgggtgaagccgcggccatattcatgacggcaacaccacccggctcagttgaagcctttcctcaatcgaacgctgtgattcaggatgaagagagggacatacctgaaagatcgtggaatagcggctacgaatggataacagatttcccaggtaagactgtctggttcgtgccatccattaaagcaggaaacgacatcgcaaactgtctaaggaaaaatggaaagcgtgttattcagcttagccgtaagaccttcgatacggaatatcagaaaactaaaaacaacgattgggattacgtagtaactactgatatatcagaaatgggtgccaattttagagcagatagggttatcgacccgcgcagatgcttaaagccagtaattctgaaagatggaccagaaagagtgatactcgctggacctatgccagttaccgttgcctctgcggcgcaaagacgcggccgaataggtcggaaccacaataaagaaggcgatcaatacatctacatgggacagcctctaaacaacgacgaagaccatgcccactggactgaagcaaaaatgctcctagataacattaatacaccagaaggcataataccagcactcttcgaaccagaaagagagaaaagtgctgcaatagacggagaataccgcctaagaggagaggcaagaaaaacttttgttgaattgatgagaagaggggatctacctgtatggctgagttacaaagttgctagcgagggattccaatatagcgataggcgttggtgtttcgacggagaaagaaataaccaagtcttagaggaaaacatggacgtcgagatttggacgaaagaaggtgagcgcaagaaattaagacccagatggttagacgctcgtacttattccgatccactagctctccgagaatttaaagaatttgcagcagggcgtcgatctgtatcaggagacctgattctagaaatcggcaaactcccacaacacctgacgcaacgagcacagaacgcattggacaatttagttatgctacataatagcgaacaaggaggcagagcatatagacacgcaatggaagaactcccagacaccattgagacccttatgctacttgctctaatcgctgtattaaccggtggggttactttattcttcctgtcgggcaaagggctagggaaaacaagcataggtttattgtgcgtgatggcatcaagtgtattattatggatggcatcagtagaaccccactggatagccgcgtctataattctagagttctttctcatggttctactgatacccgaaccagacaggcaaagaacaccacaagacaatcaattggcatacgtagtaatcggactgttgtttatgattcttacagtcgctgcaaatgaaatgggcttattagaaacaaccaagaaagaccttgggataggccacgtcgctgtagaaaatcaccatcacgcagctatgctagacgtagatttgcaccccgcaagtgcctggaccctttacgctgtagcaactaccataattacacccatgatgagacatacaatagaaaatacgactgcgaacatctctctaacggccattgcgaaccaagccgcgatcctaatgggcttagacaaagggtggccgatatccaaaatggacataggggtacctttgcttgctctagggtgctatagtcaagtaaatcccttaacgttaacagcagcggtattaatgcttgtagcacactacgctattataggtccagggttacaagcaaaggctacccgagaagcccagaaaagaaccgccgcaggcataatgaaaaacccgactgtagatggcatagttgcaattgacctagatccagttgtctatgacgcaaaattcgaaaaacaactggggcaaatcatgctattaatattatgtacaagtcaaatacttctcatgcgaacaacttgggcattatgtgaatcaattaccttagcaacaggacctttaacaacactatgggaaggttccccaggaaaattctggaatacaacaatcgccgtcagcatggccaatatcttccgtggaagctacctagcaggagcgggactcgccttctccttaatgaaaagccttggcggaggtaggcgaggaacaggagcacagggtgagacgctaggtgaaaagtggaagagacaactaaatcagctcagtaaaagcgagttcaatacatacaagggatctggtatcatggaggtggatagaagcgaggccaaagaaggcctgaaacgtggggagacgactaagcacgccgtaagtcgtggaactgcaaaattaagatggtttgttgaaaggaatcttgtcaaaccagaaggaaaagtaatcgatctgggatgtggaaggggcggttggtcatactattgcgcaggactcaagaaagtaactgaagtgaaaggatatacgaagggagggccaggccatgaagaaccaattccaatggctacatacgggtggaatctcgtaaagctacattcaggaaaggatgtattctttattccacctgaaaaatgcgataccttactatgtgatataggagaaagtagccctaatccaaccattgaagaaggccgaactctaagagtcttaaaaatggtagaaccatggctgaaaggcaaccagttctgcataaaaatattaaacccatacatgccttcagttgtagagacattggagcagatgcaacgaaaacatggaggtatgttagttcgaaatccgttaagccgaaactccacacatgagatgtattgggtctcttgtggaacgggaaatatagtaagtgcggtgaacatgacatcgcgaatgctactaaatagattcaccatggcccacagaaaaccaacctacgagcgtgacgtagaccttggagcaggcacaaggcatgtggctgtagaacctgaagtagcaaacttagacataataggtcaacgcatcgaaaatattaagcatgaacacaagagcacttggcattacgacgaagataacccatataagacttgggcgtatcacggatcctatgaagtcaaaccctctgggtctgcatcaagcatggtaaatggagtcgtgaaactgctaacaaaaccgtgggatgtcatcccaatggttactcagattgccatgaccgatacaacaccgtttggacaacagagggtgtttaaggaaaaggttgataccagaaccccaaaagcgaaaagagggactgcacaaattatggaagtgacagccagatggctttggagctttttgagtcggaacaagaaacccagaatatgcacaagggaagaatttacccgaaaagttcgaagtaacgctgctataggagccgtatttgtagatgaaaaccaatggaatagtgcaaaagaagccgttgaggacgaacgcttttgggacctagtacatagagaaagggagctacataaacagggcaagtgtgctacatgtgtgtataatatgatgggcaaacgagagaagaaattaggggagtttggaaaagcaaaaggaagtagggccatatggtatatgtggttgggggcaagattccttgaatttgaagcgctcggttttatgaacgaagatcattggttcagtcgtgaaaattctcttagtggagtagagggtgaaggacttcataagctcggatatatattgcgcgatatatcaaaaataccgggtggaaatatgtatgctgatgacacggcgggttgggatacacgtataacggaagacgacttacaaaacgaagcgaaaataaccgatatcatggaaccagaacatgccctactagcaaagtctatttttaagttaacatatcaaaataaggttgtgagggttcagcgacccgctaagaacgggacagtgatggacgttatttcaagaagagatcagcgcggtagtggccaagttgggacgtatggtctaaatacgttcacaaatatggaagcccaattaatacgacaaatggaatccgaaggcatcttttcaccttcggaactagagactccaaatttggcggaaagagtcttagactggctggaaaaatatggagttgagcgtctaaaaagaatggcgatatcaggagacgattgtgtagtaaaaccaatagacgacaggttcgcaaccgcactcaccgcactaaacgatatgggtaaagtaagaaaagacattccacaatgggaacctagcaaaggatggaatgactggcaacaggttcctttctgtagtcatcactttcatcaattaataatgaaagacggaagagaaatagtggtgccgtgtagaaatcaggatgagctagtaggacgggcccgagtatcacaaggggctggatggtcattacgagaaactgcttgcttagggaaatcgtatgctcaaatgtggcaattaatgtattttcatcgccgcgacctgcgtctcgcagccaacgctatttgcagtgctgtacctgtagactgggtcccaaccagtcgtacaacgtggtccatacatgcccatcaccaatggatgacaactgaagatatgctatccgtatggaatcgagtctggattgaggaaaacccatggatggaagacaaaacacacatttcatcttgggaagacgtcccttatttaggtaaacgagaggatcaatggtgtggcagcttaatcggattaacagctcgacccacctgggcaaccaatattcaagtagctataaatcaagttaggaggttaattggcaacgagaactatctagattacatgactagcatgaaacgcttcaaaaatgaatcagaacctgagggtgcactttggtag

SEQ ID NO: 21082 - RNA, 9879 nt, synthetic construct
  misc_feature 1..9879: note = derived and/or modified CDS sequence (opt6) from DENV-1__HE795086__SS-prME
  source 1..9879: mol_type = other RNA
tctgttactatgctattgatgcttatgccaactgcattagcttttcatctaaccacaagagggggagaaccacatatgattgtgtccaaacaagaacgagggaaaagtctattatttaaaacatcagctggagttaacatgtgcacactaattgcaatggatctgggtgagttctgcgaagatacaatgacgtataaatgtcctcgtatcacagaagccgaacctgacgatgtggactgctggtgcaatgcaactgatacttgggtgacctacggtacttgttcccaaacgggagaacaccgtagagataaaagaagcgttgcattagcaccgcacgtagggctaggattagaaacacgaacagaaacatggatgagtagtgaaggtgcgtggaaacaaatacagagagttgaaacatgggccctcagacaccccgggtttacagttatagctttgtttctagcacatgcgatcggtacaagtatcacccaaaaaggcatcatatttatattgctaatgctggttacacctagcatggcaatgcgctgcgttggaataggttcaagagattttgtagaaggattatcaggagcaacttgggtagatgttgtactagaacatggaagttgcgttactacaatggcaaaagataaaccaacgttagatatcgaattactaaaaacagaagtaaccaatcctgcagtacttcgtaaactctgcattgaagccaaaatctcaaacactacaacagatagcagatgcccaacccagggcgaagcaacactggtggaagaacaggatgctaacttcgtctgccgccgtacattcgtagatagagggtggggtaatggatgtggtttattcggtaaaggtagtttgatcacatgtgcaaaatttaaatgcgtaactaaactggaaggcaaaattgttcaatacgaaaatttgaaatacagtgtgattgtcacggtacacacaggcgatcaacatcaagtgggcaatgaatcaacagaacacggcacaactgccacaataacaccgcaagcgccctcaacagaaattcagctgactgattacggcgcactcacgctagattgtagtcctaggacgggcctagattttaacgaaatggttctactcacaatgaaagaaaaatcatggcttgtccataaacaatggtttctcgacttacccctcccctggacaagcggggcaagcacctctcaagaaacttggaatagaaaagacctcctagtaacgtttaaaactgctcatgctaaaaagcaagaagttgtagtattagggtctcaagaaggagctatgcacactgcattaacgggagcaacggagatacagacaagcggaactaccacaatatttgcagggcatcttaaatgtcgtttaaaaatggataagttaacacttaaaggtatgagctatgtcatgtgtacagggtcatttaaacttgaaaaagaagtagccgaaactcaacacggaacggtattggttcaaatcaagtatgaaggaacagatgcaccttgcaaaataccatttagtacccaggacgaaaaaggggtaacgcagaacggtagattaataactgcaaatcccattgtaaccgataaagaaaaaccggtaaacatcgaggctgaacccccgttcggagagagttacatagtaattggagccggtgaaaaagctcttaaactctcatggttcaagaaaggtagttctataggcaaaatgtttgaagctacggcacgtggcgctcggcgaatggcaatattaggtgacacggcatgggacttcggctctataggaggggttttcacttcggtagggaaactcgtacatcaaatctttggaacggcatatggcgtcttgttttcaggagttagttggacaatgaagataggaataggtgtactgttaacgtggcttgggttaaattcaagatcaaccagtttatccatgacttgtatcgcggtgggtttagttactttgtatctaggggtaatggtacaagcagactcgggatgtgtaataaattggaagggcagggagttaaaatgtggtagcggtatatttgtcactaacgaagtccacacatggactgagcagtacaagttccaggcagattcacctaaacgattaagcgcagcgataggaaaagcctgggaggaaggtgtatgcggagtaagatctgctactcgcctcgaaaatatcatgtggaaacagatcagtaacgaattaaaccatattttgcttgagaacgatatgaaatttacagtagtcgtaggtgacgttgctggaatcctagcacaaggcaagaaaatgataagaccccaacctatggaatataagtactcctggaaaagttggggcaaagccaagattataggtgcagacgtacagaacaccacattcatcatagatggtccgaacacacccgaatgtcctgatgatcagagagcatggaacatatgggaagtggaagactatggatttggaatcttcacaacaaatatttggttaaaacttcgagactcatatactcaagtatgcgatcatcgattgatgtctgcggctattaaagattctaaagccgtccacgctgatatgggatattggatagaaagtgagaaaaatgagacatggaaattagcacgtgcatcatttattgaggttaagacatgtatttggccgaaatcgcacactttatggagtaacggagtgctggaatcggagatgattatccccaaaatttatgggggaccgatatcccaacataactatagaccggggtactttacgcaaactgctggtccttggcacttaggtaaactagagctggattttgacctttgtgaaggaacaacagttgttgtggacgaacactgcgggaataggggaccatctcttaggactacaacggtaacaggaaagataatacacgaatggtgctgtagaagttgtaccctaccaccacttcgatttaagggtgaagatggctgctggtacggcatggagatcaggccagtaaaagaaaaagaagaaaacttagttaaatcaatggttagtgcgggatctggtgaggttgactctttctctctcggcctattatgtatatcaataatgatagaggaagtgatgcgcagtaggtggtctcgcaaaatgttaatgacaggaacgctcgcagttttctttctacttataatggggcagctcacatggaacgacttaataagactatgcataatggttggcgccaacgcgagcgatcgcatgggcatgggaactacctatttagctttgatggcaacatttaaaatgcgcccaatgtttgccgtcggtcttctatttcgacgacttacctcaagagaggtattacttcttactataggacttagtctagtcgcgtcagtcgaattgcctaactccctggaagaattaggcgatggactagcaatgggcataatgattctaaagttgctaacagatttccaatcgcatcaactttgggcaactttactatctttgacttttataaaaaccactttctctctacactatgcatggaaaaccatggccatggtcttgagtatcgtatccctattccctctatgtttgtcaaccacaagtcagaaaactacgtggttgccagtccttctaggatcacttggctgcaagccacttacaatgttcctaatagcagaaaataaaatttggggtagaaaatcctggccgctgaatgagggcatcatggcagtaggcatcgtatcgatattgttaagctctttactcaagaacgatgtccctttagccggaccacttattgctggtggtatgcttatcgcgtgctacgttataagcggttccagcgcagacttatcactagaaaaggcagcagaggttagctgggaagaagaggcagaacattctggcgcatcccataacatattggtagaggtacaagacgacggtactatgaaaattaaagacgaagaacgagatgataccctcactattcttttaaaggcgacgttattagcggtatcaggagtatatcccctatcgatacctgcgacactatttgtatggtatttttggcaaaagaagaaacaaagatcaggagtcttatgggatactccgagtccacctgaagttgaacgagcagtattggacgacggtatatatcgaattatgcaaagaggcctattaggtagaagccaagttggagtaggagtcttccaagaaaacgtcttccacacgatgtggcatgtaacacgaggtgccgtcctaatgtatcagggaaagcgcctagaaccatcttgggcatccgttaaaaaggatctgatttcgtatggaggaggatggaggttacaggggagttggaatacaggagaggaggtacaagtgatagccgtggaaccagggaagaatcctaaaaatgtacaaactgcaccgggaacgttcaaaaccagtgaaggtgaggttggcgcaattgcccttgactttaagcccggaacttccgggtccccgatcgtaaacagagaagggaaaatagtaggtctatatggaaatggagtagtcacaacttcaggcacgtacgtaagcgccatcgcgcaggcaaaagcatctcaggacggtcctctcccagaaatcgaagacgaagtgtttcgaaaacggaatcttacaataatggatctacatcctggaagtggtaaaaccagacgatatttacctgctatcgttcgtgaggcaattaaaaggaaactacgaaccttgatacttgcacccacaagggtagtagcaagtgagatggcagaagcactgaagggcatgcctataaggtatcagacaacagcagtgaagtctgaacatacgggtaaggagatagtagatctaatgtgccacgcaaccttcactatgcgtctccttagccctgtccgagttccaaattataatatgataattatggatgaagcacactttacagacccttcatctattgcggcaagagggtacatctcaactcgcgtgggcatgggagaagcggctgcaatattcatgactgccacacccccaggctctgtggaagcatttccccaaagcaacgctgttatccaagacgaagaaagagatatcccagagagatcatggaatagtggatacgaatggataacagactttcctggtaaaactgtttggtttgttccttctataaaatcggggaacgacatagccaattgtcttaggaagaacggaaaaagagtcatacagttaagtcgcaaaacattcgatactgaatatcaaaagacgaaaaacaatgattgggactacgtggtcactacagacataagcgaaatgggtgcaaattttagagcagatagagtaatagacccacggaggtgcctaaagccagtaatactaaaggacgggccggaaagagtaattcttgcaggtcctatgccagtaactgtagccagtgctgcacagagacgagggcgtataggcaggaaccataacaaagaaggagatcaatacatttacatgggacagccgcttaacaatgacgaagatcatgcacattggacggaagcaaagatgctattggataacattaataccccagaagggataataccagcattgtttgaaccggaacgggagaaaagtgccgcaatagacggtgagtaccgactaagaggtgaagcgaggaaaacatttgtagaacttatgagacgaggggatttaccagtctggttgagctacaaagtcgcctctgagggatttcaatactctgatcgaaggtggtgtttcgacggcgagaggaataaccaagtcttggaagaaaatatggatgtagaaatctggacaaaagaaggagaacgtaagaaattaagaccacgatggctagacgctcgcacatattcagaccctttggccctaagagaatttaaagagtttgcagcaggccgcagaagcgtatctggggacctaattttagaaataggtaagttaccccagcacctcactcagcgcgctcaaaacgctttagacaatttagttatgcttcataattctgaacaaggagggcgtgcatacaggcacgctatggaggaattacccgacaccattgagaccctaatgcttttggcattaatcgcggtattaaccggtggtgtcacattgtttttcttgagtggaagaggcctgggaaaaacaagcattggactcctctgtgtaatggcttccagtgtacttttatggatggcaagcgtcgagccgcattggattgctgcatcaatcattttagagttcttcttaatggtcttactaattccagagcctgaccgacagcgcacccctcaggacaaccaattagcatacgttgtgataggactgttgtttatgattctcacagtcgcggcgaatgagatgggcttgcttgaaactaccaagaaagacttaggaattggtcacgttgcagtcgaaaatcatcaccacgctgcaatgttagatgtagatctacatcccgcctcggcttggacactctacgcagtagccaccacaataataacacctatgatgaggcatacgattgagaatacaacggccaacattagcttaacagcaattgccaatcaagctgctattcttatgggattagataaaggttggccgataagcaaaatggatataggggttccacttctagctctagggtgttattcacaagttaacccattaacccttacagcagccgtacttatgttagttgctcattatgccataataggtcccggattacaagctaaggcaacgcgtgaagcacagaaaagaacagctgcgggtataatgaaaaacccaaccgtagatggcatagtggcaatagatttagacccagtagtgtacgatgcgaaatttgaaaaacaactaggacaaataatgttattaatactttgtacatcacaaatattgttaatgagaacaacatgggccctatgcgaaagtataacattagccacaggaccccttactacactatgggaaggaagtccgggtaaattctggaatactaccatagccgtatcgatggcgaatatatttcggggttcgtatttagcaggggcaggactagctttttctctaatgaaatctttaggcggaggacggaggggtacaggagcccagggagaaactctgggtgaaaaatggaaaaggcaactaaatcaactaagcaaatccgagtttaatacatacaaaagaagtgggattatggaggtcgatcgcagtgaagctaaagaaggactaaagcgcggagaaacaacaaaacatgccgtatcaagaggaacagcaaaattgaggtggtttgtagaaagaaatctcgtgaaacccgaaggaaaagtcatagatttaggctgtggtaggggaggttggtcttactattgtgctggactcaagaaagttacggaagtaaaaggttatacgaaaggtggacctggacatgaagaaccgataccaatggcaacctacggttggaacttagtcaaacttcactcaggaaaggacgtcttcttcataccacctgaaaaatgtgatacactactgtgtgatatcggcgaatcatctcccaacccaactatagaagaaggtagaacactaagagttctgaagatggtagaaccatggttacgaggcaatcaattttgtataaaaattctaaatccatatatgccaagtgtagtggaaactcttgaacagatgcaacgaaaacacggaggaatgttggtgcgtaatcctctgtccagaaattcaacgcacgaaatgtactgggtaagctgcggtacaggaaatatcgtatccgccgtaaacatgacgtcacgaatgctacttaaccgatttactatggcgcatcgtaaacctacatatgaaagggacgtagatctcggagcagggacccgccacgttgctgtagaacctgaggttgctaacctagacatcattggtcagcgtattgaaaacataaaatatgagcataaatccacatggcattatgatgaagataacccatataagacatgggcttaccatggttcatatgaagtaaaaccttcagggagtgcgtcttccatggtaaatggagtggttaaactactgacaaaaccctgggatgttatacccatggtaacacagatagcaatgacagatacgacgccattcggacaacaacgagtattcaaagaaaaagtggatactagaacaccaaaagcgaaaagaggaaccgcacaaataatggaagtaacggccaaatggctatggggtttcttgagtcgtaataagaaacccagaatatgtaccagagaagagttcactaggaaagtccgatcaaatgcagctataggcgcagtttttgtcgatgaaaaccaatggaacagtgctaaggaagcagtagaagatgaaagattctgggacctagtccatagagagcgtgaattgcataagcaaggaaaatgcgcgacatgtgtatacaacatgatgggcaaacgagagaagaaactcggggagttcggaaaagccaaagggtcacgagcaatatggtatatgtggctgggggcaagatttctagagttcgaagccttgggttttatgaacgaagatcactggttttcgagagaaaatagtctaagtggagtagaaggagaagggttacacaaattaggttatatactacgagacattagcaaaattccagggggtaatatgtatgcagatgatacagctggctgggacacaaggataacagaggacgacctacagaatgaagcgaaaattaccgatataatggaacccgaacacgcactccttgccaaaagcatatttaaactcacataccaaaacaaagttgtacgcgtacaacgccctgctaagaatggaacagtaatggacgtcatttcaagacgtgaccaaagggggtcgggacaggtagggacttacgggttaaacacattcacaaacatggaggcacaacttatccggcagatggagtctgagggtatattttcaccctcagagcttgaaactcctaacctcgctggaagggtgttagattggcttgaaaagcacggcgtcgaaaggctaaaacgtatggccattagtggtgacgactgtgtggtgaaaccaattgacgaccgttttgctactgcacttaccgccctgaacgatatgggtaaagtgagaaaagatatcccccaatgggaaccgtcaaaaggttggaatgattggcaacaggtaccattctgtagtcatcattttcaccaacttattatgaaggacgggagggagattgtcgtgccgtgtagaaaccaagacgagctagtaggccgagcaagggtttcacaaggagcagggtggtcactacgtgagactgcctgcctaggcaaatcatacgctcaaatgtggcaactcatgtattttcaccgtagagatttaagattagctgcgaatgcaatttgcagtgcggttcctgtcgattgggttccgacttcgagaacaacatggtcaatacatgctcaccaccaatggatgactaccgaggacatgcttagcgtgtggaacagagtgtggattgaagagaatccctggatggaagacaaaacccatataagtagctgggaagatgtaccatatctgggaaaaagggaggatcaatggtgtgggtcacttataggtctcaccgcaagagcaacatgggcaactaacattcaagttgcaataaatcaggtccgacgactaattgggaatgaaaactacttggattatatgacctcaatgaaaaggtttaaaaatgagtccgatccagagggtgctttatggtaa

SEQ ID NO: 21083 - RNA, 9879 nt, synthetic construct
  misc_feature 1..9879: note = derived and/or modified CDS sequence (opt6) from DENV-1__AB189120__SS-prME
  source 1..9879: mol_type = other RNA
tctgtaactatgttactgatgctattacctacagtactcacatttcacctcactaccagaggcggagagccgcacatgatcgtttcgaaacaggaaagaggcaaatcactactatttaagacttcggccggcgtaaacatgtgcactttaatcgctatggatttaggcgagctgtgcgacgacaccatgacttataaatgtcctagaattacagaaacagaaccggacgacgttgactgctggtgtaacgctacagaaacgtgggtaacatacggcacctgtagtcaaactggcgagcaccgcagagacaaacgatcagtagcactagcgcctcatgtaggcctaggtttagaaacacgaactgagacttggatgtcttccgaaggcgcttggagacaaatccagaaggttgagacatgggctcttcgacatcctggtttcactgttatagcattatttttggcacacgccatcggcacttcgatcacccaaaaaggaataatttttatcttattgatgttggtgacgccatcaatggcaatgcgttgtgttggtattggtaacagagatttcgttgaaggactatccggagcaacgtgggttgatgtagttttagaacatggatcatgtgtgacaaccatggccaaggacaaaccaacattagacatagaactattgaaaacagaagtcacaaatccggcagtgctacgaaagttatgcattgaggcaaagatatccaacacaacaactgacagtagatgtccaactcaaggagaagctacgctggtcgaagagcaggacgcaaattttgtgtgtaggagaacttttgttgacagaggttggggtaatgggtgcgggttgtttggtaaaggaagtttaataacatgcgcgaaattcaagtgcgtgacaaagctagaagggaaaatagttcaatatgaaaacctaaagtatagtgtaatagtgacagtgcacacaggggatcaacatcaagtaggaaacgaaacgacagagcacggaacgattgcgacaataactcctcaggctccaacaagtgaaattcagcttaccgactatggggcgcttacattagattgtagtccacgaaccggtctggacttcaacgagatggttttacttacaatgaaagaaaaatcatggctagttcacaaacaatggtttctagacttaccattgccatggacgagcggggcgtcgacgtcccaagaaacgtggaatagacaagatctactggtaacattcaaaaccgcacacgctaagaaacaagaagcagtggtacttggctcccaggaaggtgcaatgcacacagctttaacgggcgcaacagagatacaaacgagcgggactacgactatattcgctggacatctgaaatgccgtttaaaaatggacaaactaaccttaaagggaatcagctacgtcatgtgtacagggtcatttaaactagaaaaagaagtggctgaaacgcaacatgggacagtactcgtacaagtcaaatatgaaggtacagatgcaccatgtaagataccatttagctcacaggatgaaaagggcgtaacacaaaatggacgtttggtgacggctaaccctatagtgactgacaaggagaaaccagttaatattgaggcagagcccccctttggtgaatcatatatagtcgttggggcaggcgaaaaagcgttaaaattaagttggtttaagaaaggctcgtcgatcggaaaaatgtttgaagctaccgctagaggtgccagaaggatggcgatattgggagatacagcatgggacttcgggagtattggtggagtgtttactagcgtaggaaaactagttcatcagatttttggtacagcttatggtgttctattttctggagtatcatggacgatgaagattggtatcggaatcttattaacttggctaggactgaacagtagatctactagtctatctatgacatgtatcgccgttggaatggtaaccttatatctcggtgtaatggttcaggcagattcaggctgcgttattaattggaaagggagggaacttaagtgcggatcgggtattttcgttactaacgaagtccatacatggactgaacaatataagtttcaagcagattctcccaagcgtttatccgccgcgattggtaaagcttgggaggaaggagtttgtggcatccggagtgcaacaaggttagaaaacattatgtggaagcaaattagtaatgagctaaatcatattttattagaaaatgatatgaaattcacagtagtagtcggtgacgttagcggcatactagcacaaggaaaaaaaacaattcggccacaaccaatggaacataaatattcgtggaagtcatggggtaaagccaaaataataggagccgacgtacaaaatactacatttattatcgacgggccaaacacgccggagtgtccagatgatcaaagggcgtggaacatatgggaagtagaggattacggatttggcatatttacaacgaatatttggctcaagttacgtgatagctatacccaagtgtgtgatcacagattaatgagcgcagcaataaaagactcaaaagccgtccatgctgatatggggtattggatagaaagcgaaaaaaatgaaacctggaaattggccagagcatcattcatagaagtcaagacatgcgtttggccaaaatctcatacactttggagcaacggagtcttggaatccgaaatgataatacctaagatatatggaggaccgatatcacaacataattatagacccggttatttcacccaaaccgctggcccatggcatctaggtaaactagagctagacttcgatttgtgtgaaggtacaaccgtagttgtagacgaacactgtggaaaccgtgggccttctctccgaacaacgacagtaacaggaaaaataatacatgagtggtgttgcaggtcatgtacattacccccactcagatttaaaggcgaagacggttgctggtatggaatggaaataagaccagttaaggagaaggaagagaatttagtaaagtcaatggtttcagcagggtcaggcgaagtagatagcttctcactaggtctgttatgtatatcaataatgatagaagaagtaatgagatccaggtggtcccgtaaaatgttgatgacaggtactctggttgtttttctattattgacattaggtcaacttacatggaatgatcttatccggctatgtatcatggttggagctaatgcaagtgacaacatgggtatgggaacgacttatttagctttgatggcgacgtttcggatgcgaccgatgttcgcagtaggactgttgtttcgaaggctcacatctagagaagtcttgttactgacggtaggattgagcctagttgcaagtgtcgaactgccaaattcgctagaggagttaggggacggacttgcaatgggcattatgatacttaaattgctcacggatttccagagccatcaattatgggcgacgttgctatctttaacatttgtcaaaacgacgctgtccctccactatgcgtggaagacgatggcaatgatcttgtcaatagtatctctcctccctttatgcttaagcacaacgagtcaaaagacgacgtggttacctgttctcctaggttcattaggttgcaaaccgcttactatgtttcttataacagaaaataagatctggggacgaaaaagctggcctctaaatgaaggcatcatggctgtaggtatagttagcatcttactatcatctctattgaagaacgacgtacccctagcaggtcctttgattgccggcggtatgttgatagcatgttacgttataagtggtagctctgcagatttaagtttagagaaggcggcgaaggtatcatgggaagaagaagccgaacattcaggcgcatcgcataatatacttgtagaaatacaagacgatggaacaatgaaaatcaaggacgaggaaagggacgatacaattaccatactattaaaagccaccctactggctatatcaggagtgtaccccatgtcaataccagctacattgtttgtatggtatttctggcagaaaaaaaaacaacgctcgggtgtattatgggatacaccttcacctcccgaagtcgaaaaagcagttttagacgacgggatttacagaattttgcaaagagggttactaggcaggagccaagtgggcgtcggtgtgttccaggaaggagttttccacacaatgtggcacgtaacccgcggcgcggtattaatgtatcagggcaagcgcttagaaccatcatgggcaagcgtgaaaaaggatctaattagttacggaggtggttggaggtttcagggatcctggaatacgggtgaagaagtacaagtaattgccgttgaacctggtaagaatccaaaaaatgttcaaaccgctcctgggacatttaaaacatcagaaggagaagtaggtgctattgcgctagatttcaaacctggcacaagtgggagtcctatagtgaaccgagaaggtaaaatagttggcctgtatgggaacggtgtagtaactaccagcggcacatacgtatcggccatagcgcaagcaaaagcaagccaagagggtcctttacctgaaatagaagacgaagtgtttagaaaaagaaatttgacaattatggacttacacccaggttctggcaaaactaggcggtatttacctgctatcgtaagagaggctattaaaagaaaattaagaaccttggttctcgccccaacgcgtgtcgtcgcatctgaaatggcggaagcgctaaaagggatgcccatcagatatcaaacaacagctgtaaaaagcgaacacacaggaaaggaaattgttgaccttatgtgtcacgctacatttacaatgaggctcttatcaccagtcagagtaccaaattataacatgataataatggacgaggcacatttcactgacccagcctctatcgcagcaagaggatatatctcaacaagagtaggaatgggagaggcagcagcaatttttatgactgccacaccaccaggctcagtggaagcttttccacaatcaaatgctgtgattcaggatgaagaaaaagacataccagaacgaagttggaactcgggctacgactggattactgattttccgggcaaaactgtttggttcgttccgtctattaaatcgggtaacgatatagcgaactgcttaagaaaaaatggaaaaagagtgatacaattatcgaggaagacatttgacacagaatatcaaaaaactaaaaacaatgattgggattacgtagttacaacggatatatcggaaatgggagcaaattttcgagctgacagggtaatcgaccctaggcgatgcctaaaaccggttatacttaaagatggaccggagcgagtgatactagcaggtccaatgcccgtaaccgtggcttcggcggcccaaagacgaggtcgaatcggaagaaatcaaaataaagagggagaccagtacatctatatgggtcaaccattaaataatgacgaggatcacgcccattggactgaagccaaaatgttgctcgataatatcaacactccagaaggtattattccggcccttttcgaacccgaaagggaaaaaagtgcagcaatagacggcgaatatcggctccgaggagaagcaagaaaaacattcgtcgaactgatgagaaggggcgatttgccggtttggctatcttacaaggtggcctcagaaggatttcagtactccgataggcgctggtgcttcgatggggagcgtaacaaccaagttttagaagaaaatatggacgtagaaatatggaccaaagaaggggaaagaaaaaaattacgacccagatggttggatgctcgtacgtactcagacccattagcactgagagaatttaaagaattcgctgcgggccggagatctgtttcaggtgatctcatattagaaataggcaaacttccgcaacatctcacgcaacgggcccagaatgcattagataatttggttatgttacataattctgagcaaggagggaaggcatatagacatgcaatggaggaattgccagatacaattgagaccatcatgttattagccctaatagccgttttaactggcggggtaaccctatttttcttaagtggaagaggattagggaagacatctatagggctcttatgtgtaatgtcctcctcagcgttattatggatggcatcagtggaacctcattggattgcagcaagtatcattttagaattctttctaatggtactcctaataccagaaccagacaggcaaaggacaccacaagacaaccaattagcctacgtagttataggtctgctgttcatgatattaacagtcgcagcaaatgagatgggtcttctagagacaacgaaaaaagatttaggcatcggccacgcagctgcggaaaatcatcatcatgccgccatgcttgatgtcgaccttcatcctgcaagcgcctggactctctacgcagtggctactacgatcattactccaatgatgagacatacaattgaaaatacaaccgcaaacatttccctgactgcaattgccaaccaagcagcaatcctaatgggactagataaaggatggcccatttcgaaaatggacattggagtacctttgcttgctttgggatgctatagtcaagtgaatccgttaacgctcacagcagcagtcttgatgctcgtcgctcactacgctataatcggcccgggactccaagcaaaagccactcgcgaagcgcagaaaagaactgccgctggaataatgaaaaacccgaccgtagatggaatcgttgccatagatttagatcctgtagtatatgatgcaaaatttgaaaaacaattaggtcaaattatgttacttattttgtgtacgagtcaaatcttattgatgcgaaccacatgggccctatgcgagtcaataacactcgccactggaccgctgactactttgtgggaaggttccccaggtaaattttggaacactacgatcgctgtgagcatggcaaatatatttcgcggttcttacttggctggtgcagggttagctttttccttgatgaaaagtttaggcggtggccgaagagggactggggcccaaggggaaacactgggagagaagtggaagcgacaactaaaccagctatcaaaatcagagtttaacacttataaaagatcaggcataatcgaggtggacaggtcggaagcaaaagaaggtttaaaacggggggaaacaacgaaacatgccgtctcgcgaggcactgcaaagttacgctggtttgttgaaaggaatttggtaaaaccagaaggaaaagttatagacttaggctgtgggaggggtggatggagctattattgtgcgggactcaagaaagtaaccgaagtaaaaggttacacgaaaggaggtccaggtcacgaagaaccaattccaatggcaacctacggttggaatttagttaagctccatagtggaaaagatgttttctttattcctccagaaaaatgtgatactctactatgtgatataggagaaagttcgcccaatccaacaatagaagaagggagaactctgcgggtacttaaaatggtagagccttggttaagagggaaccaattttgcataaaaattttgaatccttacatgccgagtgtagtagaaacattggaacaaatgcaaagaaaacacgggggaatgctcgtgcgtaatccattaagcagaaatagtacacatgaaatgtactgggtgagctgtggaaccggaaatatagtatcggctgtaaacatgacttctagaatgttactaaacagattcacaatggctcatcgcaaaccaacttacgagcgcgatgtcgatctaggagccggcacgcgccacgttgcagtagaaccagaggtagcaaatctagacattataggacaaagaattgaaaacattaaaaatgaacacaagtcaacgtggcattacgatgaagacaatccttacaagacttgggcatatcacggaagctacgaagtaaaaccttctggctcagccagtagtatggttaatggagttgtcagactattaacaaaaccgtgggacgtaatacccatggttacacagatagcaatgactgatactactccttttggtcagcaaagggttttcaaagaaaaagtcgatacgagaactccaaaggctaaacgtgggacagcccagataatggaggtcacagccaaatggctatggggattcctatcaagaaacaagaaacctcgtatatgcactagggaagaattcactagaaaagtacgttccaatgcggcaataggtgcagtattcgttgatgaaaaccagtggaactcggcgaaggaggcagtagaggatgaaagattttgggatttagtgcgcagagaaagagagttgcataaacagggaaaatgtgcaacgtgtgtatataatatgatgggaaaaagagaaaaaaaattaggcgaattcgggaaagcaaaaggctctagagcgatatggtacatgtggctaggtgcaagatttttagaattcgaagcattaggattcatgaatgaagatcattggttctcacgagagaatagtttgagcggggttgaaggtgaaggtcttcataagctgggatatatactaagagacatatccaaaatccctggtgggaatatgtacgcggacgacacagcgggttgggatactcgtattacagaggatgacctacaaaacgaagcaaaaattaccgacataatggagccagaacatgcactattagcaacctctatttttaagctcacgtaccaaaataaagtggttagagtacaaagaccggcaaaaaatgggacagtaatggacgtaattagtagaagggatcaaagaggttcaggtcaagtgggcacttacggtctaaatactttcactaatatggaagctcagttaattcgacaaatggaaagtgaagggattttctcaccctctgaactagagacacccaacctagcaggaagagttctagattggctcgaaaaacatggaactgagcgattacgacgaatggccatctcaggggatgactgtgtagtgaaacccatagatgacaggttcgctactgcattaacagcattaaacgatatgggcaaaataaggaaagacatcccacagtgggagccatccaaaggttggaatgactggcagcaagtaccattctgttcgcatcattttcatcaattgataatgaaagatggcagagagatagtcgtcccatgtcggaatcaagatgaacttgtcggaagggcaagagtatcccaaggtgctggctggagtctgcgagaaacggcttgtttaggaaagtcttacgcacaaatgtggcaacttatgtactttcatagaagagacttaagacttgcagcgaacgcaatctgctcagcggtgccagtcgactgggtaccaacctccagaacaacctggtcaattcacgcacaccatcaatggatgacgacggaagacatgttaagtgtatggaacagagtatggatagaagaaaatccatggatggaagataaaactcacgtaagttcatgggaagacgtcccatatcttggaaagagggaagatcagtggtgcggtagcttaatcggattaaccgcgagagcaacatgggcaacgaacattcaagttgcaataaaccaagttagacgtctaataggcaatgaaaattatttggactatatgacttcaatgaaacgattcaaaaatgagtcagatccggaaggtgcgctgtggtga

SEQ ID NO: 21084 - RNA, 9879 nt, synthetic construct
  misc_feature 1..9879: note = derived and/or modified CDS sequence (opt6) from DENV-1__AB189121__SS-prME
  source 1..9879: mol_type = other RNA
agtgttacgatgttgtttatgctattaccgacggccctagcttttcatttgacaactcgcggtggagaaccgcatatgatcgtttccaaacaagaaagaggcaaatctttactatttaaaacaagtgccggcgtgaatatgtgcaccttgattgcaatggatctaggagaactgtgtgaagatacaatgacttacaaatgccccagaattacagaaactgagcctgatgatgtagattgctggtgcaacgccaccgaaacatgggttacctatggtacgtgttcccaaacaggtgaacatcgccgcgataaaagatcagtagcactagcaccacatgttggcctcggcctcgaaacaagaacggagacatggatgtcgtctgaaggtgcttggaggcaaatacaaaaagtagaaacttgggctttgagacacccaggctttacagtaatggccttatttctagctcacgctatcggtacatctataacacaaaaagggatcatatttatactacttatgttagttacccctagcatggcgatgcgatgcgtaggaatcgggaatagagattttgtcgaaggactatctggggcaacctgggttgatgtagtcttagaacatggctcctgtgtaacaacgatggctaaagacaaaccaacattggatattgagctgttgaaaacagaagtgacaaatcctgccgtcctaagaaaattgtgcattgaagccaaaatctcaaacacaacgaccgattcaagatgtcctacacaaggcgaagcaaccttagttgaggaacaggataccaacttcgtttgtcgacgtacattcgtagatagaggatggggtaatggatgtggtctttttggaaaaggttcgctcataacctgcgctaaatttaaatgtgtgaccaaattagaaggaaagattgtacaatacgaaaatttaaagtatagtgtaattgtgactgttcatacaggtgatcaacatcaagtagggaatgagactaccgaacacggcacaacagcgataattacgcctcaagcaccgacaagcgaaatacagctaactgattatggagccttgacactagattgttcaccacgtactggtctagatttcaacgaaatggtgttactaaccatgaaggagaaatcgtggttggttcataaacaatggttcctcgacctaccactaccgtggacatcaggagctagcaccagtcaggagacatggaacagacaagacttactggtgacatttaaaacagcgcatgcaaagaaacaggaggtcgtcgtgttaggtagtcaagaaggcgccatgcataccgcgttaacgggcgcaacagagatacaaaccagcggtaccacaacaatctttgcgggtcacctaaaatgccgattaaaaatggataaactaactctcaaaggagtcagctatgtaatgtgtaccgggtcctttaaacttgaaaaggaagtggcagaaacgcaacatggcaccgtattagtgcaagtaaagtatgaaggaacagatgcaccttgtaaaatcccgttttcgagtcaagatgaaaaaggagtaatccaaaacggaagattgattacagcaaatccaatagtcacagataaagaaaaaccggttaatattgaagcggagccaccttttggagagagttacattgtagtaggggctggcgaaaaggcccttaaactatcatggttcaaaaagggaagctcaatcggaaaaatgttcgaagcaacagcacgaggggcacgtagaatggctatattaggagatacagcctgggactttggcagtataggaggtgtttttacaagcgttggaaagttggtacatcaaatatttgggactgcgtacggggtcctattttctggagtaagctggacgatgaaaataggaattgggatattactaacctggctagggctgaacagtcggtctacatcgctaagtatgacatgtattgcggttggcatggttacgctatacctgggcgtaatggtacaagcagactcgggctgtgtcataaattggaaggggagggaattaaaatgcggctcaggtattttcgttacaaatgaggttcatacatggaccgaacagtacaaattccaggcagattctccaaagaggttatcggcagcgataggtaaagcctgggaagaaggtgtgtgtggtataaggagtgcaacacgcctagaaaacatcatgtggaaacaaatttcgaatgaattaaatcacattttactcgaaaatgatatgaagtttaccgtagttgttggagacgtgtccggtatactcgcacagggaaagaagatgatccggccgcaaccaatggaacataagtactcttggaaaagctggggaaaggccaaaatcataggagcagacgtgcaaaatattacatttataatagatggaccgaacacatccgaatgccccgataaccagcgcgcatggaatatatgggaagtagaagattatggattcggtatatttacaacaaacatctggttaaaacttagagattcctatacacaagtttgcgatcacagactaatgagcgcagcgataaaggactccaaagcagtacatgcagatatgggctattggatcgaaagcgaaaagaacgagacatggaaactcgcaagagcatcattcattgaagttaaaacgtgtatttggcctaagtcacatacattatggagcaatggagtgttagaaagcgaaatgataatccctaaaatttatggaggaccagtaagccaacacaactatagacctgggtattttacgcaaaccgcgggaccatggcatttggggaaattggaactggattttgatttatgtgaaggtactacggtagtagttgatgaaaattgcggtaacaggggaccttcgttaagaacaacaacagtaaccggaaaaacgatacatgagtggtgctgccgtagttgtactttaccaccgcttcgattcaagggagaggatggttgctggtatggaatggaaatcaggccggtgaaggagaaagaagaaaatttggttaaaagtatggtctcagcgggatcaggtgaggttgatagtttttcactcggcttattatgtatatctataatgatcgaagaagttatgagatctagatggagtagaaaaatgcttatgacaggaacgctagcagtattcttgctcttaactatgggacaacttacatggaatgatttgatacgactttgcatcatggtcggtgcaaatgcgtctgatatgatgggtatgggtactacctatctcgctttaatggcaacattccgtatgcggccaatgttcgccgttggattactgtttaggagactaacatcacgtgaagtacttttgttgacggtaggtttgtctctcgttgcaagtgtggaattaccgaactcgttggaagaactaggtgacgggctggcaatgggaataatgatgctaaaactcttgacagattttcaaccccaccaactatgggcgactcttctatcattaactttcgtcaaaacaacatttagtttacactacgcgtggaaaacaatggcaatgattctcagtatagtatctctgttaccactatgtttgagcacgacatcccagaaaactacatggcttcccgtattattagggagtctagggtgtaagccattaacgatgttacttataacagaaaacaaaatctggggcagacggagttggcccctaaatgaaggaataatggcgataggaatcgtctctatattacttagtagcctactcaaaaatgacgtaccacttgcaggcccactaatcgcgggaggaatgttaatagcctgctatgttatttccggcagttccgccgatttatcattagaaaaggctgcagaagtctcttgggaagacgaagcagagcattccggagcgagtcacaacatattagtggaagtacaagatgacggaacaatgaaaataaaagacgaagaacgcgacgacacactgacaatattacttaaggctacactattagccattagcggggtttatccgatgagtataccggcaactctgttcgtctggtatttctggcagaagaagaaacagagaagtggagttctctgggatacaccgagtcctccggaagtagaaagagcagttttagataatggaatatatagaatattgcaaagaggacttctcggacgctcacaggttggcgtcggcgtctttcaagaaggagtgtttcatacgatgtggcatgtcacaagaggagcagtcttaatgtatcaaggcaaacgactagagccttcatgggctagcgttaaaagggatttaatttcatatggcggtggatggaggttccaaggaagctggaatactggtgaagaagtacaagttatagcagttgagccagggaaaaaccccaagaatgtgcaaacaacgcctggaacatttaaaacaccagagggagaagtgggagctattgctttagattttaaaccaggaacgtcaggatcaccaattgttaatcgagagggtaaaatagtcggattgtatggcaatggcgtagttacaacctcaggtacctacgtatctgcaatcgcacaggctaaggcttcacaggaaggccccctacccgaaatcgaagatgaggtatttcgaaaaagaaatttaacaataatggatttgcatccgggatcgggtaaaacgcggagatatctaccggcaatcgtacgagaagcaataaaaagaaaactacgaacgctagtgttagctccaacaagagttgttgccagtgaaatggcagaggctttaaaaggtatgccaattaggtatcagacaacagctgtaaagagcgaacacacgggtaaagaaatagtcgacttgatgtgccatgcgacatttacaatgagattactgtcccccgtaagggttccaaactataatatgattatcatggatgaagcccattttacagacccggcctccatagcagcccgaggctatataagcactcgagtcggaatgggagaggcagcggcaatattcatgacagccactcctcccggctcagtggaagccttcccccaatcgaacgcggtaatacaagacgaagaacgtgacattcccgaaagatcatggaatagcggttatgaatggattaccgatttcccaggcaaaaccgtgtggtttgtgccgagcataaaatcaggaaatgacattgcaaattgtttacggaaaaatggcaaaagagttgtacaattaagcaggaaaacattcgatacagagtatcagaaaactaagaataacgattgggactatgtggtaactactgatatttctgaaatgggagcaaactttcgtgcagatcgggtcatagatcctagaagatgcttaaaacccgttatattaaaagatggaccagagcgtgtaatcctggccggccctatgccggtaacggtagcttccgcagcacaacgcaggggaagaatcgggagaaacccaaataaagaaggtgatcaatatgtctatatggggcaaccattaaacaacgacgaagatcatgcacactggacagaggcgaaaatgttgttggataatataaatacacctgaaggtataataccagcactatttgaacccgagagagaaaagagcgccgctatagatggagaatatcgactacgaggagaagcaaggaaaacgttcgttgagttaatgcgccgaggagatcttccagtttggctaagttataaggtagcatcggaaggctttcaatatagcgatcgaagatggtgctttgatggtgaacgaaataatcaagtcttagaagagaatatggacgttgaaatctggaccaaggaaggagagcggaagaaactaagaccaagatggttagacgcgagaacctacagtgacccactcgccttaagggagtttaaagaatttgctgcaggacgaagatcggtttcaggtgatctaatattggaaattggtaaactaccgcaacacctgactcaaaaagcacagaacgctttagataatttagtaatgctccataactctgaacaagggggaaaagcgtaccgacatgcaatggaagagttgcctgacacaattgagacattaatgttattggcattaattgcagtcttaactggaggcgttacattgttctttttaagcggacgaggacttggtaaaacgtcaattggattgctatgcgttatggcgagtagcgcacttctatggatggcgagcgtcgaaccccactggattgcggccagcataattttggaatttttcttaatggtgttacttattccggagccagatagacagcgaacaccgcaagacaaccaactagcgtatgtagttataggattactatttatgatactaaccgtagcagccaatgaaatgggattattagagacgactaagaaggatctcggaattggacacgccgcagcggaaaaccaccaccatgcagcaatgctggacgtggatttacatccagcctcagcatggaccctatacgcggtagcaacaacaattataactccgatgatgagacatacaatagagaatacgacggcaaatattagtttaacagctatagcaaaccaggctgctatactcatggggctggataaaggatggccgattagtaagatggacataggagttcccttattagctctaggctgctactctcaagttaacccactaacactcacagcggctgtgttaatgttggtggcacattacgcaataatcggacccggtctacaagcgaaagcaactagagaagcccagaaaaggacagcagcaggaattatgaaaaaccctacagtagatgggatagtggcaatagatcttgacccagttgtatatgatgcaaaatttgaaaagcagttgggccaaattatgttgttaattctatgtacatcacaaatattgctaatgcgtacaacatgggccctatgtgagtcaataacgctggcgactgggccattgactacattatgggaagggtctcctggtaaattttggaacactactatagctgtatcaatggcaaatatatttaggggaagctatctagctggagccggtttggcgttttcactcatgaagtccttaggtggcggtagaagggggactggcgcgcaaggagaaacacttggagaaaaatggaagcggcaacttaatcaactctccaagtcagaatttaatatatataaaagatccggaatcatagaagtggaccgatcagaagcaaaagaaggattaaaaagaggagagactacgaagcatgccgtttcgagggggacggccaaattaagatggtttgttgaacgaaacttagtgaaaccagaaggaaaagtcatagacctaggatgtggacgaggtggatggagttattattgcgcgggactcaagaaagtcactgaagttaaaggctacacaaaaggtggacccggccacgaggaacctatacctatggcaacctatggatggaatctcgttaaattacactcggggaaagatgtattcttcactccacccgagaaatgcgatacactattatgcgatatcggggaaagcagtcccaacccaaccatagaagaggggcgaacactacgtgtgcttaagatggtggaaccatggctgaggggcaaccaattttgcataaaaatccttaacccttacatgccctcggtagttgagacactggagaaaatgcaaagaaaacatgggggcatgttagtgaggaatcccttatctagaaatagtacacatgaaatgtattgggtatcatgtggaaccggaaatatagtcagcgctgtaaacatgacaagcagaatgctcctaaacagattcactatggcgcatagaaaaccaacttatgaaagagacgtagatttaggagctggcacacggcacgtagctgtagagccagaggtagccaacttagatataattggtcaacgtattgaaaacattaaaaatgaacataaaagcacgtggcactatgatgaagataatccgtataaaacatgggcataccacggctcctatgaagtcaaaccttctggaagcgcatcaagcatggtaaatggagtggttcgtcttttaacaaagccctgggatgtgattcctatggtaacacaaatagcaatgaccgacacaacaccgtttggacaacaaagagtatttaaggaaaaggtggacacccgaactcctaaggccaaaaggggaactgcccaaataatggaggtaacagcccgatggttatggggattcctgagtagaaacaagaaaccacgtatatgtacaagggaagagttcacacgcaaagttagaagtaatgcagcaattggggcggtgtttgtagacgagaatcagtggaatagcgccaaagaggcagtggaagacgaacgcttctgggatttggtacatcgagagagagagttacataagcaagggaagtgcgccacgtgtgtctataatatgatgggaaaacgtgaaaagaaattaggagagtttggaaaggctaaaggttcaagggccatatggtatatgtggctaggtgcgagattcttggaatttgaagcacttggtttcatgaatgaggaccattggttcagtagagaaaacagcctatcgggcgtggagggtgaaggcctacataagttggggtatatattgcgagatataagcaaaatacctggtggaaacatgtacgcagatgacacagcagggtgggacacccgaataacagaagacgaccttcaaaatgaagcaaaaatcactgacataatggaaccggaacacgctctgttagctacttctatatttaagttaacgtatcagaataaggtagttagagttcaaagacccgcgaagaacggaaccgtaatggatgtaatttcaaggagagatcaaagagggagtggacaagtcggaacttatggacttaacacgtttacaaacatggaagcacaacttatccgacaaatggagtctgagggaatattttccccatcagagctagaaaccccaaacctggctgagagggtatttgattggctagaaaaacatgggattgagcgcttaaaacgaatggctatctctggtgatgactgcgttgttaagccaatcgatgatagatttgcaaccgcattaacagcactaaacgatatgggaaaagtaaggaaagacattccacaatgggaaccatcaaaaggttggaacgattggcagcaagttccattttgcagtcatcatttccaccaactaatcatgaaagatggtagagaaatcgtagtcccatgccgaaaccaggatgaacttgtgggacgagcacgcgtatcccaaggagcgggctggtcactacgtgaaacagcatgtttgggaaaaagctatgcacaaatgtggcagttaatgtattttcataggcgagatttgcgactagccgcaaatgcaatttgtagtgccgttcccgtggattgggtcccaacgagtaggacgacttggagtatacatgcgcatcaccaatggatgacaacagaagatatgttgtcagtatggaatagggtatggattgaagaaaacccgtggatggaagacaaaactcatgtctcaagttgggaagacgtaccttatttaggaaaacgagaagatcaatggtgtggatccttaataggtctaaccgctcgagcaacttgggccactaacattcaagtcgcaatcaatcaagttagaagattaataggaaatgagaactatctagattatatgacaagtatgaaaaggtttaaaaatgagagtgatcctgaaggcgccttgtggtag

SEQ ID NO: 21085 - RNA, 9879 nt, synthetic construct
  misc_feature 1..9879: note = derived and/or modified CDS sequence (opt6) from DENV-1__AB195673__SS-prME
  source 1..9879: mol_type = other RNA
agtgtcaccatgttacttatgttacttcctactgcacttactttccatttaacgactaggggaggagaaccccacatgattgtagggaaacaagaaagaggtaagagcttgctatttaaaacctcagcaggagtgaacatgtgcactttaatagcaatggatttaggggaactatgcgatgatactatgacctacaaatgccctcgcataacagaaaccgaacccgatgacgttgactgttggtgtaacgcaactgaaacatgggttacttacgggacatgttcgcaaacgggcgaacacaggcgcgataaacgatctgtggctttagcaccacatgtcggtttaggattagaaacacggacagaaacttggatgagctcagaaggggcatggagacaaatacaaaaagttgaaacctgggcgttgaggcaccccggatttacagtaatagcgctattcctggcgcatgtgattggtacttcaatcacacaaaaaggaataatattcatactgctaatgctagtaaccccaagcatggctatgcgatgcgtaggaataggtaatagagatttcgtcgaaggattgagcggagctacttgggtggatgtagtattggaacacggttcttgtgtaacaacgatggcaaaagataaaccgacgctagacattgaattactcaaaactgaagtaacaaatccagctgtactacgtaaattatgcatagaagctaaaatttcaaacactaccacagacagtagatgtccaacacaaggagaagcgacattagtagaagaacaagataccaactttgtttgtagaagaacattcgtggatcgaggatggggtaatgggtgcggactattcggaaaaggatcactgataacatgtgcgaaattcaaatgtgttacgaaactagaaggaaaaattgtgcaatatgaaaaccttaaatattcagtaattgtcacggttcatactggggatcaacaccaagttggtaatgaaacaacagaacacggaacgatagcaacgataactccacaggcgccaacaagtgaaatccaattaacggactatggagcattaacattggattgttctccaagaacaggtctagacttcaacgaaatggtcttattaacaatgaaggaaaaatcatggctagttcataaacaatggtttctagacttgccgctaccctggacgagcggcgcgtcaacttcacaagagacatggaatagacaagatttattagttacttttaagaccgctcacgcaaagaaacaagaagtagttgtcttagggtcccaagaaggagctatgcacacagcattgaccggagctacagaaattcagacaagtggtaccacaacaatatttgcaggtcacctaaaatgcaggttaaaaatggataaacttacgttaaaaggaattagttacgttatgtgtacaggtagcttcaaattagaaaaagaggtagcggagacacaacacggaacagtcttggtccaagttaaatatgaagggacggatgcaccatgtaaaataccgttttcaagccaggatgagaaaggtgtaacacagaacggtagactcgtcactgcaaatccaattgtaacggacaaagaaaaaccggtaaacatagaggcagaaccaccctttggagaatcatatatcgtagtcggtgccggtgaaaaggctttgaagctcagctggtttaagaaaggatcatcgataggcaaaatgtttgaagcaacagcaaggggagcgcgaaggatggcaatacttggcgatacagcatgggactttgggtctattggcggtgtattcacgtcagtggggaagttagtccatcaaattttcggtacagcttatggagtactattttctggagtttcgtggactatgaaaataggaattggaattttactaacatggctcggtctaaactctcgttcgacatctttgagcatgacttgtatagctgtcggactaatcaccttatacctaggtgtaatggtacaggcagattcaggatgtgttattaactggaaaggtcgagagcttaaatgtggcagcggtatatttgtaacaaacgaagttcatacttggacagaacagtataaatttcaggccgacagtccaaaaagactttccgcagcaataggcaaggcttgggaagaaggcgtttgcggaattagatcagcaactaggcttgagaatatcatgtggaaacagataagtaatgaattgaatcacatcttattagagaatgacatgaaattcaccgtagttgtcggcgacgtcagcggtatacttgcacaaggcaagaaatcgataagacctcaaccaatggagcataaatattcatggaaatcatggggaaaagcaaagataatcggagcggatgtgcagaacaccacttttatcattgacggtccaaatacacccgaatgcccagatgaccagagggcatggaacatatgggaggtcgaggattatgggtttggaattttcactaccaacatatggctaaaactaagagactcatatacgcaagtatgcgatcatcgactcatgagtgccgcaataaaagacagcaaagccgttcacgctgacatgggatattggattgagtcagagaaaaatgaaacctggaaattggctcgagccagctttattgaagtgaaaacgtgtatttggcctaaatcgcacacactatggtcaaatggtgtactggagtctgaaatgataattccaaagatatacggtggccctatctcacagcacaattaccggccagggtattttacacaaactgcgggaccatggcaccttggaaaactggagcttgatttcgacctatgtgaggggaccactgttgtggttgacgaacactgtggaaatagaggcccatccctgagaactacaacagtgaccggcaaaataatacacgaatggtgctgtcgatcatgtactctaccaccattacgcttcaaaggtgaagatggatgttggtatggtatggagataaggccagtaaaagaaaaagaagagaatctcgtgaaatcaatggtatcagctggcagcggagaggtcgatagtttctcattgggtctcttatgtattagcattatgatcgaagaagtgatgagatctcgatggagcaggaaaatgcttatgactggaactctggcggtgtttttgctgttaactatggggcaactcacttggaacgatctcataagattgtgcatcatggtaggcgctaacgcatccgataatatggggatgggaacaacctatttggctttaatggccacattcaggatgcgaccgatgttcgcagtcggacttttgtttagaaggttaacttcaagagaggtgcttctactaaccgttggcttatccttggtagctagcgtggaacttccaaactcactggaagaactaggagacggtttagcaatgggtataatgatactgaaattgctcacagactttcagtcacaccaattgtgggccacgctactttccctaacctttgtgaagaccacattttcactacattacgcctggaagactatggcaatgattcttagtatagtttccttatttccattatgcctttcaacgacgagtcagaaaacaacgtggcttccggtccttctgggctcgttaggttgtaaacctttaactatgtttctcataactgaaaacaagatctggggacgaaaatcatggccgctaaatgagggaataatggcagtagggatagtaagtatacttttaagtagcctgctcaaaaacgatgtacctttagctgggcctttaattgctggcggcatgctaatagcatgttatgtaatttctggcagcagtgctgacctaagcctggaaaaagctgcggaagtatcttgggaagaggaggcagagcattccggagccagtcataatatattggtcgaaatacaagacgacggaactatgaaaataaaagacgaggaaagagacgataccataaccattctcttgaaggctaccctattagctattagtggagtctacccaatgtcaatcccagcaaccttatttgtgtggtatttttggcagaagaagaaacaaagatcgggagtcctgtgggacaccccttctcctccagaggtcgagagagctgttcttgacgatggaatctaccgaatacttcaacgaggattgcttggtcgtagtcaggtaggggtaggagtgttccaagaaggggtatttcatactatgtggcatgttaccagaggagcggtactcatgtatcagggtaaaagactggaaccaagctgggcatcggtaaagaaagatctaatatcatatggtggtggctggaggtttcagggttcatggaacaccggagaagaagttcaagtaatagctgttgagccgggcaaaaatccgaaaaacgtgcagactgcacctggaaccttcaaaacgagcgaaggagaggtaggggcaatcgcccttgattttaaaccaggtacaagtggaagccctatcgttaacagggaaggcaaaatcgttggtttatatgggaatggcgttgtcacaacaagcggcacctatgtgtccgccattgcgcaagctaaagcatcccaagaaggaccacttcctgaaatagaagacgaagttttcagaaaaagaaacctaactataatggatttgcatccagggagtggaaaaacccgtcgctatctaccagccattgtacgagaagcaattaaacgtaaactacgaacccttgtacttgcccccacaagagtagtagctagtgaaatggcggaggctctaaaaggcatgcctattcgctatcaaacaactgcggtgaaatctgaacatacagggagggaaatagtagaccttatgtgtcatgctacatttacaatgcggttgctgtcccccgtcagagttcctaactacaatatgataattatggacgaagctcattttacagatccggccagtatagcagcaagaggatacatcagcacccgggtaggcatgggagaggcagcagcaattttcatgacagctaccccaccaggatctgtagaggcttttccacagtctaacgctgtgattcaagatgaagaaaaagatatcccagaacgaagttggaactcaggctacgattggataacagattttccaggtaaaaccgtgtggttcgtacccagcataaaaagtggaaatgatatagctaattgtcttagaaagaatggcaaaagagtgatacagttaagtagaaaaacctttgataccgagtaccagaaaactaagaacaatgattgggattacgtagtaacaaccgatatatccgagatgggagctaatttcagagcagatcgagtaatagaccccaggcgatgcttaaaacctgtaatactgaaagacggacccgaaagagtaattcttgctggacccatgccagtcacggtagcaagcgcagctcagaggcgtggtcgaataggaaggaatcaaaacaaagaaggtgaccaatatatctatatgggacaaccactaaacaatgacgaagatcatgctcactggacagaagcaaaaatgttactagacaatataaatacacctgaaggtattattccagcattgtttgaacctgaaagagaaaagagtgccgcaatagacggagagtatcgattgcgaggcgaagcacgaaaaacatttgtagaattaatgcgtcgcggtgatctgcccgtatggttaagttataaggtagcaagcgaaggctttcaatactctgatagaagatggtgttttgacggagagaggaacaaccaagtattagaagaaaatatggatgttgagatatggactaaggaaggtgaaagaaagaaactacggccaaggtggctagacgccagaacttatagtgatccgttagcacttagggagtttaaagagttcgcagcaggtagacgatccgtctcaggtgacttaatattagaaatagggaaacttccgcaacatctgacacaacgagctcaaaatgcgctagataatctggtaatgttacataattcggaacaaggaggtaaggcttatagacacgcaatggaggaattaccagacacgatagaaacacttatgctgttggccttaatcgcagttttgacaggaggtgttactttatttttcctgagtggacgtggtttaggcaaaacatccataggattattgtgtgtcatgagttcctccgcattactatggatggctagcgtggaaccgcattggatagcagcaagcattatactagaatttttcttaatggtactcttgattcccgagccagacagacagagaacacctcaggacaatcagttggcctatgtagtaataggattgctattcatgatactaactgtagcggcgaatgaaatgggtttactagaaacgactaaaaaggacttaggtattggacatgcggcagctgaaaatcaccaccatgcggcaatgcttgacgttgacctacatccagcttcggcttggacattatatgctgtagctacgacaataatcactccaatgatgcgacacaccatagaaaataccactgctaatattagcctgacagccatagctaatcaagcagcgatcctcatgggacttgataaaggttggcctataagtaagatggacataggagtaccactcctagcattaggttgttactcgcaagttaacccgctaacattaaccgcggccgttctcatgttggtcgcgcattacgctatcataggacctggtttacaagctaaggcaactcgtgaagcgcaaaagaggaccgcagcaggtatcatgaaaaaccctaccgttgatggaatcgtggctatagatctggacccagttgtatatgacgcaaaatttgaaaaacaattaggacaaattatgctattgatactttgtacatcacaaatactcttaatgagaacaacctgggctctctgcgaatctataaccttggctacggggccattgacaacactatgggaggggtcccccggaaagttttggaatactactatagccgtcagcatggccaatatatttagaggtagttatcttgccggggcaggtctagctttttccttgatgaaatcacttggcggaggcagacggggtacaggagctcaaggagagacgctcggtgaaaagtggaaacgccaactaaatcagctgtccaaatcagagttcaatatttacaagaggagtgggatagtagaagtggacagaagcgaagccaaagagggactaaagcgtggtgagacaataaaacacgccgtttctcgaggtacagcaaagttgcgatggttcgtagaaagaaacctagtaaagcctgagggtaaagtaatagatttgggttgtggaagaggtgggtggtcttattattgcgccgggttaaagaaggtaacagaagtgaaaggatacaccaagggaggacccgggcatgaagaacctattcccatggcaacttatgggtggaatcttgtaaagttatatagtggtaaagatgtcttcttcataccacccgaaaaatgtgatacattattgtgtgacattggtgaatcatcgcccaaccctacaattgaagaagggagaaccttgcgcgtgctaaaaatggtagagccatggttaagaggtaatcaattctgtataaaaattctaaacccgtatatgccgtctgtagtagagacactcgaacaaatgcaaagaaagcacggtggaatgttagtacggaatccgttaagcaggaactctactcatgaaatgtattgggtttcatgtgggactgggaatatagtatccgctgtgaatatgacaagcagaatgttgttaaacagattcacaatggctcacaggaaacccacatatgaaagagatgttgatctcggagctggaacaagacacgtagcagtcgaacccgaagttgcaaatctcgatataattggacaaagaatcgaaaacataaagaatgaacataaaagcacgtggcattatgacgaagacaatccgtacaaaacttgggcataccatggatcgtatgaagttaaaccctcaggctcagcatcatctatggtaaatggtgttgtaaggttgttaacaaaaccctgggatgtcatcccaatggtgacgcaaattgccatgactgacactacaccgtttggtcagcaaagagtcttcaaagaaaaagttgacacacggactccaaaagcaaagagggggaccgcacaaattatggaagtgacggctaagtggctatggggatttttaagtagaaataagaaacccagaatttgcacaagagaggagttcactcgtaaggtcagaagtaatgcagcaataggagctgtttttgtggatgaaaatcaatggaactctgcaaaagaagctgtcgaagatgaaagattctgggatctagttagaagagaacgagaattacacaaacaaggcaaatgtgcgacatgcgtttataatatgatgggaaaaagggaaaagaaactaggcgagttcggtaaagcgaagggatcgagagcaatatggtatatgtggcttggggcccgatttctcgagttcgaagctcttggttttatgaatgaagatcattggtttagcagggaaaattctctgtctggagtggagggcgaaggtttacacaaactcggatacatcctccgtgatattagtaaaatcccagggggaaatatgtacgcagacgatacagccggttgggacacacgtattactgaagatgacctccaaaatgaggcaaaaattacggacataatggaaccagaacatgctctcctcgcgacgtcaatatttaaactaacctatcaaaataaggtagtcagggtacagcgtccggccaaaaatgggacagtcatggacgtgatttccagaagagatcagagaggcagcggacaagtaggaacctatggactcaatacttttactaatatgggcgcccaactaattcgccaaatggaatcagaaggtatattctcccccagcgaactggaaacgcctaatttagccggacgagtcttggattggcttgaaaaacatggaattgagagactacgccgaatggctattagtggggatgattgtgtagtcaaaccaatagatgaccgatttgcaacagcgttaactgcactaaacgacatgggaaaagtccgcaaagatattcctcagtgggaaccttcgaaaggctggaacgattggcaacaagtccccttctgctctcaccactttcatcagctgataatgaaagacggaagagagatagtcgtaccttgtagaaatcaagacgagctagtcggcagagcaagggtatctcaaggcgccggctggagtctcagagaaacggcatgtttagggaaaagctatgcacagatgtggcaacttatgtattttcaccgcagagatttaaggttagcagcaaatgcaatctgctcagccgtacctgttgattgggttccaaccagtcgaaccacctggagtattcatgctcatcatcaatggatgaccactgaagacatgctgtcggtatggaatagagtctggatagaagaaaatccttggatggaagacaaaactcacgtgtcatcatgggaagatgtaccatacttgggcaaacgggaagatcaatggtgtggcagcttgataggtttaacagcacgtgccacgtgggccacgaacattcaggtggctattaatcaagtccgaaggttgatcggaaacgaaaactatttagactatatgacaagcatgaaaagatttaaaaatgaatctgatccggaaggtgcactgtggtaa

SEQ ID NO: 21086 - RNA, 9879 nt, synthetic construct
  misc_feature 1..9879: note = derived and/or modified CDS sequence (opt6) from DENV-1__AB204803__SS-prME
  source 1..9879: mol_type = other RNA
tcagttactatgttactcatgctattacccacggtactaacgtttcatctcaccactaggggtggggaacctcatatgattgtaagtaaacaagaaagaggtaaatcactcctctttaagacctccgcaggggttaatatgtgtacgctgatagcaatggacttaggtgaactctgcgaagatactatgacgtataaatgtcccaggataactgagactgagcctgatgatgtcgactgttggtgcaatgcaaccgagacgtgggtaacttatggaacttgctcccaaactggagaacataggcgggacaagcgaagcgtggcattggctccacatgtaggactcggactagaaacgagaacggaaacatggatgtcgtctgagggggcttggaagcaaatacaaaaagtagaaacatgggcgctaaggcatccgggattcaccgttattgctctcttccttgcacacgccatcggaacaagtattacgcaaaagggaatcatttttatattactgatgctagtaacaccctctatggcgatgcgatgtgtaggaataggaaatcgagattttgtagaaggactatccggggcaacttgggtcgacgtagtactagaacatggctcgtgtgttacaacaatggcaaaggataaaccgacactagatatagaactacttaaaacagaagtcacaaacccagctgtattacgcaagttatgtatcgaggctaaaataagcaacacaacaacggattcacgttgtccgactcaaggtgaggctactctcgtggaagaacaagatacaaacttcgtatgccgaagaaccttcgttgatagaggatggggaaacggttgtggcctttttggtaaaggcagcttaataacctgtgttaaatttaagtgcgtaaccaaattagaaggaaaaatagtgcaatatgaaaaccttaaatatagcgtcatcgtcactgtacacacaggagatcaacaccaagtagggaatgaaacgacagagcatgggaccatagcgacaattacccctcaagcaccaacctcggagatacaacttacagactatggagcattaacactagattgctcgccaaggacaggtttagacttcaatgaaatggtattactaaccatgaaagagaaaagttggttagtgcacaagcaatggttccttgatcttcctctcccttggacaagtggagccagtacctcccaagaaacatggaaccgtcaagacttgttagttacatttaagactgctcatgccaagaaacaagaagtagtggtacttggttcacaagagggcgcgatgcatacggctttgacgggtgcgactgaaatccagacgtcgggcacaacaaccatatttgctggtcacctaaaatgtcgactaaaaatggataaactaacactcaaaggcacatcctatgtaatgtgcacaggtccttttaaactggaaaaggaggtagctgaaacgcaacacgggactgttttggttcaagtaaaatatgaaggaacagatgcaccatgcaaaataccgtttagttctcaagatgaaaagggtgtaacacaaaatgggaggttgatcacggccaacccaatagttactgacaaagaaaaacccataaatattgaggctgaaccgccgtttggtgaatcgtacattgtagtgggtgttggagaaaaggctctaaaactttcatggtttaagaaaggctcatctatcggcaaaatgttcgaagctacggcaaggggtgctcgaaggatggccatattaggagatactgcatgggatttcgggtctataggtggggtattcacaagtatgggaaaactcgtacatcaaatatttggcaccgcatacggagttttattttctggagtctcgtggacaatgaagattggcatcggtatactgttgacttggctcggactcaattcaagatcgacatccctgagtatgacgtgcatagcagtaggaatggtaacattatacttaggtgtcatggtacaagcagacagcggatgtgtcataaactggaaaggaagagaactaaaatgtggcagtggaatatttgttacaaatgaggttcatacatggacagaacagtataaatttcaagcggatagtcccaagagattgagcgcggctatcgggaaagcatgggaagagggagtatgcggtataaggtcagcgacccgtctggagaatatcatgtggaagcaaatttcgaatgaacttaaccatattttactagagaacgatatgaaatttacagtcgtagttggagatgtatcaggaattttagcccaaggcaagaaaatgatacggccacaaccaatggagcacaaatactcttggaaatcgtgggggaaagcgaaaattataggagctgatgtacaaaacactacctttataatcgatgggccaaacacaccagaatgttcagatgatcagcgtgcatggaatatttgggaagtggaagactacggatttggcatatttacaactaacatttggttaaaattacgggacagttatacacaagtatgcgatcaccgattaatgtccgcggccataaaggactcaagagcagtacatgcggatatgggatattggatcgagtcagagaagaatgaaacatggaaacttgcccgtgcttcatttattgaagttaaaacatgcatatggcctaaaagccacacgttatggtcgaatggcgtgttagaatcagagatgattatccccaagatatacggcggtccaatttctcaacacaactaccgtccgggttacttcacccaaaccgccggaccatggcacctgggaaagttagagttggatttcgatctttgtgaaggtactacagtagttgttgacgagcaatgcggaaacagggggccgagtctacgaactacaacagtaactgggaaaataatacatgaatggtgttgtaggtcctgcacgcttccacccttaaggttcaaaggtgaagatgggtgttggtacggaatggaaataagacccgtcaaagaaaaagaagagaacctagtaaaatcaatggtaagtgctgggtcgggagaagttgattcattctcgctagggttactatgcatcagtataatgatagaggaagtgatgcgttctcgttggtcaagaaaaatgcttatgacgggtaccttggctgtattcttactgctaacaatgggacaactgacttggaatgacttgatacggttatgtattatggtgggagctaacgcttcagataaaatggggatgggaaccacctatttagctctaatggctacgtttcgaatgcgaccaatgtttgcagtaggattactgtttagagggctaacaagtagagaagtactgttactgaccgtcggactatcgttggtcgcttcagttgagctacctaattcattagaggaacttggcgatggcttggcgatgggaataatgatgctgaagttattaacagattttcagtcacaccaactgtgggcaacgttattgagcctaacatttgtcaaaacaactttctccctacattacgcttggaaaactatggccatgacacttagcatagtatcactttttcctttatgtttatcaaccacaagtcagaaaactacctggctaccagtgctattagggtcgttaggatgtaaaccacttacaatgtttcttatcactgagaataagatttggggacgtaaatcatggcctctcaacgaaggaataatggcagtcggaatcgtatctatattactgtcatctctactcaaaaatgatgttcctctagccggccctttgatcgccggaggtatgctgatagcgtgctacgtaataagtggctctagcgcagatctcagcctcgaaaaagcggcagaagtaagctgggaagaagaagcagaacattctggggccagtcacaacatattggtagaagtacaagacgacggaacaatgaaaatcaaagacgaggagagagacgataccataaccatattgttaaaggctacattattggccatcagcggcgtataccctatgtcaataccagcaactttatttgtctggtatttttggcagaaaaagaaacaaagatcaggtgtattgtgggacacgccatcaccaccagaagtagaaagagcagttcttgatgacggaatatatcgaatattgcaacggggactattgggccgctcacaggttggcgtaggagtattccaagaaggagtcttccacacaatgtggcatgtcacccgtggagcagtattaatgtaccagggaaaaagactagagccctcatgggcaagtgtcaagaaagatctcattagttacggaggaggatggagatttcaaggcagttggaacaccggcgaagaggtacaagtgatcgcggtagaaccaggcaaaaaccccaaaaatgttcagaccgcacctgggacgtttaaaacatcggagggtgaagtaggcgcgatagcattagacttcaaacctgggacatctggatcacctatagttaatagagaagggaaaatagtaggactttatggaaatggtgtagtgaccacatccggaacttacgtgtcagcaatagcacaagcaaaagcatcgcaggaagggcctctacccgagatcgaagatgaagtatttagaaaaaggaaccttacaataatggatttacatccgggatctggaaaaactagacgttacctaccagccatcgtaagagaagcaataaaaaggaaattaagaactctagtattagcgccaactagagttgttgcctctgaaatggccgaagcccttaaaggtatgccgataagataccaaactaccgcggtcaaaagcgaacacacgggaaaagaaattgtagacctaatgtgtcatgccacgtttactatgcgactattatctcctgtccgagtccctaattataatatgataatcatggatgaggcacatttcacggatccagcatcaatagcggcaagaggttatataagcacacgagtagggatgggagaggcagcagccatcttcatgacagctaccccacctggatcagttgaggcctttccacaatcaaatgctgtcattcaagatgaagaaaaagatatacctgaaagaagttggaactcagggtacgactggattaccgatttccccggaaaaacagtctggtttgtaccatccattaaaagcggaaatgatatagccaattgtcttagaaagaatggaaagagagtgattcaattaagtcgaaaaacattcgacacagagtaccagaaaactaagaataatgattgggattacgtagttactacggatatatcggagatgggggcaaacttcagggccgacagggtcatagacccaaggagatgccttaaacctgttatactaaaggatggtccagagcgcgtaatattagctggacctatgccagtaacggttgcgtcagcagcccagaggcggggtcgaatcggcaggaatcaaaacaaagaaggagatcagtatatatacatgggtcaacctctcaataatgatgaagatcatgcgcattggacggaagcaaaaatgttattagacaacataaatacacccgaagggataattccggccttatttgaaccagagagagagaaaagtgcagcaatcgatggagaatatagacttagaggggaagcaagaaaaaccttcgttgaattgatgagacgaggggacctaccagtatggctatcctataaagttgcatcggaaggattccagtattccgaccgaaggtggtgttttgacggggagcgcaacaaccaagtcttagaggaaaacatggacgtcgagatttggacgaaggaaggcgagcggaagaaactgcgtcctcgatggctggacgccagaacatattccgaccctcttgcgctgagagaatttaaagaatttgcggccggacggaggtccgtgagtggagacctaattttagaaataggaaaattgccccaacacttaacacaaaaagcacagacggcgctagacaatcttgttatgctccacaatagtgaacaaggtggtaaggcgtatcgtcacgctatggaagaacttccagatacaatagaaacactcatgctccttgcgctcatagcagttttgacaggaggcgttacattattctttctcagtggcaaaggcctaggaaagacaagtatcggactgctgtgtgtcatgtcctcgagcgctttactgtggatggcatcagttgaaccccattggatagcagcgtctataatacttgagttctttttgatggtactgctaataccagaacctgaccgacagagaacaccccaagataatcaattggcatatgttgtaataggattactatttatgattcttactgtcgctgcaaacgaaatgggtctcctagaaactacgaagaaagatctaggcatcggacacgcagcagcagaaaatcatcatcatgcagcaatgttagatgtcgacctccatcctgcgagtgcctggacgctatatgcagttgcaaccacaataataacacctatgatgcgtcatacgatagagaatactacagctaatatttcgctaaccgcaatagcgaatcaagcagcaattctaatgggattagataagggttggcctataagtaaaatggatattggagttcctttgttagcgctaggatgctacagccaagtcaatccgttaacattgacggcggcagtcctcatgctagtggctcactacgcaattataggtccggggctacaggcgaaagctactcgtgaagcccagaaaaggactgctgccggaataatgaaaaatccaactgttgatggaatcgttgctatcgatcttgacccagtagtctatgatgctaagttcgaaaaacaattaggtcaaataatgttactcatcttatgcacttctcagatactcttaatgcggaccacctgggctctttgcgagagtatcaccctggctactggtccattaactacattatgggaagggtcaccgggaaagttctggaacacaactatagcagtatctatggctaacattttcagaggaagctacctagcaggggcaggcctggcatttagtttaatgaaatcattagggggcggaaggcggggaaccggtgcccaaggagagacattaggagagaaatggaagagacagttgaatcagcttagtaaatcagaatttaatacttacaaaagatcggggattatggaagtagatagaagtgaagcaaaggagggtttgaaaaggggagaaacgaccaaacatgcagtaagcagaggtacagcaaaactcaggtggtttgtagaaaggaatttagtaaaaccggaaggtaaagttatagatctgggctgtgggagaggcggatggtcatattactgcgcgggactcaagaaagtcacagaagtaaaaggctatacaaaaggagggcctggacatgaagaaccgatacctatggcgacgtatggatggaatctagtaaaactgcacagcgggaaagacgtattctttattcctccggagaagtgtgatactttattatgcgatataggtgaaagctctcctaacccaacgatagaagaaggtcgcacattacgggtactcaaaatggtagagccctggcttcgcggaaaccagttttgtatcaagatccttaatccttacatgccatcagttgtagaaacattagaacagatgcaacgaaagcatggtggcatgctagtaaggaacccactttcaagaaattcgacgcacgaaatgtattgggtatcttgtggtaccggtaacatcgtcagcgcagtaaatatgacttctagaatgctgcttaatagatttaccatggcgcataggaaaccaacatacgaaagagacgtcgatcttggagctggaacaagacatgtagcagtcgaacccgaagttgcaaaccttgacataataggccagcgaatagagaatataaagaatgagcataagtccacttggcactatgacgaggacaacccttacaaaacttgggcatatcacggttcctacgaagtaagacccagtggaagtgcatcctcaatggtgaatggagttgtacgactcttgacaaaaccatgggacgtaataccaatggttacacaaatagctatgactgatactacgccgttcggacaacaaagagtgttcaaagaaaaagtcgatactcggacccctaaagctaaaaggggtactgcgcagattatggaagttacagcaaaatggttgtggggatttctttcaaggaacaaaaagccacgcatatgtacacgagaagaatttaccagaaaggtaagatcaaacgcagccataggcgcagtatttgtcgatgaaaatcaatggaacagcgccaaagaagcagtagaggacgaacgattttgggatctagtgcacagagaaagggaattgcataaacaaggaaaatgcgcaacatgcgtatacaatatgatgggtaaacgtgagaagaaactgggcgagtttggaaaagccaaagggtcacgtgcaatttggtacatgtggttaggggcaagatttctcgaatttgaagcattaggctttatgaatgaagatcattggttttctcgtgagaactcactatcgggagtggaaggggaaggactacataaactaggatacatcttgagggatatttccaaaataccgggaggaaatatgtacgccgatgatacagccggatgggatactcgcataactgaggatgatctgcaaaatgaagctaaaatcactgatatcatggaacccgaacatgcactattagctacatcaatctttaaactgacctatcagaataaagtggtaagggttcagagaccggctaaaagcggtactgtaatggatgtgataagtcggagagaccaaagaggttcaggacaagttggcacttacggattaaacacttttacgaacatggaagcccaattaataagacaaatggaatcggaaggaattttcagcccaagtgaacttgaaacacccaaccttgctggcagagtattagattggctcgaaaaacatggaatagagagactaaagcgaatggcaatatctggtgatgattgcgttgtaaaaccaatagacgataggttcgcaacggcattaacagctttgaacgatatgggcaaggtaaggaaagacatcccacaatgggaaccgagtaaaggatggaacgattggcaacaagtaccgttttgctcacaccactttcatcaattaattatgaaagacggaagggaaatcgtagttccttgccgatctcaggatgagttggtaggaagggcaagagtatcccagggagcaggatggagtctgagagaaactgcttgtctaggaaaatcatacgctcaaatgtggcaattaatgtacttccatcgaagagatctaaggctcgcggcgaacgcaatatgttcagctgtaccagttgattgggtaccgacaagtcggaccacatggtccattcatgcgcatcatcaatggatgacgactgaagatatgttgtcagtgtggaatagagtttggattgaagagaatccttggatggaagataaaacacacgtatctagctgggaggacgtaccctatcttggaaaaagggaggatcaatggtgtgggtcattaataggactaacggcaagggcgacgtgggcaacgaacatacaggtcgccataaatcaggtaagaaggctaattgggaatgaaaattatcttgactatatgacatctatgaaaaggttcaaaaatgaatccgacccagaaggagccctatggtaa

SEQ ID NO: 21087 - RNA, 9879 nt, synthetic construct
  misc_feature 1..9879: note = derived and/or modified CDS sequence (opt6) from DENV-1__LC016760__SS-prME
  source 1..9879: mol_type = other RNA
agtgtaactatgcttttaatgttaatgccgactgctttagcatttcatcttacaacacgtggaggtgaacctcatatgattgtttctaaacaagaaaggggaaaatcattattatttaaaacgagtgctggggtgaacatgtgcacattaatagcaatggatctgggagaactatgcgaagatactatgacttataaatgccctagaataactgaagctgaaccggatgatgtagattgttggtgcaatgctacagacacatgggtcacttacggaacttgcagtcaaacaggagaacaccgccgggataaacgctcggtagcattagctccacatgtaggactaggactagaaaccagaacagagacttggatgtcatcggaaggagcatggaaacaaatacagagagtagaaacgtgggctttacgacatccgggatttacagtaatagccttgtttcttgcacatgcaataggtactagcatcactcaaaaaggaattattttcatactcctgatgttggttacaccaagcatggccatgaggtgtgtcggaatcggaagtagagattttgtggaaggactatcaggagccacttgggtcgacgttgttctcgaacatggatcctgtgtcacaacaatggcaaaagacaaaccaacattagacatcgagctactaaaaacagaagtaactaacccagccgtcttgaggaaattatgtatagaggcaaaaatttctaacacaacaactgatagtagatgcccaacgcaaggtgaagcaactttggtagaagaacaagacgcaaactttgtatgtagaagaacctttgtagacaggggttggggaaatgggtgcgggctattcggaaagggtagcttgataacctgtgctaaatttaagtgtgtaacaaaattggaaggaaaaatcgtccaatatgaaaacctgaaatactctgtaatagttacagtacacacgggcgatcaacatcaagtaggaaatgagtctaccgaacatggtaccacagccacgataacccctcaagcaccaacaactgaaatacaattaacagattatggcgcgttaacgctggattgtagtcctcgaaccggattagattttaatgaaatggtcctactaacaatgaaagaaaagagctggttagtacataaacaatggtttttggatctaccattaccttggaccagtggggcgtcgacatcccaggagacgtggaataggcaagacttgctagttacttttaagacagcacacgctaagaaacaagaagtcgtggttttaggatcacaagaaggagcaatgcatacagctcttaccggagcgacagaaatacagacatcaggcacaacaacgattttcgcaggtcaccttaaatgtagactcaaaatggataaactcacactaaaaggtatgtcatacgtaatgtgtacgggtagctttaagctagaaaaagaagtagctgaaacacagcacggaacagtcctcgtgcaaatcaaatatgagggaacagatgcaccatgtaagataccatttagtacacaagatgaaaagggtgttacgcagaatggcagattaataactgcaaatcccattgtcacagacaaagaaaaaccggtaaatatcgaggctgaaccgccatttggagaatcttacatagtaataggtgctggtgagaaggcacttaaactttcttggttcaagaaagggagtagcatagggaaaatgtttgaggcaacagcaagaggcgcacgacgaatggctatcctcggtgacactgcatgggacttcggatcaattgggggtgtgttcacgagcgtagggaaattagtacaccagatattcggaacagcgtatggagtccttttctcaggtgtatcgtggactatgaaaataggaatcggtgtactcttaacgtggttgggcctgaactcgcgaagcacatcgttgtctatgacatgtatcgctgtaggtctagttacgttatatttaggcgtaatggttcaagcagactccggctgcgtaataaactggaaaggaagagaattaaaatgcgggagcggcatatttgttaccaacgaagtacatacatggacagaacagtataagttccaggctgattcaccaaaaagactatcagccgccataggtaaggcatgggaggaaggagtatgtggaataaggagtgcgacgagactagaaaatataatgtggaaacagatatctaatgagctgaaccatatactattagaaaatgatatgaaattcaccgtcgttgtaggagatgttgctggaattttggcccaaggtaaaaagatgattcgtccacagccaatggagcataaatacagctggaaatcatggggcaaggctaagattatcggagcagatgtacaaaatacaacttttatcattgatggaccaaatactcccgagtgccccgatgatcaaagagcttggaacatatgggaagtagaagattatggttttggaatattcactacgaacatatggctcaaattaagggattcgtatacacaagtctgtgatcataggctaatgtcggctgcgatcaaagatagcaaagcagttcacgccgacatgggctattggatcgaaagcgagaaaaatgaaacttggaaacttgcgcgggcatcctttattgaggtaaaaacatgtatttggccgaaatcacacactttatggagtaacggagtcctagagtcggaaatgataatcccgaaaatttatggcggaccgatttcacaacataactataggcccggttacttcacccaaactgcggggccttggcatttaggaaaacttgaacttgacttcgacctatgcgagggaacaacagtagtagtggacgaacactgtggaaatagagggccatctcttcgaactaccacagtaactggcaaaataatacatgagtggtgttgtagatcatgtacactaccaccattgcgttatagaggggaggatgggtgttggtacggcatggagattcgaccggtcaaggaaaaagaagaaaatttagtaaagagtatggtttcggccggaagtggcgaagtagactcattttcactaggacttttgtgtatatccattatgattgaagaagtgatgcgatcaagatggtcaagaaaaatgctaatgaccgggaccttagcggtgtttttcctattaattatgggacaactaacatggaatgacttaataagactttgtataatggtaggagcaaatgcatccgatagaatgggcatgggaaccacatacttagctttaatggcgaccttcaaaatgcgaccaatgttcgctgttggactactttttcgccgtttgactagccgagaagttcttttactgacaataggtctgtcccttgtcgcctctgtagaactcccaaatagtttggaagaactaggagacggtttggcaatgggaattatgatcttaaagttactcacagatttccagtcacaccaactatgggcaactcttttgtctctcacattcataaaaacaacattctccctacactacgcttggaaaacaatagctatggtattaagcattgtttctttatttcctctttgtctcagtactacaagtcagaaaactacttggttaccagtgttattgggaagtttaggatgcaagcctttaactatgttcctaatcgccgaaaacaaaatatgggggcgtaaatcatggccactcaatgaagggatcatggcagtaggtatcgtcagcatcttgctttcatccttactcaaaaatgatgtcccgttggcgggacctttaatagctggcggtatgctaatagcatgttacgtgataagtggaagtagtgctgatctatctttagaaaaagcggcagaagtatcatgggaagaagaggcagaacactctggagcctcccataatatccttgtcgaagtccaagatgacgggactatgaaaataaaagacgaggaaagggatgatactttaacaatattattaaaggctactctattggcggtatcgggagtttatccgctctctatcccagcaacactcttcgtatggtatttctggcagaagaagaaacaaagatcaggcgtactttgggatacacctagccctccagaagtggaaagagctgtacttgatgacggaatatatcggataatgcaacgtggtctcttaggaagatcacaggttggagtcggagtgttccaagaaaatgtctttcatactatgtggcacgtaacgaggggagctgttttaatgtatcaaggcaaacgattggagccgtcttgggcatcagtaaagaaagatttgataagttacggaggaggttggcgcctgcaaggtagctggaacaccggggaagaagtgcaagttattgctgtcgaaccaggcaaaaatcccaaaaatgtccaaacagctcctgggacgtttaaaacaccggaaggagaagtaggtgcaatagcactcgattttaaaccaggtacgtcaggatcaccaatagtaaacagagaaggcaaaatagtaggattatacggtaatggcgtagttacaacttccggaacatacgttagcgctattgcgcaagcaaaagcatcacaggaagggcctttgccggagatagaggacgaagttttcaggaaacgaaacctcacgatcatggacttacatcccggctccggaaagacaagaaggtatcttcccgctatagttcgggaagcaataaagcgtaaactcagaaccttaatcctagctcccacgagagtagtagcctccgaaatggcagaggctctaaaaggcatgccgattagatatcagacaacagctgtgaaaagcgagcacacaggcaaagaaatcgtagacctaatgtgccacgcgacatttacgatgaggttgttgtcaccggtgagagtaccgaattataatatgataataatggacgaagcacacttcactgatccatcttccatcgcagctaggggctacatatctactcgtgtcgggatgggagaagctgcagcgatttttatgactgcaacccctcctggatcagttgaggcatttccccaatccaacgcggttatccaagatgaagaaagggacataccggagcgaagttggaactcaggttacgagtggatcacagacttcccgggaaaaacggtatggtttgtcccaagtatcaagtcagggaatgatattgcaaattgcctccgaaagaacggtaaacgagtaatacaactatcccgcaaaacatttgacaccgagtaccagaaaactaaaaacaacgactgggactatgtggtgacaacagatataagcgagatgggcgccaattttcgtgcagaccgagttattgaccctagaagatgccttaagcccgtaattttaaaggatggccctgaaagggttattttagcagggccaatgccagtaacagtagcatcagctgcgcaaaggcgcggaaggataggccgaaatcacaacaaggaaggtgatcagtacatctacatggggcagcccctaaacaatgatgaagaccacgctcactggacagaagctaaaatgttacttgacaatattaatacacctgaggggatcataccagccctctttgaaccagaaagagaaaagagtgcagcgatcgatggggagtataggttacgcggagaggctcgtaaaacttttgtggaactgatgcgtagaggagacctccctgtctggctgtcatacaaggtagcaagcgaagggtttcaatattcagataggaggtggtgctttgatggcgaacgaaacaaccaagttttagaggagaatatggacgtagaaatctggaccaaagaaggcgagcgaaagaaattaaggccacggtggctagatgctaggacatactcggacccactagctctaagagaatttaaagagttcgcagctggaagacgatctgtatcaggtgacttgatcttggaaataggcaaattaccacagcacctcactcaaagggcccaaaatgctcttgataatttagtaatgcttcataatagtgaacaaggtggcagagcatacagacatgccatggaagagttaccagacacaatagaaacattaatgcttttggcattaatcgctgtactaactggaggagtaacattattctttctttcaggaaaaggcttaggaaaaactagcattggcttgttgtgtgtaatggcttcatcagtattgttatggatggcatcggtcgagccacattggattgcagcaagtataatattggagttctttttaatggtattgttaatccctgaaccagacagacaaagaacaccgcaagataatcaactagcgtatgtagttattggattgttatttatgatattaacggtggccgcaaatgaaatgggtttacttgaaaccacgaaaaaggacttaggaatcgggcacgtggcagtagagaatcaccaccacgctgccatgctcgatgtagacctacacccagcaagtgcatggacattatacgctgtcgcgacaacaataattacacccatgatgagacacaccatagaaaatactacagcaaacattagtcttacagccatcgcaaatcaagcggctattctgatgggcctagataaaggttggcccatatcaaaaatggacattggtgtaccccttttagccctcgggtgttactcacaagttaacccgttaacactcacggctgccgtattaatgttagtcgcacattatgcaattataggaccagggttacaagctaaagcaacccgagaagcccagaagcggacagcagcaggaataatgaaaaatcccacggtggacggtatcgtcgctattgatctagatcctgtagtctacgacgcaaaatttgagaaacagctaggacaaataatgttactcatactttgcacatcccaaatcttacttatgaggacaacctgggcactgtgcgaaagtataacattggccacaggaccactcacaactctttgggaaggtagcccaggtaagttctggaatactacaattgcggtaagcatggctaacattttcaggggaagttatctcgccggtgcagggttagcatttagtttaatgaaaagtctaggcggtgggcgaaggggtaccggcgcacaaggcgaaactttaggagaaaaatggaagagacagctgaatcaactatctaaatctgagtttaatacttacaagcgtagcggaatcatggaggtagacaggagcgaggccaaagaaggtcttaaacggggagagacaacgaaacatgctgtatctcgaggaacagcaaaattgcggtggttcgttgaacgaaatctagttaagccagaaggaaaagtgatagatctcggatgcggacgtggaggatggagctattattgtgctggcctaaagaaagtgacagaggttaaaggctacacaaaaggtggcccaggtcacgaagaaccagtcccaatggcgacatatgggtggaatttggtaaaattacactccgggaaggacgttttctttattccacctgaaaaatgcgatactcttctatgcgatatcggagaatcttccccaaacccgacaattgaggagggcagaactctgagagtcttaaaaatggtagaaccatggctacgcggaaatcagttttgtattaagatcttaaatccatatatgccttctgtagtcgaaactctagaacaaatgcaaagaaaacacggaggaatgctggtacgtaaccccctctctcgaaacagcactcacgaaatgtattgggtatcatgtggtactggaaacatcgtgagtgctataaatatgacaagcagaatgctacttaaccgattcacgatggcccatagaaaacctacttatgaaagagatgtagacctaggtgcgggaacccgacatgtcgctgtagaacctgaggtagctaatctagacattataggtcaaagaatagaaaacataaaatgtgaacataaatctacatggcattacgacgaggataatccttataaaacatgggcttatcatggaagctacgaagtcaaacccagtggttcagcctctagtatggttaatggagtagtaaaactactgactaaaccctgggatgttatacccatggtaacacagatagcgatgacggatactacacctttcgggcaacaaagagtatttaaagaaaaagtggacacacggacacctaaagcaaaacgcggtacggctcagattatggaagtaaccgccagatggttatggggattcttatcgagaaacaagaaaccgaggatctgtacgagagaagaatttacgaggaaagtaagatctaacgccgctatcggcgcagtttttgtggacgaaaaccaatggaactcagcaaaagaagctgtagaggacgaacgtttctgggatctagtacatagagaaagagaattgcacaaacaaggaaaatgcgcaacctgtgtttacaacatgatgggaaagagggaaaagaagctaggagagttcggcaaggcaaagggcagtagagccatttggtacatgtggcttggggctcgcttcttagagttcgaggcgttaggatttatgaatgaggaccattggtttagcagagaaaattccttatcaggagtagagggtgaaggacttcataaactaggctatattcttagggacatatcgaaaattagtggaggaaacatgtatgcagacgatactgcaggctgggacacgagaatcacagaagacgatctgcaaaatgaggcaaaaataacagaaatcatggagccggaacacgctcagttggcaaaagcaattttcaaacttacatatcaaaacaaagtcgtaagggtacaacggccagccaaaaatggcacagtaatggacgtaatatcaagacgcgatcaaaggggatcgggccaagtcggaacgtatggtttaaatacatttacaaacatggaagctcaattaatcaggcaaatggaaagcgaaggaatatttagtccttctgaattagaaaccccgaatttagcagaacgtgtcttagattggctagagaaatacggagtcgaaagattaaaaagaatggcgattagtggggacgattgcgttgtaaaaccaattgacgatcgatttgctacagctttgacagccctaaacgacatgggaaaagtccgtaaagatattcctcaatgggaaccaagtaagggctggaacgattggcaacaagttcccttctgtagtcaccacttccaccaattgataatgaaagacggacgtgaaatagtagtaccatgcagaaaccaagacgaacttgttggtcgagccagagtgtcacagggagcaggatggtcattgcgcgaaacggcatgtcttgggaaaagctatgcgcaaatgtggcagctgatgtactttcatagaagggacctcaggctggctgctaacgctatatgttcggctgtacctgtagactgggtgcccacaagccggactacgtggagtatccatgcgcaccatcaatggatgaccaccgaagacatgctatctgtatggaacagagtctggatcgaagaaaatccatggatgaaagataagacacacatcagttcttgggaagatgtaccttatttaggaaaaagagaagaccaatggtgcggatcactcataggactaacggctcgagcaacttgggcaactaatattcaagtagccataaaccaggtccgccggctgattggaaatgaaaattatctagactatatgacatccatgaaaagattcaaaaatgaatcagatcctgaaggcgcattatggtag

SEQ ID NO: 21088 - RNA, 9879 nt, synthetic construct
  misc_feature 1..9879: note = derived and/or modified CDS sequence (opt6) from DENV-1__LC128301__SS-prME
  source 1..9879: mol_type = other RNA
agtgtaacaatgcttttaatgctactacctacagctttagcgttccatttgacaacacggggaggtgaaccgcatatgatagtttcaaaacaagaacgaggtaaaagtcttttatttaaaacgtcggcaggggttaatatgtgtacattgatagcaatggacttgggggaattatgtgaagatacgatgacatacaaatgtcctagaataacggaaacagaacccgatgatgtagactgttggtgtaatgccacggaaacttgggtaacttacggaacatgttcacaaacaggtgaacatagacgcgataaacgcagcgtagctctggctcctcatgtaggattgggattagaaacaagaactgaaacatggatgagctcagaaggagcatggagacagatacagaaagttgaaacgtgggcattaagacatccgggctttacggtaatagcgttattcctcgcgcacgcgattggtactagcatcactcagaaaggcataatattcatattactaatgttggtaacccctagtatggctatgagatgcgtgggaatagggaatagagatttcgtggaaggcttgagtggtgctacatgggttgatgtagttctagaacacggcagttgcgtaactaccatggcaaaagataaacctacactagatattgaactattaaaaactgaagtcacaaacccagcagttctcagaaaattatgcattgaagctaaaatatctaatacaacaacagattctagatgcccgacgcagggcgaagcaactttagtcgaggagcaagacacaaattttgtgtgccgaagaacgtttgtggacagaggatggggaaacggttgcggtttattcggcaaaggctcactgataacttgcgctaaattcaaatgtgtaactaaacttgaaggtaaaattgtacagtatgaaaatctaaaatacagtgttattgtaacggtccatacaggtgatcaacaccaagtcggaaatgaaacaacagaacacggaacgactgcgacaatcactccacaagcaccgacgtcggaaattcaacttacagattatggagcacttacattagattgttcacctcggacaggactcgacttcaatgaaatggttctattaacgatgaaagaaaaatcatggttagtgcataaacaatggtttttagaccttcccctcccgtggacatccggtgcctcgacctcgcaagaaacctggaataggcaagatctcctggtgaccttcaaaaccgctcacgccaagaaacaagaggtggttgtcttaggatctcaagaaggggctatgcacacagctttgacaggtgccaccgagattcaaacttcaggcacaactactatttttgcagggcacttgaagtgccgattaaaaatggacaagttgacactcaaaggagtttcatatgtgatgtgtactggttcatttaaactagaaaaagaagttgccgaaactcaacacggtactgtattagttcaagtaaagtacgaaggtacagatgcaccttgtaaaatccccttctcatctcaagacgagaaaggggtaacacaaaatggacggttgatcacggccaacccaattgtcactgacaaagagaagccagttaatatagaagccgagccaccatttggtgaaagttacctagtagttggagccggtgaaaaggctctgaaacttagttggtttaagaaaggatcgagcatcgggaaaatgttcgaagcaaccgcaagaggtgccagaaggatggcaattttgggagatacagcttgggatttcggttccataggcggtgtatttacctcagtgggtaaattaattcaccagatttttggtacggcatatggagttctcttttcaggagtgagttggactatgaaaattggaataggcattctattaacgtggctaggcctgaatagcagaagcaccagtttaagtatgacatgtatagcagttggtatggtcaccctttatttgggagtaatggtacaggctgattcagggtgtgtaataaattggaaaggcagagaattaaaatgtggctcgggtatatttgtcacaaacgaagttcatacgtggacagagcaatacaaatttcaagcagattcgcctaagcgtctctcagccgcaattggaaaggcctgggaagagggagtgtgcggaataagaagcgcgaccagattagaaaatataatgtggaaacaaatatccaatgaacttaatcacatattgctcgaaaacgatatgaaatttaccgtagtagtgggggatgtaaacggtatattagcacaaggtaagaaaatgattcgaccccaaccaatggagcataaatattcgtggaaaagctggggtaaggcaaaagttataggtgctgatgtgcagaatacaaccttcataatcgacggccctaacactcctgaatgtcctgatgatcaacgagcctggaatatatgggaggtcgaagactacggatttgggatatttacgacaaacatctggcttaaattgagagatagttatacgcaagtatgtgatcaccgcctaatgagtgccgcgataaaagacagcaaggccgtacacgcagacatgggatattggatagaatcagaaaagaatgaaacgtggaaattaacaagagcctcattcatagaagtaaaaacatgcatttggccgaaatctcatactttatggtcaaatggtgtattggaatctgagatgataatacctaaaacgtatggtggcccaatctcccaacataattatcgtcccggctattttactcaaacagccgggccctggcatttgggtaagctcgagttagacttcggactctgcgaaggtactacagtggtcgtagatgaacattgcggaaacagaggaccatcgttacgaaccaccaccgttaccggcaaaataatacacgaatggtgttgccgaagttgcaccttgccgccgctgcgattcaaaggagaggacggatgttggtacggtatggaaattcggccagttaaagaaaaagaagaaaacctcgttagatccatggtgtccgccggatcgggcgaagtggatagcttttcactcggattactatgtatatccatcatgatagaggaggtaatgcgatcaaggtggagcagaaagatgttaatgacgggaacgttagccgtgtttttattgctaataatgggtcaattaacatggaacgatttaattcgactgtgcataatggtaggggcgaatgcgagtgacaaaatgggaatggggaccacctatttagctctaatggcaactttcaggatgagaccgatgttcgctgtaggattactatttaggagattgacaagtagggaagttcttcttctaacggtggggttatcactcgtagcatccgtagaattacccaattcactagaagaactcggtgacgggttggctatgggaattatgatgctaaaacttttgacagactttcaatcacatcagttatgggcagccttattaagtttgaccttcgtaaaaacaacattcagtcttcattacgcgtggaaaacaatggctatgatattatctattatttcgctatttccactatgtatgtcaacaacgtcccaaaagaccacttggctgcctgtgctgttaggttcattaggatgcaagccactgactatgttcttgattacagagaataaaatatggggaagaaagtcctggccattaaatgaaggtattatggccgttggtatagtatcgattctactttcttcattactcaaaaacgatgtcccacttgccggcccactgattgcaggaggaatgttaatcgcatgctatgtcataagcggttcgtcagcagatttatcattggaaaaagcagccgaagtctcttgggaagaagaagcagaacattcaggagcgagccataacatcctagtggaggtgcaagatgacggaacaatgaaaattaaagatgaagaacgcgatgatacattgacgatcttattaaaagcgacgctgcttgcaatatctggcgtatacccgatgtccatacctgcaacgctatttgtctggtatttttggcaaaagaagaaacaacgatcaggcgtattgtgggacacaccaagtcctccagaagtggaaagagccgtattggacgacggaatatatagaattttacagcgtggattactaggaaaatcccaggtgggagtgggagtatttcaagaaggcgtcttccatacaatgtggcacgttactcgcggtgcggtactaatgtaccaaggaaaaagactcgaaccaagttgggcttcagtcaagaaagatctgatatcatacggaggaggatggcgtttccaaggctcttggaatactggtgaagaagtacaagtaatagcagtagaacctggcaagaatccaaagaacgtacagacagcgcccggcaccttcaagaccccagagggcgaggtaggtgcaatagcccttgactttaaaccgggcacgagcggaagccccattgttaatcgggagggaaaaatcgtgggactatatggaaatggcgtcgttacgacatcgggaacatatgtctctgcgatagctcaagctaaggcttcccaagagggtccgctccccgaaatagaggatgaggtctttagaaagcgaaatttaactattatggacttacatcccggatcgggaaaaacacggcgatacttaccagcaatagtgcgagaggcgattaaacgtaagttgcgaacgctggtgctcgccccaactcgagtagtggcctcagaaatggcagaagctctgaaaggcatgcccataagataccaaacaactgcagttaagagtgaacatacagggaaggaaattgtagacttaatgtgccatgcaacattcacaatgaggctattatcccctgtgcgcgtgccaaattataacatgataatcatggacgaagcccattttacagatcccgcttcaatcgcagcgcgaggatacatatcaaccagagtcgggatgggagaagccgcagcaatatttatgactgcaaccccacctgggtcaatggaggcttttccacagtccaatgcagcaatacaagatgaagaacgagatattccagagcgctcctggaatagcggatatgattggatcactgattttcccgggaaaacagtctggtttgtcccttcaatcaaatcgggaaatgatatagcaaactgcttaaggaagaatgggaaacgagtagtacaactgagccgaaagacatttgatacagaatatcaaaagaccaaaaataatgactgggattatgtagtgacgacagatatcagtgaaatgggcgctaactttagagcagaccgagtaattgacccgagaaggtgcttaaaaccagttatattgaaagacggaccagaaagagtgatcctggcgggacctatgcctgtaactgtagcatcagctgcacaacggagagggagaattggacgtaaccagaacaaggagggtgaccagtacatttatatgggccagccattaaacaacgatgaagatcacgcacactggacagaagctaagatgttgttagataatatcaatacacctgaaggaataatacctgctcttttcgaacctgagcgagagaaaagtgcagcaatagacggggaatatagactacgtggtgaagccagaaaaacattcgttgagttaatgagaagaggagatctacctgtgtggctatcctacaaggtagcctcagaagggtttcaatactcagacaggagatggtgttttgatggagaaaggaacaatcaagttctagaagaaaatatggacgttgaaatctggacgaaagaaggagaacgcaagaaattgcgacccaggtggcttgatgcacgaacatattcagatccgctagcgttgcgggaatttaaagaatttgcagccggaaggcgatcggtatcgggggatttgatattagaaataggcaaacttccccagcacctgacgcagcgcgcacaaaatgcattagataatttggtgatgctccataattcagagcaaggaggcaaggcttaccgtcatgcaatggaagaactccccgatacaattgagactctaatgttactagcacttattgccgttttaacgggaggtgtgacattgtttttcctgagtgggcgtggtttaggaaaaacctcaataggtttactctgtgtgatggcatcaagcgcgttactgtggatggcatcggtagaaccacattggattgcagctagcataattttggagttctttttaatggtactattaattccggaaccagatcgacaaagaacaccacaagataaccaattagcatatgtggtaatagggctgttatttatgatacttactgtcgcggcgaacgaaatgggtctcttagaaacaacaaagaaagatttaggaattggacacgtcgcggcagagtcccatcaccacgcagcgatgcttgatgtagacctacacccagcatctgcatggacgttatacgcagtggccactacaataataacgccaatgatgcggcatacaatagaaaacacaactgcaaatataagcctaactgctatagctaatcaagccgcgattttaatggggctagacaaaggctggccgattagcaaaatggacataggtgtgcctctactagctttgggttgctattctcaagttaacccacttacattaactgccgctgtattgatgcttgtcgcacattacgctatcataggccctggtcttcaagcaaaagctacccgggaagcacaaaagcgaacggctgccggaataatgaaaaatcctacagtagatggcatagttgctatagatctagacccagtagtatatgatgctaagtttgaaaaacagttagggcaaatcatgctactgatcctttgcacaagccaaatacttcttatgaggactacttgggcactttgtgaatcgatcacactagcaactggaccacttacaactttatgggaagggagtccgggtaaattttggaatacaacgatagcagtttcaatggctaacatctttcgaggctcatatttggctggagcagggcttgcattttctttaatgaaatcacttggcggaggcaggagaggcacaggagctcagggggaaactctaggtgaaaaatggaaacgtcaacttaaccagttaagcaagagtgaatttaacacttataaaaggtcgggaatcatggaagtggaccgatctgaggcgaaggaaggtttgaaacgaggggaaacgaccaaacatgcagtcagtcgaggtacagcaaagctacgctggttcgtagaaagaaaccttgtaaagcctgagggaaaagttatagacttggggtgcggtcgcggaggttggagttattactgtgctggactcaagaaagttacggaagtcaagggctatacgaaaggaggtcctggacacgaagaacccatcccaatggcgacctacggatggaacttagtgaaactatattccgggaaagatgtgttctttacccctcctgaaaaatgcgatacactcttgtgcgatatcggcgaatcatcaccaaacccgacgatcgaagaaggaagaacccttcgagtactcaagatggttgaaccatggttgaggggaaaccagttctgcatcaaagtactcaatccttatatgccttccgttgtagaaacgctagaacaaatgcagagaaaacacgggggaatgttagttagaaacccgttaagtagaaattcaacacatgaaatgtattgggtaagttgcggcacgggaaacatagtctcggccgtaaatatgacaagtcgaatgttattaaatcggtttactatgacacatagaaagcccacatacgagaaagatgtggatctgggggcaggtaccaggcatgttgccgtcgaaccagaagtagcgaatttggatataataggtcaaagaatagagaatatcaaaaatgaacacaaaagcacctggcattacgatgaagataatccatataaaacatgggcttatcacggtagctatgaagtcaaaccatcgggaagtgcgtctagtatggtaaacggcgtagtaaggctactcactaaaccatgggacgtcattccaatggttacacaaatagcaatgactgatacaaccccgtttggtcaacaaagagtgtttaaagagaaagtcgatacccgtacacctaaggctaaaagaggaacagctcagattatggaagttactgcacgatggctatggggatttctatctcgaaataagaaacctcgtatatgcactagagaagaatttacaagaaaagtacggtcaaatgcagcaatcggagcagtttttgtagacgaaaatcagtggaactcagcaaaagaggccgtggaggacgaacgattttgggatctagtccatagagaacgcgaactgcacaaacaggggaagtgtgcaacctgcgtttataatatgatggggaaacgagaaaagaaactaggagaatttgggaaggccaaaggttctagagcaatttggtacatgtggttaggagcaagattcttagagttcgaagctctaggattcatgaatgaggaccattggttctctagggaaaattcactatcaggagttgaaggagaaggcctacacaaattaggttatatacttagggatatttctaaaattccaggcgggaacatgtacgcagacgatacggctggttgggacactcgtatcacggaagatgatctgcaaaatgaagcaaaaataaccgacataatggaacccgaacatgctctactagcaacttctatattcaaattaacataccagaataaagtagtgagagttcaaaggcctgcgaagaacggaactgtcatggatgtaatctcaagaagggatcaacgagggagcggtcaagtaggaacatatggtctaaatactttcactaatatggaagcgcaactaatacgacaaatggaatctgagggcattttccttccgtcagaactagaaacaccaaacttagccgaacgggtgctcgactggctagaaaaacacggcactgagcgattaaagaggatggcaatctcaggcgatgattgtgttgtaaaaccaattgacgacagatttgccacagcattaacggccctaaacgatatgggaaaggtacggaaagatatccctcaatgggaaccgtcaaaaggatggaatgattggcagcaagtcccgttttgctctcatcactttcatcaattaataatgaaagatggaagagaaattgtggtcccatgtagaaaccaagacgagctagtgggccgcgcaagagtatcacagggagctggatggagtttgcgagaaactgcttgtctaggcaagtcttatgcccaaatgtggcaactcatgtacttccacaggcgggaccttcgattagcggccaacgcaatatgcagcgcagtgccagtggattgggtacccacctcaagaaccacatggagtattcatgctcaccaccaatggatgacaacagaagacatgctatccgtttggaatagggtatggattgaagaaaacccatggatggaagataaaacgcatgtctcttcctgggaagacgtgccttatttagggaaacgagaagaccaatggtgtggctcgcttataggattaacagctagagccacctgggcaacaaacattcaagtggccatcaatcaggtacgaagacttataggtaatgaaaactatcttgattatatgacatccatgaagagatttaaaaacgaaagcgatcctgagggagcactctggtag

SEQ ID NO: 21089 - RNA, 9879 nt, synthetic construct
  misc_feature 1..9879: note = derived and/or modified CDS sequence (opt6) from DENV-1__LC011945__SS-prME
  source 1..9879: mol_type = other RNA
tcagtaactatgttactaatgttaatgccaactgcattagcgtttcacttaactactcgaggaggggaaccgcatatgatagtgagtaaacaagaaaggggcaaatctttattatttaaaacctcagctggcgtaaatatgtgcactctaatagcaatggacctaggtgaattatgcgaagacacaatgacgtataaatgtcctagaatcacggaggcagaacccgatgatgtagactgttggtgcaatgcgacagacacctgggtaacttacggtacgtgtagtcaaacaggagagcacaggagagataagaggtctgtggccttggcgcctcacgttggcttgggcctggaaacgcgtacggagacttggatgtcctctgaaggagcatggaagcaaattcaaagagtcgaaacatgggcgctaaggcatccaggattcaccgttatagcactatttctggctcatgctattgggactagcataacacaaaaaggaatcatttttattttactaatgttggttacaccctcaatggcaatgcgttgtgtaggaatcggaagcagagattttgttgaggggttatctggagcaacttgggtggatgttgtgttggaacatgggtcatgcgtcacgaccatggcgaaagataaaccgacactcgacatagagctgcttaaaacagaagtaacaaatcccgctgtattgaggaaactttgtatagaagcaaaaataagtaatacaactactgattcacgatgccctactcaaggcgaggcaaccttagttgaagaacaagatgctaatttcgtctgccgaagaacatttgttgaccgtggatggggaaatggatgtggcctttttggcaaaggatccttaataacatgcgctaagttcaaatgtgtgaccaagctagaaggtaaaatagtccagtacgaaaatttaaagtatagtgtaatagtgacagtacatactggcgatcaacaccaggttgggaatgaaagtacagaacatggaactactgctacaatcacaccacaggcacctacaaccgaaatacagcttactgattatggtgcgcttaccctggattgctctcctagaacgggtctcgatttcaatgaaatggtactacttactatgaaggagaaaagctggctcgtgcataaacaatggtttctagacttacctctgccatggacaagtggtgcgagcacgtcgcaagaaacgtggaaccgccaggatctccttgtcacttttaaaactgctcacgccaagaagcaagaagtcgttgtcctaggatcacaagagggagccatgcacactgcattgacaggcgctacagaaattcagacaagtggaacgacaactatattcgctgggcatctaaaatgtcgcttgaaaatggataaacttacattaaagggtatgagttacgttatgtgcaccggttcatttaagttagagaaagaagtcgctgagacacagcatggtacagtgttggtacaaataaaatatgaaggaacggacgctccttgcaaaatccccttttcgactcaggacgaaaaaggggtaactcaaaatggacgtctcatcaccgccaatcccatagttacagataaagagaaacccgttaatatcgaagcggaaccaccatttggtgaaagctatatcgtgataggtgccggagaaaaagctctaaaactcagctggtttaagaagggctcatcaataggaaaaatgttcgaagcgacggcaagaggagctcgaagaatggcaatacttggtgacactgcatgggatttcggtagtatcggcggtgtgttcacttccgtaggaaagttggttcaccaaatatttggcaccgcatatggagttttattctcaggtgtttcatggacgatgaagattggtatcggagtattacttacatggttaggattgaatagtcgtagcacttcactaagtatgacatgcattgcggttggtctagttacactatatttgggtgttatggtacaagcagacagcggatgcgtaataaattggaaaggccgagaattgaaatgtggtagtggtatcttcgtaactaacgaagtccatacatggactgagcaatataaatttcaggctgattcaccaaaacgactatccgccgcgattggaaaggcgtgggaggaaggagtctgtggaattaggtcggctactagattagaaaacatcatgtggaagcaaatttcaaacgaattaaaccatattttgctggaaaatgatatgaaatttactgtcgttgtgggggacgttgcaggaatactagcacaaggcaagaaaatgatacggccacaaccgatggagcataaatactcttggaaaagctggggtaaagcaaaaataattggcgcagacgttcaaaatacaactttcataatagatggaccaaatactcccgaatgtcctgatgaccaaagagcgtggaatatatgggaagttgaggattatgggttcggcatttttacaacaaatatatggctgaaactaagagattcatacacccaggtgtgtgatcacaggttaatgtcggctgctatcaaagactctaaagcagtccacgcagatatgggatactggatcgagtcagagaaaaatgaaacgtggaaattagcccgagcgtcctttatagaagttaaaacgtgtatctggcctaaatcgcatactctgtggtctaacggagtcttggaatctgaaatgatcataccaaaaatatacggaggcccgatatcgcaacataattacagaccaggatatttcactcaaactgctggaccctggcacctagggaaattagagttagattttgatttatgcgaaggaacaaccgttgtagtagacgagcattgtggcaaccgtggaccaagtttacgcacaacgaccgtcacgggaaaaattatacacgagtggtgttgcaggagctgtactctgcctccattaagatacaggggagaagacggatgttggtacggaatggagattagacctgtaaaagagaaagaggagaatttagtgaaaagcatggtcagcgcaggaagtggagaagttgattctttcagtttgggtttgctatgtatatcaataatgatagaggaggtcatgagatctcgatggtcacgaaagatgttgatgactggtaccttagcggttttctttctgcttatcatgggacaacttacgtggaatgacctaattagattgtgcattatggttggagcaaacgcctcggaccgaatggggatgggaaccacatacttggccctcatggcaacgttcaaaatgaggcctatgttcgctgtaggcctattatttcgacgactcacctcaagagaagtccttctattgaccatcgggctaagccttgtggcgtccgtagagttgccgaatagtctagaagaattaggtgacggacttgcaatgggaatcatgattctaaaactattgactgatttccaatcacatcaactatgggcaactctcttgagccttacgtttataaagaccacattctccttgcattacgcgtggaaaacaatcgctatggttctttccatagtatcactgtttcccttatgtttatccactacttctcagaaaacgacgtggctccccgttcttctaggaagcctgggatgcaaacccttaacaatgtttctaatagcagagaacaaaatctggggaagaaaatcatggcccctaaatgagggtataatggcagtagggatagtttcaatcctattgtcatccttgcttaagaacgacgttccattagctggacctctaatcgcgggagggatgttaatagcttgttatgttatttcgggcagctcagcggatttaagccttgaaaaagcagcagaagttagttgggaagaggaggcagagcattcaggggcatctcacaatattttagtcgaagttcaggatgatggaacaatgaaaatcaaagatgaagaaagagacgatacacttactatattactaaaagcaacacttctagcagtttctggtgtatatccactctcaatccctgccaccttgttcgtttggtatttttggcagaagaagaaacaaagatcaggtgttctgtgggatactccgagcccgcctgaagtagaaagagcagtactagatgatgggatttatcgcattatgcagagaggtttactcggcagatcacaagtcggagtcggggtatttcaggagaacgtttttcatacaatgtggcatgtgacgagaggtgcagtacttatgtatcaagggaaaagactggaaccgagttgggcgtcggtaaagaaagacttaatcagttacggagggggatggagattacaaggttcatggaataccggagaagaagtacaagtaatcgctgtagagccaggtaaaaaccctaaaaatgtacaaactgcccctggaacttttaaaacacccgaaggagaggtcggcgcaattgcactagattttaaaccaggtacaagcggctcaccaatcgtaaatagagaaggaaaaatcgttggattatatggaaacggtgtggttactacgtcaggcacatatgtttctgcgatcgcccaagcaaaggctagccaagaaggacctcttccagagatagaagacgaagtatttagaaagagaaatcttacaataatggatttacatcctggttctggaaagactagacgttacttacccgcaattgttagggaagccatcaaacgaaaattacgtactttaatactggcaccgactagagtcgtcgcatctgaaatggccgaagccctcaaaggcatgccgatcagatatcagactacggcagttaaaagtgaacatacaggcaaagaaattgtcgatctaatgtgccacgcgacattcacgatgcgtctcctaagtccagtccgggttcccaattacaatatgataatcatggacgaggcgcatttcaccgatccatcaagcattgctgctcgtggctacatctccaccagagtgggtatgggagaggctgctgcaattttcatgacagcaactccaccgggttccgtggaagcatttccacaatcaaatgcagtaattcaagacgaggaaagggacattccggaaagaagctggaatagcggatatgaatggatcacagattttccgggtaagaccgtgtggttcgtgccctccataaaatcaggcaacgatatagcgaattgcttacgtaagaatggcaaacgtgttatacaattaagccgcaagactttcgacacagaatatcagaaaaccaagaataatgactgggattatgtggttactacagacatctcggagatgggtgccaatttccgagctgaccgtgtaatagatccaaggagatgcttaaagccagtaatcttaaaagatggatcggaaagagtcattttagcgggtccgatgccagttaccgtagcgagcgcagcgcagagaagaggaagaattgggcgaaatcataacaaagaaggagatcaatacatatatatgggtcaaccattaaacaatgacgaagaccatgcccactggactgaagccaaaatgctattagataacataaatacgccagaaggcattattcctgcattgtttgaaccagaaagagagaaaagtgctgctatcgatggtgaatatcggttacggggcgaagcacgaaaaacctttgtggagcttatgagaaggggagacctcccggtatggttgtcatacaaggttgcttcagaaggtttccaatatagcgatagaagatggtgctttgatggtgaacgaaataaccaggtattagaggaaaacatggatgtcgaaatttggacaaaagaaggggaacgaaagaaacttaggcccaggtggttggatgcaagaacctactccgatcctctggcactgcgggaatttaaagaatttgcggcaggtcgcagatcggtatcgggcgatttgatacttgaaatcgggaaacttccccaacatttgactcaacgcgctcaaaacgctctggataacctggttatgttacataattcagaacaaggcggtagagcgtaccgtcacgcgatggaagaattgccagacacaatcgaaactctgatgcttttggcgctgatagctgttttaaccggaggtgtaactctatttttcttaagtggcaaaggattggggaaaacatcaatcggtctattatgtgtgatggcatccagtgtactgctttggatggcatctgtagagcctcactggatagctgcgagtattatacttgagttctttttgatggtcttattaataccggaacctgatagacaacgcacacctcaagacaaccagctcgcgtatgtagttataggactcttattcatgatattaacggtagcagcgaatgaaatgggattattagaaacaactaaaaaggatctaggtataggacatgttgctgtggagaatcaccatcatgctgctatgctggatgtagatttacatcccgcttctgcatggacgctatatgctgtcgctacgaccataataacacccatgatgcgacataccattgaaaacacaacagcgaatatttctttaacagcaatagcaaatcaagcagctatactaatggggttagataagggatggccgatatcaaaaatggacataggtgttccattactcgcattgggctgttattcacaagtcaacccacttactttgacagcggcggtactaatgttagttgcgcattatgcaataatcggacccggattacaagcaaaagcaacgcgtgaggcccagaaacgaacagcggctgggattatgaaaaatcctacggtcgatgggatagtagctatagaccttgatccagttgtgtatgatgctaaattcgagaaacagttaggacaaattatgttattaatactttgcaccagccaaatactactaatgagaacaacttgggcattatgcgaatccattaccctcgcaacgggtcctttaacaactctatgggaaggcagccctggtaaattttggaatacgacgattgctgtatcaatggctaatatatttcgcggctcttatttagcaggagcagggttggcattttcattgatgaagagtttaggtggtggaagacggggtactggcgcgcaaggtgaaacacttggagaaaaatggaagcggcaactaaaccagttatcaaagtcagaatttaatacgtataaaagaagtggcatcatggaagtagatcgaagcgaagccaaagaaggtttgaaaagaggagaaactacaaaacatgcagtaagccgtggcacagccaaattaagatggtttgtggagagaaaccttgtaaaacctgaaggaaaggtaatcgatttgggctgcgggagaggaggttggtcatactattgtgccggcctcaaaaaggtaacagaagtaaaaggttatacaaaagggggcccaggacatgaggaacctgtaccaatggcgacgtacggatggaatcttgttaaattacatagtgggaaagacgtattctttataccaccagaaaagtgtgacacattactgtgtgacattggggagagttcaccgaacccgacgatagaggaaggacgaacattaagggtactcaagatggtggaaccatggttgagagggaaccagttctgtataaaaatcttaaatccatacatgccaagcgttgtggaaacacttgaacaaatgcaacgtaaacatggcgggatgctagtccgtaatccactcagcagaaattcgacgcatgaaatgtattgggtatcttgcggaacaggtaatatagtaagcgcaattaacatgacctcacgaatgctcttaaaccgatttacaatggcgcatagaaagccaacgtacgaaagggatgtagatttaggtgcaggaacgagacatgtagcagtagagcccgaagtggcaaacctggatataataggacaacgcatcgaaaacattaaatgcgagcacaaatcaacgtggcactatgatgaggacaatccttacaaaacctgggcctatcatggatcttatgaggtgaaaccaagcggatcggccagctctatggtcaatggggtagtgaaactactcacaaaaccgtgggatgtaatccctatggtaacacagattgctatgaccgacacaacgccgttcggtcaacaacgggtatttaaagagaaagttgatacccgcacaccaaaagccaaaagaggaacagcacaaataatggaagttactgcaaggtggttatgggggtttctttctcgtaacaagaaaccacggatttgcacaagagaagagtttactagaaaggtaagatcaaacgccgcaataggcgctgttttcgtcgatgaaaaccaatggaactctgcaaaagaagcagtagaagacgaacgtttttgggatttggttcatcgggaaagagagctacataagcaagggaagtgcgccacttgtgtttacaacatgatgggtaaaagagagaaaaagttaggcgaatttggcaaagcaaaaggtagtcgcgccatatggtacatgtggttaggagctagatttctagagttcgaagcgttgggtttcatgaatgaagatcactggttcagtcgagaaaattcactaagcggggtagaaggcgaaggcttacataaactaggttatatattacgagacataagcaaaatttcgggtggaaatatgtatgctgacgatacagctgggtgggacacgaggataactgaggatgatctacaaaacgaagcaaaaattacagagataatggaaccagaacatgcgcaacttgctaaagcaatttttaaacttacctatcagaacaaagtggtgagagtacaacgacctgcgaagaacggaaccgtaatggatgttatttctcgaagggatcaacgtggctcgggtcaagtcggaacatatggacttaacacgtttactaatatggaggcgcaactcatcaggcaaatggaatctgaaggaatattctcccctagcgaactcgaaacacccaatctagcggaaagagtgttagattggttagagaagtacggcgtcgaacgacttaaacgaatggcaatatcgggcgacgattgcgtggtaaaacccatagatgatcgctttgcaaccgcccttaccgcattgaatgacatgggaaaagtcagaaaagatatacctcaatgggaaccgtcaaaaggatggaacgactggcaacaagtaccattctgcagccatcactttcatcaattaataatgaaggatggcagagaaattgtagtaccctgccgaaatcaagacgaattagtaggacgagctcgagttagtcagggagctggatggagccttcgcgaaacagcttgcctagggaaatcttacgcacaaatgtggcaattgatgtattttcacaggagggaccttaggctagctgccaacgcaatttgttcagcagtcccggtcgactgggtcccaacaagtagaacgacgtggtcaatacatgcacatcaccaatggatgaccacagaagacatgttatcggtctggaaccgggtatggattgaggagaacccctggatgaaagataaaacacacatatcatcatgggaagatgtcccatatcttggaaaaagggaggatcaatggtgtggttcactaataggactaactgctagagccacatgggctactaatatacaagtagccataaatcaagtacgcaggttaatcggtaacgaaaactatcttgattacatgacatccatgaaacgattcaagaatgaatcagacccggaaggagccttatggtaa

SEQ ID NO: 21090 - RNA, 9879 nt, synthetic construct
  misc_feature 1..9879: note = derived and/or modified CDS sequence (opt6) from DENV-1__LC011949__SS-prME
  source 1..9879: mol_type = other RNA
tcagtgactatgctgttaatgcttgtacccactgcccttgcgtttcatcttacaactagaggaggggaaccgcatatgatagtttcaaaacaagaacggggaaagagcttgttatttaaaacatccgcaggagtcaatatgtgcactctcattgctatggatcttggagagttgtgcgaagacactatgacatataagtgtcccaggatcacggaagctgaaccagatgacgtggactgctggtgtaatgccacagacacttgggttacatacggtacatgcagtcaaacaggagaacacagacgcgataagagatcagtagctctagctcctcatgtggggttaggtctagaaactagaacagaaacatggatgtcatctgagggagcatggaaacaaatacaaagagtcgaaacttgggcgctacgccatccaggatttacagtgatagcgctatttcttgcacatgctattggaacaagtattacccaaaaaggaataatttttatattgctcatgttagttacgccaagtatggcaatgagatgtgttggaattggatcacgtgactttgtggaaggtctatcgggagctacctgggtggatgttgttctggagcacggaagttgcgtaacaacaatggcaaaagacaaacctacgctagatatagaactcttgaaaacggaagttactaatcccgccgtacttcgtaaattatgtatcgaagccaaaatatcaaacaccacaacagatagtcggtgtccaacacaaggcgaagcaactctcgttgaggaacaagacgctaactttgtatgtagacgaacttttgtcgacagaggttggggaaacggctgtggcctcttcggcaaaggatctctgataacgtgtgctaaattcaaatgtgttacgaaattagaaggaaaaattgtacaatatgaaaatttaaaatactctgttatagtaacagtacatacaggggatcaacaccaagtgggtaacgaaagcacagaacacggaacgacagctactataactccgcaagcgccaacaaccgaaattcaattaactgattacggtgccctgacgctagactgctctccgcgcacaggattagactttaacgaaatggttctacttacgatgaaagaaaaatcgtggttggtgcataaacaatggttcttagacttgccgttaccttggacatctggagccagtacaagtcaagaaacctggaaccgccaagatctcttggtcacattcaaaacggcacatgccaagaaacaagaggtcgtagttttaggaagccaagaaggcgcaatgcatacggctctaacaggggcaacagagattcaaacaagcggcacaacaaccatattcgcaggacatttgaaatgtaggttaaaaatggataaattaacacttaaaggtacttcgtatgtaatgtgtactgggagctttaaacttgagaaagaggtagctgaaactcaacatggtacggtgttggtacaaataaaatatgaaggcactgatgcaccctgtaaaattcccttttccacacaagatgagaaaggcgttacacagaatggacgcttaataactgcaaatccaatagttacagacaaagaaaaaccggtcaatattgaagcagaaccaccattcggagaatcatacatagtgattggagcaggcgaaaaagctctgaaattatcatggtttaagaaaggttcttcaattggaaaaatgtttgaggctacagcaagaggggccagaaggatggcaatacttggggacacagcatgggatttcgggagtattggaggagtttttacttctgtagggaagttagtgcatcaaatttttggtacagcttatggtgtgttattttcaggtgtttcatggaccatgaagatcgggataggagtgttactgacatggttgggtctgaatagtagaagtacctctttatccatgacttgtattgccgtaggcctcgtcacattatacctaggagtaatggttcaagcagatactggctgtgtcataaactggaaaggacgcgaattaaagtgcgggtctggaattttcgtcacaaacgaggttcatacgtggactgagcaatataaattccaggccgactcacctaaaagactgagtgctgcgatagggaaggcctgggaagaaggcgtatgcggaataagatccgccacacggcttgaaaatattatgtggaaacaaatttcaaatgaattaaatcatatcttattagaaaatgacatgaagttcactgttgtagtgggcgacgtcgcaggaatattggcacaaggtaagaaaatgattagaccgcagccaatggagtataaatactcctggaaatcatggggaaaggccaaaatcataggggcagatgttcaaaacaccacttttattatagacgggcctaacaccccggagtgcccagatgaccaaagggcttggaatatttgggaagtagaggattacggatttggaatctttacaacaaatatttggttaaaactgagagatagttacacccaagtgtgcgaccaccgcttaatgagcgctgcaatcaaggattcaaaggcggtccatgcagacatggggtactggattgagtctgagaaaaacgaaacatggaaactcgcgcgagcgagcttcatagaagtcaaaacatgcatttggccaaaatcacacacactatggtcaaatggggttcttgaatcagaaatgataattccaaaaatttacggtggaccgatttcccagcataactacagacccggatattttactcaaaccgcaggaccatggcatttgggtaagctagaactagattttgatctctgtgaagggacgaccgtagtagtagacgaacactgtggaaatcgaggtccatctctaagaaccactacagtcacaggtaagataatacacgaatggtgttgtagatcatgcactttaccgccgctaagatttaggggtgaagatggttgctggtacggaatggaaataagaccagtcaaagagaaagaagaaaatctagttaagagcatggtaagtgcaggatctggtgaggtcgatagttttagtttgggactcttgtgcatctcaataatgattgaagaagtaatgcgaagtagatggagtcgcaaaatgctgatgacaggaaccttagccgtattctttcttctcatcatggggcaacttacttggaacgacctcataagactgtgcattatggtcggggcgaatgctagcgatcgaatgggaatgggcacaacataccttgcgttaatggcgacgtttaaaatgcgccccatgtttgcagtaggcctactattcagacggttaacgtcaagggaggttttattactaactatagggttgtccctcgtagccagcgtagagctacctaatagtcttgaggaattaggagatggtttagccatgggaattatgattttgaagttactaacggacttccaaagccatcaactatgggcgacattattaagcctaacgtttataaaaaccacattcagccttcattacgcttggaaaacaatggcaatggtattaagtatcgtatcgctgttccccctttgtctgtctacaacatcacagaagaccacttggttgccggttttattaggaagtctcgggtgtaaaccattgaccatgtttctgatagcggaaaataaaatatggggaaggaaatcatggcccttaaatgaaggtataatggcggtgggaatagtaagcatacttctatcttcactgctgaaaaacgacgtaccgttagctggaccactcatagccggtggtatgttaattgcatgttacgtaatatctggctcatcagccgacctaagtctagagaaagccgcagaggtgtcatgggaggaagaagctgagcactcaggtgcaagccataatattttagtggaagttcaagacgatggaactatgaagataaaagacgaagaaagagatgataccttaacaatactactaaaggcaactctattggcagtgagtggtgtttatccattatccataccagcaacattattcgtgtggtacttttggcagaaaaagaaacagagaagcggagttttgtgggatacacccagtccaccagaagtagaaagagcagtgcttgacgacggaatataccgaattatgcagcgcggtcttctcggccggtcacaagtaggggtaggggtttttcaagaaaatgtttttcataccatgtggcacgtaaccagaggagcagtattgatgtatcaaggtaaacgccttgaaccgagttgggcaagtgttaagaaagatttaatttcctacggcggcggatggcgactacaaggaagttggaacacgggtgaagaagtgcaagtaatcgcggtcgagcctggcaaaaaccctaaaaatgtacagacggctccaggtacatttaagacgccagagggggaagtaggcgcgatcgccctagacttcaaaccaggaacgtcgggttctccaatcgtaaatcgagagggtaagatagtcggcctatatgggaatggtgttgtaacgacgtccgggacatatgtcagtgctattgcgcaggcgaaagcaagtcaggaaggtcctctacccgaaatagaggacgaagtgttcaaaaagcgaaatcttaccatcatggatttacacccagggtcaggtaaaacgaggagatacctacctgctatagttagagaggctataaaaagaaaactaagaacattaattttagcaccaactagggtcgtagcatccgaaatggcggaggcactcaagggtatgccaatcagatatcagacaacagctgttaaatctgaacacactggcaaagagatagtggatttgatgtgtcacgctacatttactatgagattattaagcccagtgcgtgtgccaaattataacatgataattatggacgaggcacatttcacggacccaagctcaatagcagctcgagggtacatttcaacacgggtcggcatgggagaagcagcagccatatttatgactgcaacacctcctggaagcgtggaggcttttccccagtcgaatgccgtcattcaagatgaagaaagagacataccagaaagaagttggaactcgggatacgaatggattaccgatttccctgggaaaacagtatggttcgtgccctccattaagtccggaaatgatattgcgaactgcttacgtaagaacggaaagagagttatacaattgagcaggaaaacgtttgatacggagtatcagaaaaccaaaaataatgactgggactacgtagttacgaccgacatatcggaaatgggagcaaacttcagagccgatagggttatagatccgcgacgatgcttaaaacctgtaatacttaaggatggaccagaaagggttatattggctggaccaatgccggtgacagttgcatcggccgcacaaagacgcggacgcataggaagaaaccataataaggaaggtgatcagtatatatatatgggacaaccattaaataacgatgaagatcacgcccattggacagaggctaaaatgctattagataatattaatactccagagggaataataccagctctattcgaaccagaacgagaaaaatctgcagccatagacggggaatatcggttaagaggagaagctcgaaagacatttgtagagttaatgagacgaggtgaccttccggtatggctatcgtacaaggtagcatctgaaggcttccaatatagtgacagacgctggtgctttgacggggaaaggaataatcaagtattagaagaaaatatggatgtggagatatggactaaagaaggcgagcggaagaaactacgcccgcgatggctagatgctagaacatattcagacccgctagcccttagggaatttaaggaatttgctgcaggaaggcgatcaattagtggagaccttatacttgaaatagggaaactaccacagcatctaacgcagagagcgcaaaacgcactagataacttagtaatgctgcataattcggaacaaggagggcgggcatacagacacgctatggaagaactcccggatacaatcgagacactaatgctattagccctaatagccgtcttaacgggaggtgtaactttgttcttcttatctggtaggggattgggcaaaacaagtattggattactatgtgtaatggcgtcatcggtactcctctggatggcatccgtagaaccccactggatcgccgcatcgatcatattagagttctttttgatggtgttactaataccagaacctgatcgacaaagaaccccacaagataatcaattggcgtacgtggtaattggactgttattcatgatattgacagtagcggcaaatgaaatggggttattagaaactaccaaaaaggatttaggaatcgggcatgtagcggtagaaaatcatcatcatgccgctatgcttgatgttgacttacatccggctagcgcatggactctatatgcagttgcaactacaatcattacaccaatgatgagacatacgatcgagaacaccacagcaaacatctctttaacagcaatagcgaatcaggccgcaatattgatggggttggacaaaggatggccaattagcaaaatggatataggtgtaccattgttggcattgggatgttactcgcaagttaaccctctaacgttgacagcggccgtcctgatgcttgtcgctcattacgcgattataggaccgggattgcaagcaaaagcaaccagagaagcgcagaaaaggacggctgcgggaatcatgaaaaatcctaccgttgatgggattgtcgcaattgacttagaccctgtggtatatgatgccaaatttgagaaacaacttggacagataatgttattaatactatgtacatcacaaatcttgttaatgagaacaacgtgggctctgtgtgaaagtattacgctcgcaacaggaccgcttacaacactctgggagggaagcccaggtaaattctggaatactacaatagcagtaagcatggctaacattttcagggggagttatctagccggtgcggggttagcattctcactaatgaaatcattagggggaggtcgtcgagggacaggtgctcaaggggaaactttaggcgaaaaatggaaacgtcagctaaatcaactttctaaatcagaatttaacacatataaaaggtctggcattatggaagttgacaggagtgaagctaaagaaggactaaaacgaggtgaaacgacgaagcacgcagtaagtcggggaaccgctaaattaagatggtttgtagagcgaaacctagtcaagccggagggaaaagtcatagatctgggttgcggaagaggagggtggagttattattgtgcgggacttaagaaggtgactgaagtgaaaggatatacgaaaggcggtccaggacatgaggaacctatacccatggccacatatggatggaatttagttaaattacattcaggtaaagatgtattcttcatccctcccgaaaaatgcgatactctcctgtgcgacattggtgaaagttcgccaaacccaaccatagaggagggaagaacattgagagtcctcaagatggtcgagccctggttaagaggaaatcagttttgtattaagattctgaatccctacatgccaagtgtagtcgaaactctagaacagatgcaacggaagcatggcggtatgctcgtgagaaaccccctatctcgtaattcaactcatgaaatgtattgggtaagctgtggcactggaaatatagtatctgcagttaacatgacatcacgaatgcttctaaatagattcacgatggctcatcgtaaaccaacttacgaaagggatgttgacctaggagctggcactcggcatgttgctgtagaaccagaagttgcgaacctggacatcataggccaaagaatagaaaacataaaacatgaacataaatcgacatggcattacgatgaagacaatccttataagacatgggcatatcacggtagttatgaggtaaagccgagcggaagtgcatcttcgatggtgaatggcgttgtaaaattgttaactaaaccgtgggatgtgataccgatggttacacagatagcaatgacggacaccactcccttcggacaacaaagagtattcaaagagaaagtagatactcgcacacctaaagccaaacgaggaactgcccagataatggaagttactgccagatggctatgggggttcttatcacgcaacaagaaaccacgaatatgtacacgagaagaatttacaagaaaagtcaggtcaaatgccgccataggtgctgtattcgttgacgaaaaccaatggaatagcgcaaaagaagccgttgaagatgaacgtttttgggatttagttcacagagaaagagaattacacaaacaaggtaagtgtgcaacatgtgtttacaacatgatgggcaaaagagagaagaaattaggggaatttggtaaggcaaaaggaagcagggcaatctggtacatgtggctaggcgcaagatttttagagttcgaagcacttggatttatgaatgaagatcattggttttcgcgggaaaatagtctatccggtgttgaaggcgagggcctacataaattgggttacatattaagagatataagtaaaataccgggaggtaacatgtacgcggacgatacagcaggctgggataccaggataacggaagatgatttgcaaaatgaagcaaaaattacagacattatggaaccagaacacgcattgctcgcgaaagcgatctttaaactcacatatcaaaacaaagtcgtacgcgtacaaagacctgcgaaaaacgggacagtcatggatgtaatttcccgtagagatcaaagaggaagtggtcaagtaggtacatatggactaaacacttttactaacatggaagcgcaattaattaggcaaatggagtcagaaggaatatttttaccatcagagttagaaactccaaacctcgcagaaagagttttagattggctagagaaatatggtgtcgaaagattgaaacgtatggcaataagtggcgatgattgtgttgttaagcccatagatgatcgatttgctacagcacttacagccctaaatgatatgggtaaagttaggaaagacatcccacagtgggaaccatcaaaaggatggaacgattggcaacaggtaccgttctgttcgcaccatttccaccagcttataatgaaagatggtagagaaatcgttgtaccttgtaggaaccaagacgaattagtcggcagagcccgagtatctcagggagccggatggtcacttcgcgagacagcttgtttaggtaaaagctatgcacaaatgtggcaattaatgtactttcatagaagggatttacgattagccgcgaatgctatatgtagtgctgttcctgtagattgggtgcctaccagtagaactacttggtcaattcatgcacaccaccaatggatgacgacggaggacatgctatcagtctggaatagagtttggatagaagaaaacccgtggatggaagacaagacccatatttcttcttgggaagacgttccatatctaggcaagcgagaggatcaatggtgcggtagtttaataggtctaactgcgagagccacctgggccacaaatatacaagtagcaatcaaccaggttagacgattaataggtaacgaaaactatctagattatatgacttcaatgaaaaggttcaaaaatgaaagtgatccagaaggagcattatggtaa

SEQ ID NO: 21091 - RNA, 9879 nt, synthetic construct
  misc_feature 1..9879: note = derived and/or modified CDS sequence (opt6) from DENV-1__HM469966__SS-prME
  source 1..9879: mol_type = other RNA
agcgttactatgctactgatgctgatgccgacagcactcgcatttcatttgaccactaggggtggggaaccacacatgatagttagtaaacaagaacgtggaaaatctttgctatttaaaacatcagctggtgtgaatatgtgtactctaatagctatggaccttggggaactatgtgaagacacaatgacatataaatgtccaagaataaccgaagcagaaccagatgatgtagactgctggtgtaatgctacagatacctgggttacatatggtacatgctcacaaactggagaacatcggagagataaacgctcagttgctctagctccacacgttggcctaggactagaaactaggactgaaacatggatgtcctcagaaggagcatggaaacaaatacaaagggtcgaaacctgggcgctaaggcatcccggttttactgtgattgcattatttttggctcacgctataggtacatcaataactcaaaaaggaataatttttatattactaatgctagtgaccccctctatggccatgagatgcgtggggattggttcaagagattttgtggagggcctgtccggtgccacttgggtggatgtggtattagaacatggttcatgcgtcactaccatggcaaaagacaaaccaacactggatatcgagcttctgaaaacagaagtaaccaatccagctgtactacgaaaattatgcatagaagcaaaaataagcaacacaactactgacagtcgatgcccaacccaaggagaagcgactttggtagaggaacaagatgctaactttgtatgcagaagaaccttcgtagacagaggatgggggaatggctgcggacttttcgggaaagggagcttaatgacttgcgcaaaattcaaatgcgttacaaagttagaaggaaaaatagtccaatatgagaacttaaaatactccgtaatagttacagttcataccggagatcaacaccaagtaggaaatgaaagcacagaacatggaactactgcaacaatcactccacaagctcccacgactgagatacagttgaccgactatggagcgttgactcttgactgctcaccaagaacaggtttggattttaatgaaatggtattactgacaatgaaagaaaagtcctggttagtacacaaacaatggttcctggatctacccttaccatggacgtcaggtgcctcaacatcacaagaaacatggaatcgtcaagatctgttggtaactttcaaaaccgcgcacgcgaagaaacaagaagtagttgtgttagggagccaggaaggcgctatgcatactgcactaacaggtgcaacagaaattcaaacaagtggaaccacaacaatattcgccgggcaccttaaatgtagactaaaaatggataaacttacactcaagggaatgtcatatgtcatgtgtactggatcattcaaattggagaaagaggtagcggagacacaacatggtacagtgttagtccagattaagtacgaaggaacagacgcaccttgtaaaatacccttcagtactcaggatgaaaaaggcgtgacacaaaatggtcggttaataaccgcgaatccgatcgtcacggataaagaaaaaccagtaaatatagaggctgaacctccatttggagaatcttatatagttataggtgccggtgaaaaggcgttgaaactgagctggtttaagaaaggttcaagtatcggtaaaatgttcgaagcaaccgcaagaggggcgcgccgaatggccatcttaggcgacacagcatgggactttggatctataggaggtgtctttacgtcagtaggaaaattagtacatcagatattcggcaccgcgtatggtgttttattctcaggagttagttggacgatgaaaattggaataggagtattattgacatggctcggccttaactctagatcaacttcgttaagtatgacctgcatcgctgtagggttagttactctctatcttggagttatggttcaagcagatagtggatgtgtcattaattggaaggggcgggagctaaaatgcgggtctggaatattcgttacaaacgaggtacacacatggacagaacaatataaatttcaagcagactcaccaaaaagattatctgcggctatcggtaaggcttgggaggagggcgtctgtggaatcagaagcgcgacaaggctagaaaatatcatgtggaaacaaattagtaatgaattaaaccatattctattagaaaacgatatgaagttcactgtggtggtcggcgatgttgctggtatacttgcacaagggaagaaaatgattagaccccaacccatggaatataagtattcatggaaatcttggggcaaggcaaaaataataggagccgacgtgcaaaacacaacatttataatcgacggtccaaacactccagaatgtccagatgaccagcgagcctggaacatctgggaagtagaagattatggttttggtatattcactacaaacatctggttaaaattaagagatagttatacgcaagtgtgtgatcaccgtttaatgagtgcagcaatcaaagattcaaaagcggtacatgcagatatggggtactggatagaaagtgagaaaaatgagacctggaagttagctcgcgccagctttattgaagtgaaaacctgtatatggccaaaaagccatacgttatggagtaatggtgttttagaaagcgaaatgattatcccgaaaatatacggaggtccgatatcacaacataactatcgtcctggctatttcacacaaactgctggtccctggcacttaggcaagttggaactagatttcgatctatgtgaaggtacgactgtagtagtagatgaacactgtggaaatcgtggaccgtccttaagaactacaacggtaacaggtaaaataattcacgaatggtgctgtcgaagctgcacacttccacccctgagattccgcggtgaggacggatgttggtacggaatggagataaggccagtaaaagaaaaggaagaaaacttagtaaagagtatggtcagcgcggggagtggggaagtagactcattctcattgggattattatgtatttcgatcatgatagaagaagtaatgcgaagtcgatggagtcgtaagatgctcatgacgggaactttagcagtattctttctgttgataatgggtcaattaacgtggaatgatttaatccgtttgtgtataatggtgggcgctaacgcctccgatagaatgggcatgggtacgacgtacttagcgctaatggccacgttcaaaatgcgaccaatgttcgcagtaggccttctattcagacgactaaccagtagagaagtactactgttgacgatcggtctgagtttggtcgcgagtgtagaattacccaattcgctcgaagagttgggtgatgggcttgctatgggtataatgatattaaaactactgacagatttccagtcacaccaactgtgggctactctattaagtttgactttcataaaaacaacattcagccttcactacgcatggaaaacaatggccatggtcctcagtatcgtcagcctttttccactttgtcttagtacgacttcgcagaaaacaacttggttaccagttctattaggttcgttgggttgtaagcccttgacgatgtttctaatcgcagagaataagatatggggaagaaaatcgtggcccttaaacgaaggaatcatggcagtaggaatagtgtccatcttattaagctcgctgctcaaaaatgacgtacccctagccggaccactaatagccggtggtatgttaattgcatgttatgtaatatcgggatcgtcagcagatttaagtctggaaaaagctgcggaagtttcatgggaagaagaagctgaacattctggagccagtcataacatcttagtagaggtgcaggatgacggaaccatgaaaattaaggatgaagaaagagatgacacattaacgatcttattaaaggctactctactcgcagtctctggagtatacccgcttagcattcctgccactttatttgtatggtacttctggcaaaagaaaaagcagcgttcgggtgttttatgggatacacccagtccacccgaagtggagagagcagtcttagacgatggtatttacagaattatgcaaagagggctactaggccgatcacaagtaggcgtgggagtgtttcaagaaaatgtcttccacacgatgtggcacgtaacgagaggagcagtattaatgtaccaaggtaagcgtttagaaccatcttgggcaagcgttaaaaaggacttaatcagttatggaggcgggtggagattgcaaggctcttggaatacaggtgaagaagtacaagtaatagcagtcgaaccaggtaagaatcccaaaaatgtacaaaccgcgccaggcacgtttaaaacacccgaaggtgaagttggagctatagctcttgacttcaaacctgggacatcaggttcccctattgtgaatcgagaaggtaaaattgtcgggctctatggaaacggagtagtaactacttcaggtacatacgtatcggcgatagcacaagcaaaagctagtcaagaagggcccctaccagaaatcgaagatgaagtattccgaaagagaaatttaactatcatggatttgcatccaggatctggaaaaactcgtcggtacttacctgcgatagtacgtgaagccattaaacgaaaactaagaacactaatactggcacccacccgcgttgtggcatccgaaatggcagaagctctgaaaggaatgcctatcagatatcaaacaacggcagttaaatccgaacataccggaaaagagatcgtggaccttatgtgtcacgcgaccttcaccatgcgcttactatcacctgtgcgagttccaaattacaatatgattattatggacgaggctcacttcactgatccttcttcaattgctgcaagaggatatatttctacgagagtaggcatgggagaagctgcggcaatatttatgactgcaacgccgcctggctccgtagaagcattcccacaatcaaatgcagtgatccaagacgaagaacgagatatccccgaaagatcatggaatagcggctacgactggataactgatttcccggggaaaactgtatggttcgtaccttccatcaagtcgggcaacgatatcgctaactgcctgagaaagaacggaaaacgggtaattcaactcagccgtaagaccttcgacacagaataccagaaaactaaaaacaatgactgggactacgtagtaaccaccgacatatctgagatgggcgctaactttcgagctgacagagtaattgatccacgtcgatgtttaaaaccggttattttaaaggatggaccggaaagagtcgtgcttgcgggacctatgccagtgacagtcgccagtgcagcacaacggagaggtagaattggaagaaatcataataaggaaggggatcaatatatatatatgggacaaccgttaaacaatgacgaggatcacgcgcattggaccgaagctaagatgcttctggacaatataaatacgccagaagggattatcccagccctatttgaaccagaacgagaaaaatctgctgcaatagacggagagtacagattacgaggagaggctcgtaaaacattcgttgaattaatgcgtagaggggatttacctgtgtggcttagttataaagtagcaagtgaaggttttcaatattctgaccgacggtggtgctttgatggtgagagaaataaccaagtattagaagaaaatatggatgtagagatatggacaaaggaaggcgaacggaagaaactcagacctcgatggttagatgctagaacctatagtgacccgttagccttacgggagtttaaagagtttgctgcaggcagaagatcggtgtccggagatctaattttagaaatcggcaagttaccgcaacatttgacgcaaagagcacagaacgcattggacaacctggtaatgttacataatagtgaacagggaggcagagcatatagacatgcaatggaagaattgccggacacaatagagacgcttatgctattggcgttgattgctgttctaacaggcggcgtaacattgttcttcttatcgggcagaggacttggtaaaacctctattgggctattatgcgtgatggcttcgagcgtgctactatggatagcaagtgtagaaccacactggatcgctgcgtcaattattctagagttctttctaatggtcttgctcataccagaacccgataggcaaagaacaccccaggataatcaattagcttatgtcgtaataggtttattgttcatgatattaacggtagcagcaaatgaaatggggcttcttgaaacaaccaagaaagacttggggattgggcacgtagctgtcgaaaaccatcatcatgcggctatattggatgttgatttacatccagcaagtgcatggacattatatgcagttgcaaccaccataataactcctatgatgagacataccatagaaaacactacggcgaacatcagtttaactgctattgcaaatcaagcagcgatactaatgggcttagacaaaggctggccaatatcaaagatggatattggagtgccattgctggcgcttggttgttactcacaagtaaatccgcttacacttactgctgccgtactgatgttagtagcccactatgcaattatcggtcctggattacaggcgaaagctacgagagaggcccaaaaacgtacggcggcgggtataatgaagaatccaactgtagatgggatcgttgcaattgacctggatcccgtagtatatgacgccaagttcgaaaagcaattgggacaaattatgctattgattttatgtacgtcccaaattttgctgatgagaacaacttgggcgttatgtgagtcaattacactagctactggtccattaacaacattatggaaaggatcaccaggaaaattttggaatacaacaatagctgtaagtatggctaacatttttcggggatcctatttggctggagcaggcttagcattctcattgatgaagtctctaggaggaggacgaagaggtactggagctcaaggagagactcttggagagaaatggaaaagacaattaaaccagctaagtaaaagtgagttcaacacatataagcgatctggaataatggaagtcgaccgcagtgaggctaaagagggtctaaaacgcggagaaactaccaaacatgccgtttcccgagggaccgcaaaactccgttggtttgtagagagaaatttggtcaaaccagaaggaaaggttatagacttgggctgcgggcggggtggatggtcgtactactgcgccggcctaaagaaagtcacggaagttaaaggatacacaaaaggaggtcctggacacgaggaacctattcccatggctacctacggttggaacctagttaaactatactctggcaaagatgtcttcttcattccgccagagaaatgtgatacgcttctatgtgatattggagaaagtagccccaacccaacaattgaagagggaagaaccctgagagttcttaagatggtagagccgtggcttcgaggaaatcagttctgcataaaaatcctcaacccgtatatgccaagtgttgtggaaactttggaacaaatgcagagaaaacatggtggcatgttagtaaggaacccgctatccaggaactctacacatgaaatgtactgggtatcctgtggaactggcaacatagtaagtgcagttaatatgacctcgcgtatgttattaaaccgatttacgatggcacatcgtaagccaacatatgagcgggatgttgatttaggcgctggaacccgtcatgtggccgttgaacctgaagtagctaatctagatataattggtcaaagaatcgagaacattaaacacgaacacaaaagtacatggcattatgacgaagataatccgtacaaaacttgggcataccacggaagttatgaagtgaaaccttcaggttcagcatccagtatggttaatggtgtggttaaacttttaacaaaaccctgggatgtcatcccaatggtaactcagatagccatgacagacacaacgcctttcggtcaacaaagggtattcaaagagaaagtcgacacacggactcctaaagcaaaaaggggcactgctcaaataatggaagtcactgctagatggctatgggggttcctatctcgaaataagaaaccgagaatttgtacgagagaagaatttactagaaaagtgaggtcaaacgccgcaattggtgcagtatttgtcgacgaaaatcaatggaactcggctaaggaagctgtggaagatgaacgtttttgggatttagtccatagggaacgggaattacataaacaaggcaaatgtgcaacttgtgtatataatatgatgggtaaaagagagaagaaattaggagaatttggaaaagctaagggttcgagagctatatggtacatgtggttaggtgcacgattcttagaatttgaggctctagggttcatgaatgaagaccattggttctcccgagaaaactccttgagcggcgtggagggagaaggactacataaacttggatatatcttacgagatataagcaaaattccaggaggaaatatgtacgctgatgacaccgccggctgggatacaaggattaccgaagacgatttgcaaaatgaagcaaagattacagatattatggaacccgaacatgctctgctagcaaaagcaatatttaagctaacctatcaaaataaagttgtccgggtacagcggcctgctaaaaacggaacagtcatggatgtaatttcacgcagggatcaaagaggttcaggccaagtaggcacatacggactcaacacattcaccaacatggaggcacaactgatacgacaaatggaatcggaggggatatttagtcccagcgaattagaaactcctaacttggctgaaagggtcttagattggttagaaaaatatggagtggagcgattaaagagaatggcgatctcgggggacgactgtgtagttaaaccaatagatgatagattcgcaacagccttaacagcgttgaatgatatgggaaaagtacggaaagatataccgcagtgggaaccgtcgaagggatggaatgattggcaacaagtcccattttgttcacaccattttcaccaacttataatgaaagacggacgtgaaattgttgttccatgcagaaatcaagacgaactggtaggacgtgcaagagtcagccaaggagccgggtggagtcttcgagaaacagcttgtcttggaaaatcctatgcgcaaatgtggcaactaatgtatttccaccgtagggacctcagacttgcagccaatgcgatctgttcagctgtacccgttgactgggttcctacctcaagaacaacatggagcatccatgctcaccatcaatggatgactacagaagatatgttatctgtctggaatagagtatggattgaggaaaatccatggatggaagataaaacacatatcagttcgtgggaggatgtgccatacctagggaaacgagaagaccaatggtgtggatctctaattggattaacagcaagagccacgtgggccacaaacattcaggtggcaataaatcaggtacggagattaataggaaacgagaactaccttgattatatgacctctatgaagcgcttcaaaaatgaaagcgatccagaaggtgcactctggtaa

SEQ ID NO: 21092 - RNA, 9879 nt, synthetic construct
  misc_feature 1..9879: note = derived and/or modified CDS sequence (opt6) from DENV-1__JX669462__SS-prME
  source 1..9879: mol_type = other RNA
agtgttacgatgttattgatgctactcccgacagcattggcatttcatttaacgacgagaggtggagaaccccacatgatcgtatcgaaacaagaacggggtaaatcgctcttatttaaaacatccgcaggagtcaacatgtgcactttaatagcaatggatctgggagaactttgtgaagatacaatgacatacaaatgtccgaggatcactgaagcagaacccgacgacgtagattgttggtgcaatgcaacagacacatgggtaacatacggtacttgctcacaaacaggtgaacatcgtagggaaaaacgttcagtagcgttagcgccccatgttggattagggctagaaacacgtacagaaacttggatgtcatcagaaggagcatggcgccaaatacaaagagttgagacctgggcacttaggcacccaggattcaccgtaatagctttcttcctagcgcatgctattggaacaagtataacgcaaaaaggaataatatttatacttttaatgttagtgacaccgtcaatggctatgcgttgcgtaggcatagggaatagagacttcgtcgaaggattatctggagcaacctgggtagacgtagttttggaacatggatcctgtgtgaccacgatggccaaaaacaaacctaccttagatatcgaattgttaaaaactgaagtcactaatccagcagtcctgagaaaactttgcatcgaagcaaaaataagtaatactacaacggactcacggtgccccacccaaggagaagcaacgctagtcgaagaacaagacgctaacttcgtgtgcaggagaacgttcgtagatagaggttggggtaacggctgcggtctattcggtaaagggagcttgttaacgtgcgccaaatttaaatgtgttaccaaacttgaaggaaaaatcgttcaatatgaaaacctaaaatattccgtaatcgtcacagtacacacaggagatcaacatcaagtaggcaatgagactacagaacacggaacaatagctacaattacaccacaagcaccaacatcagaaatacaactaactgactacggtgcattgaccctcgattgctctccgagaacgggattagattttaatgaaatggtacttctaacaatgaaagaaaaatcgtggctagtgcataaacaatggtttcttgatttacccctaccatggacatcaggcgcttcaacatcacaagaaacatggaatagacaggatctactcgttactttcaaaacagcacatgcgaagaaacaggaagtcgttgtactaggatcccaagagggagcgatgcacacagcattgaccggcgcaacggagatacagacaagcgggacaacaactatctttgctggccatctgaaatgtcgattaaaaatggacaaactaacacttaaaggtatgtcatatgtaatgtgtacaggtagttttaaattagaaaaagaagtggcagaaacgcaacatggaacagttctagtccaagtgaaatacgaaggtactgatgccccatgcaaaataccgttttcaactcaggacgagaaaggagtaacccagaatggaagactaataacagcgaacccaatagttacggacaaagaaaaaccggtcaacatcgaaacagaaccaccatttggagaaagctacatagtggtaggggcgggggaaaaagccttaaaactcagttggttcaaaaggggttcctcgataggaaaaatgttcgaggccacagcacgaggtgctcgtcgcatggccatcttaggcgataccgcatgggatttcggaagtataggcggagtttttacatctgtggggaaattggttcatcaagtttttggtactgcttatggggtcttattttctggagtcagttggacaatgaaaataggaataggaatattgctgacatggttaggattgaactcacggagtactagccttagtatgacttgcattgcagtaggcatggtcaccttatatcttggagtaatggtacaagcagactccggttgtgtaatcaattggaagggtagagaattaaaatgtgggtctggaatattcgtcacaaatgaagtacatacgtggacagagcagtacaagttccaagccgacagtcctaagcgactctctgctgcgataggtaaggcttgggaagagggagtatgcggaatcaggtcagcaactaggttggaaaacataatgtggaaacagatatccaacgagttgaaccatattttattggaaaacgatatgaaattcacggtggtagtgggcgatgcaaacgggattctcgcacaaggtaaaaagatgatcagaccgcaacccatggaacacaaatatagttggaagtcttggggaaaagcaaagataattggtgccgacatacagaatacaacgttcattatagatggacctgataccccggaatgcccagatggccagcgcgcgtggaacatttgggaggtcgaagattatggatttggcgtgtttactactaatatatggttaaaattacgagattcctatactcaaatgtgcgaccatcgtctaatgagtgccgcaatcaaggattcaaaagcagtacatgctgatatggggtattggattgaaagtgaaaagaatgaaacttggaaactcgcacgagcttccttcattgaagtgaaaacctgtacatggccaaaaagtcataccttgtggagtaacggagtcttagagagcgaaatgattatccctaagatattcggaggcccaataagccaacataactacaggcctggctacttcactcagacagcaggcccctggcacttggggaagttagagttagactttgacttatgtgaaggaacaacagtagttgtggacgagcactgcgggaacagaggccctagcctacggacaacaacggtaactggaaaaattatccatgaatggtgttgtaggtcatgtaccctaccaccactccgatttagaggagaggacggctgctggtatggcatggaaattaggccagtaaaagaaaaggaggagaacttggtcaggagtatggttagcgctggtagtggagaggttgacagcttctctcttggaatcctatgcgtgagtattatgatagaagaggtaatgcgttcgcgctggagcagaaagatgctaatgacaggaaccctagcagtgtttcttctattaattatgggacaattaacatggaatgatctaatacggttatgtataatggttggagcgaatgcttcggacagaatgggtatgggtacaacgtatttggctttaatggctacgttaaaaatgaggcctatgtttgcagtagggttattatttagacgcctcacatcaagagaagtccttcttcttactatcggattatctcttgttgccagtgtagagcttcctaattcattagaagaattgggagacggattagcgatgggaattatgatgttaaaacttctaacagagtttcaaccacatcaactttggacgaccctactttcactaacttttgttaaaactactttaagtcttgattacgcatggaaaaccacagctatggttctatcaatagtctcgttattcccgctatgtctttcaacgacatcccagaaaaccacttggctcccagtcctacttggatcctttggttgtaaaccattaacaatgttccttatcactgaaaataaaatttggggtagaaaaagttggccactaaacgaaggcataatggcaattggaatagtttctatactactatcgtcactccttaaaaacgacgttccactagctggtccattgattgcgggtggtatgctaatagcatgctatgtcatctcgggaagctccgcagacctctccctagagaaagccgccgaagtctcgtgggaacaagaagctgagcactcaggcgcctcacataacatattagtcgaagtccaggacgatgggaccatgaagatcaaagacgaagagagagatgatacattaacaatattactaaaggcaacattactagccgtatctggtgtgtatccaatgtcaatcccagcgactttatttgtgtggtatttttggcagaagaagaaacaaagaagtggcgtcctatgggatacaccaagtccacccgaggtagaacgagcagtattagacgacgggatatataggatattacagagagggttactcggtagatcccaagtcggagtaggagtatttcaagacggagtatttcacactatgtggcatgtaacaaggggagctgttctaatgtatcaaggaaaaagactggaaccgtcctgggcatcagtcaagaaagacttaattagctatggaggtgggtggcgatttcagggatcttggaatacaggagaagaagtacaagtaatagccgttgaaccgggtaaaaacccgaaaaacgtacaaacaacgccaggtacatttaagacccctgagggcgaagtcggagcgatagcattggacttcaaacccggtacctctgggagtccgattgtaaatcgagaaggaaaaatagttgggctctatggaaacggagttgttactacctcaggaacctacgttagtgcaatagcacaagcaaaagctagtcaagaaggaccactcccggagattgaagatgaagttttcaagaaaaggaatctcacaataatggatctccatcctgggtcagggaaaactagacgttatctaccagctatagtaagagaagcgataaaacgaaagctaagaacgctgatactagctccaacgagagtagtggcaagtgaaatggccgaggcattaaaaggcatgccgataagataccaaaccacagcagtcaagagtgaacataccggacgagaaatagtagatctgatgtgtcatgcgacattcactatgagattgttatccccagtccgagtacccaattataatatgataattatggacgaagctcactttaccgatccagctagcatcgcagctagaggttacattagcactcgcgttggaatgggtgaggctgccgcgatatttatgacagctactcctccaggatcagttgaggcgttccctcaatcaaatgcagttatacaagatgaagaacgtgacatacccgagcgtagctggaactcaggttatgattggattactgatttcccgggcaaaacagtttggtttgtacccagtattaaatctggcaacgatatagcaaattgcttgcgtaaaaacggcaaaagggttattcaacttagtaggaaaaccttcgacacagaataccagaaaacaaagaataacgattgggattatgtagtaacaaccgacataagtgaaatgggcgctaattttcgagcagatagggtaatcgatccaaggagatgtctgaagccagtgattctaaaggatggacccgaaagggttatactagccggaccaatgccggttacggttgcatccgcagcacagagacgaggaagaattgggagaaatcaaaataaggaaggagaccaatatgtgtacatgggacaacccctaaacaacgatgaagaccacgcccattggactgaagcaaagatgcttcttgacaatatcaacactcctgagggaataatccccgcattattcgaacctgaacgcgaaaagagcgccgccatcgacggagagtatcgtttgagaggcgaagcgcgaaaaacatttgtagagttgatgagaagaggagaccttccagtttggctatcttataaagtagcatccgaaggctttcagtattcagacagacgatggtgtttcgatggggaacgtaataatcaggtcctagaagaaaacatggatgttgaaatatggacgaaagaaggagaacgcaaaaagttacgaccgagatggttagatgcccgaacatacagcgatcccctagcgttgagggaatttaaagaatttgctgcaggacgtaggtctgtctctggggacctgatattggaaattggtaaattaccgcaacatctcacgcttagagcacaaaatgctttagacaatctcgtaatgttacataattcagaacagggaggtaaggcttacaggcatgcgatggaagaacttcctgatacgatagagacactcatgttattggcactgatagcagttctcactgggggtgtaacactatttttcctaagtggtaagggcctaggcaaaactagcattggtttactgtgtgtcacggcatcgtccgctttgttatggatggcatctgttgaaccgcattggatagcagcatcaataatattagaatttttcctaatggtgctactcattccggaaccagatcgtcagagaacacctcaagataatcaactggcatatgtagtaattggactactatttatgatactgactgtcgctgcaaatgaaatgggacttctagaaacgaccaagaaagacttgggtataggttacgtagctgccgaaaaccatcaacacgctacaatgttagacgtcgatttacatcctgccagtgcctggaccttgtacgctgtagctacaacggtaataacaccaatgatgagacatacgattgaaaataccacggcaaatatatcactcactgccatagcaaaccaggccgctatactcatgggactggataaggggtggccaatatcaaaaatggacataggagtgccattgttagctctaggatgttacagtcaagtcaacccactaacactaaccgcagcggtactcatgctggttgcacattatgcaataatcggacctggtctgcaagcaaaagctaccagggaagctcaaaaacggactgctgcaggcatcatgaaaaaccccacagtcgatggaatcgtagcaatagatctcgaccccgtagtatacgacgccaaatttgaaaaacaattagggcaaataatgcttttgatattgtgtaccagtcaaatcctattaatgcgcacgacctgggctctatgtgaaagtataacattagcaaccggccctttaaccacactctgggaagggagcccaggaaaattttggaatactactattgctgtgagtatggcgaacatctttaggggttcatacctagccggcgcagggctagcattcagtttaatgaagtctttgggaggaggtagacgaggaacaggagcacagggtgaaaccttaggcgagaagtggaaacggcagttaaatcagttgagtaaatcggagttcaatacgtacaagaggagtggaataatggaggtagatagaagcgaagcaaaagagggattaaaacgaggcgaaacaacaaaacatgctgtatctaggggtacagctaagttaaggtggttcgttgaacggaatctagttaagccggaaggaaaagtaattgatctaggttgcggacgtgggggatggtcatattattgcgcaggtcttaagaaagtaacagaagttaaaggttacacaaaaggcggtccaggacatgaggaacccataccaatggccacgtacggctggaacctggtaaagctacacagtggaaaagatgtgttcttcatgcctccagaaaagtgcgacacgcttttatgtgatattggagaaagttcaccaaatccgaccatcgaagaaggcaggactcttcgcgtattaaagatggtagagccatggctgaggggaaatcaattctgcattaagatcttaaacccttacatgccgagtgtggtcgaaactctcgaacagatgcagaggaagcacggaggaatgttagtaagaaaccctttaagccgaaatagtacccacgaaatgtactgggtcagctgtgggactggtaatatcgtaagtgcagtgaacatgacaagccgaatgctcttgaatcgatttactatggctcatagaaaaccgacctatgaacgagacgttgatctgggagcaggcacacgccatgtagcagtcgaaccagaggtagccaatctggatatcattggtcaaagaatagagaatatcaaaaacgaacataaatcgacatggcattatgacgaagataatccatataaaacgtgggcataccacggcagttacgaggtaaaaccaagcggaagtgcgtcttctatggtgaatggagtagtacgactattaacaaaaccatgggatgtaatacctatggtcacacaaattgcaatgacggacactacacctttcggacaacagcgtgtcttcaaagaaaaggtggacaccagaaccccacgagctaaacgtgggaccacacaaataatggaagtcacggctaaatggttgtggggttttctaagtcggaacaagaaaccaagaatctgtactagagaagagttcacaagaaaagttagaagcaacgctgctataggggcggtcttcgtagatgaaaatcaatggaatagtgcaaaagaagcagttgaagatgaacgtttctgggacctagttcacagagaacgcgaactacataaacaaggaaaatgcgctacgtgtgtctacaatatgatggggaaaagagagaagaaattaggtgagttcgggaaagccaagggatcaagagctatatggtacatgtggcttggcgcacgatttttagagttcgaagccttgggatttatgaacgaagaccattggttttctagagagaactcactatctggagtggaaggtgaaggactacacaagttaggatatatcctacgagacatttcgaaaattccaggaggcaatatgtacgcagacgacactgctggttgggacacgaggattacagaagatgacttacaaaacgaagcaaaaatcactgatattatggaaccagaacacgcacttttagctacatcgatttttaaattaacataccaaaataaggtagtacgtgtacaaagaccggccaaaaacggcacggtaatggacgtaattagcaggagggatcaaaggggtagtggacaagttggaacctatggacttaatacatttacaaacatggaggtccaactcatccgccagatggaatctgaaggaattttcttacctagtgaactagaaacccctaacctagcagagagagctctcgattggctggaaaagcatggcgccgaacgcttaaagcggatggctatttctggagatgactgtgttgttaaacctatagatgacagattcgcgaccgcattaaccgctctcaacgatatgggtaaagtccgaaaagatataccacaatgggaacctagcaaaggctggaacgattggcaacaagtacccttttgcagtcaccatttccaccaactaataatgaaagatggaagagaaattgttgtcccatgtcggaatcaggatgaactcgtaggcagagcgagagtgagtcagggagccgggtggtctttaagagaaaccgcttgcctaggaaaatcatatgctcaaatgtggcaactgatgtatttccacaggcgagatctccgccttgctgcgaacgctatctgcagtgcggtacccgtagattgggtccctgcttcacggacgacatggagtatacacgcccaccaccagtggatgacaactgaggatatgttgtcagtctggaacagagtttggattgaagaaaatccatggatggaagataaaactcacgtatcatcgtgggaagaagtcccatacctaggtaaaagggaggatcaatggtgtggcagcttaattggtttgacagctagagcgacatgggccactaacatacaagtggccataaaccaagtaagacgactaataggtaacgaaaattatctagattatatgacttcaatgaaaagattcaagaacgaatcagatccagagggtgcactctggtaa

SEQ ID NO: 21093 - RNA, 9879 nt, synthetic construct
  misc_feature 1..9879: note = derived and/or modified CDS sequence (opt6) from DENV-1__JX669463__SS-prME
  source 1..9879: mol_type = other RNA
agtgttacaatgttattaatgctattacctactgcactggcattccatctaactacacgcggaggagaaccacatatgatagtatcgaaacaagaaaggggaaaaagtctattgttcaaaacatctgctggtgtaaacatgtgtacattaattgctatggatttgggagaactatgcgaagacaccatgacttacaaatgtcccaggataacggaagcagaaccagatgatgtagattgctggtgtaacgccactgacacgtgggtaacatatggcacttgtagccaaactggcgaacataggagagagaaacgatctgttgctctcgcccctcatgtaggactcggattagaaacccgcaccgaaacctggatgagtagcgaaggcgcatggagacaaatccaaagggtagaaacttgggctctgagacaccctggatttacagtcatagctttcttcctggctcatgcaatcggcacttcaatcacacagaaaggaattattttcatcttactcatgttagttactccaagcatggctatgaggtgcgtaggtattggcaatagggacttcgtagaaggcttatcaggcgccacgtgggtagatgtagttctggaacacggaagttgtgtcacaacgatggccaaaaacaaaccgaccctagatatagaattgctaaaaacagaagttacaaatcctgccgtgctgagaaaattatgtattgaagccaaaatctcaaacacgacaaccgactcccgctgtccaacacaaggtgaagctacattagtggaagaacaagacgctaatttcgtttgtagacgaacatttgtcgacagggggtggggtaatgggtgtgggctctttggaaaagggagtctcctaacgtgcgcgaaattcaaatgtgttaccaaactcgaaggcaaaatcgtacaatatgaaaatcttaaatattctgtaatagttacagtccatactggggatcaacaccaagttgggaatgaaactacagagcatggtaccatagcaacgataactccgcaagctccgactagcgaaatacaactaactgactacggagcacttacactagactgttccccaaggacaggattagatttcaatgaaatggtattgctaactatgaaagagaaatcttggcttgtacataagcaatggtttcttgacttgccactcccctggacatcgggcgcctcaacctctcaagagacttggaacagacaagatcttctagtaacgtttaagacagctcatgccaagaaacaagaggtcgtggtcttaggatcgcaagaaggagcaatgcacactgctttaacaggagccacagaaatccaaacaagcggcacaactacgatatttgcaggacatctaaaatgcaggcttaaaatggacaaactaacattaaaaggaatgagttatgtgatgtgcacagggagttttaaattagaaaaagaagtggctgaaacgcagcacggaaccgtattggttcaagtaaagtatgaagggacagatgccccctgcaaaataccattctcaactcaagacgaaaaaggcgtaacacaaaatggaagattaataacagctaatccaatagtgaccgacaaggaaaaacccgttaatatagaaactgaacccccgtttggagaaagttatatagtagtaggagctggagaaaaggctttaaaattgagctggtttaaaagaggtagttcgataggaaaaatgttcgaagcaactgcacgaggtgccaggaggatggcgattttgggagatacggcctgggacttcggaagcataggcggggtatttacgagtgtcggtaaattagtacaccaagtcttcggcacagcctatggagtgctattcagcggagtttcttggacaatgaaaataggaatagggatattattaacttggttagggctcaactcgcggagtacttctttaagcatgacgtgtattgcggtaggaatggtaacgttgtacctcggagtaatggtgcaggctgatagcgggtgcgtcataaattggaaaggcagggaactcaaatgcggatcgggaatctttgtaactaatgaggttcatacctggacagaacaatataaatttcaagctgactctccaaaacgcttaagtgcagctataggtaaggcgtgggaagagggtgtatgtggtattagatctgcgactcgtctagaaaatattatgtggaaacaaataagtaatgaactaaaccatatactactagaaaacgacatgaaatttaccgtcgtagtgggggatgcaaatgggattctagcacaaggcaagaaaatgatacgaccccaaccaatggaacataaatactcgtggaaatcctggggaaaagccaaaataataggtgcagatatccagaataccacgttcataatagatggcccggacacaccagaatgccctgatggccaaagagcatggaatatatgggaagtggaagattacggcttcggagtttttacgaccaatatttggttaaaattaagagattcttacacgcagatgtgcgatcacagactcatgtccgcagccattaaggacagtaaagcagttcacgcagatatgggttattggatagaatccgagaaaaatgagacatggaaacttgcgagggcgagttttatcgaagtcaaaacttgtacttggcctaaatcacatacactatggtccaatggtgtcttagagtcagaaatgataattccaaaaatattcggagggcctatctcgcaacataattacagaccaggttacttcacacaaacagcaggtccttggcacctaggtaaactagaacttgattttgatttatgtgagggcacgacggttgtggtggatgaacattgtgggaatcgaggtccgtctttgagaaccactactgtaactggtaaaataatccatgaatggtgttgtcgtagctgcactctccctcctctgcggttccgtggggaagatggatgttggtatgggatggaaataaggccagtaaaagagaaagaagaaaatcttgtaagaagcatggtctcagcaggctcaggtgaggtagacagttttagtttaggcatactgtgcgtatcgattatgatagaagaggtaatgagatcaagatggtcgagaaaaatgttaatgacaggtaccctcgcggtatttttgcttctaataatgggacaacttacttggaacgacctaatacgattatgcattatggtcggtgcgaatgccagtgaccggatgggcatgggcacgacctatttggcgttgatggccacactgaaaatgcgacccatgtttgccgtagggttactattcagacgattaacatcgagagaagttctactattaacaattgggctttccctggtagcaagcgtcgagctaccaaactccttggaagaattaggggatggattagccatgggtattatgatgcttaaactactaacggaatttcaaccacatcaactatggacaaccctattgagtctcacttttgtgaaaacaactctatcactagattatgcatggaaaaccactgccatggttttatcaatagtgtctttgtttcccctgtgtcttagtacaacgtcacagaaaactacatggcttccagttctcctgggatcatttggatgtaaacctctcactatgtttttaataacagaaaataagatttggggcaggaaatcatggcctttaaatgaagggatcatggcaataggaattgtatcgattctcttatcgtccctactgaaaaatgacgtacctcttgcaggcccattaatagctggaggaatgttaatcgcctgctatgtaatcagtgggtcatcagctgacttatcgttggaaaaggctgctgaagtatcgtgggagcaagaagccgagcatagcggggcttctcataatatattggttgaggttcaagacgatggcacaatgaagattaaggacgaagaaagagacgatacacttacaattctactaaaggcaactctgctggccgtttcgggcgtataccctatgagcataccagccacactgtttgtatggtacttttggcaaaagaagaaacagcggtcaggtgtactctgggatacaccttcgcctccagaagtagaaagagcagtcttagatgacggtatataccgtatacttcaaaggggactgcttggacgctcacaagtaggcgtgggggtttttcaagacggagtgtttcacactatgtggcacgtgacgagaggggcagtactaatgtatcagggaaagagacttgaaccaagttgggcgagcgtcaagaaggatctgataagctacggtggtggttggagatttcaaggaagctggaatacaggagaggaagtacaagttatagccgtcgaacccggcaaaaatcctaaaaacgttcaaacaacgccaggtacttttaaaactcctgaaggagaagtaggagccattgcgttagacttcaaaccaggtaccagtggatcacctattgtcaacagagaaggaaaaatagtcggcttatacggaaacggggtagttacaacaagcggaacttatgttagcgcaatagctcaagccaaagcatctcaggaagggcccttacctgagatcgaagatgaagtattcaaaaagcgaaatctcaccataatggacctccaccctggtagtggcaaaaccagaagatatctaccagcaatcgtacgcgaagcgataaaaaggaaactccgtaccttaatattggcgcccactagagtggtagccagcgaaatggcagaagccctaaaaggtatgccgattagatatcaaacaacagcggtcaaaagcgaacatacaggacgcgaaatagtagacttgatgtgccatgccacttttacaatgcgacttctatccccggttagagttcctaattacaatatgattattatggacgaggcgcattttaccgatccagcatcaattgcagccagaggatacatatctacaagagtaggcatgggtgaagcagccgccatctttatgacagccactcctccagggtcggtggaagcattccctcagtcaaatgccgtaattcaggatgaagaaagagatataccggagcgatcatggaactcggggtatgactggataactgattttccagggaagacggtatggttcgtaccttcaataaaaagtggtaatgacatagccaactgtttaaggaaaaatggaaaaagagttatccaactgagtagaaagacgtttgatactgaatatcagaagacaaagaacaatgattgggattacgtggtaacgaccgatatatctgaaatgggcgcgaacttccgggccgatagagtgatcgatcctagaagatgcttgaaaccggtaatattaaaggatgggccagaaagggtcatattggcaggaccaatgccagtcacagttgcatctgcagctcaaagacgaggaagaatagggcgcaatcagaataaagaaggtgatcaatacatctatatgggacagcctttaaacaacgatgaggaccatgcgcattggacggaagctaaaatgttattggataacatcaacaccccagaggggatcattcccgcgttattcgaaccggagagagagaaatccgcagcaatagatggagaatatagactacgaggcgaagccaggaaaacctttgttgaactaatgcgacgcggagatctaccggtttggctgtcgtacaaagtagccagcgagggctttcaatatagcgaccgacggtggtgttttgatggagaaaggaacaaccaagtgttagaagaaaatatggatgtcgagatatggactaaagaaggggagcgcaagaaactacgtccacggtggctagacgcacggacatacagcgatccattagcattacgagaatttaaggaatttgcggcgggcagaagatcagttagcggcgacttaatattggaaattggtaaactaccacaacatttgactttgagggcacagaacgcattagataacctcgttatgctacataattcagaacaaggagggaaagcgtatagacatgcaatggaagaattacccgacaccatagagacactaatgcttttagcactgatagcagtattgacgggaggagttactctgttctttttgagcgggaaaggcttgggaaaaacaagtataggtctgctctgtgtcacagcgtcttcggccttgttatggatggcctccgtcgaaccacactggatcgcagcaagtattattttagagttctttcttatggtcttgttaataccggaaccggatagacaaagaacccctcaggacaatcaattggcctatgttgttattggacttctatttatgatattaaccgtagcagcaaatgaaatgggattactagagactaccaagaaagatttaggaataggatatgtagcagctgaaaatcatcagcatgccacaatgttagacgtagacctccatccagctagcgcgtggacactgtacgctgtggcaacaacagtaattacgccaatgatgagacatacaatagaaaacaccactgctaacatcagcctaacggcaatcgccaaccaggccgccatcctcatgggactagataaaggatggccgataagcaaaatggacataggcgtgcctctcttagctttgggatgttactcgcaggtaaatccgcttaccttgacagcggctgttttgatgttagtagcacattacgcaataataggtcctggtttgcaagcgaaagcaacccgtgaagcgcaaaaacgaaccgcagcgggaataatgaaaaatcctacagtcgatggaatagttgctatagatttagatcccgtagtttatgatgcgaaatttgaaaaacaattaggccaaataatgctactaattttatgtacttcacaaatactcttgatgcgaaccacgtgggcactatgtgaaagtataactctagctacaggtccactaaccacattgtgggaaggctcacccggaaagttctggaataccaccatagcagtaagtatggcgaacatatttaggggttcatacttagcgggcgccggtcttgcctttagcctaatgaaatctcttggagggggacgacggggaaccggagcacaaggcgaaacgcttggagaaaaatggaaaagacaactaaaccagctttccaaaagcgaatttaatacatacaaaagatcaggtatcatggaagtagatagatcagaagccaaggaaggcttgaagcgtggggaaacgaccaaacatgcagtcagtaggggaactgccaaactacgatggttcgtagaaaggaaccttgttaaacccgaaggaaaggtaatagatttgggttgcggtagaggaggttggtcttattactgtgctggattgaagaaagtaaccgaggtcaaaggatatacaaaaggaggaccgggtcatgaagaaccgattccaatggctacatacggttggaacctagtgaaattacattcaggcaaagacgtatttttcatgccaccggaaaaatgtgatacgctgctatgtgatattggcgaatcgtctcctaatccaaccatcgaagaaggccgcacgctcagagtcctcaaaatggtagaaccatggctgcggggaaatcaattctgcattaagatactgaatccatatatgccgagtgtggtagagacgttagagcaaatgcaaagaaaacacggtggcatgttggttagaaatccgttaagtcgcaatagcacacacgaaatgtactgggtatcttgcggtacaggaaacatcgtgtccgcagttaacatgacaagcaggatgttactaaatagatttacgatggcacacagaaagccaacatacgaacgtgatgtggatttaggggctggaaccaggcacgtggctgtagagccagaagtcgctaaccttgatataatcggccaacgaatcgaaaatatcaaaaatgaacacaaatccacctggcactacgacgaggataacccctacaaaacatgggcttaccatggttcttatgaagtcaagccgtccggcagcgcatcaagcatggtaaatggcgtagtaagacttcttacaaaaccttgggatgtcataccaatggtaacacaaattgctatgactgatacgaccccttttggacagcagcgtgtttttaaggagaaggttgacactagaactccaagggccaagcgaggtactacacagattatggaagtaaccgcaaagtggttatggggctttttaagcagaaataaaaagcctagaatctgcacccgtgaggaatttacccggaaagtgagaagcaacgcagcaattggtgctgtatttgtggatgagaaccagtggaactctgctaaggaagccgttgaggatgaaagattctgggatttggttcaccgtgagcgagaactacacaaacaagggaagtgcgccacatgtgtttataacatgatggggaaacgagagaagaaactaggcgaatttggaaaagctaaaggttcacgcgccatatggtatatgtggcttggagcgagattcctagaatttgaagctctcggatttatgaatgaagatcactggttcagtagagaaaattcactgagcggtgtggaaggtgaaggcctacacaaattaggttacatacttcgagacatatcgaaaattcccgggggaaatatgtatgccgatgataccgcaggctgggacactagaataacagaagatgatcttcaaaatgaagctaaaatcaccgacattatggagcccgagcatgcattattagctacttcgattttcaaactgacatatcaaaacaaagtagtaagagtacaaagaccggctaaaaacgggactgtcatggatgtaataagcagaagagatcaacgtggctcaggccaggtcggaacctacgggctaaatacatttacaaatatggaagtccagctcatacgacaaatggaatcagaaggcatatttttaccgagtgaattagaaacgccaaacttagcagaacgggcattggactggttagagaagcatggtgctgagcgtttgaaaagaatggcaattagcggagatgattgtgttgtcaaacctatagacgatcgctttgcgacagcactaacagctcttaatgatatgggtaaagttagaaaagatattccccaatgggagccctcaaaaggttggaacgactggcaacaggttcccttttgtagccatcattttcaccaattaataatgaaagacggtagggaaatagtagtcccttgtagaaatcaagatgagttagtggggcgggcaagagtgtctcaaggagcaggctggagtttgcgagagacagcttgcctaggcaagtcatatgcacaaatgtggcaactaatgtattttcatcggcgcgatctgcggctagctgcaaacgcgatatgtagtgcagtcccagtcgattgggtccctgcgtccagaacaacatggtcgatacacgcccaccatcaatggatgactacagaagacatgctgagcgtgtggaatcgagtatggatagaggaaaacccgtggatggaagacaaaacacacgtctcaagttgggaagaggttccatatctaggtaaaagagaggaccaatggtgcggctctcttataggactaacagcacgcgctacctgggcaacaaatattcaagtagcaatcaatcaggtaagacgtttgataggtaatgagaactacctagactatatgacctcaatgaaaagatttaagaatgaatctgatcctgagggagctctatggtga

SEQ ID NO: 21094 - RNA, 9879 nt, synthetic construct
  misc_feature 1..9879: note = derived and/or modified CDS sequence (opt6) from DENV-1__JX669464__SS-prME
  source 1..9879: mol_type = other RNA
agcgtgacaatgttattaatgttattaccaacagcgctagcattccacctcactacgaggggaggagaaccacatatgattgtttcaaaacaagagagagggaaatcattgctttttaaaacatctgtgggagttaatatgtgtacattaatagcgatggacttaggtgagctttgtgaagacacaatgacttataaatgtccgagaataacagaagctgaaccggacgatgtagattgttggtgtaatgcaacagatacatgggtcacatatggaacatgttcacaaacgggagaacacagacgcgacaaacgctcagttgcgttagcacctcacgttggattaggacttgaaacaagaacggaaacctggatgtcgtcagaaggagcttggaaacaaatacaaaaagttgaaacgtgggcattgaggcatccaggattcacagttatagcactttttctggcacatgctatcggtacctcaataactcagaaaggaataatattcattttgttaatgttagtcaccccttcgatggccatgcgttgtgtcggaatcggtaacagagatttcgtcgaagggttatcaggagcaacgtgggtagacgttgtacttgaacatgggagttgtgtcacaacaatggccaaaaataaacctactttagacattgagttgttaaaaaccgaagttactaatccagccgtcttgagaaaactgtgcattgaggctaaaatttccaatacgacaacagacagtcgatgtccaacacaaggagaagcaacattggtggaagaacaagatgctaattttgtctgtaggaggacttttgtcgacagggggtgggggaatggctgtgggctctttggaaaaggatcgctgcttacttgtgcgaaatttaaatgtgtcacaaaactagaagggaaaatagttcaatatgaaaatttaaagtactcggttatagttacagtacacactggcgatcaacatcaagtaggtaatgaaacaactgaacacggtacgatagcaactataactccccaggcacctacaagtgaaattcagctaactgattatggagccttaacactcgactgctccccaagaacaggtcttgattttaacgaaatggtgttactaactatgaaagagaaatcatggctagttcacaaacaatggttcctagatctaccattaccctggacttcaggggcttcaacatctcaggaaacctggaatagacaggatttacttgtgacgtttaagaccgcacatgctaagaagcaagaagtagtcgtattaggcagccaagaaggtgcaatgcatacagcactcacaggtgcaacggagattcaaaccagtggtacaacgaccatctttgcaggacatctaaaatgccgcctcaagatggacaaattaacactaaaaggaatgtcgtacgttatgtgtacaggaagtttcaaacttgagaaagaggtggcagaaacacaacatggtacagtactcgtccaagttaaatacgaaggaactgatgcaccttgtaaaataccgtttttaactcaagatgagaaaggagtaactcagaatggacgtctgattacagctaacccgattgtaaccgacaaggaaaagccagttaatatagaaacagaacctccttttggggagagttatatcgtggtaggcgctggagagaaagcgctgaagctatcgtggtttaaaaagggaagttcaataggaaaaatgttcgaagccaccgcaagaggagcacgcaggatggcaatcttaggggacacagcatgggactttgggtcaattggcggtttatttacaagtgtcggaaagctaatacatcaagtatttggaactgcatacggtgtattgttttcaggggtcagttggacaatgaaaataggcattggtatattactaacatggttgggccttaatagtagaagcacatcattgagtatgacatgtattgcagtaggaatggtaacattataccttggggtgatggtccaagctgattcaggttgcgtaattaattggaaaggcagagaattaaagtgcgggagtggcatatttgttacaaacgaagtgcacacctggacggaacaatataagttccaagcggattcaccgaaacgtttatcagcggcgatcggaaaagcgtgggaagaaggggtttgtggtataagatcggcaacaagactggaaaacattatgtggaaacaaatatcgaatgaattaaattacattttattggaaaacgatatgaagttcacagtagttgttggagacgtaaatggtatattagctcaaggcaagaaaatgataagaccacaacccatggaacataagtatagctggaaatcatggggaaaagctaaaatcatcggcgccgatattcaaaacaccacatttataattgatggtccggatacgccggagtgcccagatgatcaacgggcttggaatatttgggaagtagaagattatggctttggaatattcacgacaaacatatggcttaaactccgggatagtcatacacagatgtgtgatcacaggctaatgtccgccgctataaaagacagcaaagctgtacatgctgatatgggatactggatcgaatcagagaagaatgaaacatggaaacttgcgcgagcgtcatttattgaggtaaaaacatgtatatggccgaaatcgcatactttatggtcaaacggggtgctggaatcggagatggtaataccaaaaatatatggaggcccaatcagtcagcataactacagaccagggtatttcacgcaaactgcaggtccatggcatctcggtaaactggaattggacttcgacttatgtgagggcacgactgtagtcgtggatgaacattgcgggtaccgaggtcccagtttacgaacaaccacagtgacaggaaaaattattcatgaatggtgttgccgatcttgtactttacccccattgaggttccgtggtgaagacggttgttggtacggtatggaaatacgcccggtaaaagagaaagaggaaaatcttgttagatcgatggtttctgccggatcaggagaaatggatagtttctcactaggaatattatgtgtatctatcttaatcgaagaagtaatgagatcacgctggtctcgtaaaatgttgatgacaggtactctggcagtatttttgttattaataatgggacaactaacatggaacgacttaatacgattgtgtataatggtaggagctaatgcgtcagaccgaatgggtatgggaacgacgtatctcgcgttaatggccacctttaaaatgcgtcctatgttcgctgtggggctcttgtttcgccgattaacgtctagagaagtgttactgctgacggtaggtctatctttagttgcatcagtagaattacctaattcacttgaagaactaggagacggcttagcgatgggcataatgatgctcaaattactgacagacttccagccacaccagctttggacaaccctactctcactaacgtttattaggacaagccttagcttagactatgcctggaagaccatggcaatggcgctatccattgtatcactatttccattgtgcttgagcacaacttcacagaaaactacttggctacccgttctattaggcagctttgggtgcaaacccctaactatgtttctaatcacagaaaataaaatttgggggcgaaagtcatggcctataaatgagggaattatggctgttggtattgtttctatcttattgagttcattactcaaaaacgatgtaccgttggcggggccattaatagcaggagggatgctaatcgcttgctacgtaatctcaggatcctcagcagacttaagcctagaaaaggccgctgaagtatcctgggaggaggaagccgaacattcggggacatcccacaacattctggtcgaagtccaagatgacggtacaatgaaaattaaagatgaagaaagagatgataccctcacaattctcctaaaagccacacttttagcagtatcaggagtttaccctatgtcaataccggcgacattatttgtttggtatttttggcaaaagaagaaacaacgcagcggtgttctttgggatacccctagcccgccggaagttgaaagagcagtattggatgacggtatatataggattcttcaaagagggctcttaggtagatcgcaggttggcgtaggggtcttccaagatggggtctttcatacaatgtggcacgtcaccagaggcgcagtcttaatgtatcaaggcaaaagactagaaccaagttgggcctcggtgaagaaagatttaatctcctacggcgggggttggcggttccaaggatcttggaatacgggagaagaagtacaagtaattgcggtagagccaggtaaaaaccctaaaaatgtccagactactccaggaacatttaaaattccagagggcgaagtgggagcaatagctctagacttcaaaccgggtacatcaggaagtcctatagtaaatcgagaaggaaaaattgtaggattgtacggaaatggagttgtaacaacttctggaacgtatgtatccgccatagctcaagccaaggcaacccaggaaggacctttaccagaaattgaggatgaagtatttaagaaaagaaacctgacgatcatggatctacacccaggtagcggaaaaacgaggagatacttacctgcgattgtccgagaagcgataaaaagaaagttaaggactctcatattggcgcctacacgtgttgtcgccagcgaaatggcagaagcccttaaaggaatgcccattaggtatcaaacaacagccgtgaaatcagagcacactgggcgggagattgttgatcttatgtgtcatgcaacgtttactatgagattactgagtcccgtacgggtacctaattacaatatgattataatggatgaagcacattttacggacccggccagcatagcagcgagggggtacatatcaacaagggttggaatgggcgaagcggcagctatatttatgactgcaacacctcccggatccgtcgaggcgttcccccaatcaaacgcagtaatacaagatgaagagagagatataccagagcgatcatggaacagtggttacgattggatcactgactttcccgggaagaccgtatggtttgtcccatccataaaaagtggtaatgatatcgcaaattgtctccggaaaaacgggaaaagggtaatccaattgagtcgcaaaaccttcgacaccgaatatcagaaaaccaaaaacaatgattgggattatgttgttacgacagatattagcgaaatgggggctaacttccgcgcggacagagtgatagatccaaggagatgtcttaaacctgttattctgaaagagggcccggaaagagtaattctagcaggtccaatgccggttacagtcgcatcagcggcacaaagaaggggtaggatagggagaaatcaaaataaagaaggagatcaatatatctacatgggacagccattgaacaatgatgaagatcatgcccattggacagaagctaagatgcttttagataacatcaacacaccagaaggtataattcctgctttatttgaacccgaaagggaaaaatcggctgcaatcgatggagaatacagactaagaggagaagccaggaaaaccttcgtggagttaatgagaagaggcgatctgccagtctggttgtcgtataaagtagcttctgagggtttccagtactccgatagaaggtggtgctttgacggcgagcgaaataaccaagtactagaggagaatatggatgttgagatctggaccaaagaaggagaacgcaagaaactccgcccgagatggttagatgccagaacatactcggatccactggcactacgagaatttaaagaatttgctgcaggacgcaggagcgtatcgggagatcttatattagagatcggaaaattgccgcagcatttgacccttagagcccagaacgcacttgataacttagtaatgttgcacaactctgagcaaggaggaaaagcgtatagacatgcgatggaggagctcccggataccatagaaaccctcatgttattagcactgatcgctgtacttaccgggggagtaaccctattctttctgtcgggaaaaggattagggaaaacaagtattggattattgtgcgtcatggcgagtagtgcacttttatggatggcctccgttgaaccgcactggattgcagcctcaataatcctagagtttttcttaatggtcctgctaatacccgaacccgaccgacaaagaacgccgcaagacaaccaactggcatacgtcgttattggtttgctattcatgatattaacagtagcagctaacgagatggggctcctcgagacaacaaagaaagatttgggaattggtcatgttgcagtcgaaaatcatcaccacgcgacaatgttggacgtcgatctgagaccagcgagcgcatggacgctatacgcggtagcgactacagtcataacaccaatgatgcgacacaccatcgaaaatacaacagcaaatatcagtttaacagcaatagccaatcaagcagccatattgatgggtttggataaaggatggcctataagtaaaatggatatcggagttccgttattagccctgggatgctactcacaagtaaatccattaactctcactgcagcagtattaatgctagtcgcacattatgcaattatcgggccagggttacaagcaaaagctactcgagaagctcaaaagcgaaccgcagctggtataatgaaaaatcctaccgtggatggtatagtaacgattgatctggatccagtggtgtatgatgcgaagttcgaaaaacagttgggtcagataatgctattaatcttatgcacctcacaaattttactaatgagaacaacgtgggcactgtgtgagagcatcactctagcaacaggcccactgaccacgctctgggaaggaagtccgggcaagttttggaacaccacaatagcggttagtatggccaacatattcagaggttcttacctggcaggcgcaggacttgctttttcattaatgaagtcactagggggtgggagacgagggactggagcacagggagaaacactaggagaaaagtggaaaagacagctaaaccaactttctaagagtgaatttaacacatacaagaaatcagggattatggaagttgaccgctcggaggccaaagaaggactaaaaagaggagaaacaacaaaacacgcggtcagtcgaggaacagccaaattacggtggtttgttgaaagaaacttagtaaaacctgagggcaaagttatcgatttaggatgtggtcgaggcgggtggagttattattgcgcaggattaaagaaagttacggaagtaaaaggctatacaaaagggggacccggtcatgaagaaccaatacctatggctacctatggatggaatctagttaagctacacagtggtaaagatgtattctttacacctccggaaaaatgtgatactctgctttgcgacatcggagaatcctcaccaaatccaacgatcgaggaaggccgtactttaagggtgttaaaaatggtagaaccatggttacgtggtaaccaattctgtataaaaatactcaatccgtacatgccatctgttgtagaaacacttgagcaaatgcaacggaaacatggaggcatgttagtaagaaatcctcttagtaggaacagtacccacgaaatgtattgggtaagttgtggaacaggcaatatagtaagcgccgttaatatgacttctcgtatgttgttaaacagattcaccatggcgcaccgaaaaccaacatacgaaagggatgtagacctaggagccggaacaagacatgttgcagtggaacccgaagtcgcaaacttagatataattggccaaagaattgaaaacattaaaaatgaacacaaaagtacctggcattatgatgaagataatccgtacaaaacgtgggcgtatcacggatcttacgaagtaaaaccaagtggttcagccagctctatggtcaacggcgttgtcagattgttaacaaagccgtgggatgtgatcccaatggttactcaaatagccatgaccgacactacaccattcggccaacaaagagtattcaaagaaaaggtggacacgcgaacaccgagagcgaagagagggaccgctcagattatggaagttactgcaaagtggctatgggggtttctgtcacgaaataaaaagccgcgtatttgtacacgagaagaatttactaggaaagtccgatctaatgcagcaattggagcggtattcgtcgacgaaaaccagtggaactcagcaaaagaggcagttgaagatgaacgtttttgggacctagttcaccgcgaaagagaacttcacaagcaaggaaaatgtgccacttgtgtctacaatatgatggggaaaagagagaagaaacttggcgaatttggtaaagccaaagggtcacgtgcaatatggtatatgtggctgggggcccgattccttgaatttgaagcattaggatttatgaatgaggatcattggttttcacgtgaaaatagcctgtcaggtgttgaaggagaagggctacataaattaggctacatacttcgagacataagtaagattccaggtggcaacatgtatgcggatgatactgcgggatgggatactaggatcacggaagatgaccttcaaaatgaagcgaagataacagatatcatggagccagagcacgcgcttttagcaacaagtatcttcaaattaacctatcagaataaagtggtaagagtccagagaccagcaaagtcagggacagttatggacgtgataagtcgacgggatcaaagagggtcagggcaagttggaacatacggtctaaatacattcactaatatggaggtacaactaataagacaaatggaatctgaaggaatcttcttacctagtgaactagaaacgccaaatctagcgaaaaaggtcttagattggcttgaaaaacacggagccgaaagactgaagagaatggctatcagtggcgacgactgtgtggtaaaaccaattgacgatcggtttgctacagcactaacagctttgaacgatatggggaaggtcagaaaagacataccccagtgggagccatcaaaaggttggaacgattggcagcaagtaccattttgttcacatcattttcatcaattaattatgaaagacggtagggaaatagtggtaccgtgtagaaaccaggatgaattagtaggcagagcaagggtctcacaaggcgcaggatggagccttcgggaaaccgcttgtctcgggaaatcatacgctcaaatgtggcaactaatgtatttccaccgacgggatcttcgcttagcagcaaatgctatctgcagtgcagtaccagtagattgggtcccgacgagtaggacaacatggtcaattcacgctcatcatcagtggatgactactgaagatatgttaagtgtatggaatagggtctggattgaagaaaacccatggatggaagacaaaacacatgtttccagctgggaagaggtgccttatttgggtaagcgagaagaccaatggtgtgggtcactaataggactgacggcacgagcgacctgggccacaaatatacaagtagcaattaatcaagtaagaaggctaattggtaatgaaaattatttagattacatgacatctatgaagagattcaaaaatgaatcagatcctgagggcgcattatggtaa

SEQ ID NO: 21095 - RNA, 9879 nt, synthetic construct
  misc_feature 1..9879: note = derived and/or modified CDS sequence (opt6) from DENV-1__JX669465__SS-prME
  source 1..9879: mol_type = other RNA
agtgttacaatgttattgatgttacttccaactgcactagcatttcatctaactacacgaggcggtgaaccacacatgatagttagtaaacaggaacgagggaaatccctactttttaaaacttcagtaggggtaaacatgtgcactcttatagcaatggatttgggagaattatgtgaagatactatgacatataaatgtcccagaataaccgaagccgagccagacgatgtcgattgttggtgcaatgcaacggatacttgggtgacatacggcacatgtagccaaacgggtgaacaccgtagagataaaaggagcgttgccttagcaccacatgtaggcctcggactagagacaagaacagaaacttggatgtcgagtgagggggcttggaaacaaattcaaaaagtggaaacatgggcacttagacatccaggatttacagtaattgctttatttttggcacatgctatcggaacaagtataactcaaaaaggaatcatattcatactacttatgttagtcactccatcaatggcaatgaggtgcgttggaattggaaatcgtgattttgttgagggactgagcggagccacctgggtggacgtcgttctcgagcatggctcgtgtgtcacaactatggccaaaaataaacccacgctagacatcgaattgcttaaaacggaagtaacaaatccagcagtattacgaaaactatgcatcgaagctaaaatatcaaataccacaacggactcgaggtgcccaacccagggagaagcaactcttgtagaggagcaggatgcgaactttgtctgcagaagaacatttgtcgataggggttggggaaatggatgcggcttatttggaaaaggatccctacttacttgtgcaaaatttaaatgtgtgactaaattggagggcaaaattgtacagtacgagaatctaaaatactcggtaatagtaactgtccacaccggtgatcaacaccaagttgggaacgaaactacggaacacggcaccattgcgactatcacgcctcaagcccccacaagtgaaatacaacttacagattatggagcattgactctggattgttcaccacggacaggtctagattttaatgaaatggtactgctaacaatgaaagaaaaatcatggctagtgcataaacagtggtttttagatcttccgctcccatggacctcaggcgcaagcacctcacaagaaacatggaatagacaggatttacttgtaaccttcaaaacagcgcatgccaagaaacaagaagttgtcgtattaggaagtcaagaaggagccatgcacactgcgctgacaggcgctacagaaatacaaacctcgggcactacaactatatttgcaggccacttaaaatgtagactgaaaatggacaaactaacacttaaaggaatgagttacgtcatgtgtactgggagcttcaaactagagaaagaagttgccgaaacacaacatggaactgtattggtacaagtaaaatacgaaggcacagatgcgccgtgtaaaataccgtttttgacacaggacgaaaaaggtgtaacacaaaatggacgattaataaccgctaacccgatagttacagataaagaaaaacctgttaacatagaaacggagccgccttttggtgaaagctatatcgtcgttggagctggtgaaaaagcacttaaattatcatggtttaagaaaggttcctcaataggaaaaatgtttgaagctaccgcaaggggcgccagaagaatggccatacttggagacacagcgtgggatttcggaagcataggcggactatttacttccgttggcaaacttattcatcaagtatttggaacagcgtatggcgttttgttttcgggggtatcctggaccatgaaaataggtatcggaatattgctcacttggctgggattaaattcaagaagtacatcattaagtatgacgtgtatagcagttggaatggtgacgctatacctaggagtaatggtacaagctgattcaggatgcgtaataaactggaaaggccgagaactaaaatgcggaagcggaatttttgtaaccaatgaagtacatacatggacggaacagtacaaattccaggcagattcgccaaaaagactaagtgcagcaattggtaaggcctgggaagaaggcgtgtgtggaatacgaagtgccactcgtctagaaaacataatgtggaaacagatctcaaacgagcttaattacatacttttagaaaatgacatgaaattcactgtagtagtaggcgatgtgaatggtatactagcgcaagggaagaaaatgatcagacctcagcctatggaacacaaatactcttggaaaagttggggaaaggccaagataatcggtgcagacacccagaatacaacattcataatcgatgggccagatacaccagaatgtcctgatgatcaacgagcttggaacatatgggaagtagaggattacgggtttggcatttttacaacaaatatatggttaaagttaagagatagccatacgcagatgtgtgatcacagactaatgagtgccgctattaaagattctaaagcagttcatgccgatatgggatattggatagagagtgagaaaaacgaaacatggaagctggcaagagcctcatttatcgaagtaaaaacatgtatttggccaaaatctcatacgttgtggtcaaatggggttctcgaaagtgagatggtcataccaaagacctacggtggtccaatttcgcaacacaactacagacctggttactttacacagactgcaggtccttggcatctaggtaaacttgaactagactttgatttatgcgaagggaccaccgtagtcgtagacgaacactgtggctatcgcggacctagtttaaggacaacaacagttacgggaaagattatacatgaatggtgttgtaggtcatgtactttaccccctcttcgttttcgcggggaagacggatgctggtatggtatggagattaggccagttaaggaaaaggaagagaatctagttcgctcgatggtatccgcaggttcaggtgaaatggacagcttttcattagggattttatgtgtaagtatcttaattgaagaagttatgagaagtcgttggtcacgcaaaatgttgatgacgggaacccttgctgtcttcttactattaattatgggacagctgacatggaatgaccttatacgtctatgcattatggtgggcgcaaacgcaagcgaccgaatgggaatgggtaccacataccttgcccttatggctacctttaagatgagacctatgttcgcggtgggtttactgtttcgacggttaacgtctagagaagtgttactactaactgtcggattgagcctagtcgcatcagtagagttgcctaactccttagaagaattaggcgatggattagcaatgggtatcatgatgttaaagctcttaacagattttcaacctcatcaattatggactacgctcttatctctcacttttatccgaacaagccttagcctagattatgcttggaaaacgatggccatggctctaagtatcgtatcattattcccattatgcctatctactacgtcgcagaagaccacctggctacctgtattacttggtagctttggttgcaagcctttgacgatgttcctgattacggaaaacaaaatatggggtagaaaatcttggccaataaacgagggtataatggcagtgggtatcgtatcaatactgctctctagtctcttgaaaaatgacgtaccactagctgggcccctaatagcgggagggatgttaatagcgtgttacgtaataagtggcagcagtgctgacctttccttagaaaaagcggcggaggtgtcatgggaagaggaggcggaacactcagggacgtcacataacatcctggtagaagttcaggatgatggtacaatgaagataaaagatgaagaaagagacgatacattaacaatactcttaaaagcgactctacttgccgttagtggtgtttatcctatgtcaatacctgccactcttttcgtgtggtatttttggcagaagaagaaacaaaggagtggtgttttatgggacactcctagtccacctgaagtagaaagagcagttttagacgacggtatatacaggatattgcaaagaggtttattgggtagaagtcaagttggcgtaggggtattccaagatggagtttttcatacgatgtggcacgtgacgagaggagctgttttgatgtaccaaggcaagagattagagccaagctgggcatcagtcaagaaagatttaatatcatatggaggcggctggaggtttcaaggttcctggaatacaggcgaagaagttcaagttattgcggttgaacctgggaaaaatcccaagaacgttcagactaccccgggaacatttaaaaccccagaaggagaagttggagcaatcgcactggacttcaaaccaggcacatcaggaagtcctatagtaaacagagaggggaagatagtaggtctatatggaaatggagtagttacaacatctggcacgtatgtatccgctatagcacaagcaaaagccacccaagaagggcccttaccagaaattgaagatgaagtatttaagaaacgaaatttaacaataatggatctacatcctggtagtggaaagacgagacgttacctaccagcgatcgtgagagaagccataaaacgaaagttacgaacacttatacttgcccccacaagggtagtcgcatcagagatggccgaagccttaaaaggtatgccgatacgatatcagaccacagctgtaaaatctgaacatacaggaagagaaatcgtagacctcatgtgccacgccacgtttacgatgcgactactttcccccgtaagggtccccaattataatatgattatcatggatgaagcacacttcacagatcccgcctccatagccgctcgagggtatattagtactcgagtagggatgggagaagctgctgcgatttttatgacagcaaccccacccggatctgtcgaggccttcccccagtctaacgctgtaattcaagatgaagaacgagacatcccagagcgtagttggaactccggatacgattggataacggattttcccggaaaaactgtctggtttgttcctagcataaaatcaggtaacgatatagctaattgcctccgcaagaatggaaaacgagttattcaattaagtagaaaaacttttgatactgaatatcaaaagactaaaaataatgactgggattatgttgtcaccacagacatttctgaaatgggcgccaattttagagcagaccgcgttatcgatccacgacgatgtcttaaaccagtgatattaaaagaaggaccagagagggtgatattagccgggccgatgccagtcacggtagcctcagcggcgcaaaggcgaggtcgaatcggccgaaatcaaaacaaagagggtgaccagtatatttatatgggccaaccactgaataacgacgaggatcatgcacactggacggaagctaagatgctcttagacaatattaatactccagaaggtattatccctgcgttgttcgaaccggaaagagagaaaagcgccgctatagatggtgagtatcgtttacgaggtgaagctaggaaaactttcgtagaattaatgagaagaggagacctccctgtttggctcagttataaagttgccagtgaaggatttcaatatagtgatcgaaggtggtgttttgatggtgaaaggaataatcaagttttagaggaaaatatggatgtcgagatctggaccaaggaaggagaaagaaagaaattgcgtccacgatggcttgacgccagaacgtattcagatcctttagctctgcgagaatttaaagaatttgcagctgggagacgatctgtgtctggagatcttattcttgaaattggaaaactacctcaacacttaactctgcgagcacaaaatgctttagataacttagtgatgctgcacaatagtgaacaaggaggaaaagcatatagacatgcaatggaggaattgccagatacaatcgaaacactaatgttattggccctaatagcagtactaactggaggagtaactctcttctttctgtctggaaagggtctgggaaaaacttcaatagggttactatgtgtgatggcttcaagcgcattgctatggatggcttcagtcgaaccccattggatcgccgcttccataatcctggagttcttcctgatggtcttactgatacccgaacctgatcggcaaagaacccctcaggataatcaattagcatacgtagttatcggcttactatttatgatcttgaccgtcgccgctaacgaaatgggtttacttgaaacaaccaagaaagacctaggcattgggcatgtggcagtcgagaaccaccaccatgcaacaatgctagatgtcgatttgagaccagccagcgcttggactctttatgcagtagcaacaactgtaattacaccaatgatgaggcacacaatagaaaacacaaccgcaaacatctcgctgacagcaatcgcaaatcaagctgccatattaatggggttagataagggatggccaatctcaaaaatggatataggcgtccctctacttgcattgggttgttactcgcaagttaacccgcttaccctaacagcagcagtattgatgctcgtggcccactacgcaataatcgggccaggattacaggctaaagcaacgcgagaagctcaaaaacgaactgctgccggcataatgaagaatcctactgtcgatgggattgtgacaatcgatttagatccagttgtatacgacgcaaagttcgaaaaacaactagggcaaataatgttgttaatactgtgcactagccaaatcctattaatgaggactacgtgggcattatgcgaatctataacattggccactggcccgctaaccactctctgggaaggatcgcctgggaaattttggaacacaacgatagccgtatccatggcaaatatatttaggggaagctatttggcaggagccggtctagcgtttagtttaatgaaaagtctaggtggaggcagacgaggcacgggcgcacagggggagactttaggagaaaaatggaaacgccagctgaaccagctaagcaaatcagagtttaacacttataagaaatcaggcattatggaagtagatcgaagcgaggcaaaagaaggcctcaaacggggagaaacgacaaaacatgcagtgtcacgcggtacagcaaaacttcggtggtttgtagaaagaaatctagtcaaaccagaaggtaaagttattgacttagggtgtggacggggaggttggtcgtattattgtgcagggttgaagaaagtcactgaagttaaaggatatacaaagggaggtcctggacacgaggagccaattcctatggcaacttacggatggaatctagtaaaactacatagcgggaaagacgtgttctttacgccgcccgaaaaatgcgacactttattatgcgatataggggaatcctctcccaatccaacaatagaagaaggacgcacattgcgcgtattaaaaatggtagaaccctggttacgtggtaatcaattctgtattaaaatattaaacccatatatgcctagcgtggtggaaacacttgaacagatgcaaaggaagcatggaggtatgttggttcggaacccgttatcgcgcaatagcacgcatgaaatgtattgggtttcgtgcggtactggaaatatcgtttcagcagtcaacatgacttcacgaatgctcctaaataggttcacaatggcacatcgtaaaccaacctatgagagagacgtcgatttaggagcgggtacgagacatgtcgccgtagaacccgaggtcgcaaatttagatattattggacaaagaattgagaacatcaaaaatgaacacaagagtacatggcattacgatgaagacaatccgtataagacatgggcttatcatggaagctacgaagtgaaaccatctggtagcgcaagctcaatggtcaacggagtagtccggttacttacaaagccgtgggacgtcataccaatggtaactcagatagcgatgacagatacaaccccttttggtcaacaaagggtgttcaaagaaaaagtcgacacgaggactcccagggctaaaagggggacagcacaaattatggaagtaacagctaaatggttgtggggattcctctccaggaataagaaaccacgcatctgtacacgagaggaatttactagaaaagtgaggtcgaatgccgcgattggagctgtctttgtcgacgagaaccaatggaacagtgctaaagaagccgtcgaagacgaaagattttgggatctggtgcatagggaacgtgagttacacaaacaaggtaaatgtgcaacttgcgtttacaatatgatgggtaagagagagaagaaactgggagagttcggtaaagcgaaaggtagtagagctatctggtatatgtggctgggagcacgcttcttagagttcgaagcactagggttcatgaatgaagatcactggttctctagagaaaacagtttatccggagtagaaggtgagggcttacacaaattaggctacattctgcgcgacatttccaagataccaggcggtaatatgtacgctgatgacacagccggatgggatacacgcataaccgaagatgatctacaaaatgaagctaaaataacagatatcatggaaccggaacacgctctgttagccacgtctatattcaaattaacatatcagaataaagtagtaagggtacaacgacccgcaaaatctggtacagtcatggatgttataagccgacgggatcaacgaggaagcggacaagtaggcacatacggtttgaataccttcacgaatatggaggtgcaacttatccgacaaatggaaagcgagggaatatttagcccctcagaactagagacacccaatctagcgaagaaagttttagactggttagagaaacacggtgcagagagacttaaacgcatggcaattagcggagacgattgcgtagtgaagccaattgacgatcgattcgctacggcgctaacagcactaaatgatatgggaaaaatacgaaaagatattccacaatgggaaccgtccaaaggctggaacgattggcaacaagttccgttctgcagtcatcacttccaccaactaattatgaaggatggacgagaaatagtagtaccgtgcagaaaccaagatgagctagttggtagagcaagagtgagtcaaggagccggttggtcattgcgcgaaactgcttgtctaggaaagtcttacgctcaaatgtggcaactcatgtattttcaccgccgagatttacgtttagcagcgaacgcaatctgttcagcagtgccagtggattgggtgccaacatctcggacaacttggagtatacacgcacatcatcagtggatgacaacagaagacatgctatcagtatggaatcgagtatggatagaagagaacccatggatggaagacaagacgcatgtaagcagctgggaagaggtcccgtacctaggaaagagggaggatcaatggtgcggcagtctaataggtctcacagccagggcaacatgggcaacaaatatccaagttgctattaaccaagtcagaagactcataggaaatgagaattatctggattatatgacaagtatgaaacgatttaaaaatgagtcagacccggaaggagccctgtggtaa

SEQ ID NO: 21096 - RNA, 9879 nt, synthetic construct
  misc_feature 1..9879: note = derived and/or modified CDS sequence (opt6) from DENV-1__JX669466__SS-prME
  source 1..9879: mol_type = other RNA
agcgtaactatgctactaatgcttttacctacagcacttgcatttcatttgaccacacgaggaggtgaacctcatatgatagttagtaaacaagaaagaggaaagagcttgttgttcaaaacttcagcaggggttaacatgtgtacattgattgccatggatctgggtgaactctgtgaagatacaatgacatataaatgtccacgtataactgaagcggaaccggacgacgtagactgctggtgtaacgcgacagacacatgggtgacttatggtacttgcagccaaacaggagaacaccgaagagagaaacgttccgttgctttagctcctcatgtcggcctcggacttgaaactcgcacagaaacctggatgtcgagtgaaggggcatggagacaaattcaacgcgtagaaacttgggctctcagacatcctggattcacagtcatagcattcttccttgcacatgccataggaacaagtattacacaaaaaggaattatcttcatacttttaatgctagtgacaccgtctatggccatgagatgcgtcgggattggaaatagagacttcgtagaaggtttatcaggggccacatgggtggatgtagtattggaacatgggtcttgtgttacaacgatggctaaaaacaaacctacactagatatagaactactaaaaacagaggtaacaaaccctgccgtgttaaggaaattatgtatcgaggccaaaatatctaacacaaccacagattccaggtgccctactcaaggggaagcaacgctggtagaagaacaagatgcaaatttcgtctgtcgaaggacattcgtagacagaggctgggggaacggatgcggactatttggaaaagggtcattactaacctgtgcaaaatttaaatgtgtgaccaaattagaaggcaaaatagtacagtacgaaaacctaaaatacagtgtcatagtaacagtacatactggtgatcaacaccaagtcggaaacgaaactacggaacatggtacaatagcaacaattacaccacaagcaccaacatcagaaatacaacttaccgattatggcgctctgactctggattgttcgcctaggacaggattagatttcaacgagatggttctgctcacgatgaaagagaaaagttggctagtgcataaacagtggtttctggatctgccattaccttggacgtcgggggcaagtacatcacaagaaacttggaataggcaggatttattagttactttcaaaacagctcatgcaaagaaacaagaggtggtagtattgggaagccaggagggcgcgatgcataccgcacttactggagcgacagaaatacaaacctcaggaactactacaatattcgctggacatttgaaatgtcgcctcaaaatggacaaactgacgctaaaaggaatgtcatatgtgatgtgcacaggttcatttaaactggagaaagaagtagctgaaacacaacatgggacaatcctagttcaggttaaatacgagggaaccgatgcgccatgtaaaataccatttagcacacaagacgagaagggtgtaacacaaaacggacgactgatcactgcgaatcccatagtgacagataaagaaaagcctgttaacattgagaccgagcccccattcggggagagttatatcgtggtgggagcaggagaaaaggctttaaagttaagttggtttaaaagaggctcaagcatcgggaaaatgtttgaggcgacagcaagaggagccaggaggatggccatattaggtgataccgcatgggatttcggctcgataggaggagtcttcacatctgtgggaaagttagtgcaccaagtctttggaactgcttacggagtactttttagcggagtcagttggactatgaagataggaatcggcatattattaacgtggctaggattaaattcccggagcacttcattaagcatgacctgcatagctgtcggaatggttactttatacctcggggttatggtccaggcagatctaggatgcgttataaattggaaagggagggagctaaaatgcggatcaggaatatttgttaccaacgaggtacatacatggacagagcaatataaatttcaagccgactctcctaaaagattatccgcagcaattggaaaagcatgggaagaaggagtttgtggaatccgatctgctaccaggcttgagaatatcatgtggaagcaaatatcaaatgaacttaatcatattcttcttgagaatgatatgaaatttacggtagtggtaggagatgcaaacggtatcctcgcccaaggaaagaaaatgattcgcccacaaccaatggaacataaatattcttggaaaagttggggtaaagcgaaaattataggagctgatatacagaataccacgttcattatcgacggtccagacacaccagaatgccctgacggtcaacgagcttggaatatatgggaggtggaagactacggatttggggtttttaccacgaacatatggttaaaattaagagactcttacacacagatgtgcgatcatcgtcttatgtcagcagcaataaaggattcaaaagcagttcatgctgacatgggttattggatcgaatcagaaaagaacgaaacgtggaaactagcacgagcttcattcatagaggtcaagacatgtacttggcctaaatctcatacactatggagcaatggcgtattagagtctgagatgataatacccaaaattttcggcggacctattagccaacacaactaccgaccaggatactttactcaaacggcagggccatggcatctaggaaaattagaattggattttgatttgtgcgaaggcacaaccgtagtagttgatgaacactgcggtaaccgtggccccagtctaaggacaacgacagtaacaggcaagataatacatgaatggtgctgtcgttcatgtacactacccccacttagatttagaggtgaagatggttgttggtacggtatggaaattcgcccagttaaggaaaaagaagagaacctggtacggtcgatggtatcggcaggttcaggagaagtcgattccttctccctcggaatactttgcgttagcataatgattgaagaagtcatgcgttcccgatggtctcgaaaaatgcttatgactgggactctcgcggtatttttacttttgataatgggacagttgacctggaatgatttaataagactatgtataatggttggggccaatgcatctgacaggatgggtatggggacgacatatctagctctaatggcaacatttaagatgagacccatgtttgccgttggtttgctttttcgtagattaacctctcgagaagtactactccttacgataggactatcattagtagcttcggtcgaattaccaaattccctggaggaacttggagacggactagcaatgggcattatgatgctgaaactattaactgaatttcaacctcatcaattatggacgacgctattatcactgacatttgtaaaaacaaccctatctttagattatgcttggaagacaacagccatggtattgtctatagtttctctgttcccgttatgtctcagtacgacatcccagaaaacgacctggctgccagtattattaggatcttttggttgcaagccgctaacaatgtttcttataaccgagaataaaatatggggcaggaaatcatggcccctcaacgaaggaattatggctataggcatcgtgtcaatattactatcctcactgctaaagaatgacgtcccacttgccggccctttaatcgcaggaggcatgttaatagcatgttatgtcataagtggctcaagtgctgacttgagcttagaaaaagcagcggaagtttcatgggaacaagaagccgaacattcgggagcgagccacaatatattagtcgaggtacaggacgatggaactatgaaaataaaagatgaagaaagagatgacacattaactatcttgctaaaagcaactctactagcagtatctggtgtgtatcccatgtctattcccgcaacactgttcgtatggtacttttggcagaaaaagaaacaaaggagtggtgtattatgggatacaccgagtccccctgaagtggaacgggcagtactagacgacggtatttacagaattttacaacgaggtctcctcggcagatcgcaggttggtgtaggtgtatttcaggatggcgtgtttcatactatgtggcacgtaactagaggcgctgtactaatgtatcaaggcaaaagactagaaccatcatgggcttcggtcaagaaagatttaattagctatgggggaggatggagatttcaagggtcatggaatacaggagaagaagtgcaggttatagcagtggaacctgggaaaaaccccaaaaacgtccaaacaacccccggcaccttcaaaacaccagaaggtgaggtaggggctattgccttagatttcaaaccaggcaccagtggttctccaatcgtaaaccgagaaggaaaaatcgtaggcttatacggaaatggcgtagtcacaacgtccggcacttacgtgtcagcaatagcacaagcaaaagcatcccaagaggggcccctaccagagattgaggacgaagtctttaaaaagagaaatttgactattatggacctgcaccctggaagcggaaaaacacggcgttatttaccagctattgtgagagaggcgattaagagaaaacttcgcactctaatattggctcctacaagagtagtagcatcggaaatggcagaagcattgaaggggatgcctataagataccagactacagccgtcaagtcagaacacacaggtcgtgaaatagtagacctaatgtgccatgccacttttacgatgcgtcttctatcaccagtaagggtcccaaattataatatgataattatggacgaggctcattttactgaccctgcatcgatagcagctagaggatatatctcaactcgtgtgggcatgggagaagccgctgcgatttttatgacggcgaccccacccggatcagtagaagcctttccacaaagtaacgcagtgatacaggatgaagaacgtgatatcccggaacgaagttggaacagtgggtacgactggataaccgattttccaggaaaaaccgtgtggtttgtgcccagtattaaaagcgggaacgacatagctaattgtcttcgcaaaaatggtaaacgggtaatacaattatcaaggaaaacatttgatacagaatatcagaaaaccaaaaataatgactgggactacgttgttacgacagatatttcagaaatgggtgcgaattttagggcggaccgtgtaatagacccacggagatgtcttaaacctgtaatactaaaagatggaccggaaagagtgattctggcaggaccaatgccagtaacagtggcctccgcggcccagagacggggaaggattggaaggaaccaaaataaagaaggggaccagtatgtgtatatgggacaaccacttaacaatgatgaagatcatgctcattggacagaagcgaagatgctgctcgataacataaacacgccagaggggataattccggccctatttgaaccagaaagagaaaaatcagcagctatagacggagagtaccgacttagaggtgaagctcgtaagactttcgtcgaactaatgcgaagaggggatcttcccgtatggctttcttataaagttgcatcagagggctttcaatattctgacagaagatggtgttttgacggcgaacgaaacaatcaagttttggaagagaatatggatgtagagatatggacaaaggaaggtgaaaggaagaaactgagaccccgttggctagacgcgagaacatattcggaccctctcgccttacgagaatttaaagaatttgcagctggtagacggagtgtaagtggtgatctaattctggaaataggtaaactcccacagcacctcacgctccgagcacaaaatgcactagacaacttagttatgctacataactcagaacaaggcggaaaggcataccggcatgcgatggaagaacttccagatacaatagaaacacttatgttactagccttgatagctgtgttgactggaggggtaacactcttctttctaagcggaaaaggactagggaagactagcattggcttattatgtgtaactgcgagtagtgctttactttggatggcaagcgttgagccacactggatagcagcttctatcatcttggagttctttttgatggtgttgttaataccggaacccgatagacagcgcacgccacaagacaatcaattagcatacgtagtaataggattgctattcatgattttaacagtagctgcaaatgagatgggactattagagacaactaagaaagatctaggaatagggtatgtggccgcagaaaaccatcaacatgcaaccatgttggatgtagacttacatccagcctccgcctggacactatacgcagttgccaccacagtaattacacctatgatgaggcacaccatagaaaacactacagcaaatatatcattgacagcgatcgctaatcaagccgcaattttaatggggcttgacaagggttggcccatttcaaaaatggacataggagttccactattagccttaggatgttattcacaagtaaacccccttactcttaccgccgcagtgcttatgctagtcgcacattacgcaataataggtcctggccttcaagcgaaggcaaccagagaagcgcaaaagaggacggcagcaggtattatgaaaaatcctacagttgacggaatagtagcaatcgatctggaccctgtagtatatgacgcaaagttcgaaaaacagctcggtcaaatcatgttgttaatattgtgtaccagtcaaatattgctaatgcgaacaacatgggcactctgtgaatccataaccttagcgacaggaccgttaacgactctgtgggaaggaagcccgggaaaattctggaacactactatagcagtctccatggcgaatatatttagaggctcttacctggctggggcaggtttagcattttctttaatgaaaagtctaggaggtggaagacgaggtacgggtgcacagggcgaaacattaggagaaaaatggaaaagacagctgaatcaactatcaaaaagcgaatttaacacttataagagaagtgggatcatggaagtagaccgcagtgaagccaaagaggggttgaaaagaggagaaacaacaaaacatgcagtatcacgtggaacagctaagttgagatggtttgtagagagaaacttagtaaagcctgaaggcaaagtgattgatctaggctgcggtcgaggcggatggtcatactactgtgctggtctaaagaaagtcacagaagtaaagggttacacaaaaggtggccccggacatgaggaaccgattcccatggctacgtacggttggaatttagtgaaactacattccggtaaagacgtgtttttcatgccacccgaaaagtgtgacacactactatgtgacatcggagaaagttcaccgaatcctacgattgaagaaggtagaaccctaagagttttaaaaatggtagaaccctggttgaggggtaaccagttttgcatcaaaatactcaatccttatatgccgtcagtcgtcgaaacgctagaacaaatgcagagaaaacatggtgggatgttggtaaggaatccccttagcaggaatagcacacacgaaatgtattgggttagttgtggcacagggaatatagtctcagctgtcaatatgacctcaagaatgttactaaacaggttcactatggcacatagaaaacctacctacgagcgtgacgtagatcttggagcgggaactaggcatgttgctgtagagcctgaggtggccaatcttgatataataggacaaaggatagagaacatcaaaaatgaacacaaatccacttggcattatgacgaagacaatccctacaaaacttgggcataccatggttcgtatgaagtcaaaccaagtggctccgcgagttcaatggtgaatggagttgtacgtttgttaacaaaaccctgggacgtaataccaatggttacgcagatagcgatgaccgatacaactccattcggccaacagagagttttcaaagaaaaagtggacacaagaacacctagagctaaaaggggtactacccagataatggaagttaccgccaaatggctatggggatttttatctcggaacaagaaacctagaatttgtacacgcgaggaatttacgaggaaagtgaggtcaaacgcagctattggagcagtgttcgtcgatgaaaaccaatggaactctgctaaagaggccgtagaagatgaacgtttctgggatttggttcatagggaacgcgagttacacaagcaaggtaaatgtgctacatgcgtatacaatatgatgggaaaacgtgaaaagaagctaggagaatttggtaaagcaaaaggatccagggctatctggtatatgtggcttggcgcacgatttctagagttcgaggcactaggatttatgaatgaagaccattggttcagtcgcgaaaattcactaagcggcgttgaaggtgaaggattacacaaattgggatatatactacgcgatatatcgaaaattcctggaggtaatatgtatgcggacgacacagcgggttgggacacacgaattaccgaagatgacttacaaaacgaagcaaaaataacagacataatggaacctgagcatgcattattagcaacatctatttttaaactaacttatcaaaacaaagtagttagagtccaaagaccagccaaaaatggtactgtaatggatgtgatctcgcgaagagatcagaggggtagcggacaggttggcacttacgggttaaatacctttaccaacatggaggtacagttaatcagacagatggaaagcgaaggcatatttctgccatcagaattggagacccctaatctagcagaaagggcacttgactggttggagaaacacggcgccgaaagattgaagaggatggcgatatctggtgacgattgtgtggtaaagcctatagatgataggtttgctactgctttaacggcactaaacgatatgggtaaagtacgcaaagacattccccagtgggaaccatcgaaaggttggaacgattggcaacaggtcccattttgttcccaccattttcatcaattaataatgaaggacggcagagaaatcgttgtcccgtgccgaaatcaggatgagttggttggacgggctagagtaagccagggagcgggctggtcattgagggagacagcttgcctcggaaagtcgtacgctcaaatgtggcaacttatgtactttcatcgaagggacctgagattggctgctaatgctatctgttcagcagtccctgtggactgggtaccagctagtcggactacttggtcaatacacgcacaccaccagtggatgacaactgaggatatgttaagtgtatggaatagggtgtggatagaagaaaatccctggatggaagacaaaacgcatgtttcgagctgggaggaagtaccgtatttagggaagcgcgaggatcaatggtgtggatctctaataggtctcactgcgagagcgacatgggctaccaatatacaagtggctataaaccaagttaggaggttaatcggtaatgaaaactacctcgattatatgacatcaatgaagagattcaaaaatgaaagtgacccagagggcgcattatggtaa

SEQ ID NO: 21097 - RNA, 9879 nt, synthetic construct
  misc_feature 1..9879: note = derived and/or modified CDS sequence (opt6) from DENV-1__JX669467__SS-prME
  source 1..9879: mol_type = other RNA
tctgtcacaatgttactaatgctattacccacagctctagcatttcatcttacaacacggggaggggaaccacatatgatagtctcaaaacaagaaagaggtaaatcactactctttaaaacatctgccggtgttaatatgtgtaccctcatagcaatggatctgggggaattatgtgaagacacaatgacttataaatgtccaaggattactgaagcagaacctgacgatgtcgactgttggtgtaatgctaccgatacgtgggttacgtacggtacttgttctcagacaggagaacatagacgtgacaaaaggagtgtggcattagcaccacacgtgggtctgggattggaaaccaggacagagacatggatgtcatccgaaggagcttggaaacagatacagaaagttgaaacttgggctttaaggcaccctggattcaccgttattgcattatttttagcacatgcgatcgggacgtcaatcacacaaaaaggcattatctttattttattaatgttggttacaccgagtatggcgatgaggtgcgtcggaataggaaacagagattttgtagaagggctatcaggagcaacatgggtcgacgtagttctagaacacggatcctgcgtgacaactatggccaaaaataaaccaacgttagacattgaactactaaaaaccgaagtaaccaatccagcagtcctacgtaaactttgtattgaagccaaaatttccaacactactacagattcgagatgtcccacacagggtgaagcaaccttagtggaagaacaagacgcaaacttcgtatgtagaagaacattcgtcgatcggggttggggtaacgggtgtggcctatttggcaaaggttccctactaacatgtgctaaattcaaatgtgttacgaaattggaaggcaaaattgttcaatatgaaaacttaaaatactcggtaatcgtcacagtccatacaggcgatcagcaccaagttggaaatgaaacgaccgaacatggtacaatagcgacgataacaccacaggctcctacatccgaaatccaactcacagattatggcgcattaaccttagattgcagtccaaggacgggtcttgattttaatgaaatggtgctacttactatgaaagagaaaagttggttagtacataaacaatggttcttagacttgcccttaccgtggacatcaggagcctccaccagccaggaaacctggaataggcaagacctattagtaaccttcaaaaccgcccacgccaagaaacaagaagtcgtggtcttagggagtcaagaaggggcgatgcatacagcacttactggggccacagaaatacaaacttctggaacaacaacaatttttgccggtcacctgaaatgccggctcaaaatggacaaattaactctgaaaggcacttcctatgtcatgtgtacgggctcttttaaattagaaaaagaagtagcggaaactcaacacggaacagtactcgtccaggttaaatacgaaggaacagatgcaccgtgcaaaattccattcagcacacaagacgaaaaaggtgttacccaaaatggaagactaataacggccaatccaatagtcacggacaaggaaaaacccgtcaatattgaaacagaacctcccttcggagaaagttatattgtagtgggtgctggcgaaaaagcattaaaattgtcctggttcaaaaagggaagtagtattggtaagatgtttgaagccacggcaagaggagcccgaagaatggcaatattgggcgacacagcctgggatttcggtagcattggaggagtgtttaccagcgttggtaaattggtccaccaagtatttggtactgcgtacggtgtcctattttcaggagtcagttggacaatgaaaataggaattggaatccttttaacatggctgggactaaatagtagaagtactagcctttcgatgacgtgtatcgcagttggcatggtaacactatacctgggagtaatggtacaggcagatagtgggtgtgttatcaattggaagggacgtgaattaaaatgtggcagtggaatttttgttacaaacgaagtacacacatggaccgaacaatataaattccaggctgactcaccaaaacggctttctgcagccattggcagagcttgggaagaaggagtctgcggaataagatcggcaacgaggttggaaaacattatgtggaagcaaattagcaatgaactaaatcacatcttattggaaaatgatataaaattcacagttgtagttggcaatgcaaacggtatattagcccaaggaaagaaaatgataagaccccaaccgatggaacataaatattcctggaaatcgtggggaaaagccaaaatcatcggcgcagatatacaaaatacaactttcataatagacggaccagatacaccagaatgccctgacgaacaaagagcttggaacatctgggaagtagaagattatggattcggaatattcactactaacatatggctaaaactgcgggattcgtacactcagatgtgtgaccatcgactgatgtccgcagcaattaaggattccaaagctgttcacgcggatatgggatactggattgaatccgaaaagaacgaaacttggaaattagctagagcctccttcattgaagttaaaacatgcatatggccaaaaagccacactctatggtcaaatggagttcttgaatcagaaatgattataccaaaaatgtacggcggacccatctcgcagcataactaccgccccggttatttcacacaaacagccggtccatggcaccttggtaaattggaacttgattttgacctttgtgagggaacaacagtcgttgtggacgagcattgcggatcgagagggcctagcctacgtactactactgtgaccggtaagattatacacgaatggtgctgtcgatcgtgcacacttccaccgctacgcttcagaggagaagatgggtgctggtacggcatggaaataagaccagttaaagaaaaggaagaaaatttagttcgttctatggtttccgcgggatcgggcgaggttgatagtttttcactaggaatcttatgtgtgagtatcatgattgaagaagtaatgcgaagtcgatggagtcgaaaaatgttaatgactgggacattagcagtattcttattgctaattatgggacagcttacatggaatgaccttatcaggctatgcatcatggttggagctaatgcaagcgacaaaatgggaatggggacaacatacctcgcgttaatggctacattcaaaatgagaccaatgttcgccgttggccttttgtttcgaaggttaacttctagagaagtactcctattaacaataggattgagtctggtagcgtcagttgaacttccaaactctctagaagaactcggggatggactagctatgggcataatgatgcttaaacttttgacagaatttcagccacatcaactatggacgactttattatcactcaccttcataaagacaacattatccttagattacgcatggaagacgaccgccactgtactgtccatagtgtcattattcccattgtgtttaagcactacttcacagaagacaacctggttgccggttttactaggtagtttcggatgtaaacctctaacaatgttcttaatcacagagaacgaaatatggggcagaaagtcatggcctcttaacgaaggaattatggcaatcgggatcgtatcgattttattatcatcattgctgaaaaacgacgtacccttagcaggacctctgatagctgggggtatgttaatcgcgtgttacgtaatatcaggctccagcgccgatctatcattggagaaagccgctgaagtctcatgggaggaagaagccgaacattctgggacttctcacaacattctcgttgaagtacaagacgatggaaccatgaaaattaaagatgaagaacgagatgatacgctcacaatattattaaaagcaacccttctagctgttagtggagtctatccaatgtctatccccgcaaccctttttgtttggtatttttggcaaaagaagaaacaaaggtcaggtgtgctttgggacacaccaagtcccccagaagtagaaagagccgtcctagacgacggaatataccgaatactccaaagaggattattgggaaggagccaagtaggggtcggcgtattccaagatggagtttttcataccatgtggcacgtaacgagaggcgctgtattgatgtatcaaggaaaacgtctggaacctagctgggctagcgtcaaaaaggatctgatttcttacggtggaggttggagatttcaaggaagctggaatacaggggaagaagtacaagtaatagctgtggaaccaggtaagaaccccaaaaatgtgcaaaccacacctggtacttttaagacacccgaaggtgaagttggtgcaattgccttggacttcaagcctggaacaagtgggagtcctattgtgaatcgcgagggcaaaatagtaggattgtatggaaatggggttgtaacaacatctggaacttatgtcagtgctatagcacaggcaaaggcctctcaagaaggcccgctacctgaaattgaagatgaagtctttaagaaaagaaatttgacaataatggatttgcatccgggcagtggaaaaacacgacggtatttaccggctatcgtacgagaagcaataaaacgtaaactaagaacactcatactagccccgacacgtgtagtagcatcagaaatggcagaagctctaaaaggcatgcccatcaggtatcaaaccacggctgtaaaatctgaacatacaggaagagaaatagtagacctaatgtgccatgcaacatttacaatgcggcttctttcaccagtgagagtcccaaattataacatgataataatggatgaagcccactttaccgatccagccagtattgcggctcgcggatatatatctactagggtcggtatgggggaagcagcagctatcttcatgaccgctacacctcccggcagtgtagaggcttttcctcaaagcaacgcggtaatacaggatgaagaacgagatatcccggaacgtagctggaatagcggatatgattggattacggattttcccggtaaaacggtatggttcgtcccatcaattaaaagtggaaatgatatagcgaactgtcttagaaagaacggtaagagagtaatacaactatctagaaaaacgtttgatacagagtaccagaagaccaaaaataatgattgggactacgtagtgacgactgacatctccgaaatgggcgccaactttagagctgatagagtaattgacccacgaagatgcctaaaaccagttattcttaaggatggaccagagcgggtcattttagcaggcccaatgccggtcaccgtggctagtgccgcacaacgaaggggtcgaataggaagaaatcagaacaaagagggcgatcagtatgtgtatatgggtcaacccttgaacaacgatgaggaccatgcccactggacagaagcaaaaatgctgttagacaacataaatacacccgaagggataatacccgcgttatttgagccagaacgagagaaaagtgccgcgatagacggggaatacagattacgaggcgaagcacgaaaaacttttgtagaactcatgagacgaggagatcttccagtatggttaagttataaagtagcatcggaagggtttcaatacagcgatagaaggtggtgcttcgatggagaaagaaataaccaagtattggaggagaacatggatgttgaaatatggactaaggaaggagaaagaaagaaacttcgcccaaggtggcttgacgccagaacgtattccgatcctctagcccttcgtgagtttaaggagtttgcagcaggacgtcgttcagtgtcaggagacttaattctagaaataggtaaattaccgcaacacctaacgctacgagcacaaaatgctcttgataatttagttatgctacataattctgaacaagggggtaaggcttacagacatgctatggaggagttaccggataccatagaaacacttatgttacttgcactaatagcagtcctaacaggtggtgtaacgttatttttcctaagtggaaaaggactaggaaaaacttccattggcttgctatgtgtaacggcatcatctgcattgttatggatggcatccgttgaaccacactggattgccgccagtatcatattagagtttttcctcatggtgttattgatcccagaacccgaccgacaaagaacaccccaagacaatcaacttgcgtacgttgtaataggattactatttatgatccttacggtagcagcaaatgaaatgggtctattggaaacaacaaagaaagacctaggtatcggacatgttgcagcagaaaaccaccaacacgcaactatgttagatgtagaccttcatcccgcgagcgcttggactttatatgctgttgccacaactgtcattactccgatgatgagacatacgatcgagaataccactgccaacataagcctgactgctatagctaatcaagcagctatcttgatgggattagacaagggatggcccatcagcaagatggatttaggagtccccctgttagcccttggttgttacagccaggtcaaccccctaacattaacggcagctgtactgatgctcgtagcgcattatgctatcatcggaccaggattacaggcaaaagcaacaagagaagctcagaaaagaacagcagcaggtattatgaagaatcctaccgtagatggtattgtagcgattgatctagacccggtagtctatgacgctaaattcgaaaaacagttgggacaaataatgttacttatattgtgcacatcccaaatcttactcatgagaactacatgggcactctgtgagtcaataacactggcaaccggaccattaactaccctttgggaaggcagccctggaaaattctggaataccacaattgcagtatcaatggcgaatatattccgcgggagttatctggctggagccggactagccttctcacttatgaaaagtctgggcgggggcagacgggggaccggcgcacaaggtgaaactctcggagagaagtggaaacgacaactaaatcaattatcgaaatctgagttcaacacttacaaaagatctgggataatggaggtcgatagatcagaagccaaagaaggtctcaaaagaggagagacgacaaaacatgcggtctcacgagggactgctaaactgagatggttcgtcgaaaggaatctagtaaaaccggagggtaaagtaattgatttgggttgtggaagaggaggctggtcatattactgtgctggtctaaagaaagtaacggaggtaaaagggtataccaaaggaggaccaggccatgaagaaccgatacctatggctacatacggttggaacttggttaaactacacagtggaaaggatgtcttcttcatgccgcctgagaaatgtgatacccttttatgtgatattggtgaaagctcaccaaatcccacgatcgaagaaggtcgaactcttagggtacttaagatggttgaaccatggttaagaggtaaccaattctgtataaagatactcaatccatatatgccgtcggttgtcgaaacacttgagcagatgcaacgaaaacacggaggaatgctcgtaagaaaccctctaagtagaaattccactcacgaaatgtattgggtgagttgcggcacaggaaatatcgtgagtgccgtaaatatgacctcacggatgttgttaaataggtttactatggcacataggaagccaacttatgaaagagatgtagatctaggcgccggaactagacacgtcgccgtcgagccagaggttgcgaatctagatatcattggacaaagaatagaaaatattaaaaatgaacataagagcacgtggcattatgacgaagacaatccttataaaacgtgggcctatcacggtagttacgaagtaaagccttcgggatcagcatcaagcatggtaaacggtgttgtgagactattgacaaagccttgggacgttataccgatggtgacgcaaatagcgatgacagataccacaccattcgggcaacaacgagtttttaaagaaaaagttgacacacgcacccccagagcaaagcgtggaacggcgcaaataatggaagtcacggccaaatggctatggggattcctctcacgtaataagaaaccacgaatatgtactagggaggagttcactcggaaagttcgcagtaatgcagctatcggagcagtattcgtggatgagaatcaatggaactcagcaaaagaggccgtggaagatgaacgattttgggatttagttcatcgtgaacgcgaattacacaaacaaggaaaatgcgctacttgcgtatacaacatgatgggcaaacgtgagaagaaattaggagaatttggcaaagcaaagggttctcgtgcaatatggtacatgtggctaggagcaagattcctggaatttgaggctttgggttttatgaatgaagatcattggttcagtagagaaaatagtttatcaggggtagagggtgagggcttacacaagctcgggtacatactccgtgatatatctaaaataccaggtggaaacatgtatgcggacgatacagcaggctgggacactcggataaccgaagatgacttgcaaaatgaggctaaaataacagacataatggaaccagaacatgctctactggctacatcaattttcaagctaacgtatcagaacaaagtagtccgagtacagagaccggccaaaaacggcacagtaatggatgtaattagtcgacgggaccaacgcggttcaggacaagtcggaacatatgggttaaatacattcactaatatggaagtccagttaataagacaaatggaaagcgaaggtatcttctttcctagcgaattagaatcgcccaatttggcggaacgggttttagactggctcgaaaagcatggtgccgagcggctcaaaagaatggcaatatcaggtgacgactgcgttgttaaaccaatagacgatcgatttgcaacagctctgatagcgctgaatgatatgggaaaagttagaaaagatattccacaatgggaaccatcaaaaggatggaatgactggcaacaagtacccttttgtagtcatcatttccatcaattaataatgaaggacggaagagaaatagtcgtaccttgcagaaatcaagatgagctagtaggtcgtgctagggtcagtcaaggtgcaggctggagtctaagagaaacggcgtgtttaggaaagtcatatgcccaaatgtggcaacttatgtatttccatagaagggatttacggctggcagcaaacgcaatctgcagtgctgtaccagttgattgggtacctacaagtcgaacgacctggtctattcacgcgcaccaccagtggatgacgaccgaagatatgttatctgtctggaatcgggtatggattgaagaaaatccctggatggaagataagacccatgtaagcagttgggaagaagtaccttatttgggaaaacgagaagatcagtggtgtggcagtttgattggactgacggctagggcgacgtgggcaacaaacatccaggtcgctattaatcaagtacgaagactaattggtaatgaaaattatttagattatatgacatctatgaaaagatttaaaaacgaatcagatccagaaggagctctatggtaa

SEQ ID NO: 21098 - RNA, 9879 nt, synthetic construct
  misc_feature 1..9879: note = derived and/or modified CDS sequence (opt6) from DENV-1__HM469967__SS-prME
  source 1..9879: mol_type = other RNA
agcgtcacaatgcttttgatgttaatgcctacagcacttgccttccatttaacgacacgtggaggggaaccgcacatgatcgtaagtaaacaagaaaggggaaaatcactcttatttaaaacaagcgcgggtgtaaatatgtgcacattaatagcaatggacttgggcgaactttgcgaagacacaatgacatacaaatgtcctcgaatcactgaagctgaacctgatgacgttgactgttggtgcaatgccacagatacttgggtaacttatggaacgtgcagtcaaacgggcgaacaccgaagagataaacgttccgtagcactagcaccccatgtgggtctaggcttagaaacgcgtacagagacctggatgtctagtgagggcgcatggaaacaaatacaacgagttgaaacctgggcattaagacatccgggtttcacggtaatagcattatttcttgctcacgcaataggaacatcaattacacaaaaaggaataatatttatattattaatgttagtaacacccagcatggcaatgcgctgcgtaggtataggcagcagagatttcgtagagggactcagtggggctacgtgggttgatgtagtattggaacatggatcttgcgtgacgactatggctaaagacaaacccacattagacatcgaacttctgaaaaccgaagtcacgaatcccgcggtattaagaaaattgtgcatcgaagccaaaataagtaataccacaacggatagtaggtgtcccacacagggcgaggcaaccctggttgaagaacaagacgcgaactttgtatgtcgtagaactttcgtagacagaggctggggtaatggatgtggtttatttgggaaaggatcacttatcacttgcgcaaaatttaaatgtgtaacaaaactggaaggaaaaatagttcaatacgaaaatttaaaatacagtgttatagttacagtgcataccggggatcaacaccaagtaggcaatgaatctaccgaacatggaactacagcaaccatcactccacaagcgcccacgacagaaatacagctaacagattatggggctctgacattggattgctcaccacgaactggactggactttaatgaaatggtcctactaacaatgaaagagaaatcctggttagtacacaaacagtggtttctagaccttcctctcccatggacatcaggcgctagtacaagtcaggaaacttggaatagacaggatctattagttacgtttaaaaccgcccacgctaagaaacaagaggtcgtggtattaggatcacaagaaggcgcaatgcatacagctcttacaggagccactgaaattcaaacatcggggaccacaactatctttgcaggacatctaaaatgccgcttaaaaatggataaacttacgttaaaaggaatgagctatgttatgtgcacaggaagtttcaaacttgagaaagaagtagcggagactcaacatggaacggtactggtccaaataaagtacgaaggcacggatgcaccatgtaaaatcccattctctactcaggacgagaagggtgtaactcaaaacggacggttaattacagctaatccaatagtcactgataaagaaaagccggtcaatatagaggctgaacctcccttcggagaaagttacatagtaattggtgcgggcgaaaaagcgctaaaactatcatggttcaagaaaggatcttcgataggcaagatgtttgaagctactgctcgaggtgcaagacgtatggccatacttggagataccgcttgggacttcggatcgataggcggtgtatttacatctgtgggtaagctagtacatcaaatttttgggaccgcgtatggggtattattcagcggcgtatcttggacaatgaaaataggaatcggggtacttttaacctggcttggtctaaatagcagatcaacctccctcagtatgacgtgtatagcagtaggactggttacgctataccttggtgtcatggtacaagccgattctggatgtgttattaactggaaaggaagggaactaaaatgtggtagtggcatcttcgtaacgaacgaagtccacacttggacagaacaatataaatttcaggcagatagtccaaaaagattatccgcggctatcggaaaggcttgggaggagggggtttgtggtattagatctgcaacacgcctcgaaaacataatgtggaaacaaataagtaatgagttgaatcacatactattagaaaatgacatgaagttcacagtagtagtaggtgatgtagccgggattttggcgcaaggcaagaaaatgatacgcccgcaacctatggaatacaaatatagttggaaaagttggggtaaagctaaaattataggagccgatgttcaaaatacgacatttataatcgacggccctaatacaccggaatgtcccgatgatcaacgtgcttggaacatctgggaggtagaagactatgggttcggcatattcactactaatatctggttaaaactaagggattcttacacgcaagtttgtgatcatcgtttaatgtctgcagcaattaaagactcaaaagcggtacacgctgacatggggtactggattgaatctgaaaagaatgagacatggaaattggccagggccagcttcatcgaggttaagacatgtatatggccaaagagtcatacattgtggtcaaacggagtcttggaatccgagatgatcattcccaagatatatggaggtcccatttcgcaacataattacagacccggatacttcactcagaccgcgggaccctggcatttaggaaaacttgaactggactttgatctatgtgagggaactacagtagtagtagacgagcactgcgggaatagaggaccatctcttagaacaacaacagtcacgggtaaaataattcacgaatggtgttgtcggagctgtactctaccacctttaagattccggggcgaagatggatgttggtatggaatggaaatcagacctgtcaaggaaaaggaagaaaatctagttaaaagtatggtatctgcaggatcaggggaagtcgattcgttttctcttggtttgttgtgcataagtataatgattgaagaagtaatgaggagtagatggtctcgaaagatgctaatgacaggcacgctagccgtattctttctgcttataatgggtcaattaacctggaacgatttaattagactatgtattatggtcggggccaacgctagcgacagaatggggatgggcactacatatttagcactgatggcaacgttcaagatgcgacccatgttcgcggtcggactcctgttccgcaggttaacatctagagaagtgctcctattaactataggattatccctagttgcttctgttgagttacccaatagtctagaggaactgggagatggtctagctatgggaattatgattctaaagttactaacagattttcagagccaccaactgtgggcgacattactatcactgacgttcattaaaactacgttttcactacactacgcatggaaaacaatggcaatggtcctaagtatagtatcgttatttccactatgcttaagcacgactagccagaaaacaacgtggttacccgtgttgctaggctcactgggatgtaaaccactaactatgtttttaatagctgaaaataagatatggggtagaaaatcttggcctctcaacgaaggtatcatggcggtaggtatagtatcaatattactttccagccttcttaaaaacgacgtaccgctggccggaccattaattgctggtggtatgctaatagcatgctatgtgatttccggatcatcagctgatttatcacttgagaaggccgctgaagtaagttgggaagaagaagctgaacattcaggagcctcgcataatattctagtcgaagtccaggacgatggcactatgaaaataaaagatgaggaaagagatgacacgctaacgattttattaaaagcgacattattagctgtatcaggcgtataccccctttcaattccagcaacattatttgtatggtacttttggcagaagaagaaacaacgaagtggtgtattatgggatactccttctccgcctaaagtagaacgcgcagtactcgacgacggtatataccgaataatgcaaagggggttattaggcaggtcccaagttggggttggggtattccaagaaaacgtattccacacgatgtggcatgtaacccgtggtgcagtgctgatgtatcaagggaaacggttggaaccatcctgggcaagcgttaagaaagacctaatcagttatgggggagggtggagactgcaaggttcatggaatacgggtgaagaggtacaggtcattgcggtagaaccaggcaaaaatcctaaaaacgttcaaactgcgcctgggacttttaagacccctgaaggagaaattggagcaatcgcgttagattttaaaccaggcacatcaggctcgccaattgtaaaccgtgaaggaaagatagtaggcctgtacgggaatggggtcgtaacaacttcaggaacatacgtttcagcaattgctcaagctaaggcctcacaagagggccccttgccagaaatagaagatgaggttttcagaaaacggaacctcacaatcatggatctgcaccccggctcaggaaaaacacgtagatatttaccagctattgttagagaggcaattaaaaggaaattacgaactttaatcttagctccgacacgagttgtagcctctgaaatggcagaagcgttaaaaggtatgccaattcgctatcagactacagcagtcaaatctgagcatacagggaaagaaatagttgatttgatgtgccatgcgacttttaccatgagactcctatcaccagttcgcgttccaaattataatatgataataatggatgaagcacactttactgatcctagttccatagcggcacgtggttatatctcgacaagagttggaatgggagaggcagcagctatcttcatgacagccactcccccaggttcggtagaggcattcccgcaatctaatgcagtaattcaagatgaagaaagagatatacctgagagatcctggaactcaggatatgaatggatcaccgacttccccggtaaaactgtatggtttgttcctagcataaaggctggcaacgatatcgctaattgtttaaggaagaatggcaagagagtcattcaattatcaagaaaaacatttgacacggaataccagaaaaccaaaaactcagactgggattacgtcgttacaacagatatatcggaaatgggcgccaattttagagcagatagagtgatcgatccaaggagatgtcttaaaccagtgattctaaaagatggaccagaacgagtaattctagccggacccatgcctgttactgtagcctccgcagcccaaaggagaggccgtgtaggaagaaatcataacaaggaaggggaccaatatatttacatgggccaacctcttaacaacgacgaagatcacgcacattggactgaagctaagatgctacttgacaacataaacacacctgaaggtattataccagccctatttgaaccagaacgagagaaatcagctgctatagacggtgaatatagactgcgaggtgaagcgagaaaaacatttgtcgaactcatgagaagaggagatctcccagtctggttgagttataaggtcgcgagcgaaggtttccaatatagtgatcggagatggtgctttgacggtgaaagaaacaatcaagtgctcgaagaaaacatggacgtagagatatggacgaaggaaggagaaagaaagaaactaagacctagatggttagatgcacgaacttactccgacccgctcgctttaagagaatttaaggaatttgcagccggaagacgatctgtttcgggtgaccttatacttgaaatcgggaaactacctcagcacctgacccaacgcgcgcaaaacgccttagacaatttggtcatgctccataattcggaacaaggaggtcgagcataccgccacgcaatggaagaactaccggatactatagagactttgatgctattggccttaattgccgtactaacaggaggcgtaaccctctttttcttatcaggtcgaggattaggcaagacctcaattgggctcttatgcgtaatggcttcctctgttttattatggatggcatcagtagaaccacactggatagcagcatcgatcatcttagagttctttctaatggtattgctaataccagaaccagacaggcaaaggacaccccaggataatcagcttgcctacgtagtaatagggctgctctttatgatcttaacagttgctgctaatgaaatgggactccttgaaacgaccaagaaagacctcggaataggacacgttgcagttgaaaatcaccatcatgctgctatgttagacgtagacctacaccctgcatccgcctggacgttgtatgcagtcgcaacaaccatcataaccccaatgatgagacacacaatagaaaacacaacggcgaatatatccttgacagccatcgcaaatcaggctgccattttgatgggattagataaaggatggcctataagcaaaatggatattggtgtcccacttttagcattaggttgctattctcaagtcaacccactaacactaactgcagctgttctgatgctcgtagctcattacgctattattgggcctgggctacaagctaaggctacacgagaggcccagaaacgaaccgcagcaggtataatgaaaaacccgacggttgatgggatcgtagctatcgatttagatccagtggtctatgatgcgaagttcgaaaagcaattaggacaaatcatgttattaatactgtgtacaagtcaaatattactaatgagaacgacatgggcgctttgtgaatccatcacattggcaacaggcccactaactacactctggaaaggatcgcctgggaaattttggaacacaacaatagccgtaagcatggccaacattttccgaggttcttacctagcaggagcgggactggcattttcactaatgaagtccttaggaggaggcaggagaggaaccggggcacaaggggagacactaggggagaaatggaaacgacaacttaatcaactttcaaaaagtgaatttaatacttataaacggtctggtataatggaagtagatagaagtgaagctaaagaaggcttaaagaggggagaaaccacaaaacatgcagtttccaggggtacagccaaactaaaatggtttgtagaaaggaatctagtgaagccagaaggcaaagtaattgatttaggatgtggtagaggaggatggagctattattgtgcaggtttgaaaaaggttacggaagtaaaagggtatactaaagggggcccaggacatgaggaacctattccaatggcgacctatggttggaatcttgtgaagctgcattcgggcaaagatgtattctttataccccctgaaaagtgtgatactttactttgtgatataggggaatcatcgccaaaccccacaatcgaagaaggccggacgcttcgtgttctaaaaatggtagaaccttggctaaggaaaaatcagttttgtataaagattctcaacccgtatatgcccagcgttgtagaaactctagaacaaatgcaacgaaagcatggcggcatgttagtcagaaatccactcagccgaaattcaactcacgaaatgtactgggtaagttgcggcacagggaatattgtaagcgctgtgaatatgacgtcaaggatgctcctgaataggtttacaatggcccatagaaaacctacctatgagcgagacgtagaccttggcgcaggtactagacacgtagcagtagagccagaagtagccaatctggacattatagggcaaaggatcgaaaacattaaacacgaacacaagagtacctggcattacgacgaagacaacccgtataagacttgggcttatcatggatcttacgaagttaaaccaagcggaagtgcatcctcaatggtcaacggtgtagtaaaattattgacgaagccatgggacgtaattccgatggtaacacaaattgctatgacggataccactccattcggacagcaacgtgtttttaaagaaaaggttgatacaagaactccaaaggcaaagaggggcaccgcacaaataatggaagtcactgcaagatggctatgggggttcctgagtcgaaataagaaacccagaatttgtaccagagaggagttcacacggaaggtgagatcgaatgcagcgataggcgcggtgtttgtcgatgaaaaccagtggaacagtgcaaaagaggcagtcgaagacgagcgtttctgggaccttgttcatagagaaagggagttacataaacaaggaaaatgcgcaacttgcgtatataatatgatgggaaaaagggagaagaaactaggagagttcggaaaagccaaaggtagtcgagcgatatggtatatgtggctgggcgcgcggttcctagaatttgaagcattaggctttatgaacgaagatcattggttttccagggaaaacagtctgtcgggtgtcgaaggcgaaggcttacataaactggggtacattctaagggatatcagtaagattccgggagggaacatgtacgcggatgacactgctggctgggataccagaatcacagaagacgacttgcaaaacgaagcgaaaataactgatataatggaaccagagcacgccctattggctaaaagcatttttaaactgacctatcaaaacaaggttgtaagagtccaacgtccggccaaaaacgggacggtcatggacgtaatatccagacgagatcaaagagggagtgggcaagtcgggacgtatgggcttaacacattcacaaatatggaggctcaactcatacgacaaatggaatcagagggtatcttttccccgtctgaattggaaactcctaatctagctgaaagggttctagactggttagaaaagtacggcgtggaacgattgaaacgcatggctatttcgggagatgattgcgtcgtaaagccaatagatgataggtttgcaactgctttgactgcgttaaacgatatgggaaaagtgcgtaaagacataccccaatgggaaccatcaaagggttggaatgattggcagaaggtaccattctgtagtcaccatttccaccaattaatcatgaaagatggacgcgaaatagtcgtaccttgccgaaaccaagacgaattagtcggacgagcacgagtatcgcaaggcgcaggttggtcgctaagagagaccgcatgcctgggaaaaagctacgcccaaatgtggcagcttatgtatttccatagaagagatttaagactagctgctaacgccatttgcagtgccgttccagtagactgggttccgacgtcgagaacgacgtggagtattcacgctcaccatcaatggatgaccacagaggatatgcttagtgtatggaaccgagtttggatagaggaaaatccatggatggaagataaaactcatatatcttcttgggaagatgtaccttatttaggcaagagggaagaccaatggtgtggttctttgattggacttacagcgagagccacatgggcgactaatatccaagtagcgataaatcaggtgagacgactgattggaaatgaaaattacctcgactatatgacttcaatgaaacggtttaaaaatgaatcagatcccgaaggggctctctggtag

SEQ ID NO: 21099 - RNA, 9879 nt, synthetic construct
  misc_feature 1..9879: note = derived and/or modified CDS sequence (opt6) from DENV-1__JX669468__SS-prME
  source 1..9879: mol_type = other RNA
agtgtaacgatgctgctaatgctcctccccactgctttggcgtttcatctaactactagaggtggggaaccacatatgattgtaagtaaacaagaacgaggtaaaagtctgttgtttaaaacatcagcaggagtgaacatgtgtaccctaattgctatggatctgggtgaactatgtgaggatacgatgacatataaatgcccaaggattactgaagcagagccggatgacgttgattgttggtgtaatgctactgatacttgggttacatatggaacatgttctcagacgggcgaacatcgaagagacaaacgaagtgtagctctagctccgcacgtaggtttaggattagaaacacggaccgagacgtggatgtcttcggaaggtgcttggaaacaaatacaaaaagtggagacctgggccttgagacatccaggatttacagttatagctttatttctagcacacgcaatcggcacttcaataactcagaaaggtataatctttattctattaatgttagtaacaccgagtatggctatgagatgcgtaggtattggaaaccgagatttcgtagaaggtttatccggcgcaacctgggtggacgtagtactagagcacggatcctgcgtaactaccatggctaaaaacaaacctaccttggatattgagttactgaaaactgaagtaacaaatccggcagtattaagaaaactctgtatagaagcaaaaatttctaacaccactacggatagtcgatgtccaactcaaggagaagcaacactggtcgaggaacaagatgcaaattttgtatgtagaaggacgttcgtcgatcgtggatggggcaacggatgtggattgttcggaaaaggttccttgctgacctgtgccaaatttaaatgtgtgaccaagttagagggaaagatcgtccagtacgagaatttgaaatattcagttatagtcacagtacatactggtgatcagcaccaggtaggaaatgaaactacagagcacggcactattgcgactataacgccgcaggctcccacaagtgagatacaattaacagattacggtgcactaaccttagattgtagtcctcgtacgggtctagacttcaacgaaatggttctattaacaatgaaagagaaaagctggttagtccacaaacaatggtttttagacctaccattaccatggacctcaggagcgtcaacgagccaagagacctggaatagacaagacttattagtcacatttaaaactgcacatgccaaaaagcaagaagtcgttgtattaggaagtcaagaaggcgccatgcatacggccctgacgggggctacagaaatccaaacatctggcactacaaccatctttgctggacacctaaaatgtagacttaaaatggacaaattaacattaaaaggaacgagttatgtgatgtgtactggcagttttaaacttgaaaaagaagtggctgaaacacaacacggtacagtcctagtacaagtgaaatacgaaggaacagatgcgccttgcaaaatcccatttagtacgcaggacgaaaaaggagtaacacagaatggaagacttatcacagctaatcccatagtcaccgacaaagaaaaaccggtgaacatagagaccgaaccgccattcggagagagttacatagtagttggagctggtgaaaaagcactaaaactttcttggtttaagaaaggcagcagcataggaaaaatgtttgaagcaacggcacgtggagcgagaagaatggcaatactaggagataccgcatgggactttggaagcattggcggtgtatttacatcggtaggaaagctagtacatcaagtatttggaacagcgtatggtgtcttattttcaggtgttagctggaccatgaagataggaatcggtattctattaacctggctcggtctaaattcaagaagtacgagccttagtatgacttgcatagctgtcggtatggttacattatacttaggagtaatggtgcaagcagattcgggatgcgtaatcaattggaagggaagagagttaaaatgcggtaacggcatatttgttaccaatgaagtccatacgtggacagaacaatataaatttcaagcagattctccaaaaagattgagcgccgcgataggtagagcgtgggaagagggagtttgcggaataagatcagcaaccagacttgagaatattatgtggaaacaaattagcaatgaattaaatcatatcctactagaaaatgacataaaattcacggtcgtggtaggtaacgctaatggaattttagcccaaggcaagaaaatgattcgacctcaaccgatggaacacaaatatagctggaagtcctggggaaaagcaaaaataataggtgcagacatacagaacactacgttcataatagatggtccagataccccggaatgtccggacgaacaaagggcttggaacatctgggaagttgaggattatgggtttggaatttttacaaccaacatatggctaaaactaagagattcttatacccaaatgtgtgatcatagattaatgtcagcagcgataaaagatagtaaagcagtacacgcggacatgggttattggatagagtctgagaaaaatgagacgtggaagctcgcccgagcaagttttatcgaagtaaagacatgcatctggcctaaatcccatacattatggtctaatggcgttctagaaagtgagatgattatacccaaaatgtatggaggcccgataagtcaacataattacaggccaggttactttacacagacagcgggtccctggcatctagggaaactcgaattggattttgacctttgtgaaggtaccacggtagttgtcgatgaacactgcggatctagagggccgtcacttcgaacaactactgttaccggaaaaatcattcatgaatggtgttgtagaagctgtacacttcctccccttaggttcagaggcgaagatggatgttggtatggaatggagattagacctgtcaaagaaaaagaagaaaacctcgttaggagcatggtgtcagcgggaagcggggaagtagattccttttcattaggaattttgtgtgtgtcgataatgattgaagaggtaatgagaagccgttggagtcgaaagatgttaatgaccggaacattagctgttttccttttattgataatgggacagctgacatggaatgaccttataagattatgtattatggttggagctaacgctagcgacaaaatggggatgggcactacttaccttgccctgatggcgactttcaaaatgcgacctatgttcgcagtagggctgttatttagaaggctgacatctagagaagttttattacttacaataggtttgagtctagttgcatccgtagaattaccgaactcacttgaagaattaggtgatggattagcaatgggtattatgatgctcaaacttttaacagaatttcagccacaccagctatggacaacgctactatcacttacatttattaaaaccacattgagtttagattacgcttggaaaacgacagctacagtcctaagtattgtatcattatttcccttatgtttatctaccacatcacagaaaacgacatggttacctgtactactgggatcatttggttgtaaaccactcacaatgttcttaatcaccgaaaatgagatttggggtagaaaaagttggcccctaaatgaaggtattatggcgatagggatcgtttctatactattaagttccctactaaagaacgatgtacccctagccggcccacttattgctggtggaatgctgatagcttgctatgtgatcagtggctctagtgcggatcttagcctcgagaaagcagccgaggtaagctgggaagaagaggccgagcatagtggtaccagccacaatattctagtggaagttcaagacgatgggactatgaaaattaaagacgaagagagagatgataccttgaccatccttttgaaagctactttactcgctgtaagtggagtctatcctatgtcgatacctgccacattatttgtgtggtacttctggcagaaaaagaaacaacgaagtggagtactctgggatacacccagtccacccgaagtggaaagagcagtattagacgatggtatataccgaatactccaaaggggactattaggacgttcacaggttggagtgggggtttttcaagatggtgtattccacaccatgtggcatgtgactagaggagcagttcttatgtatcaaggcaaacgattagaacccagttgggcatcagtcaagaaagatcttatctcatacggtgggggttggaggttccaaggttcatggaacacgggagaagaggttcaagtcatcgctgtcgaacccggaaagaatcccaaaaatgttcaaacgacgccaggaacgtttaaaacccccgaaggagaagtaggagcaattgcactagatttcaaaccgggtaccagtggatcgcccatcgtaaatagggagggaaaaatagtcggattatacggcaatggagtcgtcactacaagtggaacttatgtgtcagcaatcgctcaagccaaggcctcgcaagaaggacctctacccgagatagaagatgaagtttttaagaaacgaaatttaacgataatggatttacatccaggttcgggcaagacgcgaagatacttaccagcgattgtgagagaagccattaaaagaaagctacgaacgttgatactagcaccgacacgagtcgttgcttcggaaatggcggaagctcttaaaggcatgcccatccgataccagactacagctgtcaaatcggaacataccggaagagagattgtcgatctgatgtgtcatgcaacattcacaatgcgccttttgtcaccagttagggttcccaactataatatgataataatggatgaagctcacttcacagatccagctagtatcgcagccaggggctacataagcactagagtcgggatgggggaggcagcagctatttttatgacggcaacacccccaggttctgtagaggctttcccacaatcaaatgcagtaatacaggacgaagaaagggatatccctgaaaggagttggaactcgggctacgactggataacagactttccaggaaagacggtctggttcgtacctagtataaaatcaggtaacgatatcgcgaattgtctaaggaaaaatggaaaacgtgtaatacaattaagtcggaaaacatttgacacagaataccaaaagactaaaaacaacgactgggactatgtagttactacagacatatcagaaatgggggcaaattttcgtgcagatcgtgttattgaccctagaagatgtctcaaaccggtcatattgaaagacggcccggaaagagttattctagctggaccaatgcccgtgaccgttgctagcgcagcacaaagaaggggcaggattggcaggaatcaaaacaaagaaggcgatcagtatgtctatatgggtcaaccgttaaataatgatgaagaccacgcccactggactgaagctaagatgttactagacaatataaatacgcctgaaggaataatccccgcactgtttgaaccggaacgcgagaaaagtgcagcaatagatggcgagtatcgtttaagaggggaagcgagaaaaacgtttgtggagctcatgagaagaggtgatctcccagtgtggctgagttataaagttgctagtgaaggttttcagtatagcgacagaagatggtgtttcgatggagagcgaaataatcaagtactagaagaaaatatggacgtagaaatatggacaaaagaaggtgaacgaaagaaactccgtccccgatggttagacgctaggacgtactccgatcctttagctctcagggagttcaaagaatttgcagctgggcgaagaagtgtgagtggcgatctaatattggaaattgggaaactccctcaacatttaactctacgggctcaaaatgcgcttgataacttggtgatgttacacaactctgaacaaggaggaaaggcctatcgacatgctatggaagaattaccagataccatcgaaacactaatgcttctagctcttatagccgtattaacaggaggggtaacgttattctttctgagtgggaagggcttaggaaagacaagtattggtcttctttgtgtcacagcctcttcggccttattatggatggcatcggtagagcctcactggatagctgcatcgatcattttagagttctttctaatggtgctacttataccagaaccagataggcagcgaacaccacaagataaccagcttgcgtacgtggtaattggcttattgtttatgatacttaccgtggcagcgaacgaaatgggtttactagaaacgacgaagaaagacttgggaataggacatgtggcagcagaaaatcaccaacacgctacaatgttggatgtagatcttcatcctgcgtcggcttggacattatacgctgtggccacgacagtaattacgccgatgatgaggcacacaattgagaatactacagcgaacatatctctaacagcaatagcaaatcaagcagctatactgatgggattggataaaggctggccaatttcaaagatggatctaggcgttccattattggcattagggtgttactcccaggtaaatcctttgaccctgacagcggctgtactaatgctagttgcccattatgcgattatcggaccaggccttcaagccaaagctacaagggaagcgcagaaaagaacagccgcaggaataatgaaaaaccccaccgtagatggaatagtcgccatagacctcgaccctgtcgtctacgatgctaaatttgaaaaacaattgggacaaattatgctacttatattatgtacctctcaaattctattgatgcgtacaacttgggctctctgtgaatcaataactttagcaactggtcccttaacgactttatgggaggggagtccaggaaagttctggaatactacaattgctgtgtccatggctaacatattcagggggagttacttggctggagctgggctggctttttcactaatgaagagtttaggtggaggaagaagaggaacaggagctcaaggtgaaactttgggagaaaaatggaaaagacaactcaatcaattaagcaaaagcgaatttaatacttataaaaggagtggaataatggaagttgacagaagtgaagctaaagaaggtttaaaacgaggagagacgactaaacacgcagtctctagaggtacagcaaaattacgatggttcgtcgaacgtaatttagtaaaaccagaagggaaagtaatagatttagggtgtggacgcggaggctggtcgtactactgtgcgggcctgaagaaagtgacggaagtaaaaggttataccaaagggggtcctggacacgaagaacccataccgatggctacatatgggtggaatttagtaaaattacattcaggaaaagatgtgttcttcatgccacccgagaaatgtgatactctactatgtgatataggcgaatcgagtccgaacccaactatagaggaagggcgcacactaagggtactaaaaatggttgaaccgtggctgcgaggaaatcagttttgcattaaaattttgaacccatacatgccttcagtcgttgaaacactcgaacagatgcaaagaaaacacggaggaatgctagtaaggaatccactttcaagaaattcaacgcatgaaatgtactgggtaagttgcggaactggaaacatcgtgagcgcagtcaacatgacctctcgtatgttgctaaacagatttactatggcacatagaaaacctacctatgaacgcgacgtcgatttaggggccggcacaaggcacgtcgccgtcgaacctgaagttgcaaacttagatattataggacagagaattgagaatattaagaatgagcacaaatctacatggcattatgatgaagataacccttacaagacatgggcatatcatggatcatatgaggtcaaaccctccggaagtgcgtcgtcgatggtaaatggagtcgtaagattattaaccaaaccatgggatgtaattcctatggttacgcaaatagctatgacggatactactccatttggacagcaacgagtctttaaagagaaagttgatactaggacaccaagagctaagcgtggaaccgcgcaaataatggaagttacagcaaaatggctctggggattcctgtccaggaacaagaagccaagaatatgcactcgtgaagaatttactaggaaggtgagaagtaatgcggcgataggagccgtgtttgttgacgaaaatcaatggaactccgcgaaagaagctgtcgaagatgaacgattctgggatcttgtacatagggaaagagaattacataaacaaggcaaatgtgctacatgcgtatataatatgatggggaaaagagaaaagaagttaggagaatttggtaaggcgaagggttccagagcaatatggtatatgtggcttggagcaagattcctagaatttgaagctctaggattcatgaacgaagatcactggttcagtagagaaaattcattgtcaggagtggaaggtgaaggattacataagctgggatatatcttacgagacattagcaaaattccaggaggaaatatgtatgccgatgacacagcaggctgggacaccagaataaccgaggatgatctgcaaaacgaagcaaaaattacagatataatggaaccggaacatgccttactagcaacatcgatatttaagctaacataccaaaataaggtcgtgcgggtccaacgtccggccaaaaatgggactgtcatggatgtaatatctagaagagatcaaaggggatcaggtcaggtgggaacttatggtttaaacacattcactaacatggaagtacaattaataagacagatggagtccgaaggtatcttctttccaagcgaattagaaagtccaaatcttgcggagagagtgcttgattggttagaaaagcacggtgcagaacgtttaaaacgaatggcaatttcaggagacgactgtgtggttaaaccgattgacgatagattcgctacagctttaatagcgttaaatgacatgggtaaagtcaggaaagacatcccacagtgggaaccatcgaaagggtggaacgattggcaacaagtacccttttgttcacatcacttccaccagttaataatgaaggatggaagagaaattgttgttccttgtaggaaccaagacgaattagtcgggcgggcaagggttagccagggggcgggttggagtctaagagaaacagcttgcttaggcaaatcgtatgctcaaatgtggcaacttatgtacttccacagaagagatctaagactagcagcaaatgcaatatgttcggcagttcctgtagattgggtgccaacatcacgtacaacttggtccatccatgcacatcatcaatggatgaccactgaagatatgttgagtgtctggaatcgagtctggatagaagagaatccttggatggaggataagactcacgtatcctcttgggaagaagtgccatatttaggaaaacgggaagatcagtggtgcggtagcttgatcggattaacagctcgcgcaacttgggcaactaacattcaggtggcgataaatcaagtaagacgcttaataggtaatgaaaactacttagactatatgacttccatgaaaaggtttaaaaacgagtccgaccccgaaggagccttatggtaa

SEQ ID NO: 21100 - RNA, 9879 nt, synthetic construct
  misc_feature 1..9879: note = derived and/or modified CDS sequence (opt6) from DENV-1__JX669469__SS-prME
  source 1..9879: mol_type = other RNA
agcgttacaatgcttttaatgttattacccaccgcattggcatttcatctaacaactcgcggtggtgaaccacatatgattgtatccaaacaagaaagaggtaaatcacttttatttaaaacaagcgctggtgtgaatatgtgtaccttaatagcaatggacttgggcgaactttgtgaagataccatgacttacaaatgtccacgtattacagaagctgaaccagatgacgtagactgttggtgtaatgccactgatacctgggtgacatatggtacgtgtagccaaactggggaacacaggcgcgataaacgtagcgtcgcactagcaccgcacgtgggactgggactggaaacgagaacggaaacatggatgtctagcgaaggagcatggaaacaaattcaaaaagtggaaacatgggcactccgacatccaggatttactgtaatagcactctttctagcacacgcgataggcacttctataacacaaaaaggaataatatttattctgttaatgcttgtaacaccaagtatggccatgaggtgtgttggtattggtaaccgagactttgtggaaggcctctccggagctacctgggtggatgtagttttagagcatggatcctgtgtcactacaatggccaaaaataaaccgaccctagatatagaattgttaaaaactgaggttacaaatccggcagttctgagaaaactatgtataaaagctaaaatttctaacacaaccacagattcccgttgtccgacccaaggagaagcgacgcttgttgaggaacaagatgcaaactttgtatgtcgacggacttttgttgaccgagggtggggaaacggttgtggcttgttcggtaaaggaagtcttctgacatgtgctaaatttaaatgtgtcacaaaacttgaaggcaaaattgtacaatatgaaaatctgaaatactccgtaattgtgacagtgcatactggggatcagcatcaggttggaaatgaaactaccgagcacggtactatagccacaataactcctcaagcgcctacttccgaaattcaattaacagattacggtgccctcacattagactgtagtcctcgcactggattagattttaacgaaatggtattgctaaccatgaaagaaaaatcttggctagtacataaacaatggttcctcgacctcccgttaccgtggacatcaggagcgtcgacaagtcaagagacatggaaccgccaagatttattggtaacgtttaaaaccgctcacgctaagaaacaagaggtagtagtgttaggttctcaagaaggagcaatgcatacagcattaacaggggctactgaaattcagacatccggtacaactacaatatttgcgggtcacttgaaatgtcgtttaaagatggataaactaacgttaaaagggaccagctatgtaatgtgtactggatctttcaagctggaaaaggaggtagcggagactcaacatggaacagttctggtgcaagttaaatatgagggtacggacgcaccttgtaaaatccccttctcaacgcaagacgaaaaaggagtaactcaaaacggacgattaatcacggcaaatccaatagtcacagacaaagaaaaacctgtgaatatagaaaccgaacctccattcggagagagttatatagtcgtcggggccggtgaaaaagcattgaaattgagctggttcaagaaaggtagttcaattggcaagatgtttgaagccaccgccaggggagcaaggcgtatggcaatcctcggcgatacggcatgggatttcggcagtataggcggggtttttacctcagtagggaaattggttcatcaagttttcggaacagcctacggtgttttatttagtggagtctcgtggactatgaagataggaataggaattttgttgacgtggttgggactaaattcacgatcgactagcttatccatgacatgtatcgctgtcgggatggtcacactttatttaggagtcatggtacaagcggactccggctgcgtcataaactggaaagggagagagctcaaatgtgggagtggaatatttgtaactaacgaagtacacacatggacggaacaatataagttccaagctgattctcccaaaagacttagtgccgccataggtagagcatgggaagaaggagtatgcggaatacgtagtgcaaccagattggagaatattatgtggaaacaaataagcaacgaacttaatcacatcctactggaaaatgacattaagttcactgtcgtcgtgggcaatgccaatggtatactcgcacaggggaagaaaatgataagaccacaacctatggagcataaatacagttggaaatcctggggtaaggcaaagattataggagcggacattcagaatacgaccttcattattgatggtcctgacacaccagaatgccctgacgaacaacgagcatggaatatatgggaggtggaagactatggattcggtatattcactactaatatatggcttaaactgagagattcatatacacaaatgtgtgatcacaggttaatgagtgcagcgatcaaagactcaaaggcagtacatgcagacatgggttattggatagaatctgagaaaaatgagacttggaagctagcacgcgcatcatttatcgaggtaaaaacatgtatttggccgaagtcacatactctttggtccaacggtgtactagagtctgaaatgataatcccgaaaatgtacggagggcctatatctcaacacaattatagacccgggtactttacacaaactgcaggaccgtggcatctaggaaagctagaactagattttgacctatgtgaaggaactacagttgttgttgacgaacattgtggctcaagaggaccttcactccgaacaacaactgtaacagggaagatcatccatgaatggtgttgccgatcttgcaccttgcctccactacgttttcggggagaagatggatgttggtatggtatggaaatacggccagtaaaggaaaaagaagagaatcttgtgaggtctatggtatccgcaggatcaggggaagttgactcttttagtttaggtattttgtgtgtatcaataatgatagaggaagtaatgaggagtcgctggagcagaaaaatgttgatgactgggacactagcagtgtttctactgctcattatggcacaactaacctggaatgatttgatacgactatgcatcatggtaggtgcaaatgcctctgacaaaatgggaatgggtactacttacttagccttaatggccacattcaaaatgcgtcctatgtttgcagtagggctcttgttcagacgcctgacctcacgtgaggtcctactgttaacaatcggtcttagtctcgttgcatcggttgagctcccaaatagcctagaggaattgggggatggacttgcgatgggcataatgatgttaaaattgttaaccgagtttcaacctcatcaactctggacaactttgctaagcctaacgttcattaaaactacgttaagcctggactatgcatggaaaacaactgctatggttctaagcattgtctccctatttccattatgtctgagtacaacttctcaaaagacaacatggttacccgtactcctcggttcattcggttgtaagccccttactatgtttttaatcaccgagaacgagatatggggtcgtaagagttggcctttaaatgaaggtataatggcgattgggatcgtaagtatattactgagtagtttacttaaaaatgatgtacctttagcggggcctctaattgctggaggaatgctcatagcctgttatgtaattagtggaagttccgcagatttatcacttgagaaagcagcagaagtaagttgggaagaagaagcagaacattcaggaacaagtcacaatatactcgttgaggtgcaggacgatgggacaatgaaaattaaagatgaagaaagagacgacaccttaaccatattgttaaaagcaactctccttgctgtaagcggagtttaccccatgtcgatacctgcaacattatttgtctggtacttttggcagaagaagaaacaaagatcaggggtactgtgggacacaccatcaccgcctgaggtcgaacgagccgttctagacgatggaatatatcgtatactgcagcgaggattgcttggcagatctcaagtaggtgtaggcgtttttcaagatggggtttttcatacaatgtggcacgttactagaggtgcagtcctcatgtatcaaggaaagaggctagagccatcgtgggcatctgtgaagaaagatctaatatcttatgggggtggatggcgatttcaaggttcatggaacactggggaagaagtacaggttatcgcagtagaacctgggaagaatccaaagaatgttcaaacgactcctggaacatttaaaactcccgaaggagaagtgggcgccattgctctggatttcaagccaggtacctctggaagtccaattgtgaacagagagggcaagatagtgggattatatggaaatggcgtagtcacaacaagtgggacttacgtctccgcgatagcgcaggctaaagcctcccaagaagggccacttccggaaatagaagatgaggtctttaagaaacgaaacctgacgataatggacctacatccaggaagcggcaaaacccgaagatacctaccagcgatcgtaagggaggcaatcaaacgaaaactcagaacacttatacttgcacctacgcgagttgtagcatccgaaatggcagaggctttaaaaggaatgccaattaggtatcaaacgactgcagtcaaatctgaacatacaggcagggaaattgtagatctcatgtgtcacgcgacatttaccatgcgactacttagcccagttagagtacccaattacaatatgataataatggatgaggctcatttcacagacccggcatcaattgctgcacggggttatataagtacacgggtcggcatgggggaagcggcagcaattttcatgactgctacacccccagggagtgtcgaagcctttccccaatcgaatgcagttattcaggatgaagaacgcgatataccagaaagatcctggaactcaggctacgattggatcactgactttcctggtaaaacagtctggtttgtaccatcgataaagtcaggcaatgatatagcaaattgcctccgcaagaatggaaaacgagtgattcaactttctaggaaaacgttcgatacagaataccagaaaaccaaaaacaatgactgggattatgtcgttactacagatatttcagagatgggagcgaacttcagagcagacagagtgatagatcccagaagatgtttaaaaccagttatactaaaagatggaccggaaagggtaattttagcaggcccaatgccagttaccgtagcctcagcggcacaaagaagaggcagaataggccgtaaccaaaataaagaaggcgaccagtatgtatatatgggtcaacctctaaacaacgatgaagaccacgcgcattggacagaagccaaaatgttattagacaatataaatacgccagaaggaattataccagcgttgttcgaaccagagcgcgaaaagagtgcagcaatagatggagagtatcgtctgcgtggtgaggccagaaaaacttttgttgaattaatgcgccggggcgatttaccagtatggctaagctataaagtagcctcagagggatttcaatatagtgacagaagatggtgctttgacggagaaagaaacaatcaagttctagaggaaaatatggatgtagaaatatggacaaaagagggagaaagaaagaaactgagaccaagatggttagatgcgcgaacatattcagacccgctcgctctacgagaatttaaagaatttgcggcagggagaagaagtgtaagcggcgatctaatactagaaataggcaaactcccccaacacctcacattacgcgcacagaacgcgctagacaacttagtaatgttgcacaacagcgagcaagggggcaaagcctatagacatgcaatggaagaactgccagacacaattgagaccctgatgctcttagcgctaatagcggtccttacaggcggtgttacattattctttttatctggaaaaggactaggtaaaacttctataggcctcctatgcgttacggcttctagtgcgttattatggatggcctcggtcgagcctcactggatagcggcatcaataatattagagttctttcttatggtattacttatccctgaaccggacagacaacgaacaccccaagataaccaattggcatacgtcgtaattggacttttattcatgattttaacagttgcagctaacgaaatggggttactcgagacgactaagaaagatttaggcataggacatgtagcggctgagaatcaccagcatgccacaattctagatgtcgatctgcacccggcgtcagcctggactttatacgcagtagcgacaaccgtgattacgccaatgatgagacacacaattgaaaatacgaccgctaacatttcattaacagccatagcaaatcaagccgctattctaatgggccttgataagggatggccaatctccaaaatggatttaggtgtgccactacttgctctcggttgctacagccaagtgaatccattaacattgacagccgctgtcctcatgctagtagcccattacgcgattataggaccgggactacaggcgaaagctacaagagaagcacagaaaagaacggctgcagggataatgaaaaatcccactgtagatggaattgtagcaatcgatctagaccccgtagtttatgacgctaaatttgagaagcaattaggacaaataatgcttcttatactttgcacgtcacaaatattacttatgagaaccacttgggccctatgtgaaagtataaccctagccaccggacccttaaccacactatgggagggcagcccaggtaagttctggaatacaactatcgcggtaagtatggcaaatatattcagaggaagttatttagctggtgcgggtttggcatttagcttgatgaaatcacttggcggtggtagaagaggcacaggagcacaaggagagaccctgggggaaaagtggaagaggcaactaaatcaactgtcaaaatctgagtttaacacgtataaacggtcagggataatggaagtagatcgatccgaagcgaaagaggggttgaaaagaggcgaaacaactaaacacgccgtcagccgtggtactgcaaaattgagatggtttgtagagaggaatttagtaaaaccagaaggcaaagtgatagaccttggttgcggacggggaggttggtcatactattgtgctggcctaaagaaagtcacagaagtgaagggatacacaaaaggagggcctggacatgaggaacccatacctatggccacatatggctggaacctggtgaaattacactccggaaaagacgtattcttcatgcctcccgaaaaatgtgatactttactatgtgacattggcgaaagcagcccaaatcctacaattgaagaaggacgtacattgcgcgtgctcaaaatggtagaaccatggctgcgaggaaaccaattttgtattaaaatactcaatccatacatgccatcggtagtagaaaccctagaacaaatgcagagaaaacacggcggcatgttggtacggaatcccttgagcagaaattcaacacatgaaatgtactgggttagttgtggaaccggaaatatcgtctccgctgtcaatatgaccagtcgaatgctattaaacagatttaccatggcccacagaaaaccgacatatgagcgagatgtagatctaggtgccggaacacggcatgtagccgttgaaccagaagtagctaatctagatattataggccaaagaatcgaaaatatcaaaaatgagcacaaatcaacctggcattacgatgaagataacccttataagacttgggcatatcatggtagttacgaagtgaaaccatcaggtagtgcatcgtccatggtaaatggagtagttcgtcttcttacaaaaccttgggatgtgattccaatggtgacgcagatagcaatgacagacaccactccattcggccagcaaagagtgtttaaggagaaagtcgacacaagaaccccaagggccaaaagaggaacggctcaaataatggaagtcactgcgaagtggctctggggtttcttaagtagaaataagaaacctcgtatttgtactcgcgaagagttcacccggaaagtacggtctaacgcagcgatcggagcagtgttcgttgatgaaaaccaatggaactcagccaaagaagcagttgaagatgaacgattttgggatctagtacaccgggaaagagagttgcataaacaaggaaaatgtgcaacttgtgtatacaacatgatggggaagagagagaagaaactaggtgagttcggtaaagccaaaggatcacgtgcaatttggtacatgtggttaggagcacgatttttagaatttgaagccctaggtttcatgaacgaagaccattggttttcaagagaaaatagtttaagcggcgtagagggagaaggactacacaaactaggatatattctaagagatatatcgaaaataccaggtgggaatatgtatgcagatgacacagccggttgggatacgaggattactgaagatgatctgcaaaatgaagcgaaaattacagatataatggaacctgagcatgcattattagctacctcaatcttcaaactgacatatcagaataaagtagttcgagtacaaagaccagccaaaaatggtacagtcatggacgttatttctcgaagagaccaacgtggatctggacaagtgggaacatatggtctcaacacgttcactaatatggaggttcaattaataaggcaaatggagagcgaaggtatctttttcccgtcggaactagagtcacccaatctggccgagagggtgttagactggctcgagaaacatggggccgaaaggctaaagcgtatggcgatctccggagatgactgtgtagttaaaccgatagatgaccgatttgcgacagcattgattgcattgaatgacatgggcaaagtgcgcaaggatataccgcaatgggagccaagtaaaggttggaatgattggcagcaagttccgttctgctcacatcattttcaccaactaataatgaaagacggaagggaaattgtggtcccttgtcgtaatcaagacgagcttgtgggcagggctagagtttcacaaggagctggttggtctttaagagaaactgcatgtttaggaaaaagttatgcgcaaatgtggcaattaatgtacttccacagaagagatcttagattagctgctaacgctatttgtagtgccgtgccagtagactgggtgcccacatcaaggacaacatggtccattcatgcccatcaccagtggatgaccacagaggatatgttatcagtatggaacagagtctggattgaagaaaatccatggatggaagataaaacacacgttagcagctgggaggaagttccctacttaggaaagcgagaggatcaatggtgcggaagccttataggattgacagcaagggctacctgggcaactaatatccaggttgcaataaatcaagtacgtcgtcttataggaaatgaaaactacctggactatatgacttcaatgaaaagattcaaaaacgaatctgacccagaaggagcattgtggtaa

SEQ ID NO: 21101 - RNA, 9879 nt, synthetic construct
  misc_feature 1..9879: note = derived and/or modified CDS sequence (opt6) from DENV-1__JX669470__SS-prME
  source 1..9879: mol_type = other RNA
tctgtcacaatgttgctcatgttactcccaacggcacttgcatttcatctgacaacccgcggaggtgaacctcatatgattgtaagtaaacaagaaagaggtaaaagccttttattcaaaacatcagctggggtcaacatgtgcacattaatagcgatggacttaggtgaattgtgtgaagatactatgacatataaatgcccgcgcattacagaggctgagcctgatgacgtagactgttggtgtaatgccacagatacatgggtaacttatgggacatgtagtcaaacaggtgagcatagacgggacaaaagatccgtcgcgctagcaccacatgtcggacttggtttggaaacaagaacggaaacctggatgtctagtgagggagcatggaaacaaattcagaaagtagagacctgggccctacgtcatcctggttttacagtaatcgctcttttccttgctcatgccatagggacttcaataacccaaaaaggaatcattttcatactattaatgttagttacaccctctatggcgatgaggtgcgtaggtataggtaatcgggatttcgtagaaggcctctcaggggcgacatgggtagatgttgtgctagagcatggctcttgcgtgactacaatggccaaaaataaacctacactagacattgaactacttaaaacggaagttactaatcccgcagtgcttcggaaactatgcattgaagctaaaataagcaatacaacaacggacagtagatgcccaactcaaggagaggcgacgctagtagaagaacaagatgccaactttgtttgtcgtagaacatttgtagaccgagggtggggtaacggctgtgggttatttggaaaagggagcttattaacttgtgctaaattcaaatgtgtaacaaaattagaagggaaaatagtccagtatgagaatttaaaatacagcgtaatagtaactgtgcatactggagatcaacatcaagtaggaaatgaaacaactgagcacggaactatagccacaataactcctcaggcaccaacttcagaaatacaattaaccgattatggtgccctaacattagactgctcacctcgtacaggtcttgattttaatgaaatggtactattaacaatgaaagagaaaagttggttagtccataaacaatggtttctagatcttcctttaccatggacttcaggtgcctccacctcgcaagaaacttggaacagacaagatctattagtaacatttaaaacagcacacgcaaagaaacaagaagtagttgttttagggtctcaagaaggggcaatgcacacagcgcttacaggggcaactgagatacagacaagcggaactactacaatattcgcaggtcatctgaaatgtcgactcaaaatggataaactgacgttaaagggtatgtcctacgttatgtgcactggaagtttcaaactagagaaagaagtagctgaaacacaacatggaacagtgttagtacaggtaaaatatgagggaactgacgctccgtgtaagataccattttctacacaagatgagaaaggcgtaacacaaaacggtcggcttataacagctaatcctatagttacagataaagaaaaaccagtaaatatagaaacagaacctccgtttggcgaaagctacatagttgtaggcgctggagaaaaagccttaaaacttagttggttcaagaaaggctcatcaatagggaaaatgtttgaggcaacagcaagaggcgctagaagaatggcaatactaggtgatacagcttgggattttggcagtataggtggcgtttttacatctgttggcaagctcgttcatcaagtgttcggaactgcttacggagttttattcagtggggtatcgtggactatgaagataggaattggaatattgcttacttggctagggcttaactctcgatccacatcactttccatgacctgtattgtggtgggcatggtaaccctatatctaggtgttatggtacaagctgactcaggatgcgtcataaattggaaaggtcgagaattaaaatgtggatcaggaatatttgtcactaatgaggtacacacttggactgaacaatacaaatttcaagctgatagtccaaagcgtctctccgctgctattggacgggcatgggaagaaggtgtatgtggcatacgatcagcgacccgtctggaaaatattatgtggaaacagataagtaatgaattgaaccatattttattagaaaatgacataaaatttacggtagtagtagggaacgcaaacggcattttagctcaaggcaaaaagatgatacgccctcaacctatggaacataaatattcatggaaatcctggggtaaagcaaaaataataggggcagacattcagaatacgacatttataatcgatggacctgatactcccgaatgtccagacgaacaacgcgcatggaatatatgggaagttgaagactatggcttcggtatcttcaccacgaacatatggttgaaattacgcgattcatatacacaaatgtgcgatcacaggcttatgtcagccgcaataaaagactcgaaagctgttcatgccgatatgggatattggatagaatcagaaaagaatgagacatggaaactagcacgagcttctttcatagaagtaaaaacctgcatatggcccaaatcacacactctctggtcaaacggcgtcttagaatcagaaatgataataccgaaaatgtatggcggtcccatatctcagcacaattacagaccaggatattttacacagacagctggaccgtggcatctaggtaaacttgaattagactttgatttatgtgaagggaccaccgtagtagtagacgaacactgtgggagccgaggcccgtctcttagaaccacgacagtaacaggaaaaataattcacgaatggtgttgtagatcctgtactttgccgccactaagatttcgcggtgaggacggttgttggtacggcatggaaattagacccgtgaaagaaaaggaagagaatttagtcagatccatggtaagtgctggaagcggagaagtcgactccttctcgttaggcatcctatgcgtttcaataatgatcgaagaagtaatgagatcccgatggagtcgaaaaatgttgatgacaggaactttagctgtattccttcttcttattatggggcagttaacttggaacgacctaataagactctgcattatggtcggcgctaatgcaagcgataaaatgggaatggggacaacttacttagcactaatggcgacttttaaaatgagacctatgttcgctgtaggactgctattcagacgccttacaagccgagaggtgctcctcttaacaattggactctcgctggtagctagcgtagaattaccaaactccttggaggagctcggagatggtttagccatgggtataatgatgttgaaattgttaaccgaatttcagcctcaccaactgtggactacattgttatccctaactttcatcaagactacattatctttagattacgcatggaagactacagcaatggttctgtcgatagtttcactatttccgctatgtcttagcactaccagccagaaaacaacttggctacctgtgttgctaggatcatttggttgtaaacctttgacaatgttccttataacagaaaacgaaatatggggcaggaaaagttggcccttgaatgagggtatcatggctgtaggaattgtttctatactcctttcatcactacttaaaaacgatgtaccattagcaggtcccttaatagccggaggtatgttgattgcttgttatgtaataagtggttccagcgctgatctcagtctggagaaagccgcggaagtaagttgggaagaagaggcagaacacagtggaacaagtcataatatactggttgaagtgcaggatgatggcacaatgaagattaaagacgaggaaagagacgacactctaacaatattgcttaaagctaccctgctagcagtgtctggagtataccccatgagtatacctgccactttattcgtctggtatctctggcagaaaaagaaacagcgaagtggtgtcctttgggatactccttcaccaccagaagtagaaagggccgtattagatgatggtatataccgcatattacaacgggggttgttagggcgaagccaagttggtgtcggtgtcttccaagatggtgtgtttcatacaatgtggcatgtcactagaggggccgttctaatgtatcagggaaaacggctcgagccaagctgggcctccgtgaagaaagatttaatatcttacggaggtggttggagatttcagggatcatggaatacaggtgaggaagtacaggtaatagccgttgaaccaggcaaaaacccgaaaaacgttcaaactacgcctggtacttttaagaccccagagggtgaagtcggggcaatagcacttgattttaaacctggaacatctggatctcctattgttaatagagaggggaagattgtaggtctttacggaaatggtgtcgttacaacttcaggtacatatgtgtctgcaatagcacaggcaaaagcgagtcaagaagggccgctaccggaaatcgaagacgaagttttcaagaaacgaaatttaaccattatggatctacatcctggatcaggtaagactcgtcgatacttgcccgctattgtaagagaagcaattaagaggaaactgcggacactcatcttagcaccaacgagagttgttgctagtgaaatggcggaagcactgaaagggatgcctattcgatatcaaacgacggcagtcaaaagtgaacatacaggaagggaaatagttgacttaatgtgtcatgcgacctttaccatgcgactgttaagtccagtgagagtaccaaattacaacatgattatcatggatgaagcacattttactgatcccgccagtatagctgcgcgtggctacatttcgactcgagtaggtatgggtgaagcggcagcaattttcatgacagcaactccgccaggaagtgtagaggcattcccacaatccaacgccgtgatccaagatgaagaacgagacatccccgaaagatcgtggaactcaggttatgattggattacggacttcccggggaaaacagtttggttcgtaccttcaataaaatctggtaatgatatagcaaattgtctaagaaagaatggaaaaagggtcatacaacttagtagaaagacgttcgacaccgaataccaaaagacaaagaataatgactgggactatgtcgtaacaacagatataagcgagatgggtgcgaacttccgagctgatagagttatcgatccccgacggtgcttgaaacctgtaatactaaaagatggccctgaaagagttatattggcaggacccatgcctgtaactgttgcttcagccgctcaacggcgtggtcggataggaaggaatcagaataaagaaggagatcaatacgtatatatgggccagcctcttaataacgacgaagatcatgcgcattggactgaagcgaagatgctgctcgacaacatcaacacaccggaaggcataatacctgcattattcgaaccagaaagagagaaatctgcagccatagacggtgaatataggcttagaggagaagctaggaaaacatttgtagagttgatgagacgcggagatctcccagtctggctaagctacaaggtcgcgtcagaagggtttcaatatagtgacagacgttggtgctttgacggcgaacggaataatcaggtgctcgaagagaatatggacgttgagatttggactaaggaaggagaaaggaagaaactaaggccaagatggttggatgccagaacctatagtgaccctcttgcactaagagaatttaaagaatttgcggcaggaaggagatctgtctccggagatttgatattagaaattggaaagctgccacaacatttaacgttaagggcccaaaacgcattagacaacctggtaatgttacacaatagtgagcaaggtggtaaagcgtaccgtcatgcgatggaagaactgcccgatactatagaaacgttaatgttgctcgccctgatagcagttttgactggtggggttactttattctttctatcaggaaaaggacttgggaaaacgtccattggtttactgtgtgtaaccgccagtagcgcactattatggatggcatctgtagaaccgcactggattgcagccagcataatactagagttctttttgatggtattgctgatcccagaaccagacagacaaagaacaccccaagataaccaacttgcatatgtagtaatagggttgttattcatgatcctcaccgtagctgcaaatgaaatggggcttcttgaaactactaagaaagatttaggaatcggacacgtagctgcagaaaatcatcagcatgcaacaatgttggatgtagacttgcatccagcatcggcatggacgctatacgctgtggcgaccacagtgataacaccgatgatgagacacaccattgagaacacaacagctaatatttcactaaccgctatagctaaccaagcagctatattaatggggctagacaagggctggccgatatcaaagatggatctgggagtcccgttattggcattgggatgttattcacaagtaaacccactaaccctcacagcagcagttttgatgcttgtcgcacattatgccataataggtccagggctacaggcaaaggcaacacgagaagcccagaaaagaacggcggcaggaatcatgaaaaatcccacggtagatggaatagttgctatagatctagacccagtagtatatgacgcgaaattcgagaaacaactcggacagataatgttactgattctttgcactagccaaatcctactaatgagaacaacatgggcgctatgcgaaagtataacactagctacgggaccacttacgacactttgggagggatctcctgggaagttctggaatactactatcgccgtttcaatggcgaatatcttccgaggatcttatctggccggagctggcttggcattttcattaatgaagtcattgggaggcggtaggcgcggaacaggcgcccagggcgagacgttaggtgagaagtggaagcggcagctaaaccagctaagtaaatcagagtttaatacttacaaaaggagcggaatcatggaagtagaccggagtgaggccaaagagggactaaagcgtggagaaacaaccaagcatgcagttagccgtggcaccgcaaaactgaggtggttcgttgaaagaaacttagtaaaacctgaaggcaaagtaattgatctgggatgcggcaggggagggtggagctattattgtgcagggctaaagaaagtgacggaagtaaaagggtacaccaaaggtggaccagggcacgaggaacctatacctatggcgacatatggatggaacttagtaaaactacattccgggaaggatgtattctttatgccacccgaaaaatgcgatacactcttatgcgacattggagaaagttcacctaatccaacaatagaagaaggacgtacattgagagttctcaaaatggtagaaccttggctgagaggcaatcaattctgtataaaaatactaaacccatatatgccgagcgttgtcgaaacactcgaacaaatgcaaagaaagcatggcggcatgctagtcaggaatcctttatcgcggaacagcacgcacgaaatgtactgggtctcatgcggaacgggtaatatagtatctgctgtaaatatgacatcacgaatgctattaaataggtttacaatggcgcatcgtaaacccacttacgaaagagacgtagatttaggggcagggacccgtcatgtagctgtcgaaccagaagtagctaatttggatattatcggacaaagaatcgagaatatcaaaaacgaacataagtctacatggcattatgacgaagataacccctataaaacttgggcctatcatggcagttatgaggtgaaaccttcgggatccgcgagcagtatggttaatggagtcgttagacttctaactaaaccatgggatgtaatacctatggtaactcaaatagcaatgacagatacaacaccatttggacagcaaagggtctttaaggaaaaggtggatacgagaacgccaagggctaagcgaggtactgcacaaataatggaagttactgcaaagtggctctggggctttctctcgcgcaacaagaaaccacgcatttgtacaagggaagaatttacaaggaaggttcgatcaaacgcagccataggcgctgtattcgtcgacgaaaatcaatggaactcagccaaagaagctgtcgaggatgaaaggttttgggatttagttcatagggaaagagaactacataagcagggaaaatgtgctacgtgtgtgtacaacatgatgggcaagcgagagaagaaattaggagaatttggaaaagccaaaggcagcagagcaatttggtacatgtggcttggagcaaggtttctagaatttgaggctctgggttttatgaacgaagaccattggttttctagagaaaacagcttatccggggtagaaggtgaaggactacataaacttggttacattctacgcgacatatctaaaattcccgggggaaacatgtacgccgacgacacggcgggctgggacacccgaataacagaggatgatctccgtaatgaggcaaagattacggatataatggaacctgaacatgcattgctagcgaccagtatatttaaattaacataccagaacaaagttgttagagttcaacgaccagctaaaaatggaacagtaatggatgtgatatcccgcagagatcaaaggggtagtggccaagtaggaacttatggactgaatacctttactaacatggaggtacaattaatacggcaaatggaaagtgagggcatattctttccatctgagctcgaatctccaaacctagcagaaagagtactagattggcttgaaaaacacggcgctgaacgacttaaaagaatggcaatctccggtgacgactgcgttgttaaaccaatagatgataggtttgcaaccgccctaattgcactcaacgacatgggaaaagtgcgaaaagatatccctcagtgggagccaagcaagggttggaatgactggcaacaagttcctttttgttcccaccatttccatcagctcataatgaaagatggaagagaaattgttgtaccatgccgaaaccaagatgaacttgtaggtagggctagggtcagtcagggagccggttggtctttgcgcgaaacagcatgtctgggcaaaagttacgcacaaatgtggcaactgatgtacttccaccgaagggacttgcgactagctgccaacgctatctgctctgcagtaccagtagactgggttccgacaagtcgtacaacatggtcgatccatgctcatcatcaatggatgactacggaagatatgttgtcagtatggaatagagtatggatagaagaaaacccgtggatggaagacaagactcacgtttctagctgggaggaagtcccttatttaggaaagagagaagaccaatggtgtggcagcttaataggactaacagcaagggcaacatgggcaacaaacatacaagttgcaataaatcaagtacgcagattgataggcaatgagaactatttagactatatgacatcgatgaaaaggttcaaaaacgaatcagatccagaaggagcattgtggtag

SEQ ID NO: 21102 - RNA, 9879 nt, synthetic construct
  misc_feature 1..9879: note = derived and/or modified CDS sequence (opt6) from DENV-1__JX669471__SS-prME
  source 1..9879: mol_type = other RNA
tcagttacgatgctcctaatgttactcccaacggctctagcatttcacttaactaccagaggaggcgaaccacatatgattgtctcaaaacaagaacgagggaaatccttattatttaaaacttccgcaggcgtgaacatgtgcacattgatagcaatggacctaggggagttgtgcgaagacactatgacttataaatgccctaggatcactgaagcggagcctgatgatgttgactgttggtgtaacgcaacagacacgtgggttacatacgggacatgctcacaaacaggggaacatagaagggataaacgaagtgtcgcgttagcacctcacgttgggctgggacttgaaaccagaactgaaacttggatgtcaagtgaaggagcatggaaacaaattcaaaaagtcgagacgtgggcactacgacatccaggctttaccgtgattgccctattcctggcacatgctatcggaacatcaattacacaaaaagggataatttttattctcttgatgttagtaacgccatcaatggcgatgcgatgtgtaggaataggaaaccgagactttgttgaaggattatccggagcgacatgggtagacgtcgtcctcgagcatggtagttgtgtaaccacaatggccaaaaacaaacccacattggatatagaactgctgaaaaccgaagttacaaatcccgcagtcctccgcaaattgtgtatagaggcaaaaatcagcaacacaacaactgatagtaggtgtcctactcaaggagaggcaactttagtggaagaacaagacgctaattttgtgtgccggcggacgttcgttgatagaggttggggtaatggttgcggtttattcggaaaaggctccctgttaacatgcgccaaatttaagtgcgtgacgaaactagaaggtaaaattgttcaatatgaaaaccttaaatattctgtaatagttaccgtccacacaggcgatcaacatcaagttgggaatgaaacgacagaacatggaacgatcgcaacaattactccacaggcgcctacttcagaaattcaactgacagattacggagcactaacgcttgactgctcgccaagaacaggtctcgattttaatgagatggtattgctaacgatgaaagaaaaatcatggttagtacacaaacaatggttcctggacctcccattaccatggacatcaggtgcatctactagccaggaaacatggaatcgccaagacctattggtgacatttaaaacggcccatgctaagaagcaggaagtagtggtactcggctcacaagaaggcgcgatgcacacagctttaacaggggcaacagaaattcagacgagcggcacaacaactatatttgccgggcacttaaagtgtaggctgaaaatggataaacttacactcaaaggcacatcgtatgtaatgtgtactggtagtttcaaactagagaaagaagtcgcagagacccagcatgggacagtattggttcaagtaaaatatgaaggtactgacgctccctgtaaaatcccctttagtactcaagatgaaaaaggcgtgacgcaaaacggacgtctaattaccgctaatccgatcgtcactgacaaagagaaacctgttaacatcgagaccgaacccccatttggtgaatcgtatatagtggtaggtgcgggggaaaaggctttaaaattaagctggttcaagaaaggaagttcaattggcaaaatgtttgaagcaacagctcgaggagccagaagaatggccatactaggcgatacagcttgggatttcgggtcaattggaggagtattcacatctgtaggaaagctggttcaccaagtcttcgggacagcttacggagttctatttagtggtgtatcctggactatgaaaataggtatcggtatactactaacatggcttggtctaaattctcggagcaccagtctctctatgacatgcattgctgttggtatggtaactctatatctaggggtaatggtacaagctgattccggttgtgtcataaattggaaaggcagagagttaaagtgcggaagcggtattttcgtaactaacgaggtacatacgtggaccgaacaatataaatttcaagcagattcaccaaaacgtctaagcgcagctatcggaagggcctgggaagagggagtgtgcggaatacgatcggcaacgagattagagaatataatgtggaaacaaatatcgaatgaactgaatcacattctattagaaaatgacataaaatttacagtagtcgttgggaacgccaacgggatcttggcacaaggcaagaagatgataagaccccagccaatggaacataagtactcttggaaaagttggggtaaagcaaagattataggcgcggatattcaaaacaccacatttataattgatggaccggacacacccgaatgtccagatgaacaacgggcgtggaatatctgggaagttgaagactatggatttggtatttttacaacgaacatttggttaaaactcagagatagttatacacagatgtgcgaccatagattgatgtcagctgcaattaaagattctaaagccgtacacgcggacatgggttactggattgaatctgagaaaaatgaaacatggaaattagctagagcctcattcattgaggtaaaaacatgcatctggccaaaatctcatacactatggagtaatggcgtattagaaagcgaaatgatcatccccaaaatgtacggaggaccaatatcccaacataattatagacccggatattttacgcaaactgctggaccatggcacctcggaaaacttgaactggatttcgacttatgtgaaggaaccacggttgtagtggatgaacattgtggctccagaggtccctctttgcgaactactacagtgactggaaaaatcatccatgaatggtgttgtcgatcatgtacattgccaccattgaggtttaggggagaggatggatgctggtatggtatggagattcgacctgtaaaagaaaaagaagaaaatttagtcaggagcatggtctcggctggctcaggggaagtagactcattctctttagggatactctgtgtatcgattatgatagaagaagtcatgcgaagccgatggtctaggaaaatgctgatgacgggcacactagctgtcttccttctactgataatgggacaactaacgtggaacgacttaataaggctttgtataatggtgggtgctaatgcctcagataaaatgggtatgggaacaacttacttggctctaatggcaaccttaaaaatgcgaccgatgttcgcagtgggcctattattcagaaggctgacaagtagagaggttttactactcaccataggtctttcattggtcgcatccgttgagctcccaaactcattggaagaactaggcgatggactggccatgggaataatgatgttaaaactactaaccgagtttcaaccacaccaactgtggactaccctattgagtcttacatttataaagactaccctcagtttagactatgcatggaaaacaacggcaatggtcttgtcaattgtttcattattccccctgtgtttatcaacgacaagtcagaaaacgacttggcttcctgtattgctagggtctttcggttgtaaacctttaacaatgtttttaataacagaaaatgaaatatggggaaggaaatcatggccactaaatgaaggtataatggctataggcatcgtaagtatactattgtcatctttacttaaaaatgatgtaccattagctgggcccctgattgcaggaggtatgttaatagcttgctatgtaatcagtggttcctccgccgatctatctctagaaaaagcggcagaagtttcctgggaagaagaagcggaacatagcggcacaagtcacaatatcctcgtagaagtccaagatgacggaactatgaaaataaaagacgaagagagggatgatacattaacaatccttcttaaagcaaccttactagcagtatctggtgtgtatccaatgagcataccagctaccctatttgtatggtacttctggcaaaagaaaaagcagcgaagtggggttttatgggacacccccagtccaccggaagttgagagagccgtattagatgatggaatttacaggattctccaaagagggttattaggcaggtcgcaagtaggagtgggtgtttttcaagatggggtttttcacaccatgtggcatgtcacgaggggcgctgtactgatgtaccaaggaaaaaggttagaacctagctgggctagcgtcaagaaagatcttatatcctatggagggggctggagatttcagggatcatggaacaccggtgaagaagtacaagttattgctgtagaacctggcaaaaaccctaaaaatgtacaaacgaccccgggtacttttaaaacaccagagggggaagtaggagcgatagctttggatttcaaaccaggaacttcaggttctccgatagtaaacagagaagggaaaatcgtaggattatatggaaacggggtcgtaacaaccagtggtacatacgtgtctgccatcgcacaggcaaaggcgtcgcaggaaggtcccttaccagaaattgaggacgaagtatttaaaaagcggaatctaacgataatggaccttcatcccggctccggaaaaaccaggcgttatttgccagccatcgttagagaagcaataaaaaggaaattaagaacattaattttggcacccacaagagtcgtcgcctcagaaatggccgaagcactaaagggtatgcctataagatatcaaacaacagctgttaaaagcgaacataccggaagggagattgtggacttaatgtgtcacgcaacatttactatgagacttttatcaccagtacgagtaccgaattacaatatgattattatggatgaagcacactttacagttccagcaagtatagcggctagaggatacattagtacgagggtgggtatgggggaagcagctgcaatatttatgacagcgacaccgcctggttcagtagaagccttcccacaatccaatgccgtaatccaggacgaggaaagagatatacctgagaggtcttggaactctggatatgactggataacagactttccaggtaagacagtatggttcgttccaagtatcaaatcaggtaatgatatagcaaattgtttacgtaaaaatggcaaaagagtaattcagttaagtcgaaaaacgttcgatacagagtatcagaaaacgaaaaacaacgattgggattatgtcgttaccactgatatatcagagatgggagcaaactttagagccgatcgggtgattgatcctcgacgatgcctgaaaccggtgatattgaaagatggtcctgaacgcgtaatactggcgggacccatgccagtaacagtagcatccgcggcccaaagacgtggacgaattggtcgtaatcagaataaggaaggggaccaatatgtttatatgggacaaccacttaataatgacgaagatcacgcgcactggacggaggctaagatgttacttgacaacattaatacgccggaaggtataatccctgcactatttgaacctgaaagagagaaaagtgcagcgatagatggcgaatatcgtttaagaggcgaagccagaaaaacattcgtggaattgatgcgaaggggagaccttccagtttggttgagttataaagtcgcatctgaaggctttcaatactcggatcgtcgatggtgttttgacggagagcgtaataaccaggtcttagaagaaaatatggatgttgaaatctggactaaggaaggagagcggaaaaagttaaggccacgatggttagatgcacgaacatattctgacccactagcacttcgggaatttaaggagtttgcagcaggcagacgatcggttagcggagacttaatcttagaaataggaaagctaccacaacaccttacgcaaagagcacaaaatgcactagataatttagtaatgttgcacaacagtgaacaaggaggaaaagcatacagacatgcaatggaggaattacccgacacaatagaaacattgatgctattagcattaatcgccgttctaacaggaggagtcacattattctttttaagcggaaagggtcttgggaaaacttcaataggacttctatgtgtaacggcctcaagtgctttactctggatggcatcagtcgaaccccactggatcgcagcttcaataatattagagttctttctaatggtgctgctaatacccgagcctgatcgacaaaggactccccaagataatcaacttgcttacgttgtcataggactcttgtttatgatccttacagtagctgcaaatgagatgggactattagaaacaaccaagaaagatctcgggataggacacgtcgcggcagaaaaccatcagcacgcaaccatgttagatgtagacttacatcccgcgtcagcatggacattatatgcagtagctacaactgttataacgcccatgatgcgtcatacaatcgaaaacacaactgcgaatatttcgctaacagcaatagcaaatcaagccgcgatcctaatgggattagataaagggtggccaatttcaaaaatggatttaggagtaccactactagcactaggctgttacagtcaagtcaatccgctaacactaacagcagcagtactcatgctggtagctcattacgcaattatcggacctggattacaggcaaaagccactagagaagcgcaaaaacgaactgcagctgggataatgaaaaatcccacagtagacggaatagttgccatagatttagacccagtcgtgtatgatgccaaatttgaaaaacagctcggtcagataatgttactgatcttgtgcacttctcaaatattacttatgcgcaccacatgggctctatgtgaatccattaccctagcaactggaccactcacgacactatgggaagggtctccaggaaaattttggaatactaccatagcagtcagtatggcaaacatatttagaggatcttatttagcgggagcggggttagcatttagcctcatgaagtccctaggagggggacgacgcggcacaggggcgcaaggagaaacgcttggagaaaagtggaaaagacaactaaaccagctttcaaagtccgaatttaacacttataaacgtagtgggatcatggaagtagatcgaagcgaagctaaagaagggcttaaacgcggagaaacgaccaagcatgctgtcagcagaggaactgccaaattacgctggttcgtcgaaagaaatctagttaaacccgagggaaaagttatagatcttggatgcggtagaggaggatggagctattattgtgcggggcttaagaaggtaacggaagtaaaaggttatacaaaaggagggccaggtcacgaagaaccgatacctatggcaacttatggatggaatctcgtaaaacttcattctgggaaagacgtattctttatgcctcctgaaaaatgtgatacattactatgtgacataggtgagtcctcaccaaaccccaccatagaggaagggagaacattaagggttctgaaaatggttgaaccttggctccgaggcaaccagttttgtatcaaaattctaaacccttatatgccctcagtggtggaaacattagaacaaatgcaacggaaacatggcggaatgctagtgcgtaatcctctaagccgtaactctacacatgaaatgtattgggttagctgcggaactggaaacatagtatctgcagtgaacatgacctcgagaatgcttctaaatcgatttactatggctcatcggaaacctacgtatgacagagatgtggacctaggcgcagggacaagacatgtggcagtggagccagaagtagcgaacttggatatcatagggcaaagaatagaaaacatcaaaaacgaacataaatcaacttggcactatgatgaggacaatccttacaagacttgggcttatcacggaagttacgaagtcaaaccatcaggctctgcgagttcaatggttaacggggtagtcagactgctaaccaagccttgggacgttattccaatggttacacaaatcgcaatgactgacactacaccctttggacaacaacgagtgttcaaggaaaaagtcgacactcgcaccccacgtgctaaaaggggtaccgctcaaataatggaagttacagcaaagtggctctggggctttctatcgagaaataagaaacctagaatatgcactagggaagaatttacaagaaaagtaagaagtaacgctgcaataggcgcggtatttgtagacgaaaatcagtggaactctgcaaaagaagctgtagaagatgaacgattttgggatcttgtacatagagaacgggaacttcacaaacagggaaagtgcgccacatgtgtatataacatgatgggcaaaagagagaagaaattaggtgaatttggaaaagccaaagggtccagagcgatctggtatatgtggttaggtgcaagatttctggaatttgaggcattgggcttcatgaatgaagatcactggttctccagagaaaattctttatcaggcgttgagggtgaaggtctccataaacttggttacatactacgagatattagtaagatacccggaggcaatatgtatgcagatgacactgctggctgggacacccgaatcactgaggacgacctacagaatgaagctaaaattacggatatcatggagccagagcatgcgctcttagcaacttcgattttcaaattgacgtatcaaaacaaagtggttagagtccaaagaccagccaaaaacggaacagtgatggatgttatatcaagaagggaccaacgtggtagcggacaagttggaacatatggacttaatacttttacaaatatggaagtgcaactcataagacaaatggaatccgaaggtatattctttccatcagaactagagagccctaatcttgctgagagagttttggactggctagaaaaacatggtgcagagaggctgaagcgaatggcaatctcgggcgacgactgcgtggtaaaacctatcgacgacagattcgcgaccgcattaatagccctcaacgacatgggtaaggtacgtaaggacattccacaatgggaaccgagtaaagggtggaacgactggcagcaagtaccgttctgctctcatcatttccaccagttaataatgaaagatggtcgagaaattgtagttccatgtcgaaaccaagatgagctagtagggcgggcaagagtgtcacaaggagcgggttggtccctgagggagaccgcttgtctcgggaaaagctatgcacaaatgtggcagttgatgtattttcatagaagggacttacgcctggccgccaatgcaatatgcagcgcagtacccgtagattgggtacctacttctcgtaccacgtggagtattcacgcacatcaccagtggatgactacagaagatatgctttcagtatggaacagggtatggattgaagagaatccttggatggaggacaaaacacatgtaagcagttgggaggaagtaccatatctaggtaaaagagaggaccaatggtgcggaagtttaatagggctaactgcaagggcaacctgggcaaccaacatacaagtggcaataaaccaggtaagaagactcatcggtaatgaaaattacctcgactatatgacatcgatgaaaagatttaagaatgagtctgatcccgaaggagcattatggtag

SEQ ID NO: 21103 - RNA, 9879 nt, synthetic construct
  misc_feature 1..9879: note = derived and/or modified CDS sequence (opt6) from DENV-1__JX669472__SS-prME
  source 1..9879: mol_type = other RNA
tctgtaaccatgttattaatgctgttacctactgcgcttgcgtttcatttaactactcgcggaggtgaaccacatatgatcgtttcaaaacaggaacgagggaaatcgctattatttaaaacgtcagctggagtcaatatgtgtacgctaattgctatggacctcggcgaactatgcgaagataccatgacttataaatgtccacgaattaccgaagcggaaccggatgatgttgactgttggtgtaacgcaactgatacatgggtaacttatgggacatgctcgcaaacgggggagcatagacgtgacaaaagatcagtcgcacttgcaccgcacgtcgggctcggtctggaaacacgtactgaaacatggatgagcagtgaaggagcgtggaaacaaatacagaaagtggaaacttgggcgttaaggcatccgggctttacggtaatagcgttgttcttagcgcacgcaataggaactagcattacccaaaaaggaataatcttcatactactcatgctagttactccatcaatggctatgagatgcgttggaataggcaatagagattttgttgaaggcctatcaggcgctacttgggtagatgtagttttagaacacggatcttgtgtgacgacaatggcgaaaaataaacctaccttagacatcgagctattaaaaactgaagtcaccaatccagcagttctgagaaaattatgcattgaagcaaaaattagtaacactacgaccgattcgagatgccccactcagggagaagcaaccctagttgaagaacaggatgctaattttgtctgtagacgtactttcgtcgataggggatggggtaatggatgcgggctttttggaaaaggctccttgttaacctgcgcgaaattcaaatgcgtcaccaaattagaagggaaaatagtccaatatgaaaatctcaaatactcagtaatagttacggtgcacactggagaccaacatcaagttggaaatgagacaactgaacatggaactatcgcaactataactcctcaagctccgacaagtgaaatccagctaacagactatggagctctaacacttgactgtagtcctcgtacaggactcgactttaatgaaatggttttacttactatgaaagaaaaatcatggttagttcacaaacaatggttcctcgatctgccattaccatggacatcgggggcatcaacctcccaagaaacttggaacaggcaagacctattagtaacttttaaaaccgcacacgccaagaaacaagaggtggtagtattggggtcacaagaaggagctatgcatactgcacttacaggtgcaacagaaattcaaaccagcggaacaacaacgatatttgccggccatctaaaatgtagacttaaaatggacaaattaacattaaaaggcacatcatacgtaatgtgcaccgggagcttcaaactagagaaggaagtggctgaaacccagcacgggactgtattagtccaagtaaagtacgagggaacagatgcaccatgcaaaattccatttagtacccaagacgaaaaaggagttactcagaacggccgattgataacagcgaacccgattgtaacagataaggaaaagcctgtaaatatagaaacggagccgccgtttggggaatcatatatagtcgtgggcgcaggagagaaagctctcaaactttcatggtttaagaaagggtcatcgattggtaaaatgttcgaagcgactgctcgaggagctcgaagaatggcaattttaggagacactgcctgggattttggcagcatcggaggcgtattcacctccgtaggaaaacttgtccaccaggtattcgggacagcttatggcgtattattcagtggagtcagctggacaatgaaaatagggattggaatattacttacgtggctagggttaaatagtcgttccacaagtttgagtatgacatgtattgcagtcgggatggtgactctataccttggagtaatggttcaagctgattccggctgtgtgatcaactggaagggaagagaactaaagtgcggcagtggcatatttgtcactaacgaggtacatacatggacagaacagtataaattccaggcagactctcctaaaagacttagcgcagctatagggcgtgcatgggaagaaggagtttgcgggataagatctgccacacgacttgaaaatattatgtggaaacagatttctaatgaattaaatcacatactgctagaaaatgatatgaaattcactgttgttgtgggaaatgcgaacggaattttggcacagggcaagaaaatgataaaaccacaacctatggaacataagtattcatggaaaagttgggggaaagctaagattattggagcagatatacagaatacgacttttataatcgacggccctgacacacccgaatgtcccgatgagcagcgtgcatggaacatatgggaggtagaagactatggattcggcatcttcaccacaaatatatggctcaaactgcgagactcctatacacagatgtgtgatcaccgtttaatgtcagcagcaatcaaggattctaaagcagtacatgccgacatgggatattggatagaatcggaaaagaatgaaacttggaagttggcaagagcctccttcattgaagtcaaaacctgtatatggccgaaaagccatacactctggtccaatggagtactagaatcagaaatgattatacctaaaatgtatggtggtcctatttcgcaacacaattaccggcccggatattttacgcaaacagctggaccatggcatctaggaaagttagaacttgacttcgatctttgtgaaggcaccacagtggttgttgatgaacattgtggttctagaggcccatcactaagaactacgacggtaacaggtaaaataatccatgaatggtgctgtagatcatgcaccctaccaccattacgctttagaggtgaagacggctgttggtacgggatggaaattagacctgtaaaggaaaaagaagagaatctagttaggtcaatggtgtctgctggttcaggggaagtcgacagttttagtttaggcattttatgcgtaagtatcatgattgaggaggtaatgcgttctagatggagccggaaaatgttaatgacgggtacgttagctgtatttttactactaataatgggccaactaacgtggaacgatctaatacgactgtgtatcatggtgggcgctaatgcttctgataaaatgggaatgggcacaacttacctcgcattaatggctacttttaagatgagacccatgtttgcggtcggacttttattcagaaggctgacctctcgggaagtattgttattgacgataggcttgagtcttgttgctagcgtagaattacctaacagcttggaagaactcggcgatggattggccatgggtattatgatgttaaaacttttaacagaatttcaaccccaccaattatggaccactttacttagtttaacgttcattaaaacaacgctgtcactagattatgcttggaaaacaacagctactgtcttatctatagtatctctattcccattatgcctcagtactacatcccagaaaactacatggttaccagtgcttttaggctcctttggttgtaagccactcacgatgtttttaatcacagaaaataaaatatggggaagaaaatcatggccgttaaacgaaggcataatggctatcggtatagtatctattttattatcatctctactgaaaaacgacgtcccattagcggggcctctaatagcgggtggaatgttaattgcttgttatgttattagcggatcgagtgcagaccttagtttggaaaaagcagccgaagtttcttgggaagaagaagcagagcatagtgggacttcacataatatccttgtagaagtccaagatgatggaacaatgaaaatcaaagatgaggaaagagatgatacgttaaccatcttactaaaagcaacgttactggcagtgagtggagtgtaccctatgtcaatacctgcgactctatttgtttggtatttctggcaaaagaagaaacaaagatccggggtattgtgggacactccaagtccaccggaagtagaaagggctgttcttgatgatggcatatatagaattttacaaagaggtctattaggccgatcacaagtaggagtaggagtttttcaagatggagtatttcacacaatgtggcatgtaacccgcggagcagtactgatgtatcaaggcaagagattggagccatcctgggcgtcagtcaagaaagacttaatatcctatggaggagggtggagatttcagggatcatggaatacaggtgaagaagtccaggttatagcagttgaaccaggtaaaaaccctaaaaacgttcaaacaacgcctggcacttttaagacaccagaaggcgaagttggagccattgccctagattttaaaccaggaacttcaggttcgccgatcgttaatcgtgagggtaaaattgtagggttatatggcaacggagttgtaacgaccagcgggacttatgtttcagctatagcacaggcgaaagccagtcaagaaggacctcttccagaaatagaagatgaagtgtttaagaaacgaaatttgacaattatggatttacaccctgggtctgggaaaacaagaagatatctcccagcaatcgtccgtgaagcgattaaaagaaaattaagaaccttgatactagcaccaaccagagttgtcgctagtgagatggcagaagcattgaaaggtatgcccattcgatatcagacaactgccgtaaaatctgagcacactggccgggaaatagtagatctaatgtgccacgcgacttttacaatgcgtttactatcaccggtacgagtacctaactacaatatgattatcatggatgaagctcattttacggaccccgcgtcgatagcagcacgaggttatatatccaccagagtaggtatgggtgaggcagctgcaattttcatgacggcaacaccaccaggatcagtggaagcatttccccagtctaatgcagtaattcaggacgaggaacgagatatacccgagcgttcgtggaactcgggttacgactggataacagattttccaggcaaaaccgtatggttcgtcccgagtattaagtcaggaaatgatattgcaaactgtttaaggaaaaatgggaagagagttatacaactatcgagaaaaacttttgatactgaatatcaaaagactaaaaataatgactgggattatgtcgttactaccgatataagtgaaatgggcgctaatttccgagcagaccgagttattgatccgagaagatgcctaaagccggtaatattaaaggatggtccggagcgtgtaatattggcaggaccaatgccagtgaccgttgcaagcgccgcacaacgtaggggacggataggcaggaatcaaaataaagagggagatcaatacgtctacatggggcaacctctaaacaacgacgaagaccatgcccactggaccgaagccaaaatgttacttgacaacataaataccccagaaggtataataccagcgttattcgaaccggaaagagagaaaagtgcggctatagatggagagtataggctacgtggagaagcccgaaaaacttttgtggaactaatgagacgaggagacttaccagtatggttgagctataaagtggcgtctgaaggttttcaatattcggacagacgatggtgcttcgatggagagcgaaataatcaagtgctagaagaaaacatggacgtagagatatggactaaggagggagagcggaagaaacttagacctcggtggcttgatgcaagaacctactcagatccattagcacttagggagttcaaagaatttgctgcaggacggcgcagtgtatctggcgatcttatattggagatcggaaagttacctcaacacctgacattaagagctcaaaatgcactagataatttagttatgttacacaactctgaacaaggtggtaaggcatatagacatgccatggaagaactgcctgatacaatagaaactttaatgctactagcattgatcgcagtacttactggtggtgtaaccctcttctttttaagtggcaaagggctaggtaagacgtcaattggattattatgtgttacggcatctagcgccctgttatggatggcttccgtagaaccccattggatagcggccagtatcatacttgagttctttctaatggtcttattaatcccagaacccgataggcaaagaacaccacaggacaaccaattagcatacgttgtaataggtctattatttatgatattaactgtagcggccaatgaaatgggcctgctagagacaactaagaaagacctaggaatcggccatgtagctgccgaaaaccatcaacatgcaactatgttagacgttgatttacaccccgccagcgcatggacactatacgccgtggccaccacagtaatcactcccatgatgcgacatacaatagaaaatacgactgcgaatataagtctaacggcgatagctaatcaggcagctattctgatggggctagacaaaggttggcccataagcaagatggatttgggcgtaccactattggctctaggatgttattcacaagtcaaccccttaactttaacggcagcggtattgatgctagttgcgcactatgctataatcggcccgggactacaagccaaagcaacaagagaagcacaaaaacgaactgcagcagggataatgaaaaatccaaccgttgacggaatagtagccattgatcttgatccagtagtatatgatgcaaaatttgagaaacaactaggacaaatcatgttgttaatcctttgtacatctcaaatattactaatgcgtaccacctgggccctgtgtgaatccataacactagctactgggccattaacaacattgtgggagggatctcccggaaaattctggaatacaactatagctgtatccatggcaaacatatttaggggtagttatttagcaggagccggtttggcgttttcattaatgaaatctctgggtggaggaaggagaggaaccggcgcacaaggggagaccctaggagaaaaatggaaacgacaattaaaccaattatcaaaatcagaatttaatacctacaaaagaagtggaattatggaagtagacagatcagaagcgaaagaaggattaaaaagaggagagactactaaacacgctgtgagtagaggcacagctaaactacgatggtttgtagaaagaaacttagttaagccagaaggcaaagtgatagacttaggctgcggaaggggtggatggtcctattattgcgcgggactgaagaaagtcaccgaagtaaaaggatatactaaaggtggtcctggacatgaagaacccataccaatggccacgtacggttggaatctagttaaattgcactctggtaaggacgtattctttatgccgccagagaagtgtgacaccttattgtgcgatataggagaaagttcaccaaatccaactatcgaagaaggaagaaccctaagagtccttaaaatggtcgaaccttggttgagaggtaatcaattttgtattaagattctcaatccttatatgcccagtgtagtagagacattagaacaaatgcaacgaaagcacggtgggatgttagtcagaaatcctttatctagaaacagtacacatgaaatgtattgggtgtcttgcggaactggtaacatagtatctgcggttaatatgacttctagaatgttacttaaccgttttacaatggcccatagaaagcccacatacgaacgcgacgtagatttaggtgcaggaaccaggcacgtagccgtagaacccgaagttgccaatctagatataattggccaaaggatagaaaacatcaaaaatgaacacaaaagtacgtggcactacgatgaggataacccttataaaacatgggcgtaccatgggtcctatgaagttaagccctcaggttcggcatcaagcatggtgaacggtgtcgttcgattattgactaaaccctgggatgtcattcctatggttacccaaatagccatgacggacacaactccattcggtcagcagagagtatttaaggagaaagtagacaccaggacgccaagggcaaagcgaggaacagcacaaattatggaagtaactgcaaaatggttatggggattcttgtcgcgaaataagaaacctagaatctgcaccagagaggagttcacacggaaagtgcgatcaaacgccgctatcggagctgtattcgtcgacgaaaaccaatggaacagtgcaaaggaagcagtcgaagatgaacgtttttgggatttagtacatagggaaagagagctacacaaacagggtaagtgtgcaacatgtgtatataatatgatgggcaagcgtgagaagaaacttggggagttcgggaaagcgaaaggatcacgtgcaatatggtatatgtggttaggagcgcgatttttagagtttgaagccttgggtttcatgaacgaagatcactggttctcacgtgaaaatagcttatcgggagttgaaggcgaaggtctacataaattaggttacatattaagagatatttcaaaaattcccgggggaaatatgtacgcggacgataccgctgggtgggatacccgaatcaccgaggacgatttgcagaatgaagctaaaataacagacattatggagccggaacatgctttactagctacaagtatatttaaacttacttaccaaaacaaggtagtccgtgttcaaagacctgccaaaaatggtactgtaatggacgttataagccgccgggatcagagaggatccgggcaggtaggaacgtacggtctaaatacttttacgaatatggaagtacaattgatcaggcagatggaaagtgagggaatattcttcccatctgaactagagtctccgaatctggctgaacgagtcttagattggttagaaaagcatggtgctgaaagattaaaaagaatggccatatccggcgatgattgcgtagtaaaacctatcgatgatcgctttgcaacagctttaatagccttgaatgatatgggtaaagttagaaaggacataccacagtgggagccatccaaaggatggaatgactggcaacaggttccattttgctcacatcactttcaccaattgatcatgaaagatggaagggaaatagtagtaccgtgtcgcaatcaggacgaacttgttggacgggcaagagtaagccaaggagccggatggagtttacgcgagaccgcctgtctaggtaaaagttatgctcaaatgtggcaattaatgtattttcatcgccgagacttgcgcctagctgcaaacgcaatctgtagtgcagtacctgttgactgggtacctacttcacgaacgacttggtcaatacacgcacaccatcaatggatgacgaccgaagatatgttaagtgtatggaatcgtgtttggattgaagaaaacccttggatggaggacaagactcacgtaagttcctgggaagaagtaccgtatttagggaaacgagaagatcagtggtgtggtagcctaattgggttaacagcaagggcaacgtgggcgacaaatatacaagtagcaataaatcaggtgagacggttgataggtaatgagaattaccttgactatatgacttctatgaaacgttttaagaacgaatcagatcctgagggcgcgctgtggtaa

SEQ ID NO: 21104 - RNA, 9879 nt, synthetic construct
  misc_feature 1..9879: note = derived and/or modified CDS sequence (opt6) from DENV-1__JX669473__SS-prME
  source 1..9879: mol_type = other RNA
tcggtaactatgcttttaatgctgcttccaacggcacttgcatttcacttgactacacgcggaggtgaaccacatatgatagtaagtaaacaagagagaggaaaatctctactattcaaaacaagtgctggagttaatatgtgtactctaattgcaatggatttaggagagttgtgcgaagatacaatgacttacaaatgtccacggataacagaggcagaacccgacgatgttgactgctggtgcaacgcaacagatacttgggtgacatacggaacttgtagccaaacgggtgagcatagacgggataaaagatccgtcgcgctagcaccgcatgtgggactcgggttagaaacaagaaccgagacctggatgtcatcagaaggtgcatggaaacaaatacaaaaagtagaaacatgggctctgagacatccaggatttacagttatagcactatttttagcacatgcaattggcacttctattactcaaaaaggaataattttcattcttcttatgctagttacaccaagcatggcaatgcgttgtgtaggaataggtaaccgagacttcgtagaaggtcttagtggagctacgtgggtggatgttgttttagaacacggaagttgtgtgacaactatggccaaaaataaaccaactctcgatatagaactactcaaaacggaagtcacaaatcctgccgtacttcgtaaactatgcatagaagccaaaataagtaatactacaacggatagtagatgtccaacacaaggagaggcaacgcttgtggaggaacaagatgcaaatttcgtgtgccgacgtacattcgtagacagaggttggggtaatggatgcgggttatttgggaaagggagcttattgacctgtgcaaaattcaaatgtgtaacaaaactagaaggaaaaattgtccaatatgaaaatcttaaatactctgttattgtaaccgtacatactggagaccaacaccaggtaggtaatgagacaactgaacacggaactatcgcaactataactccgcaagcaccatcatctgaaattcaactaacggattacggagccttaactttggactgcagtccccgtacaggccttgactttaatgaaatggtcctgctaaccatgaaagagaaaagttggctagtacacaaacaatggtttctggatttacctttgccatggacaagcggtgcaagcacatcacaagagacatggaacagacaagatttacttgtcacgtttaaaacagcacatgctaaaaagcaagaggttgtagtgctaggttctcaagaaggtgccatgcataccgctttgacaggtgccactgaaatacaaacatcaggaaccacgacaatattcgctggacacctaaaatgccgattgaagatggacaagctcacattaaaaggcacttcgtatgtcatgtgtacaggatcattcaaattagaaaaggaggtagccgaaacccaacatggtactgtgttagtccaagtgaaatacgaaggtacagatgcaccgtgcaagattcccttttcgacccaggacgagaaaggagtaacacagaacggaaggcttataaccgcaaatcctatcgtcaccgataaggaaaaaccggtaaatatagagaccgagccgccgtttggtgaatcatatatagtcgtgggcgccggtgaaaaagcgttgaaacttagctggttcaagaaaggttcttctattgggaagatgtttgaggcaacagcgcgcggagctaggcgtatggctattctaggtgacactgcatgggactttggtagtataggaggggttttcaccagtgtaggtaagttagtacatcaagtattcgggacagcttatggagttttattctctggtgttagttggacaatgaagatcggcattgggatattattaacctggctaggattaaattctaggtcaacatccttgtctatgacatgtatagcagtagggatggtgacattatacttgggagtaatggtacaagctgactctggatgtgtaataaactggaagggtagggaactaaaatgtggttcgggaattttcgtaactaatgaagtacatacttggactgaacaatataaattccaggctgactcgccaaaacggttgtcagcagctataggtcgagcgtgggaggaaggggtgtgcggaataagatccgctacaagattagagaatatcatgtggaaacaaatctcaaatgagcttaaccacatcttacttgaaaacgatatgaaatttacggtagtggttggtaacgcgaacggcattttagcgcaaggtaagaaaatgataaagccacaaccgatggaacacaaatacagttggaaaagctggggtaaagctaaaattattggagcagatatacaaaacgctacgtttataattgacggtccggatacccctgaatgtcccgatgaacaaagagcatggaacatatgggaggtggaagactatggattcggtatttttacgactaacatatggctcaagctacgggactcatatactcaaatgtgcgaccacagactaatgtcagcggccataaaggattcaaaagcagtacacgcggatatgggttattggattgaaagtgagaaaaatgaaacgtggaaactagcacgtgcctcattcatagaagtaaagacctgtatatggccaaaatctcatactctatggtcaaatggagtgttagaatcagaaatgataattcctaaaatgtatggcggccctatatctcaacacaattaccgaccgggatactttacccagacagcgggaccatggcatctaggaaaattagaattagatttcgatttatgcgaaggaacaacagtagtcgttgacgaacattgtgggagtcgaggacccagtttgaggactactacagtgactggtaaaattattcacgagtggtgctgccggtcttgtacactaccacccttaagatttagaggtgaggatggctgttggtatgggatggaaatacgaccagtaaaggaaaaagaagaaaatctcgttcgtagtatggttagtgctgggtcaggggaagtagacagttttagtttaggaattttatgtgtttcgattatgatagaggaggtcatgagaagtaggtggtcacggaaaatgctaatgacaggtacactggcggtattcctattgctaattatgggacagcttacatggaacgacttaataaggctatgtataatggtaggcgccaacgccagtgacaagatgggtatgggaaccacatacttagcattaatggcaacatttaaaatgagacctatgttcgctgttggtctactatttagaagactcacaagtagggaagtattgctgttaacgatcggtctttctttagttgcaagcgtcgaattacctaatagcctcgaggaattaggtgacggtcttgcaatgggcatcatgatgctaaagctactaacggaatttcaacctcatcaattgtggacaaccttgctatccctgaccttcataaagactaccttgtcacttgactacgcctggaaaactactgcaacggtcttgagtatcgtatctcttttcccactgtgcctttcaaccaccagtcaaaagactacctggttaccagtcttgttagggtcatttgggtgcaaaccgttgactatgtttctcattacagaaaataaaatatggggccgaaaatcatggccactaaacgaaggcataatggctattggtattgtatcaattttattatccagcctactcaaaaacgatgtaccattggcagggccattaatagcgggcggaatgcttatcgcctgctatgttattagcggatcgagtgctgatttgtcactggagaaagccgcagaggtatcgtgggaggaagaggctgaacattctggaactagccataatatacttgttgaagtacaggatgatggtaccatgaaaataaaagatgaagaacgtgatgatactttaactattcttctcaaagccacattattagcagtaagcggtgtttatccaatgtccataccagcgacactatttgtatggtatttttggcagaaaaagaagcagagaagtggtgtcttgtgggacactccttccccacccgaagtagaaagggcagttttagatgacggtatctatagaatcctgcaacggggtctgctgggtcgaagtcaggtaggagttggcgtattccaagacggcgtgtttcacacaatgtggcatgttaccaggggtgccgtgctaatgtaccaggggaaaagacttgaaccgtcatgggcttccgtaaagaaggatttaataagctacgggggaggttggcgattccaaggttcgtggaataccggagaggaagtgcaggtaatagcggtcgaaccaggcaaaaatcccaaaaatgtgcaaactacacccggtacatttaaaacaccagagggtgaagtcggagcaatagctcttgattttaaaccaggcacttctggatcacccattgtgaatagggaaggcaaaattgtaggactatacggtaatggtgttgtgacaacatctggaacgtatgtatcggccatagctcaagcaaaagccagtcaagaaggaccgctacctgaaatagaggacgaagtctttaagaaacgaaacttgactataatggatctacatccaggaagtggaaaaacaagacggtatctccctgcaatagttagagaggccataaaaagaaaactaagaacattaatactggcacctacaagagtagttgcgtcagaaatggcggaagctctcaagggaatgccaattagatatcagacgacagccgttaaatccgaacacacaggtcgagagatcgtggatcttatgtgtcatgccacttttactatgaggttattgtccccagttagagtaccaaactataacatgattattatggacgaagctcatttcaccgatccagcaagcattgccgctagaggttacatctcaacgcgagtaggaatgggcgaagcggctgccatttttatgacggcgacaccacccggaagtgtcgaagcctttccacagtcaaacgcggtaatacaggatgaagaaagggacataccggaaagaagctggaatagtggttatgactggataaccgacttcccaggcaaaaccgtatggtttgttccttccatcaaaagtggaaacgatatagcaaactgtttacgtaaaaatggaaaaagagtgatacagctatcaagaaaaacgtttgacacagaatatcagaaaacaaagaacaacgattgggattatgtagtaaccacagatatctcagaaatgggagcaaattttagagcagacagagtcattgatccacgcagatgtcttaaaccagttatattaaaggatgggccagaaagagtgatacttgcgggaccaatgcctgttacagtcgcttcagcggctcaacgaagaggaagaataggacggaatcaaaataaagaaggtgatcaatacgtatatatgggtcaaccactgaacaatgacgaagaccatgcacactggacagaggcaaaaatgctattggataacatcaatacaccggagggaataattccagctttatttgaaccagaaagagaaaagagtgcagcaatagatggtgaataccgattaaggggagaagcacgcaagacatttgttgaactgatgagacgtggtgatcttcccgtgtggctatcttataaagtggcaagcgagggattccaatattcagacaggagatggtgttttgatggggagagaaataaccaggttctagaggagaacatggacgtagaaatttggacgaaagagggcgaaaggaagaaacttagaccgcgatggcttgacgctcggacgtactccgatccactcgcactaagggaatttaaagaatttgcagcgggtagaaggagtgtcagtggagatttaatcttagaaataggaaaattgccacagcatttaacattgagagcgcagaatgccctggacaatttagtaatgttacacaactcggaacaaggcggaaaggcgtaccgacacgccatggaagaactgccagacaccatagaaacattaatgctcctagctcttattgctgtacttacgggaggtgtgactttgttctttttatcgggaaaaggattgggtaaaacatctataggactactgtgtgtaacagcgtccagtgcactactgtggatggcctcggtcgaacctcattggatagctgcatctataatattagagttctttcttatggtcctactaatcccggaaccagatcggcagagaaccccacaagataatcagttagcctacgttgtcataggcctgctattcatgatattgacggttgcagcaaacgaaatggggctgcttgaaacgacgaagaaagaccttggaattggacatgtggccgcagaaaatcaccaacatgcgaccatgctagacgtagaccttcatccagcatcggcctggacattgtatgccgtcgctacgacagtaataactcccatgatgaggcacacaatagaaaacactactgcaaatattagtctaaccgctatagctaatcaagcagctattctaatgggtttggacaaaggatggcctatttccaaaatggatttaggagtcccattgctcgccctagggtgctatagtcaggtaaacccacttaccctaaccgctgcggtgttaatgctggttgctcactatgccatcattggacctggtttacaggcaaaggcgacaagggaagcgcagaaaagaacagctgcaggaataatgaaaaacccaacagtcgacggaattgtagcgatagaccttgacccggtggtatacgatgctaaattcgaaaaacaactcggacaaattatgctgctaatactatgcacgtcgcaaatattattaatgagaacaacctgggccctctgtgaatctattaccctagcaacaggaccgttaactaccctttgggaaggcagcccaggaaaattctggaatacaaccatagcggtttcaatggcaaatatatttcgcggctcatatttagcgggagcaggtttggccttcagtctaatgaaatccctaggaggagggaggagaggtacaggcgctcagggcgaaacattaggagaaaaatggaaacggcaattaaaccaattaagtaaatctgagtttaatacatacaaaaggagcgggatcatggaggtggataggtcagaagcgaaagaaggcctcaagagaggcgaaacaacaaagcatgccgtaagtcgtggcacggcaaaattgagatggtttgttgaacgaaatctcgtaaaacccgaaggtaaggtcatagatctgggatgtggtcgtggcggctggtcgtactattgcgccggactcaagaaagtaacagaagtcaagggatatactaaaggtggccccggccatgaggaacccatacctatggctacgtatggatggaatttggttaaattacattcaggaaaagatgtcttctttatgccaccggaaaaatgtgatacacttctgtgtgacataggagaaagtagcccaaacccaaccattgaagagggaaggaccttaagagttctaaaaatggtagaaccctggttacgagggaaccaattctgcattaaaatattgaatccttatatgccttcagtagtcgagacattagaacaaatgcaaaggaagcacggagggatgttagtccgaaacccattatctcgaaactcaacccatgagatgtattgggtgagctgcggaacaggaaacattgtatcagcggttaatatgacgtcacgtatgctactaaatagattcactatggcacaccggaaaccgacttatgaaagagatgtagatctaggagctggaacacgtcatgtggcagtagaaccagaagtagcaaacctcgatataattggccaacgtatagaaaacatcaaaaatgaacacaaatcgacctggcattatgatgaggataacccctataaaacatgggcttaccatggtagttatgaagtaaaaccgagcggatctgcatcaagcatggtcaacggagtagtacgattattgactaaaccttgggacgtcataccgatggtgactcaaatagctatgacggacactacccctttcggccaacaaagagtcttcaaagagaaagttgatacacgtacaccaagggccaagaggggtactgcgcaaattatggaagtaacagctaagtggttatgggggtttctaagtcgcaataagaaaccgagaatatgtactagagaggaatttacacggaaagtcaggagtaatgctgctataggtgcagtatttgtggatgaaaaccaatggaatagtgcgaaagaagcagtcgaagacgaaagattctgggacttagtacatagagaacgagaactgcacaagcaaggcaaatgtgcaacttgtgtgtacaacatgatgggtaagagagaaaagaagttaggagaatttggaaaagcaaagggctcacgggctatatggtatatgtggctaggagcccgctttttagagttcgaagcactaggttttatgaatgaagaccactggttctcaagagaaaacagtctttcaggagtagaaggtgaaggattgcataaattaggatatattctgagagatattagcaaaatcccgggagggaatatgtatgcggatgatacagcagggtgggatactagaatcactgaggatgacttgcagaatgaggcgaaaataactgacataatggagccagagcatgctctccttgcaacgagcatctttaaacttacgtaccaaaacaaggttgtaagagtacaaagacctgcgaaaaatgggacagtcatggacgtgatttcacgaagggatcaacgtggctcaggacaagtagggacctatgggcttaatacatttacaaatatggaagtgcaacttataagacaaatggaatctgagggaattttctttcccagtgaattagaatccccaaatttagcagaaagggtactcgactggctagaaaaacacggcgcagaaagactcaagagaatggctatatccggagatgattgcgttgttaaacctattgacgatagatttgccactgcgttaatcgcattaaatgacatgggaaaagtaagaaaagatatcccgcaatgggaaccttccaaaggatggaacgattggcaacaagtgccattttgctcacaccatttccatcaattaatcatgaaagacggaagggagatagtagtcccatgccgaaaccaagacgaactggtcggacgagcgcgtgtatcacagggggccggttggtcactcagagaaacagcatgcttaggaaaatcgtatgcacaaatgtggcaactaatgtactttcatcgtagagatttaagattggcggccaacgccatctgtagtgcagtaccagtagattgggtgcctacaagtcgcactacgtggtcaattcatgctcatcaccaatggatgacaaccgaggatatgctctccgtttggaatagggtatggattgaagaaaatccctggatggaagacaaaacacacgtcagtagttgggaagaagtgccttacctgggtaaaagagaagaccagtggtgcgggagtttgattgggctgacagcacgagcgacttgggcaaccaatatacaagtagcgataaatcaagtaagacgattaatcgggaatgaaaattatctcgattacatgacaagtatgaaaagatttaaaaacgaaagtgatccggaaggagcactttggtaa

SEQ ID NO: 21105 - RNA, 9879 nt, synthetic construct
  misc_feature 1..9879: note = derived and/or modified CDS sequence (opt6) from DENV-1__JX669474__SS-prME
  source 1..9879: mol_type = other RNA
tccgttacgatgctattaatgctattacccactgctttagcttttcatctaactactagaggtggtgaaccacatatgattgtgagcaaacaagaacgtggtaagagcttactgttcaaaacttctgcaggggtgaacatgtgcacattgatagcaatggacttaggggaattatgtgaagatacgatgacatataaatgccctcggatcacagaagcggaaccagatgacgtagactgctggtgtaatgccacagatacatgggtaacgtacggaacatgctcacaaacaggagaacatcgaagagacaaacgctcagtcgctcttgcaccacacgttggtctaggactggaaactcgaacagaaacatggatgagctctgaaggggcgtggaaacaaatccaaaaagttgaaacatgggctctaagacaccccgggtttacggtgatcgctcttttcttggcacatgcgattggaacatcaataacgcaaaaagggattatatttatccttttgatgttagtaacgccatcaatggcaatgcggtgtgtaggtataggaaatagggacttcgtagaaggtctcagcggtgcaacgtgggttgatgtagtactggaacacgggtcatgtgttaccacaatggctaaaaacaaaccaactcttgatatcgaattacttaaaactgaagttacaaatcccgcagtcctaagaaaactttgcatagaagcgaaaataagcaacaccacgactgattcaagatgccctacacaaggagaagcaaccctagttgaagaacaagatgcaaactttgtatgtcgaagaactttcgtggataggggctgggggaatggttgtggtctgtttggaaaagggtctttgttgacgtgcgcaaaatttaaatgcgtaaccaaattagaaggaaaaatagtacaatatgagaatctaaaatacagcgtaatagtaacagtacacacaggtgaccaacatcaagttggaaatgaaactacggagcacggcacaattgctacaatcactccacaagcccctacaagtgaaattcaactaacggattatggagcattgacactcgactgtagtccccgcactggtctcgatttcaacgaaatggtcttattaacaatgaaagagaaaagttggctggtacacaaacagtggttcctagatttaccactcccttggacatccggagcaagcacatcacaagaaacttggaatcgtcaggacctattggtgacatttaaaacagcacacgcaaagaaacaagaggtagtagtattgggctcgcaagagggagcaatgcacacggcactaacgggcgccacagaaatccaaacaagtggcaccactactatattcgccggacatcttaaatgcagattaaaaatggataaactcacgctcaaagggatgtcgtacgtaatgtgcaccggctcgtttaaacttgaaaaagaagttgcagaaacccagcacggaactgtattagttcaggttaaatacgaaggaactgatgctccgtgtaaaattcctttctctacacaggacgaaaaaggcgtcacacagaatggtcgactgattacagctaacccgattgtcacagacaaggaaaaacccgtaaatatcgaaactgaaccaccattcggagaaagttatattgttgtgggtgcaggggaaaaagcgctaaaattatcatggtttaagaaaggatcatcaataggaaaaatgtttgaagcgacagctcgaggagcgagacggatggccatcttgggcgacacagcgtgggactttggttccataggtggcgtatttacttcagtgggaaaattagttcaccaagtgtttggaacggcatatggcgttcttttcagtggagtatcttggactatgaagataggaataggaatactccttacttggctaggcttaaactctaggagtacttccctatccatgacgtgtatcgccgtcggaatggtcacgttatatttgggagttatggttcaggctgatagcggatgtgtcataaactggaaaggaagagagttaaaatgcggtagtggcatattcgtaacaaacgaagtacatacatggacagagcagtataaattccaagccgactctcccaaaaggttgagcgcagcaattggacgtgcatgggaggaaggagtgtgtggaattagatcagcaacacgacttgagaatattatgtggaaacaaattagcaatgaactcaatcatattctattggaaaatgacatgaaatttaccgtagtggtaggcaacgccaatggaatattagcgcaagggaagaaaatgataaaaccgcaaccaatggagcacaaatattcatggaaatcgtggggcaaagctaaaataataggcgccgacatacagaacgctacatttataatcgatggacccgatacaccagagtgtccagacgaacaaagggcgtggaacatatgggaagtagaagattatggttttgggatttttactaccaacatatggcttaaattaagggatagctacacacaaatgtgcgatcaccgtcttatgagtgcggcaatcaaagattcaaaggcagtgcatgcagatatgggttattggattgaatcagagaaaaatgaaacctggaaattagctagagcctcgtttatagaagttaaaacatgtatatggccgaagagtcatacattatggtctaatggggttctcgaatcagagatgataattcctaagatgtatggaggcccaacttctcaacacaattaccgtccgggttactttactcagacagcaggaccttggcatctaggaaaattagaactagactttgacttatgtgaaggaacaacggttgtggtggatgagcactgcgggtctagaggaccatcactacgaacaacgacagttacggggaaaataatacatgagtggtgctgtaggagttgcacgctaccacccttgcgttttcgaggagaggatggatgctggtatggtatggaaatccgcccagtgaaagagaaagaagaaaatttagtgcgatcaatggtctcagctgggtctggcgaagtcgacagcttttccttaggcatactatgtgtaagtataatgatagaagaagtgatgagaagccgctggtcccgcaaaatgttgatgacaggtacactagcagtatttctattacttattatgggtcaattgacttggaatgatttaataagattgtgcataatggttggcgcaaatgctagcgataaaatgggaatggggactacgtatctagctttgatggcgacgttcaagatgcggccgatgttcgcagtgggattgttattccgtcggttaacttcacgggaagtattacttctcacaatcggtctaagccttgttgcatctgtagaacttcctaattctcttgaagaattgggggacggactagccatgggcattatgatgctaaaacttcttactgaatttcaaccacaccagttatggaccacgttattaagtcttacatttattaagactacactttcattagactatgcttggaaaacaactgccacggttttatcaattgtctcattgtttcccctatgcttgtctacaacatcacagaaaaccacttggctacccgtattattagggtctttcggttgtaaaccgctgaccatgttcttaatcacagaaaatgaaatctggggccgtaaaagttggcctttgaacgaaggaattatggccataggcatcgtatcgatactactatccagcttactcaaaaatgatgtacctcttgccggtcccttaattgcaggaggaatgttaattgcctgctatgttatatcaggcagttctgccgacctatcattggaaaaggccgcggaagtcagctgggaagaagaagcggaacattctggtacaagtcataatatcctagtagaagtccaggatgatggcacaatgaaaattaaggacgaagaaagggacgacacacttacaatattattaaaagccaccctcctagctatctcgggagtatatcccatgagtattccggctacattgtttgtatggtatttttggcaaaagaagaaacagagaagtggggtcctctgggacacaccgagtcctcctgaagttgaacgtgccgttcttgatgatggtatatatcgaatactacaacgaggattactcgggcgatcacaagtaggtgttggggtttttcaggatggagtcttccacacaatgtggcatgtcacacgaggtgcagtactaatgtaccagggaaagagattagaaccttcctgggccagtgtcaagaaagatttaataagttatggaggaggatggcgattccagggtagttggaatactggtgaagaagtgcaggttatagcggttgagccgggaaagaatccaaagaatgtacagacaacacctggtacgttcaagacaccggagggtgaggttggtgcgatagcacttgattttaaacctggaacttctggatcacccatagtcaaccgagagggaaaaatcgttgggttgtatggaaacggagtcgtaacaacttcaggtacgtacgttagcgctatagcacaagcaaaggcgtctcaggaagggccacttcccgagatagaggatgaagtgtttaagaaaagaaacctgactatcatggatttgcacccgggttcaggcaagactagaagatatctaccagctattgtgcgcgaagcaataaagagaaagctccggactttaatattagcaccaactagagtagtagctagtgagatggccgaagcgttaaagggtatgccaatccgataccaaacgactgcagtaaagtcggaacacacgggacgagagattgttgatctgatgtgtcatgctactttcaccatgcgactgttatcaccagtcagagtacccaattacaatatgatcatcatggatgaagcccattttactgaccccgcatctatagcggcacgaggatacatttctacacgagtcggtatgggtgaagccgctgcgatttttatgaccgctactcccccgggatctgtagaagcatttccacaaagcaatgctgtaatacaagatgaggagagagatataccagaaaggtcatggaacagcggttacgactggatcactgattttcctggcaaaacagtttggttcgtaccctcaatcaaatctggtaatgatatagcgaactgtctgaggaaaaatgggaaacgcgtaatacagttatctagaaaaacattcgatacggaataccaaaagactaaaaataatgattgggactatgttgttacaacagatatatcagaaatgggagccaacttcagagcggaccgggtaatagaccctaggcgctgcttaaaacctgttattttaaaggacggtccagaaagggtgatcttagccggcccaatgccagtaacggtggcttctgcagcccaaagaaggggtcgaataggtagaaaccaaaataaagagggggaccaatacgtatatatgggccaacctttaaacaatgacgaggatcacgcacattggacagaagcaaaaatgttgctagacaacattaatactccagaaggtataatacctgcgctgttcgaaccggaacgtgagaaaagtgcagcaatagatggagagtatagattacgcggagaagccagaaaaacttttgtagaattaatgcgccgtggggatttacccgtttggctgagttataaagttgcctcagaagggtttcaatactcggatcgcagatggtgttttgacggggaacgaaataatcaagtactagaggaaaatatggacgtagagatttggacgaaggaaggcgaaaggaagaaactacgacccagatggttagacgcacggacttactcagatccattggctttaagagaatttaaagaatttgcggcgggacggagaagcgtaagtggtgatttaatacttgaaattggaaaactgcctcaacatctgactttaagagctcaaaatgcacttgacaatctagttatgttacataacagtgaacaagggggaaaggcataccgtcatgcaatggaagaactcccagatacaatagaaacactaatgctgctggcactgatagcagttttaacgggcggtgtcacattatttttcctctcaggcaaagggttaggtaaaacatcaatcggtcttctatgtgtaacggccagtagcgctttactttggatggcatcggtagagccgcactggatagcggcatcgattatacttgagttcttcctaatggttcttttaataccagaaccggatagacaaaggacgccacaagacaatcagcttgcttatgtagtcataggtctcttatttatgattttaacggttgcagcgaatgaaatgggattgttggagaccacgaagaaagacctaggaataggacatgtagcagcagaaaatcatcaacacgctacaatgttagacgtagatttgcatcccgcatcagcatggacattatacgcagtcgctactacagtcataacaccaatgatgagacatacaatcgaaaacacaacagcaaatattagcttaacagcaatagctaatcaagctgcgatactaatgggactagataaaggttggccaatctcgaaaatggatcttggtgtaccgctcttagcattaggctgctattcacaagtgaatccactaactcttaccgcagcagttctaatgttagtagcacactatgcgataattggtcccgggttacaagcaaaagcgacccgggaagcacagaaaagaacggctgctggaataatgaagaacccaacagtagatgggattgtagccatagatctagatccagtagtttacgacgcgaagtttgaaaaacaactagggcagattatgcttctaatactttgcaccagccaaatccttcttatgcgtacaacttgggcattgtgtgaaagtataaccttggcaacaggaccattgactacattatgggaaggttccccaggcaaattttggaatacgaccatagctgtgtccatggcaaatatttttcggggatcatacctcgccggtgcaggattggcattctccttaatgaaatcgttaggaggtgggcgccgtgggacaggagcgcaaggcgaaactttgggagagaagtggaaaaggcagctaaatcaactctcaaaatccgagttcaacacttataagcgatcaggcataatggaagtagacaggagtgaggcaaaggaaggactgaagcgtggtgaaaccacaaaacacgcggtgtcacgcggtacagcaaaactgcgctggttcgtagagcgaaaccttgtgaaaccggaggggaaggtaatagacctagggtgtggacgtgggggatggagctattactgtgcaggattgaaaaaggtgaccgaagttaaaggatatacaaaaggagggcccggacatgaagaacccattcctatggccacctatggatggaatttggtcaagctacatagtggaaaggatgtattctttatgcctccagagaagtgcgatacgttactctgtgacataggggaaagcagccccaatccaactattgaggagggtaggacactgagagtactcaaaatggtagagccgtggcttaggggaaatcagttttgtatcaaaattttaaatccttatatgcccagcgttgttgaaaccttagaacaaatgcagagaaaacacggtggcatgctagtaagaaatcctctgtcaagaaatagtactcatgaaatgtactgggttagttgtggtacaggaaatatagtgtcagcggttaatatgacaagtagaatgttactaaaccgttttacaatggctcataggaaacctacgtatgaacgagatgtcgatttaggagcaggtacacggcacgttgcagttgaacctgaagtcgctaacctagatataattggacagagaattgaaaacatcaagaatgaacacaaaagcacatggcattatgatgaagacaatccttataaaacctgggcctatcacggctcctacgaagtcaagccatccggtagtgcaagcagtatggttaacggcgtagtaagactactaacaaaaccatgggatgtaataccaatggttacgcagatagccatgacagatactaccccatttggacaacaaagagttttcaaagagaaagtagataccagaacacctcgtgcaaagagaggtactgctcaaatcatggaagttacagcaaaatggctgtggggatttttatctagaaataaaaagcctaggatatgtacgagagaagaatttacgcgtaaagtaagaagcaatgctgctatcggtgcggtgtttgtagacgagaatcagtggaatagtgcaaaagaagctgtggaagacgaaagattttgggatcttgtccatagagagagagaactacacaaacagggaaaatgcgcaacgtgtgtctacaatatgatgggaaagagggagaagaaactaggcgagtttgggaaggcaaaagggagtcgagctatatggtatatgtggttaggggcccgtttcctggagttcgaagcattaggatttatgaacgaagaccattggttttcaagagaaaattcactaagtggagtggaaggagaaggactacacaaactgggatatatattaagagatatttcaaaaataccaggtggtaatatgtacgcagacgatacggctggttgggatacgcgcataacggaagacgacctacaaaatgaagcaaaaattacagacattatggaacctgaacatgctttgttagctacatcgatttttaagttaacctaccaaaataaagtcgttcgagttcagagacctgcgaagaacggaaccgtcatggatgtgattagccgcagagatcaaagagggagcggacaagtcggaacatacggactaaatacgttcacgaatatggaagtacaactcatacgacagatggagtcagaaggaatattctttcccagtgaactcgaaagtcctaaccttgccgaaagagtccttgattggctagaaaaacacggtgcagagcgacttaaacggatggctataagtggagatgattgtgttgttaagccaatagatgaccgattcgctaccgctttaattgcactcaacgacatggggaaagtacgtaaagacataccccaatgggagccctccaaaggttggaatgattggcaacaagtaccattctgtagccatcattttcatcaacttataatgaaagacggaagagaaattgtagtaccatgtcgtaatcaagacgagctggtagggagagcccgagtaagccaaggtgctggctggtcactgagagaaacggcatgtctgggaaaatcttatgcgcagatgtggcagttaatgtattttcatagaagagatctcagactagccgcaaatgcaatatgtagtgcggtgccagtagattgggtaccaacgtcccggacgacatggagtatccatgctcatcaccaatggatgactacagaagatatgctttctgtatggaatagggtatggatagaagagaacccctggatggaagacaagacacacgtatccagctgggaagaagttccatatctaggaaaaagggaagaccagtggtgtgggtcgttaatcggtctaacagccagagcgacatgggccacgaatatacaagtagcaatcaaccaagtaaggagattaatcgggaacgaaaattaccttgactatatgacatcaatgaaacgctttaaaaatgagtcagacccagaaggagctttatggtaa

SEQ ID NO: 21106 - RNA, 9879 nt, synthetic construct
  misc_feature 1..9879: note = derived and/or modified CDS sequence (opt6) from DENV-1__JX669475__SS-prME
  source 1..9879: mol_type = other RNA
agtgtaactatgttattgatgctgttaccaactgctttggcatttcatctgaccacgcgaggcggggaaccacacatgattgttagcaaacaagaacgcggtaaatctttattatttaaaacaagtgctggagttaatatgtgtactttaattgctatggatcttggagaattatgcgaagatacgatgacctataaatgtccccgaattactgaagcggaaccagatgacgttgattgctggtgcaacgcaactgatacatgggtaacatatggaacgtgctcccaaacaggggaacatagaagagataaacggagcgttgcattagcgcctcacgttggtttggggttagagactaggacagaaacctggatgagtagcgaaggggcatggaaacaaatacaaaaagtggaaacatgggcattacgccacccgggattcacagtaatcgctttatttctagcacacgctatcggaacatcaattactcaaaaaggtattatatttatcctgctaatgctagtaactccctcaatggcgatgcgatgcgtaggcataggtaacagggactttgtagagggactttctggagcaacatgggtggatgtggtattagagcatggcagctgcgtcacaacaatggcgaaaaataaaccgacattagacatcgaactactaaagacagaagttaccaatcccgcagttctacgtaagctatgtatagaagcaaagattagcaatactacaactgattccagatgtccaacacaaggagaagcaacattagtagaagaacaagacgcgaacttcgtttgtcgaaggaccttcgtcgatcgtggttgggggaacggttgcggcctattcggaaaaggttctttactaacctgtgcaaagtttaaatgcgtaacaaaattagagggaaagattgtgcaatacgaaaatcttaagtatagtgttatagtaaccgtccatacaggagaccaacatcaagtcggaaacgaaactacagagcatggaactatagcgaccataacaccacaagctccaacaagtgagatacaattaacagactatggagcgttaacactcgattgcagcccacgaacagggttagactttaatgaaatggtactcttaaccatgaaggaaaaatcatggctagtacataaacaatggttcctagacttaccactaccatggacttcgggtgccagtacatcacaagaaacgtggaatagacaagacctcttggtaacattcaaaacagcacatgccaagaaacaagaggtagtagtgttgggtagtcaagaaggagctatgcacactgctctcacaggtgctactgaaatccaaacaagtggaactacaacgatattcgcagggcatttgaaatgtcggttaaaaatggacaaactaacacttaaaggaaccagttatgtaatgtgcacgggtagttttaaattagaaaaagaagtagctgaaacacaacatggaacagtacttgttcaggtaaagtacgaaggaacggacgccccctgtaaaattccgttttcaacgcaagatgaaaaaggagtgacgcaaaatggtaggctaataaccgcaaaccccatagtgacagacaaagagaaaccagtgaatatagagacggaaccaccctttggagaaagttatatcgtcgttggcgctggggaaaaagcattgaaactaagttggttcaagaagggatctagcataggaaagatgtttgaagcgaccgcaagaggggctaggagaatggccatattaggagacaccgcatgggactttgggtccataggaggcgtgttcacttccgtaggaaaacttgtccaccaggtatttggaactgcctacggggtgctatttagtggtgtaagttggacgatgaaaataggtatagggattctccttacttggcttggattaaactcgagaagcacgagtctatcaatgacttgcatcgctgtaggaatggtaacattatacttgggggtaatggtacaagcggattcaggatgtgtaataaattggaaaggtcgtgaattgaaatgtggttcaggaatatttgtaacgaatgaggtacatacatggacggaacaatataagtttcaagcagatagcccaaaacgattaagtgccgcaataggtaaggcatgggaggaaggtgtctgcggcataagaagcgctacacgtctggagaatattatgtggaagcaaatatcgaatgagttaaaccatatattactcgagaatgacatcaaatttacagtcgtagttggaaacgcaaatggtatactcgctcaaggaaagaaaatgatcagacctcaacccatggagcacaaatattcatggaaaagttggggcaaagctaaaattataggtgctgatatacagaacacaacttttattattgatggaccagatacgcctgagtgccccgatgaacagcgcgcatggaatatctgggaagtagaagattacggatttggtatattcactacaaatatatggctcaaacttagggactcatatacacaaatgtgcgatcatagattaatgagtgcagcgattaaagattctaaggcagtacacgcggacatgggttattggatagagtcagagaaaaatgagacatggaagctggcacgggcttcttttatagaggttaaaacatgcatatggcccaaaagccacaccctatggtctaacggcgttcttgagtcagagatgatcatacccaaaatgtacggaggccctattagtcaacataactatcgacctggatattttacgcaaacagctgggccgtggcatttgggaaaacttgaattagacttcgatttgtgcgaaggaacaacagtcgtagttgatgaacactgtggcagtagaggaccctcactaaggacgacaaccgtcacaggcaagataatacatgaatggtgttgccggagctgtacactaccacccctgagatttcgtggagaagatgggtgctggtatggaatggagattagaccagtaaaggaaaaagaagaaaatttggttagaagcatggtgagcgccggatccggggaagtagatagttttagtctaggaatactttgcgtatcgataatgatagaagaagtaatgagatcacgatggtctaggaaaatgctaatgacaggcacactagcagtatttttattattaataatgggtcagttaacatggaatgacttaatcagactatgtataatggttggggcgaacgcaagtgataaaatggggatgggtaccacctacctggcattgatggcgactttcaagatgaggccgatgttcgctgtaggacttagtttcagaaggttgacatcacgggaggtattactcctaacaattgggctcagtctagtagcttctgtagaactaccaaacagcttagaggaattgggcgatggtttagctatggggattatgatgttgaaattgttgaccgaatttcaaccacaccagctatggacaactttgttatcattaacctttataaaaactacattgtcattagattatgcgtggaaaacaaccgctatggtattatctatagtctccctcttccctctctgcctatcaacgacctcacagaaaaccacgtggctacccgttctactgggatcgttcggatgtaagccacttacaatgtttctaataacggaaaacgaaatatgggggcgtaaatcatggccattaaatgaaggtataatggctatagggatagtttctatcttgctgtctagtctactgaaaaatgatgtaccattagcaggcccgcttatagcgggaggcatgttgattgcatgctatgtaataagtgggtcttctgccgacctctctctcgaaaaagctgcagaggtgagctgggaagaagaagcggaacatagtggaacatcacacaatattctggtcgaagtacaagacgatggcacaatgaagataaaggacgaagaacgagatgatacattaacgatactacttaaagcaactctactagctgttagtggagtatatccgatgtcgatccccgcaacgttattcgtgtggtacttttggcaaaagaagaaacaacgatctggtgtgctatgggatacgccctctccacctgaagtagagcgagcagttttggatgatggaatctatcggattttacaacgtggattgctgggaagatcccaggtaggggtaggggtgttccaggacggggtgtttcatacaatgtggcatgttacacgaggagctgttcttatgtaccaaggtaaacgccttgagcccagctgggcatcggtgaagaaagacttaatcagctatggaggtggatggcgttttcaaggatcttggaataccggtgaagaagtacaggtcattgctgtcgaacctgggaaaaatccgaagaacgtgcaaacaacaccaggaactttcaaaactccagaaggagaagtcggagcaatagcgctagacttcaaaccaggcacgtcaggtagcccaattgtaaatagggaaggtaagatagtcggtctatatggtaatggggttgtaacgacttctggcacatatgtgagtgctatcgcacaagcaaaggcttcgcaagaagggcccctgcctgaaatcgaagatgaagtattcagaaaacgaaatctaactattatggaccttcatccaggtagtggaaaaacccgccgatatttacccgctatagtaagggaagctattaagagaaaattacggactctaatactcgcgcctactagagtagtagcctctgagatggcagaggcattaaaggggatgccgataaggtatcaaacaacagctgtcaaatccgagcatacgggccgagagatagtggacctaatgtgccatgcgacgtttacaatgcgtctattatctcccgttcgagtacctaattataacatgataattatggatgaagctcattttactgatcccgcatcaatagcagctaggggatacattagtactagagtaggcatgggagaagcagcagcaattttcatgaccgctacgcctcctggctctgtagaggctttcccacaatccaatgcagtcatacaggatgaagaacgagacattccagaacgatcttggaactccggatacgactggattacggatttccccggaaaaacagtatggttcgtaccatcaattaagtcgggcaatgacatagccaattgcttacgcaaaaatgggaaaagagtgatacaactttcaaggaaaacatttgacactgaatatcagaaaaccaagaacaacgattgggattacgtagtgactactgacataagcgaaatgggcgctaactttcgggctgatagagtgatagatcctcgacgatgtttgaagccggtcatattaaaagatggacctgaacgggtaatattagccggtcctatgcctgtcacagtggcttcggctgctcagaggcgaggaagaatcggaagaaatcagaacaaggaaggggaccaatatgtatacatgggacaacctttaaacaacgatgaggaccacgctcactggaccgaggctaaaatgttattggataacatcaacactcctgagggaataatacccgcactttttgagcccgaaagggaaaaatctgcagcaatcgatggagaataccggcttaggggcgaagctcgaaaaaccttcgttgagctgatgagaagaggcgaccttcctgtatggttaagctataaggttgcctccgaaggtttccaatactcagacagaagatggtgcttcgacggagagagaaacaatcaagtattggaagaaaatatggatgtcgaaatatggacaaaggagggggagaggaagaaactgcgtccccgatggttagatgcaaggacctactcagatccattagcgttgagagaatttaaagaatttgcagcaggcagacgaagcgtttcaggcgacctgattttggaaataggtaaattgccacaacatttaacactcagagcgcagaatgcactagacaatctggtaatgttacacaacagcgagcaaggagggaaagcctatagacatgctatggaggaactacctgacacaattgaaacattaatgcttttggctttaatagcggttcttacaggaggagtaactctgttctttctctcaggaaaaggattaggaaaaaccagtataggcctactttgcgtcacagctagtagtgccctgctatggatggcctcagtagaaccacattggatcgctgcttctattatattggagttcttcttaatggttctgttgattccagaacctgatcgacaacgtacgccccaggacaaccagttagcttatgtggtaataggtttgttatttatgatactgacggtcgcagccaatgaaatggggctattagagaccactaaaaaggacttaggtattgggcacgtagctgcagaaaaccatcaacatgccacaatgttagatgttgacctacacccggcatcagcctggactttatatgctgttgccaccacagtaattacgcccatgatgagacacacgattgaaaatacaactgccaacatctctctaacggccattgctaaccaagcagccatacttatggggttagataaaggatggccaatcagcaaaatggatctcggtgtaccattattggccttggggtgttatagccaagtcaatccattaacgcttaccgctgccgtactaatgttggtcgcacattatgcaataattgggcctggtctacaggcgaaagctacacgagaagctcagaagcgaacagcagcgggaattatgaaaaatccaacagttgacggcatcgtcgcgatagatctggatcccgtagtctacgatgctaaattcgaaaaacaactaggacaaataatgcttcttatattatgtaccagccaaatcttacttatgcgaactacgtgggccttatgcgaaagtataacactcgctacaggtccattgactactttatgggaggggtcacccggcaaattttggaacacaaccatagcagtaagtatggcaaatatttttagaggttcttatttggccggtgctggactggccttttcattaatgaaaagtttgggcggtggaaggcgtggtacaggggctcaaggagagacattaggagaaaagtggaaacggcaactgaatcaactgtccaagagtgaatttaacacctataagaggagtggtataatggaagtcgacagaagtgaagctaaagaaggtctgaaaagaggggaaacaactaaacatgcagtatcgcgaggtacagccaaactacgatggtttgtagagcggaacctagtgaaacctgaagggaaggtcatcgatctcggttgtggcagaggcgggtggagttactactgtgcaggacttaagaaggtcacggaagtcaaaggctacactaaaggtggaccaggacacgaagaacctattcctatggcaacatacggatggaatttagttaaattacactcaggtaaggatgtatttttcatgccgcctgaaaaatgtgacacactgctttgtgatattggagaatcaagtcctaatccaactatagaagagggacgcacactgcgcgtgcttaaaatggtagaaccttggttaaggggaaatcaattctgcataaaaatactaaatccatatatgccaagtgtcgtcgaaactttagaacaaatgcagagaaagcatggagggatgcttgtcagaaatcctttatcacgtaatagcacccacgaaatgtattgggtatcctgtggcaccggtaacatagtatctgcagtcaacatgacatcgcgcatgttactaaatcgatttactatggctcatcgcaaacctacatacgaaagagatgtagatttaggtgcaggaacaagacacgtagcggtggaaccagaagtagcaaatttggatatcattggacaacgaatagagaatattaagaatgaacacaagtctacctggcactacgacgaagataatccttacaaaacatgggcgtatcacggatcatatgaggtgaagcctagcggaagcgcctcaagcatggtaaatggtgtagttcgattgcttactaaaccttgggatgtaatacccatggtaactcagatagccatgactgatactacccccttcggccaacaacgagtcttcaaagaaaaagtagacacgcgaacgcccagagcaaaaagaggtactgcacagataatggaggtaactgctaaatggttatggggattcctaagtagaaataagaaaccaaggatatgcacccgggaagagttcacccgaaaggtacgtagcaatgcggcaatcggggctgtatttgtagacgaaaatcaatggaactccgctaaagaggctgtagaggatgaacgcttttgggatctagttcatagggaaagggaactgcataaacaaggtaaatgcgctacctgtgtgtataatatgatgggaaagagggagaagaaacttggagagtttgggaaagccaagggaagcagagcgatatggtacatgtggttaggtgcgcgcttcttagagttcgaagcattaggattcatgaacgaggaccattggttttcccgagaaaattctctatcgggagtagaaggtgaaggacttcacaaactcggttatatactaagagatatcagcaagataccaggaggaaacatgtacgctgatgacacagctgggtgggacacaagaataacagaggacgacctccaaaatgaagctaagattacagacattatggaaccagaacatgcattactagccacaagtatatttaagctgacttaccaaaacaaagtggtaagagtacagagaccagccaaaaatggcactgtcatggatgtaatatctaggagagaccaaagaggaagtggacaagtaggtacgtacgggcttaacacttttacaaatatggaagttcaacttattcgacaaatggagtcagagggaatattctttccatcagaattagaatcccccaatcttgcagagcgagttttagactggttagaaaaacacggggcagaaagacttaaacgtatggcaattagtggagacgattgcgtggtcaaaccaattgacgataggtttgcaaccgcgttgattgcgctaaacgacatgggtaaggtaagaaaagatattccacagtgggaaccgtctaagggatggaatgattggcagcaagtacccttttgtagccaccacttccatcaacttataatgaaagatggaagagaaattgttgtaccgtgtcgaaatcaagatgagctagttgggagagctagagtatctcagggagctggatggagtctccgggagactgcatgtttaggaaaaagttacgcacagatgtggcaacttatgtatttccatcgtagagacttgcggctggcagcaaacgccatatgctcagccgtccccgtagactgggtaccaacaagcaggacgacgtggtcaattcatgcacatcaccagtggatgacaacagaggatatgttgtctgtctggaatagagtttggatagaagaaaacccttggatggaggacaagacccatgtctcttcgtgggaagaagtcccttacctaggtaaacgtgaagaccagtggtgtggctccttaataggtttaacagcgcgtgcaacatgggcgacaaacattcaagtagctattaatcaagtacgtagactaataggaaatgaaaactatctagattacatgacctcaatgaaacgattcaaaaacgaaagtgatcccgaaggtgctctttggtga

SEQ ID NO: 21107 - RNA, 9879 nt, synthetic construct
  misc_feature 1..9879: note = derived and/or modified CDS sequence (opt6) from DENV-1__JX669461__SS-prME
  source 1..9879: mol_type = other RNA
agtgtaacaatgttacttatgctattacccactgcactagcatttcatttgacgacacgagggggtgaaccacatatgatagtaagtaaacaagaacgaggaaaaagtttgctttttaaaacaagtgtaggagtaaatatgtgcacactgattgcaatggacttaggagaactatgtgaagataccatgacgtacaaatgtccgagaataacggaagcggaacccgacgatgtagactgttggtgtaacgcaacagatacatgggtaacctacgggacctgctcacaaactggtgaacacagacgtgataaacgatctgtagcgctcgctccccatgtaggactcggattagaaactagaaccgagacgtggatgagctccgaaggagcatggaaacaaattcaaaaagttgaaacttgggcgctaaggcatccaggttttacagttatagcactgtttttagcacacgcaataggtactagcatcacgcaaaaaggaattatttttatattgctaatgctagtaacaccatcaatggcgatgcgatgcgtgggaattggtaacagagacttcgttgaaggtctttcgggtgcaacttgggtagatgtcgtactagaacatggatcatgtgtaacaaccatggccaaaaataaaccgacgttggacatagaattgctcaaaactgaagtaactaatccagctgtcttacgcaaactatgcattgaagctaaaatatccaatacaacaactgatagtaggtgcccgacgcaaggtgaagcaactctggttgaagaacaggacgcaaatttcgtctgcagacgaacgtttgtcgaccgaggatggggtaacggttgtggtctattcggcaaaggaagcctgttgacgtgcgcaaaatttaaatgcgtaacaaaactggaaggtaaaatagttcaatacgaaaatttaaaatactcagtgatcgtaacagtacacaccggcgaccaacaccaagtaggcaacgaaactacagaacacggaacaatagcaacaataacaccacaagcgccgaccagcgaaatacaactgactgattacggagcgttgacacttgactgtagtcctcgtacgggtttagattttaatgaaatggtgttattgactatgaaagagaaaagttggcttgttcataaacagtggttcttagatttaccgttaccatggacaagcggagcaagcacgtcacaagaaacatggaacagacaagacctacttgtaacttttaaaactgcacacgccaagaaacaagaagttgttgtattgggatcccaagaaggcgcgatgcatacagctctgacaggagcaacagaaattcaaacttcaggcaccactacaatattcgctggtcacctaaaatgtcgtttaaaaatggataaattaactctgaaagggatgtcttatgttatgtgtaccggtagtttcaaattagaaaaagaagtagcagaaacacagcatggaaccgttttggtacaagtaaaatatgaaggtacagatgctccatgcaaaataccattcctgactcaagatgaaaaaggtgtcacacaaaacggacgactaatcacggcaaatcctatagtaacggataaagagaaaccagtcaatattgagactgaaccaccttttggggaatcctatattgtagtaggagcaggggaaaaagccctaaaacttagttggtttaagaaaggctctagcattggaaaaatgtttgaggctacagcaagaggagcacgaagaatggcaattcttggcgatactgcctgggactttggaagtataggaggattatttacatctgttgggaaactcattcatcaagtttttgggactgcttatggtgttttattcagtggcgtaagttggactatgaaaatcggaatcgggattctactgacttggcttggcttaaattcaagatccacttccctatctatgacatgcatcgctgtaggaatggtaacattatatctcggagtaatggtacaagccgattcaggctgtgttataaattggaaaggtagggaactcaaatgcggttccggaatctttgtgactaacgaagtgcatacatggaccgaacaatacaaattccaggcagactcccccaaaagattatcggcggccataggaaaagcatgggaggagggcgtctgcggtataagatcagcgacaaggctagaaaatataatgtggaaacaaatatcgaacgagttaaactacatcctcctcgaaaatgatatgaaattcacagtggtagtaggcgacgtaaacggcatattagcccagggtaagaaaatgatacgccctcaacctatggaacataaatattcatggaaaagctggggtaaagccaaaatcataggcgccgacatacagaatacaacgttcataatagatggaccagatacaccggaatgtccagacgatcaaagagcttggaatatatgggaggtggaggattacgggttcggaatattcaccaccaacatttggctaaaacttagggattcgcacacccaaatgtgcgaccatagactaatgtccgcagcaatcaaagattcaaaagcggtgcatgcagacatggggtattggattgaaagcgagaaaaatgaaacctggaaactggcaagagccagctttatagaagttaaaacatgcatttggcccaaatcacatacgctatggtccaatggtgtcttagaatctgagatggttatacccaaaatatatggtggtccgatctcacaacacaactacagaccaggatactttacacagaccgccggaccgtggcacttagggaaactagaactagacttcgacctctgtgagggaacaacggtggtcgtggacgaacattgcggatatcgcggaccatccttaaggactacgactgtaactggtaaaataatccatgaatggtgttgccgcagttgtacactcccaccgttacgctttcggggagaagacggctgctggtacggaatggaaatccgacccgtcaaagaaaaagaagaaaacttagtacgaagtatggtttcagccggatcaggggaaatggactccttctccctagggatcctttgtgtctcgatattaatagaagaagtaatgagatctaggtggtcccgcaaaatgctaatgacaggtacactagcagtcttcctgttactaattatgggccagttgacctggaatgatttaattagactttgtatcatggtgggtgcaaacgcaagcgataaaatggggatggggacaacatacttggctttaatggctacgttaaaaatgcggcctatgtttgcagtgggacttttattccggagactaaccagtcgtgaagtgctactgttaacggtgggactaagtttagttgccagtgtagaacttccaaatagtctagaagaattaggcgacggattagcaatgggaattatgatgttaaaactattaaccgatttccaacctcatcaattatggaccacgttattatctttaacttttatacgtaccagtctatcattagattacgcctggaaaacaatggctatggcattgagtatagtatctttgtttccattgtgtttaagcactacgtcgcagaaaactacctggctccccgttctcttaggctcatttggctgtaaaccgctcactatgtttctcattacagaaaataaaatttggggacgaaaaagttggccaataaacgagggtataatggcagtcggcattgtctcaatcctcctgtcttcactgcttaaaaacgacgtaccgctcgctggacctttgatcgccggtggaatgctaatagcatgttacgtaatatctgggagcagtgcagatctctctcttgagaaagcagcagaagtctcgtgggaagaagaagctgaacattcagggacctcccataacatcttagtagaagttcaagacgacggaacgatgaagataaaagacgaggagagagatgacacattaacaatactactgaaagcaactttactagctgtgtcaggtgtataccctatgtctatccctgctacattattcgtatggtatttctggcagaagaagaaacaacgatcgggtgtgctttgggatacacctagtccaccagaagtagaacgtgcagtcttagacgacggaatataccgaatactgcaacggggtttattaggccggtcccaagtcggagttggggtattccaggacggagtatttcataccatgtggcacgtgacacggggtgccgttctaatgtaccaaggcaaacgattagaaccgagctgggcttctgtcaagaaagatttgatttcttatggcggagggtggcgctttcagggatcttggaatacaggagaagaagtacaagtcatagctgtagaaccaggcaaaaatcccaaaaacgtgcagactacaccagggactttcaaaacgccggagggcgaagttggcgctattgccctcgatttcaaacccgggacatcagggagtccaatagtaaaccgggaaggaaaaattgtaggattgtacggaaatggagttgtaacaacatctggaacatatgtatccgctatcgctcaggccaaggctacgcaagaagggcctcttcctgaaattgaagacgaagtctttaagaagcggaatctaacgataatggatttacatccgggatcaggaaaaacgcgaaggtatttaccagctatagttagagaagctataaaacgaaaacttagaacattaatactcgctccgactcgagtcgttgctagtgaaatggctgaagcactgaagggcatgccaatacgttaccaaactacggcagttaaatcagaacataccggtagggagatcgtggatctgatgtgtcatgccacttttactatgaggctcctgagtccagtacgggtcccaaattataatatgatcattatggacgaggcacactttactgatcctgcaagcattgcagccagaggttacataagtactcgcgtaggcatgggagaagcagcagccatttttatgacagcaacgcctccaggtagcgtggaagccttcccgcaatccaatgctgtcattcaagacgaagaaagagacatccctgaaaggtcgtggaactctggttacgattggattacggatttcccgggtaagacagtatggttcgtgcctagtattaaaagtggcaacgacatagctaactgtctcaggaaaaatgggaagagagtgattcaactgtcaaggaaaacattcgacactgaatatcagaaaaccaaaaacaacgattgggactacgtagtaacgacagatatcagtgaaatgggagccaatttcagagcggatcgagttatagacccaagacggtgtttaaagccagtaatactaaaagaaggtccagaaagggtcatcttagctggtccaatgcccgtaactgtggcatccgcggcacaaagaagaggaagaatcggtaggaaccaaaataaagaaggcgaccaatacatatatatgggtcaaccactgaacaatgatgaagaccatgcccattggacagaagcaaagatgctacttgataatattaacaccccagaaggtattatacctgccctatttgaacctgaaagagaaaaatctgctgctatcgatggcgaatatcgactaagaggagaagcacgaaagacatttgtcgagctgatgagacgaggagatctcccagtctggttaagctataaggttgcttcagaaggctttcaatactcggatagaagatggtgctttgatggcgaaagaaataaccaagtattagaggaaaatatggatgtagaaatatggacaaaagaaggagagcggaagaaactgcgacctcgttggctagacgcgagaacttactccgacccactcgctttaagagaatttaaggagtttgccgcaggaaggagaagtgtttcaggagatctgatactagaaattggaaagctacctcagcacctaacactacgtgctcagaacgcattagataacttagtcatgcttcataatagcgaacaaggagggaaggcatatcgacacgctatggaagaacttccggatactatagagacactgatgctactggcgttaatagctgtattaactggtggcgtcacattattctttcttagcggtaagggattaggcaaaaccagcataggactactatgtgttatggcatctagtgcattactatggatggcatcggtagaaccccattggatagctgcttcgataatcttagagtttttcctgatggttctactaatcccagaacccgatagacagagaacaccacaagacaatcagttagcatacgtagttataggtttactcttcatgatactgacagttgcagcaaatgaaatgggactactagagacaaccaagaaagacctggggataggtcatgtagctgtcgagaatcatcaccatgcgacgatgttggatgtagatctgcggccagcttcagcatggaccctatacgcagttgctacgacagtaattacacctatgatgcgacacaccattgaaaatactacggctaatatatcgctaacagctatagcaaatcaagcagctattctgatgggtcttgacaaaggttggccgatatcaaaaatggatataggcgttccgttgctagcactcggatgttacagtcaagtaaatcctttaacattaaccgcagcggtcttaatgttagttgcacactatgcaataataggtcctggattacaagccaaagccactcgagaggcacaaaagaggaccgccgcaggaattatgaaaaaccccacggtagatggaattgtaactatcgatttagatcctgtagtgtacgacgctaaattcgaaaaacagttaggtcaaattatgctgttgatactctgcacatcgcagatccttctcatgcggacaacatgggctctatgtgaaagtataacgttagcaacaggacctctgactacactctgggagggatctcccggtaaattttggaacaccacgatagccgtatctatggcaaatatattcagaggcagttaccttgcaggcgctggtcttgctttttcactaatgaagagtctgggtggtggacgtcgcgggacaggggcgcaaggtgaaacactaggtgaaaagtggaaaagacaattaaaccaactttccaaatcagagtttaacacttacaagaaaagtgggataatggaagtagatagatctgaagccaaagaggggcttaaacggggagaaactacaaaacacgcagttagtagaggtacggctaaactccgttggttcgtagagaggaatctagtgaaaccagaaggtaaagttatagatctaggttgcgggaggggaggttggagttattattgtgcaggactaaagaaagtcaccgaagtgaagggatatacgaaaggagggcctggacatgaggaaccgataccgatggcgacgtatggatggaatctcgttaagttacattcaggcaaggatgtcttctttactccgcctgaaaaatgcgacaccttgttatgtgatataggtgaatccagcccgaatccgacgatcgaggaaggaagaactctacgagttttaaagatggtagagccatggctcagaggaaaccaattttgtatcaaaatactcaatccatacatgccctcagtagtagaaactctagagcaaatgcaaagaaaacacggtggaatgcttgtaagaaatccactatcaagaaacagtacacatgaaatgtattgggtgagttgtggaaccggaaatatcgtatcggctgtcaatatgacatcaagaatgctactaaatagatttacaatggcgcatcgaaagccaacatacgaacgagatgtggatcttggagctggaacacgacatgtggccgtagagccagaagtggcaaacttggacataatcggccagagaatagagaatattaaaaatgaacacaaatctacctggcattatgacgaggacaatccctataagacatgggcatatcatggatcatacgaggtcaaaccatcaggaagtgcatcatcaatggttaatggcgtggtacgactcttaaccaaaccttgggacgtaataccaatggtgacacaaatagcaatgacagacactacacccttcggacaacaaagagtctttaaggaaaaggtagacacacgaactcctagagcaaagcgcggcactgcacaaattatggaagttaccgcaaaatggctatggggcttcctcagcagaaataagaaaccacgaatatgtacaagagaggagttcacacgtaaagtaaggtcaaacgctgctataggggctgtatttgtagatgagaatcaatggaactcagcaaaagaagccgttgaagatgaaagattctgggatcttgtgcaccgcgaacgggaattgcataaacaaggcaaatgtgcaacatgcgtttacaacatgatgggaaaacgagagaagaaactaggcgaatttggtaaagcaaaagggtctcgagccatctggtatatgtggttaggagctcgattccttgagttcgaggctttaggattcatgaacgaagaccactggttcagtcgtgagaatagcctctcaggtgtagagggagaaggtctacacaaacttgggtatatactacgcgatatctcgaaaataccaggcggtaatatgtatgctgacgataccgcaggctgggatacacgaattacagaagatgacctacagaatgaggctaagattactgatattatggaaccagaacatgccctattagcgacttcgatctttaagctcacataccaaaataaagtcgttagagtacaaagaccagcaaaatcaggcacggtaatggacgtcatttcaagaagggatcaaagaggtagtggccaagttggaacctacggtttaaatacttttacaaatatggaagttcagttaataaggcaaatggaatctgaaggaatctttagcccaagcgaacttgaaacaccgaatttggctaagaaagtattagattggctagaaaaacatggtgcggaaagattgaaacggatggctatctcaggagacgattgtgtagtaaagcccatagacgataggtttgcaacagctctgactgctctaaatgatatggggaaggtgaggaaagatattcctcaatgggaaccgagcaaaggatggaacgattggcaacaggttccattttgcagtcaccattttcaccaacttattatgaaggacggaagggaaatagtagtcccttgtcgaaaccaggacgagttagtaggacgcgcaagggtaagtcaaggagcagggtggagtttacgtgaaactgcatgtcttggaaagagttatgcacaaatgtggcaattaatgtattttcatcgacgcgatttgcgactagcagcaaacgccatatgcagcgcggtacccgttgattgggtcccaaccagtaggacaacgtggtcaattcatgcccatcaccaatggatgacgaccgaagacatgctgagtgtgtggaatagagtgtggatagaagaaaatccgtggatggaagacaagacccatgtatcgtcatgggaagaagtgccttatctcgggaaacgggaagaccagtggtgcggttcattgattggtttaaccgcacgcgctacgtgggctactaatatccaagtcgcaataaaccaagtaagacgtctgataggcaatgaaaattatctcgattacatgacaagcatgaaaaggttcaagaatgaaagcgacccggagggagcgttatggtaa

SEQ ID NO: 21108 - RNA, 9879 nt, synthetic construct
  misc_feature 1..9879: note = derived and/or modified CDS sequence (opt6) from DENV-1__KF184975__SS-prME
  source 1..9879: mol_type = other RNA
agtgtaaccatgcttctaatgttaatgccgactgctttagcatttcatttaactacaagaggtggagaaccccacatgatagtttcaaaacaagaacggggtaaatcgctactttttaaaacgtctgcgggagtgaatatgtgcacattaatagcaatggatctgggagaactatgcgaagacaccatgacatataaatgcccccgaattactgaagccgaaccagatgatgtagactgttggtgcaatgccacggacacatgggtaacttatgggacctgctcacaaaccggtgaacacagaagggataaaaggagtgtcgctctagctccgcatgtgggattaggtctggaaactagaacggaaacttggatgtccagcgaaggtgcttggaaacaaatacaacgtgtcgaaacatgggcattacgtcaccccgggtttaccgtaatcgctttattcttggcacatgcaatcggtacctcaattacccaaaaaggtattatatttattttgttaatgctggtaacaccatcaatggccatgcgttgtgtagggatcgggtcgagggattttgttgaaggtctatccggagcaacttgggtagacgttgtacttgaacacggttcatgtgttacaactatggcaaaagataaaccaactttggacatcgaactattaaaaactgaagtaaccaatcccgctgtcctacgcaaactttgtatagaagcaaaaatttcaaatacgacgacagacagtagatgtccgacccaaggagaggcaacacttgtcgaggagcaagatgcaaattttgtttgtcgtcgaacgtttgtggacagaggatggggtaacggatgcggattatttggaaaaggaagtctactcacatgcgcaaaattcaaatgtgtaacgaaactggaaggaaagatagtacaatacgagaatttaaaatactccgtaattgtaacggtccatacagaagatcaacatcaggtgggaaacgaaacaactgaacatggaacaatagccacaatcacaccccaagctccaacgtctgagatacagttaacggactatggtgctttaacactagactgtagtcctagaacagggctggactttaatgaaatggttcttctaaccatgaaagagaaaagttggctggtacacaaacaatggtttctagatttaccattgccctggacctcaggagcttcaaccagccaagaaacatggaatcgccaagatttactcgtcacatttaaaaccgcacacgcaaagaaacaagaagtagtagtattaggaagtcaagaaggagcaatgcacactgcattaaccggagctacagaaattcagaccagcggaacaacaacaatttttgcaggacacctaaaatgtcgcctaaaaatggacaaactcaccttgaaaggtatgagttatgttatgtgtacgggcagctttaaattagaaaaagaagtagccgagacacaacatggaacagttctggtacaagttaaatacgaaggtacggatgcaccatgcaagattcctttttcaatacaagatgagaaaggagtaatacaaaacggtaggttgataaccgctaacccgattgtgactgacaaggaaaaacccgtaaatatcgaaacggaacctcccttcggggaaagctacattgtggtaggggccggagaaaagacactaaagctaagttggtttaagaaaggctctagtatcggaaagatgttcgaagcaacagcacgcggagcccgaaggatggcaatattaggtgatacggcatgggattttgggtcaataggaggcgttttcacctccgtaggcaagctcgtacaccaggtatttggaacagcgtacggagtactattcagtggtgttagttggaccatgaagatagggattggaatacttttaacgtggttaggactaaacagcagatcgacatcactatcaatgacatgtatagcagtggggatggtaaccttatatcttggtgtcatggttcaagccgatagtggatgcgtgatcaactggaaaggaagagaactcaaatgtggttctggaatattcgtcacaaatgaagtacatacatggactgaacaatataaatttcaagccgacagtcctaaaagactatccgctgcgattggcaaggcgtgggaagaaggtgtgtgcggaattagatcagctactagattagaaaatgttatgtggaaacaaatcagcaatgaactaaatcacatattactagagaacgatatgaaatttacagtggtagtaggtgacgttaatggcattctagcacaaggaaagaaaatggtacgtccccagccaatggagcataaatactcctggaaaagttggggaaaagccaaaataataggtgccgatattcaaaacactactttcataatcgatggtccagacacacctgaatgtcctgacgatcagcgggcatggaacatatgggaagttgaggactatggatttggcatatttaccactaatatatggctaaaattaagggatagttatacgcaaatgtgcgaccataggctgatgagtgcggcgataaaagatagtaaagcggtacatgccgacatgggttattggatagaaagtgagaaaaatgaaacgtggaagctagcaagagcttcatttattgaagtcaagacatgtatctggccaaaatcacatacattatggtccaacggagtattagaaagtgaaatgataatacctaagatttatggaggacccacttcacaacacaattatagacctggctactttacacaaactgcggggccttggcatcttggcaaactggaactagactttgatctttgtgaaggtacaaccgtagtggtcgatgagcactgcggtaatcgagggccatccttacgaactactacggtcactgggaaaataattcacgaatggtgttgccgaagctgcacactaccaccattaagattcaaaggagaggacggatgttggtatggaatggaaataagacctgtaaaggaaaaagaggaaaacctagtaagatcgatggtgtccgctggatccggagaggtagataactttagcttaggcttgttatgcgtctccataatggttgaagaagtaatgaggtcccgatggagtagaaaaatgcttatgactgggacactcgcagtctttttattgttgataatgggtcagttgacgtggaacgaccttatacgattatgtattatggtaggtgcaaacgcttctgatcgaatgggaatgggtacgacttatcttgcactaatggcgacattcaaaatgagacctatgtttgctgtgggactattgtttagacgtttaacttctagggaagttctactgctgacaatcggactttccctcgttgcatccgttgaacttcctaattcgttagaagaattaggtgatggattggcgatgggaataatgatgttgaaattacttactgattttcaaagtcaccaactttggacaactcttctcagcttaacattcgtcaaaacgacactaagtctagattatgcttggaaaacaatggctatggtgctctcgattgtaagcctatttccactatgcttatccacaacttcccagaaaaccacgtggctcccggtgctattaggcagcttcggttgtaagccgttgactatgttcctgataaccgaaaataaaatttgggggagaaaaagctggcccctaaatgaaggcatcatggctgtaggaattgcaagcatcctattgtcatctctactcaaaaacgatgtgccgttagctggaccactcattgctgggggaatgttgatagcctgctatgtaataagcggttcgtcagcagacctcagcttggaaaaagcagcagaagttagctgggaagaagaggcagaacactctggtgccagccataatatcctagttgaggttcaagacgatggaacgatgaaaataaaggatgaagagagggatgacactttaaccatattgttgaaagcaacactactggccgtatccggtgtataccccatgtctataccagctaccttatttgtctggtatttttggcagaagaagaaacaaagaagcggggtcctatgggacacccctagtccacctgaagctgagaaggcagttctagacgatggcatatataggattcttcaacgaggtcttctcggacgaagtcaagtcggagttggagtcttccaagacggcgtcttccatactatgtggcatgttacacgtggggcagtccttatgtatcaaggtaaaagggtcgagccatcatgggcatccgtaaagaaagacctaatttcgtatggaggtggttggcgttttcaaggtttatggaatactggggaggaagtacaagtcatagcggttgaaccgggcaaaaatcctcgaaacgtacaaaccactcccgggacattcaaaacacccgagggtgaagtcggcgcaatagccttagatttcaaaccaggaacaagcggatctccaatagtaaaccgagagggcaaaatagttggactttacggaaacggcgtagtgactacgagcggcacttatgtttcagccattgcacaagcaaaggcttcacaagagggtccacttccagagatcgaagatgaggtattccgcaaacgaaatttaactataatggacctacatccgggctctggcaaaacaagaaggtacttaccagcaatagtgagggaagctataaagagaaaattacgcactctaatcctcgccccaacacgagttgttgcctcggaaatggcagaggctttaaagggtatgccaattcggtatcaaacaaccgccgtcaagactgagcatactggccgagaaatagtagacttgatgtgccatgcaacatttacgatgaggttgctatcgcctgtaagagtacctaattataatatgattataatggatgaagcccactttacagacccagcctccatagctgcgcgcggatatatcagcacgcgagtcggcatgggcgaagctgcagcaatattcatgactgctactccaccaggatcaatggaggcttttccgcagagtaatgcagtgatccaagacgaagaaagggacatcccagagcgttcttggaactctggatacgactggatcacggactttccgggaaagacagtatggtttgtaccaagcatcaaatcgggaaatgatattgcaaactgtttgagaaagaatggaaaacgcgttatacagttgtcacgaaaaacttttgataccgagtatcagaaaaccaaaaataatgattgggactatgttgtaacaactgatatctcagaaatgggcgcaaatttccgagcagatagagttatagatcctcgtagatgtttaaagccagtcatactgaaagacggaccggaaagggtgatactcgccggtccgatgccggtaacagtcgcgtccgcggcgcaaaggaggggcagaattggaagaaaccaaaacaaggaaggtgatcaatacgtctatatgggccaacccctaaataatgacgaggatcatgcgcactggacagaggcaaaaatgcttcttgacaacattaatacaccagaaggcataatacccgctctatttgagcctgagagagagaagtcagctgctattgatggtgaataccgcttaaggggtgaagcgagaaagacatttgtagagttaatgaggagaggtgatttacctgtgtggctatcttataaggtcgcatccgaaggcttccaatattcagaccgcagatggtgtttcgacggcgaacgtaataaccaggtactagaagaaaacatggatgtcgaaatatggacaaaagaaggagaacgtaagaaactgagaccaagatggctagatgctcgcacttacagtgaccctcttgctttacgcgaatttaaagaatttgcagcaggccgacgcagtgttagtggggacctaattctagaaataggaagattaccacaacacctaacgttaaaagcacagaatgcattagataatctagtcatgttacacaactctgaacaaggaggaaaggcatatagacacgcaatggaagaactgccagatacaatagagactcttatgttgcttgctctaatagcagtattaactggcggggtcactttgttctttctctccggcaaagggctaggtaagacaagcatcggcttattatgcgtcatggcctcatcagtactattatggatggcaagtgtagagcctcactggattgcagcatcaattatactcgagttctttttgatggtactcctgataccagaacccgatcgtcaacgtacaccgcaagataaccaattagcatacgtggtaataggtctattgtttataatattgacagttgcagctaatgaaatggggttgcttgaaactacgaagaaagacttaggtatcggacatgttgcagctgaggatcatcaacatgcaacaatgttagatgtagatttgagaccggcttcagcgtggacattatacgctgttgctaccacaataataaccccaatgatgcgccacacgattgaaaacacaactgcaaacataagtttaacagccatagccaatcaagcagcaatcctcatgggattagataaaggatggccaatatcgaagatggacatcggtgttccgttacttgcactaggctgctatagtcaagtgaacccacttacattgacggcagcagtattaatgttggtagcccactacgccataataggaccagggttacaggcaaaagcgacacgggaagcacagaaaaggacagctgctggcatcatgaaaaatcctaccgtagatggcatagtggctattgaccttgatcctgtagtttacgatacaaaatttgaaaaacaattaggacaaatcatgctcctaatcctttgtaccagtcaaatccttctaatgcgaacaacgtgggccttatgtgaaagtattacgcttgcgacggggccattaacaactctttgggaaggctcacccggaaaattctggaataccactattgctgtgtccatggcaaacatattccgcggaagttatctggcaggcgctggacttgcattttcattgatgaagagtttaggtggaggaagaagggggacaggggcacagggggaaacactaggagaaaaatggaaacgacaattgaatcaattaagtaaatctgagttcaatacatacaagcgttcgggaattacagaagtagaccgcagtgaagctaaagagggactaaaaagaggagaaacaacaaaacatgcggtttcacgcggtgctgctaaattaagatggttcgtagaacgcaatttagtgaaacccgagggaaaggtaattgatttaggttgtggtcgagggggatggtcatattactgtgcaggactgaaaaaggtcacggaggtgaaagggtacactaagggcggtcctggacatgaggaacccatacccatggctacatatggatggaacttagtaaaactgcattccggtaaagatgtattctttattccaccagagaagtgcgataccttgctctgcgacattggagaaagtagtccaaatcctactatcgaagagggacgaaccctaagagttcttaaaatggttgaaccatggctaagaggtaatcaattttgtattaaaatattaaatccatatatgccatcagtagttgaaacactcgaacaaatgcaaaggaaacatgggggaatgctagtccgaaatccacttagtagaaattccactcatgaaatgtattgggtctcttgtggaacggggaacattgtctcagcagtgaatatgacttctagaatgttgttaaatagattcactatggcccatcgaaaaccgacatatgaacgcgacgtagatttaggagctgggacacggcatgtagctgtagaaccggaagttgcaaatttggatataatagggcaacgaatagagaatattaagaatgaacacaaatccacctggcattatgatgaagataacccatataagacatgggcttaccacggatcttatgaagtgaaaccgtctgggtcagcgagctcgatggttaacggagtagtgagactactgacaaaaccatgggacgtcattcccatggtaacacaaatagctatgaccgacacgactccgtttggacaacagcgagtatttaaagaaaaagttgatacccgaacgcctagagccaaaagaggcacagcgcaaataatggaggtcacagcgaaatggctatggggcttcctatccaggaataagaaaccaaggatctgtacgagggaagaatttacacggaaagttcgtagcaacgcggctatcggggcagttttcgtagatgaaaaccaatggaactcagccaaagaagcagtagaagatgaaagattttgggaccttgtccatagagagcgagaattacacaaacaaggtaaatgcgccacgtgtgtctataacatgatgggaaagagggagaagaaactaggagaatttggaaaagccaaaggatcaagggccatctggtatatgtggttaggtgcaagatttttagagttcgaagcactcgggtttatgaacgaagaccattggttcagcagagagaacagcttatcaggagtagagggggagggtcttcataaattaggatatatcttaagagatatatcaaaaatacccggaggtaatatgtacgcagacgataccgcaggttgggacacacgtattacggaagatgatttgcaaaatgaagccaaaataacagatatcatggaacccgaacatgcacttcttgcaacctcgatattcaaactaacataccaaaataaggtagtaagggtgcaacgtccggccaaaagtggaacagtaatggatgtaatatcaagaagagatcaaagaggaagcggtcaagtcggcacgtatggacttaatactttcacaaacatggaagtacagttaataagacaaatggaatccgagggtattttcttacccagcgaattagaaactcctaaccttgctgaaagagcactagattggttggaaaagcatggtgtagaaaggcttaaacgtatggctatttcaggcgatgattgcgtggttaaaccaacagatgatagattcgcaacggctcttactgccctaaacgacatgggaaaagtgcgaaaagatattccacagtgggaaccgtccaaaggatggaatgattggcaacaagtacccttctgttcccatcacttccatcaactcattatgaaagacggaagggagattgtggtaccatgcagaaatcaggacgagctcgttggacgggcccgtgtatcacaaggggccggatggagtttaagagagactgcatgtttaggaaaatcttacgcacaaatgtggcagttaatgtatttccatcgacgagatctacgccttgctgccaatgctatatgctcagccgtaccggttgattgggtacccacctctagaaccacttggtctatacatgcccaccatcagtggatgacaactgaagatatgttaagtgtttggaacagggtttggatagaagaaaacccatggatggaggataagacccatgtttctagctgggaggacgttccgtacttaggtaagcgagaagaccaatggtgcggttcattaataggccttactgcgagagcaacatgggcaacgaatatccaagtggccataaatcaagtaaggcgattaataggtaacgaaaattatttggactacatgacctcgatgaagagatttaagaacgaatcggatccggaaggtgctttgtggtaa

SEQ ID NO: 21109 - RNA, 9879 nt, synthetic construct
  misc_feature 1..9879: note = derived and/or modified CDS sequence (opt6) from DENV-1__KT831765__SS-prME
  source 1..9879: mol_type = other RNA
tcggttacgatgttattgatgttaatgccaacagcactggcttttcacttaaccacaagaggtggggaaccacatatgatagtcagtaaacaagaaagaggaaaatcattattattcaaaacaagtgcgggggttaatatgtgtacgcttattgcgatggatctaggagaactatgtgaagatacaatgacatacaaatgtccgcgcataactgaagctgaaccagacgatgttgattgctggtgtaatgcaacggatacatgggttacatatggaacgtgtagccagacaggagaacatagaagagataaaagatcagtagcgttagcaccacatgtaggtcttggattagaaacaagaacagaaacttggatgagtagtgaaggggcatggaaacagatacaacgagtggaaacatgggcacttcgacatcctggtttcactgtgatagcattgtttctcgcacatgcgataggaacctcgatcacacaaaaaggaatcatatttatattgttaatgttagtgaccccctcaatggcaatgagatgtgtaggtatcggatcacgggattttgtcgagggtctatcaggtgcgacctgggtagacgtagtacttgagcatggctcatgtgttacaactatggccaaagacaaacctaccctggacatagaactccttaaaacggaagttacaaacccagccgtattaagaaaattatgcatagaggctaaaatttcaaatacgacaaccgacagccgttgtcctacacaaggagaagcgactttggtagaagaacaagatgccaacttcgtatgccgacgaacatttgtagatagaggttgggggaacgggtgcggtttatttggtaaaggcagcctaattacgtgcgctaaattcaaatgtgtgacaaaattagagggtaaaatcgttcagtatgaaaacttaaaatactcggttattgtcactgttcacaccggtgatcaacatcaggtggggaatgaatccaccgaacacggcacaactgcaacaataacgcctcaagccccaacaacagaaatacagctgaccgattatggagcattaacattagactgctcaccccgaaccggcctagactttaatgaaatggtgctcttaactatgaaggagaagtcatggttggtacataaacaatggtttctagacctcccattaccatggacatcgggagccagtacaagtcaagaaacctggaatcgtcaagatttgttagtaacatttaaaacagcccacgccaagaaacaagaagtagtggttctcggatcccaagaaggtgcaatgcatactgcactaactggcgcaacagagatacaaacgagtggtacgactacaatatttgcaggacatctaaagtgccgactcaagatggataaattaacactaaaaggaatgagctacgtgatgtgtacgggctcatttaaattagagaaagaagttgctgaaacacagcacggaacagtattggttcagattaaatatgaaggcacagatgcaccgtgtaaaataccattcagtacacaagacgaaaagggagtaacacaaaatggaaggttaattacagcgaatccaatagttacagataaagagaagcctgtaaacatcgaagcggagccaccgtttggtgaatcatatatcgtcattggggccggcgaaaaagcactgaagctcagttggtttaaaaagggttcatcaatcggaaagatgtttgaggccactgcacgaggtgcacgacgtatggccatcttaggagacaccgcgtgggatttcgggagtatagggggtgtgtttaccagtgtaggcaaattggtacaccagatattcggaacagcatatggagtcctattctcaggagtgtcgtggacgatgaaaattgggataggcgttttattaacgtggcttggtctaaattcaagatccacaagtctatccatgacatgcatagctgtcggattggtaaccctatatttaggagtaatggtccaagccgatagtgggtgtgtcataaactggaagggtcgagaactaaagtgcgggagtggtatattcgtcaccaacgaggtgcacacttggaccgagcaatataaatttcaagccgattccccaaaaaggctgagtgcagccataggtaaggcatgggaagaaggcgtctgcggtatacgatcagcgactaggttggaaaatatcatgtggaaacaaatatccaatgaactaaatcatattctactagaaaatgatatgaaatttacagtagtagtaggcgatgtggctggaatactagcgcaaggcaaaaagatgataagaccacaaccgatggaacacaaatattcatggaaaagctgggggaaggcaaaaattatcggggctgatgtccaaaacaccacttttatcatcgatggaccgaatactccagaatgtccagacgaccaacgagcgtggaacatatgggaagtggaagactatggcttcggcatatttacaacaaacatatggttgaaactaagagactcgtatacacaggtgtgcgatcataggttaatgtcggctgcaatcaaggattccaaagcagtacacgcggatatgggttattggatcgagagtgaaaagaatgagacatggaaattagcacgagccagctttattgaagtgaaaacttgcatttggcctaagagtcatacgctatggagtaatggcgtgctagaatcggaaatgattataccgaaaatatatggaggccctatatctcaacataaccatcggccgggatacttcactcaaacagcaggaccatggcatctaggcaagctagaactagactttgatctgtgcgaggggactaccgtagtggtcgatgagcattgcggaaacaggggaccatctttacgaaccaccactgttacgggaaaaattattcacgaatggtgctgtcggagctgtacgttgccaccactaagatacagaggcgaggatgggtgttggtacggcatggagatccggcctgtaaaagaaaaagaggaaaacttggtaaaatcaatggtttcagccggatctggggaagtagactcgttctccctgggtctattatgtatatcaataatgatcgaggaggttatgcgcagtcgatggtctagaaagatgcttatgactggaactctggcagtattctttctactaatcatgggtcagttaacgtggaacgacctaataagattatgtatcatggttggagcaaacgcatcagatagaatgggaatggggactacatatttagcactaatggccacgttcaaaatgcgcccaatgtttgcagttggtctcttattccggaggttaacctctagagaggtcttactattaacaataggtttgagtctcgtggcctcggtagaactacctaactcactagaggaactcggagacggtttagcgatgggaataatgatactgaaactattaacagatttccaatcacaccaactatgggcgacactattatcattaacatttataaaaacgacctttagtctacattatgcttggaaaactatggcaatggtattgagtatcgtatctctttttccgttatgtttaagcacaacctcccagaagacgacttggttaccagtcctactgggatcgctgggctgtaagccacttacaatgttcctaatagcggaaaacaaaatttggggacgcaaaagttggcctttgaatgaaggaattatggcagtaggaatcgtttcaatacttttatcatcactgcttaagaatgatgtaccactagccggcccgctcattgcgggaggcatgcttatcgcatgttatgtaattagtggatcaagtgctgatttatcactagaaaaagcagctgaagttagctgggaagaggaagccgagcacagtggtgcaagccataatatcttggtggaagttcaagatgatggtactatgaaaattaaagacgaggaacgcgatgatactcttaccattctgctgaaagcgacacttttagcggtttcaggagtgtatcccctttcaatacccgccacactatttgtatggtacttctggcagaagaagaaacaaaggagcggggtactatgggatacaccatcaccacctgaagtggaacgagctgttttggatgacggaatttaccgtataatgcaacgaggtttattaggtcggtcgcaagtgggtgtcggggtattccaagagaacgtatttcacaccatgtggcatgtaacacgaggagctgttctcatgtaccagggtaaaagactggagccgtcctgggcatcggtcaagaaagacttgatttcttacggtggcggatggcgtctacaaggttcatggaatactggagaggaagttcaagttattgctgttgaaccaggcaaaaatcccaaaaatgtacagactgcaccaggaactttcaagacacctgaaggagaagttggagccattgcacttgattttaaaccgggcacatccggtagccctattgtcaatcgagaagggaaaatcgtgggattatacgggaacggggtagtcaccaccagtggtacttacgtcagcgcaattgcacaagcaaaagcaagtcaggaaggaccgttaccagaaatagaagacgaagttttcagaaaaagaaacctgacaataatggatcttcatccaggaagcggaaaaacaaggcgatatttacccgcgatagtaagagaagccattaagcgaaaattacgcacattaatactagcaccaacaagagtagttgctagcgaaatggccgaagcattaaagggtatgccgataagatatcaaacaacagcagttaaaagcgaacatacaggaaaggaaattgtagatctcatgtgccatgcgacatttacgatgagattactttcacccgtcagagtaccgaattataacatgataataatggatgaagcccactttacagatccatccagtattgccgcaagaggctacatttcaacccgagttggcatgggagaagcagccgctatcttcatgaccgctacacctcctgggtcggtagaggcttttccccaatccaacgcagtgattcaggatgaggaaagagacatacctgaaaggtcttggaactccggatatgaatggattactgattttccggggaaaactgtctggtttgtcccaagtataaagtcaggaaacgacattgcgaattgcttgaggaagaacggtaagagagtaatacagctatctaggaaaaccttcgataccgagtatcagaagactaaaaacaatgattgggactacgtggtgacgacagatatttcagaaatgggcgcaaatttccgagcagacagagtaatcgacccaaggagatgcttgaaaccagtaattttaaaggacggacctgaacgcgtaattttagcaggtccaatgccggttacagttgcaagcgccgcccaacgccggggaaggataggacggaaccataataaggaaggggatcaatacatttatatgggacagccattgaacaatgacgaagatcatgctcattggacagaagcaaaaatgctgctagataatataaatacgcctgaaggaataataccagcgttgttcgaaccagagagagagaaaagtgctgcaatagacggtgaatatcgattgaggggagaagcaaggaaaactttcgtagaactaatgagaaggggtgatcttcccgtttggctatcttataaggtagccagtgaagggtttcaatactctgatagacgttggtgtttcgatggagaacgaaacaatcaagtacttgaagaaaatatggacgttgaaatctggacaaaagaaggcgaaaggaagaaactacggccaagatggttagacgctcgaacttatagcgatcctttagcgttaagagaatttaaggaatttgctgcaggaagacgatctgttagtggcgacttaatacttgaaatcgggaagctaccgcaacaccttacccagagagcacagaacgcgttagacaatctggtgatgctacataatagtgagcaaggaggcagagcatatcgacacgcaatggaggaactaccagatacaatagagaccttgatgttattagcccttatagctgtattgaccggaggcgttacactattcttccttagtggtaagggattaggaaagacctccattggacttctatgcgtaatggcaagctccgtcttattgtggatggcaagcgtcgaaccccattggatcgcagcttctataatcctagagttctttttaatggttctgttaataccagagccggatagacaaagaacacctcaagacaatcaactagcttacgtggttataggaatgttattcatgattcttacagtagctgctaacgaaatgggattactggaaacaaccaagaaagacttaggcatcggacatgttgctgttgaaaatcatcaccatgctgcgatgcttgacgtagacttgcaccccgcctcagcttggaccctatatgccgttgccacaaccatcattacgccaatgatgagacatacaatcgaaaacacaacagctaatatcagcttaacggctatagccaaccaggctgcaatcctaatgggcctggacaaaggctggccaataagcaaaatggacatcggcgtccctctcttagctctagggtgttatagtcaagttaatcccttaaccctaacagcagctgttttaatgcttgtagctcattatgcaattattggccccggattacaagcaaaagcaactagggaggcacaaaagaggactgcagctggcattatgaaaaacccaactgttgacggcatagtcgctatagatctagacccggttgtatacgatgcaaaatttgaaaaacagcttggacagataatgctactgatactatgtacaagtcagatattattaatgagaacaacgtgggctttatgcgaatcaataaccttagctacaggaccactaacaactttatgggagggatctccaggtaagttctggaacacaaccatagcagttagtatggctaacattttcagaggtagttacctagcgggagctggactagcattctcgttaatgaaaagcctagggggaggccgtaggggaactggcgctcagggagaaaccctaggtgaaaaatggaaacgacaactaaatcaactgtctaaaagtgagttcaacacatataaacggtctggtatcatggaagttgatagatcagaggctaaggaaggactgaaaagaggagaaacaactaaacatgctgtaagcaggggtacagccaaacttaggtggttcgttgagcgaaatttagtaaaaccagaagggaaagtgatagatctgggctgtggaagaggaggatggagttactactgtgcgggactgaagaaagtgaccgaagtaaagggctatacaaaaggtggaccaggacacgaagaaccaattcctatggccacctacggttggaatctagtgaaactgcatagcgggaaagacgtgttctttgttccaccagaaaaatgcgatactttactatgtgatataggagaaagcagtccaaaccccaccatagaagaagggcgaactttgagagttctaaaaatggttgaaccctggctaagaggcaaccaattctgtataaaaatactaaatccttatatgcctagtgtcgtggaaacacttgagcaaatgcaacggaaacatggcggaatgctagtccgaaacccactgagtcgaaattcaactcacgaaatgtattgggtaagttgcggtacgggaaatattgtgtccgcgatcaatatgacaagcagaatgctgctcaatcgatttaccatggcgcaccgaaaacccacatatgaaagagacgtagatttgggagcgggtactagacatgttacggtagagcccgaagtggcaaacttggacattattggtcaacgaatagagaacattaagtgtgaacataaaagtacctggcactatgacgaagataatccatataaaacatgggcatatcatgggtcatatgaagtcaaaccatccggaagcgcatcatccatggtaaatggggttgtaaaactcttaacaaagccatgggatgtaattccaatggttacacaaatcgccatgacagataccacaccctttggccagcaaagagtattcaaagaaaaagtagacacacgtactccaaaagccaaacgagggaccgcacagataatggaagtgactgctagatggttatggggatttctatcccgtaataagaagcccagaatttgcacgagagaagaatttacgcgtaaagtacgatcaaacgctgccataggtgcagttttcgtagatgagaaccaatggaactcagcaaaagaagctgtagaagatgaacgcttttgggatttagtacacagggaaagggaactacataagcaaggcaagtgcgccacatgcgtatataatatgatgggaaaaagggagaagaaattaggggaatttggtaaagccaaaggaagtcgagcgatatggtatatgtggctcggggctaggttccttgagttcgaggctttaggttttatgaatgaagaccattggttcagtagagagaactcgttatcgggagttgagggtgaaggactacataaacttggatacatcttgagagacataagtaaaatttcgggcgggaatatgtatgccgacgatacagcaggatgggatacgaggattaccgaagatgatctccaaaatgaagccaagataactgaaataatggagcctgaacacgcgcagctagcaaaggcgattttcaaactaacgtaccagaacaaggtggtaagggttcagagaccagcaaagaatggaacggtaatggatgttatttcaaggcgtgatcaacgtggaagtggccaagtaggaacatacgggctaaacacattcacaaatatggaagcacaattgattaggcagatggaaagcgagggaatatttagccccagcgaattggagactccgaatctcgcagagagggtactggattggctcgaaaaatacggggtggaaaggttaaaaaggatggctattagtggtgacgattgtgtcgtaaaaccaatagatgacaggtttgccaccgccctcacagccttaaacgatatgggaaaagttcgaaaagacataccacagtgggagccgtccaaaggatggaacgactggcagcaggttccgttctgtagccatcattttcaccagttgataatgaaggacggtcgggagatagtcgtaccatgtcgcaaccaagacgaactggtcggcagagcaagagtatctcaaggtgcaggatggtccctacgagaaactgcgtgcttgggaaagtcgtacgcgcaaatgtggcaacttatgtatttccacaggagagacctacgattagcagctaatgcaatatgttctgcagtaccagtagactgggttccaacaagtagaaccacatggtctattcatgcacatcaccaatggatgactacagaagatatgctctcagtctggaatcgtgtatggattgaagaaaatccatggatggaagataaaacgcatatttcgtcatgggaggatgtcccatacctagggaaaagggaagaccaatggtgcggttcgctaattggacttaccgctcgagctacttgggcaactaacatacaagtagcgatcaatcaagtaagacgactaataggcaatgaaaactatcttgattacatgacatcaatgaaaagatttaaaaacgaatctgatcctgagggtgccttgtggtaa

SEQ ID NO: 21110 - RNA, 9879 nt, synthetic construct
  misc_feature 1..9879: note = derived and/or modified CDS sequence (opt6) from DENV-1__KP188567__SS-prME
  source 1..9879: mol_type = other RNA
agcgtaacaatgctacttatgttattaccgacagcactcgcgtttcacctgacgaccaggggtggggaaccacatatgatagttagcaaacaagaacggggtaaaagcctactgtttaaaacgtcagtaggcgtaaatatgtgtacgcttattgcaatggaccttggcgaattatgtgaagataccatgacgtataaatgtccgagaatcacggaagcagaacccgacgacgtagattgttggtgcaatgctacagacacttgggttacttacggtacatgtagtcagacaggtgaacatagaagagataaacgctcagtagccctagcaccccacgtcgggcttggtttagaaaccaggacagaaacgtggatgagctcggaaggagcatggaaacaaattcagaaagtcgaaacttgggcattaaggcatccaggattcactgtaatagcgttgttcctagcacatgctattgggacatctattactcaaaaaggcataatttttatcctattaatgttagtcaccccgtcaatggccatgcgctgtgtagggattggaaacagggactttgtagaaggtttatccggagccacgtgggtagacgttgtactagaacatggctcttgtgttactacaatggctaaaaataaacctactcttgacatagagttactcaagacagaagttacaaatccggcaatcttgagaaagctctgcattgaggcaaaaatatcaaacaccaccacagatagccgatgcccaacacagggcgaggctactctggtagaagaacaagatgcgaacttcgtatgccgcagaacgtttgtcgatagaggatggggcaacggatgtggtcttttcgggaagggttcacttcttacatgtgctaaattcaaatgtgtaacaaaattagaaggaaagatagtccagtacgagaatttaaaatactccgtaattgttactgttcatacaggggatcaacatcaggttggaaatgaaacaacggagcatggcactatagcaacaataactccacaagctccaacatcagaaatccaattaactgactacggagcattaactttagactgtagccctaggacaggtttagatttcaacgagatggttctactaacaatgaaagagaaatcatggttagtacataaacaatggtttctagacttaccgctaccatggacatccggagcaagcacaagtcaagagacttggaatcgacaagatttattagtcacattcaagactgcgcatgcgaagaaacaagaggttgtcgtattaggaagtcaggaaggtgccatgcatacagctcttacgggggcaactgaaatacaaacttctgggacaaccaccatatttgcggggcacctaaaatgtagattaaaaatggataaattaacactaaagggtatgagctacgtcatgtgtactggttcgttcaaattagaaaaagaagtggcggaaacacaacacggtacagtccttgtacaagtgaaatacgaaggaacagacgctccttgtaaaattccctttctaacccaagacgaaaagggagtgacacaaaatggaagactaataactgcaaatcccatagtcacggataaagaaaaacctgtcaacatagaaacagagccaccctttggcgagagttacatagttgtaggggccggagaaaaagcgttaaaactatcgtggtttaagaaaggaagttctatcggtaaaatgtttgaagccactgccagaggagccaggcggatggctatactaggagatacagcatgggacttcgggtcgatcgggggattatttacttctgttgggaaactaatacatcaagtcttcggtacagcttacggcgtgctattttccggtgtaagttggacaatgaagatagggataggtattttactaacatggttgggcttgaacagccgatcaacatctttaagtatgacgtgcattgcggtgggtatggtcacgttgtacttgggtgtaatggtgcaggctgatagcgggtgtgtgataaattggaaaggtcgtgaattaaagtgtggatcaggcatctttgtaacaaatgaggtccacacatggacggagcaatacaaatttcaggcagatagtccaaaacggttgtcggcagctatagggaaagcctgggaggagggagtctgtggtatacgatctgctacaagactggagaacatcatgtggaaacaaattagtaacgaattgaactacatactcttagaaaatgatatgaaatttactgtagtagtcggtgacgtcaatggcatattagctcaaggcaagaaaatgataaaaccacaacctatggaacacaaatactcatggaaaagttggggcaaggctaaaatcataggagccgatattcagaacacgacttttatcatcgacggtcctgatactcctgaatgtcccgatgaccaacgtgcttggaacatctgggaagtagaagattacggatttggaatatttaccaccaatatatggctaaaactccgagacagccatactcaaatgtgtgatcacagattgatgtcggcagccatcaaagatagcaaggctgtgcacgccgacatgggatattggattgaaagtgagaaaaatgaaacatggaaactagcacgagcctcattcattgaagtcaaaacgtgcatatggccaaaatcgcacaccctttggagtaacggagtgctcgaatccgaaatggttattccaaagatatacggagggcctattagccaacacaactatcgccctgggtattttacccagacagcagggccatggcatctcggaaaacttgaactagactttgacctgtgcgaaggaacaacagtcgtagtagatgagcattgtggttacaggggcccatctctcagaactacaactgtcacgggcaaaataatacatgaatggtgctgtcgcagttgtactttaccaccgcttcgcttcagaggtgaggatggctgttggtacggtatggaaatcagaccggttaaagaaaaggaggaaaatcttgttaggagcatggtgtcagcgggaagtggcgaggtagattcgttctcgctagggattctatgcgtatcaatacttatagaagaagtaatgaggtcccgctggtctcgtaaaatgttaatgacaggtacactggcggtgtttcttttactgatcatgggacaattaacatggaatgatctcattcgcctttgtataatggttggggcaaatgcattagatcgcatgggtatgggaactacttacctagctttgatggccacatttaaaatgcgaccgatgtttgcggttggattgttgttccggcgtctcacatcaagagaggtactcttattaactgtgggactctctttagtagcatcagtagaattaccaagcagtctagaagaactgggcgacggacttgccatgggcataatgatgctaaaattattaacggactttcaacctcatcaactttggactacactcctatcattaacctttatcaggacgtcattgtcattagattatgcgtggaaaacaatggcgatggctctaagtatagtatcactgtttcccttatgtttaagtacaacttcacagaagacaacttggcttccggtactcttaggctcatttggatgcaagccactaaccatgtttttaattactgaaaataaaatttggggcaggaaaagttggccaataaacgagggaatcatggctgttgggatagtaagcatattactcagttctctgcttaagaatgacgttcctctggcaggtccattaatcgcgggtggaatgttgatagcctgttacgtgattagcggttcctctgcagatctgtcattggaaaaagctgcagaggtatcatgggaagaggaagcagagcattccggtacctcacataatatcctagtagaggtacaagacgacgggaccatgaaaataaaagatgaagaacgcgatgacacactaacaatattactaaaagctacattactcgcagtatcaggcgtataccccatgtcaatacccgcgacactcttcgtgtggtatttctggcagaagaagaaacaaagatctggcgttttatgggacacgccatcaccaccagaagtggaaagggccgtgttagacgatggaatatatagaatactgcagcgtggactattaggaagaagccaagtaggggtaggggtatttcaagatggtgtttttcacacaatgtggcatgtcacaagaggagctgtgctgatgtaccaagggaaaagattagaaccctcatgggcgagcgttaaaaaggatttaatatcgtatggaggtggatggagatttcagggctcgtggaacaccggggaagaagtgcaagtcatagcagtagaaccaggtaaaaaccctaaaaacgtgcaaactacacctgggacattcaagactccagaaggagaggtaggggctatagcattagatttcaaaccggggacaagtggcagcccaatagtaaaccgagaaggtaaaatagtaggactatacggaaacggtgtggtcacaacgagtgggacatatgtgtcagcaatagcgcaagccaaagccacacaagaaggaacattaccggagatagaggatgaggtatttaaaaagcgaaatctaacaataatggatctacatccgggaagtggtaagacgcgtagatatttacccgccatcgtaagagaagcaataaaaaggaaactaaggactttgattctagcaccaacaagagtagtggcatcggaaatggcggaagcattaaaaggtatgccaattcgttaccaaacgaccgcagtaaagtccgagcacaccggtagggagattgtagacttaatgtgtcatgcaacattcactatgcgactgttaagtccagtacgagtacctaattataacatgataatcatggacgaagctcattttaccgacccagcttcgatagctgccagggggtacataagtacgagagtaggtatgggagaagcggccgctatattcatgacagccacaccgccaggcagtgtagaagcctttcctcaatccaatgccgttattcaggatgaagaacgggatataccggaacgatcatggaactcgggatatgattggataacagacttccctggaaaaacggtttggttcgttccatcaataaaatctggaaatgacatagcgaattgtctaagaaagaatggaaaacgagtaatacaactatcgaggaaaaccttcgacacagaatatcagaaaactaaaaacaacgattgggactatgtagttacgacagacataagtgaaatgggagccaattttagggcggatagggtgatcgatccgcgacgatgtttgaaacctgtcattttaaaagaaggcccagagagagttattctggcagggcctatgcctgtaacagtagccagcgcagcacaaagaagaggtcgaatcggcaggaatcaaaataaagaaggggatcaatatatatacatggggcaaccgttaaacaatgatgaagatcacgcacactggactgaagctaaaatgttacttgacaacataaatacgccagaaggcattattcccgccctttttgaaccggaacgagagaaaagcgcagcaattgacggtgagtataggctaagaggagaagctcgaaagacattcgtagaattaatgagaagaggtgacttaccggtatggctgtcttataaagttgcctccgaaggatttcaatattcagaccgaagatggtgctttgacggagagagaaataatcaagtattagaggaaaatatggatgtagaaatatggactaaagaaggagaacgaaagaaactaagaccccgatggcttgatgctagaacatattctgatccgttagcattacgagaatttaaggagttcgctgctggaagaagatctgttagtggagacttaattctcgaaatagggaaattaccgcaacatctaactcttcgagctcaaaatgctctagacaacctagtaatgctgcacaattctgaacaaggaggtaaagcatatagacacgctatggaagagttgccggacacaattgaaacattaatgcttctcgctctaatagccgttttgactggaggagtaacgttatttttcttgtcagggaaaggtttagggaaaacatcaattggactactttgtgtaatggcatccagcgcattgttatggatggcatctgtagagccacattggattgcagcatcaataatattagagttcttccttatggtactccttataccagaaccagatagacaaagaacaccacaagataatcaattagcttacgtagtaataggattgttgttcatgattcttaccgttgcagctaatgaaatggggcttttagagacaactaaaaaggacctaggcattggacatgtagcggtggaaaaccatcatcatgcgacaatgctagatgttgatttaaggccagcgtctgcctggaccctatatgcagtagcgacaactgtaataactccgatgatgaggcataccattgaaaacacaactgcaaatatatcgctaacggcgatagccaaccaggctgctatactgatgggacttgacaaaggatggccaatttccaaaatggacattggcgtaccattattagccttaggatgttatagtcaggtcaatcccttaacattaaccgccgccgttttaatgctagtggcccattacgctattataggtcctggacttcaagctaaggccactcgcgaagcccagaaaaggaccgcggctggcataatgaagaacccaaccgttgacggcatagtaacaatagacctcgatccggtagtatatgacgcaaagtttgaaaaacaattaggtcagatcatgctcctcatactctgcaccagtcagatattactcatgcgcactacttgggcattgtgcgaatccataacactggcgaccggtcctttaacaaccctatgggaaggatcgcctggaaaattttggaatacaactatagcagtaagtatggcaaacatattcaggggatcgtaccttgctggagcgggacttgcttttagccttatgaaaagtttagggggaggacgacggggcacaggcgcccaaggtgagacattaggagagaaatggaaacggcaacttaatcaactaagtaagtcagagttcaatacgtataaaaagtcaggaataatggaagtagatagaagtgaagcaaaagaaggccttaaacgtggcgaaactaccaaacatgcagtaagtaggggcacggctaaattacgctggtttgttgaacgaaatctcgtgaaacccgagggcaaggtaattgacttaggatgcggaagagggggatggtcttattattgcgctggactcaagaaagtaaccgaagttaaaggttatacaaaaggcgggccaggacacgaggaacctatccctatggctacatatggctggaacttagtcaaactgcatagtggcaaagatgtattctttacccctccagaaaaatgtgataccctattatgcgacataggcgaatcaagtccaaatcctacgatcgaagaggggagaactctgcgagtattgaaaatggtggagccatggttacgcgggaaccaattctgtataaaaatccttaatccatatatgcccagtgtggtagaaacgttagaacagatgcaaagaaagcatggaggaatgttggtcagaaatccactgtcaagaaattctacacatgaaatgtattgggtaagttgcggaacgggaaacattgtatctgcagtaaatatgacttctcggatgttgttgaaccgctttacaatggcacataggaagcctacttacgaacgtgacgtggatcttggagccggcaccaggcatgttgccgtagagcctgaagttgcaaacttagatatcatcggtcaacgaatcgaaaacattaagaatgagcacaagtctacctggcactacgacgaagataacccatacaagacatgggcataccacgggtcatatgaagttaaacccagcggaagcgctagttcgatggtaaatggtgttgtgagacttttaacaaaaccctgggatgtgattccaatggtgactcagatagccatgacagatacaaccccgttcggtcagcagcgggtttttaaagaaaaagtagatacaaggaccccaagagccaaaagaggaacagcacaaataatggaggtcactgcaaaatggttgtggggatttctcagccgaaacaaaaagccgcgcatctgtacgagagaagaatttacacgcaaagtacgatccaatgctgcaataggagcggtttttgtcgacgaaaaccagtggaatagtgcgaaggaagcagtagaagatgaaagattttgggatctagtgcatagagaaagggagcttcataagcagggtaaatgtgctacatgcgtatataacatgatgggcaaaagagaaaagaaactgggggaatttggaaaagcaaaaggctctagagcgatctggtatatgtggctaggggctcgatttttagaatttgaggctcttgggttcatgaatgaggatcattggtttagtagagaaaacagcctttccggagtggaaggtgagggcctacataaactaggttacattttacgtgacatatcaaaaataccgggaggaaacatgtacgctgatgacacagcaggatgggatacacgcattaccgaagatgacttgcaaaatgaagcaaaaattactgacatcatggagcccgaacacgcactactagccaccagcatctttaaattaacataccagaataaagtagtcagagttcagaggccagctaaaagtggaacagttatggatgtaatcagccgaagagaccagcgaggatccggccaagtaggaacctatggtttgaacacatttacgaatatggaagtccaattaataaggcaaatggaatccgaaggtatattttcaccgagtgaactagagactccaaatctagcgaagaaagttctcgattggcttgaaaaacatggcgccgaaagacttaaaagaatggcaatcagcggggatgattgcgttgtaaaacctatagacgacaggtttgccaccgcattaacagcactaaatgacatgggtaaagtaagaaaagacatacctcaatgggaaccaagcaaaggatggaacgactggcaacaagtaccgttttgcagccaccactttcatcagttaattatgaaagatggacgcgaaattgttgtgccgtgtaggaatcaggatgaactggttggacgggccagagtctcccaaggagctggatggtctctaagagaaacagcctgtcttggaaagagttacgcccaaatgtggcagctaatgtacttccatagaagagatctacgacttgccgctaatgcgatttgttctgctgttcctgcagactgggttccaacatctaggacgacatggagcatacatgcacatcatcaatggatgacaacggaagacatgctgagtgtatggaaccgcgtatggatagaagaaaacccgtggatggaagataaaacacacgtctcatcttgggaagaagtcccttatttgggtaagcgagaagaccaatggtgtggtagcctaatcggtctaaccgccagagcgacctgggcaaccaacattcaagtagccataaatcaagtaagacgtcttataggaaacgaaaactatttagactatatgacttctatgaaaagatttaaaaatgaatccgaccccgaaggagcactatggtag

SEQ ID NO: 21111 - RNA, 9879 nt, synthetic construct
  misc_feature 1..9879: note = derived and/or modified CDS sequence (opt6) from DENV-1__KP188568__SS-prME
  source 1..9879: mol_type = other RNA
agtgttaccatgttgctgatgttattaccaacggctctcgcattccacttaaccacacgaggtggagaaccacatatgatagttagcaaacaggaaaggggcaaaagtctgttattcaaaacaagtgtaggtgtgaatatgtgtactttaattgcgatggacttaggagaattatgtgaagatactatgacttataaatgtcctcgtattacagaagcggaacctgatgatgttgattgttggtgtaacgcaacagacacctgggttacctatggcacgtgttcacagactggtgaacatcggagagataaaaggtcagtagcattagcaccacatgtaggtttaggccttgaaacgaggacggaaacatggatgtcaagtgaaggggcctggaaacagatacaaaaagtggaaacgtgggcattacgtcatcctggatttactgtaatagctctattcttagcgcatgctattggaacaagcataacgcaaaaagggataatattcatacttctaatgttagtcaccccttcaatggcaatgcgctgcgtaggaatcggtaatcgagatttcgtagaagggctatcaggtgccacatgggtagatgtcgtgttagaacacggaagctgcgtaacaactatggcgaaaaataaaccaacattggatattgagctactaaaaacagaggttacaaatcccgcagtgctaagaaaattgtgtattgaagcaaaaataagcaatacaacaactgacagtaggtgtccaacccaaggagaagccacactcgtagaagaacaagatgcaaacttcgtatgtcgaaggacatttgtagaccgcgggtggggaaatggatgtggactattcggaaaagggagtttgctaacgtgtgcaaaatttaaatgtgttaccaaattggaaggaaaaattgtccaatatgaaaatttaaaatactcagtaatcgtaactgtacatactggggatcaacaccaagtcggtaatgaaacaacagaacacggtacaattgcaactattacaccccaggctccaacgagtgaaatacaactaacagattatggcgcactaacactggactgctctccccgtactggtctagacttcaacgagatggtattgttgaccatgaaagaaaaatcttggctcgtacacaaacaatggtttctagacctacctttaccctggacttctggtgcatcaaccagtcaagaaacatggaatcgacaagatttactcgtaacctttaaaacggcacacgcgaagaaacaggaagttgtagtcctcgggagtcaagaaggagctatgcataccgcgcttacaggcgcgactgaaatacaaaccagtgggacaacaacaattttcgcaggacatcttaaatgtagactaaaaatggacaaactcacactaaaaggaatgtcttacgtcatgtgtactgggagttttaaacttgaaaaagaagtagcagaaacccaacacggaacagttttagtacaagtgaaatatgaaggaactgatgcaccttgtaaaattcctttcctgactcaagacgaaaaaggagtcactcaaaatggtaggttaataaccgctaaccctatagtcacagataaagaaaaacctgttaatattgaaacagagccaccatttggtgaatcttacatcgttgtcggtgccggcgagaaagcactcaaattaagttggtttaagaaaggctcctcaattggaaaaatgttcgaagcaactgcacgaggcgcacgacgaatggcaattcttggtgataccgcttgggactttgggagtattggagggctattcacttcagtaggaaaactaattcatcaggtattcggtacagcgtacggggtcctgttttctggagtcagttggaccatgaaaataggcattgggatattactaacgtggttgggactcaatagcagatcaaccagtttgagcatgacatgtatagcagtcggcatggttactctatacttgggcgttatggtacaagcagattctggatgtgtcattaactggaaagggcgagaactaaaatgtgggtccgggatattcgttacaaacgaagttcacacttggactgaacaatataaatttcaagctgatagtccaaaacgtctaagtgcagcaatagggaaagcatgggaagaaggagtttgcgggatcagatctgcaacacgtctggagaatataatgtggaaacagatctctaacgaattgaaccatatattactagaaaacgatatgaaatttaccgtagttgtaggggacgtgaatggtatcctggctcagggtaagaaaatgatacgaccacaaccaatggaacataaatattcatggaaatcatggggaaaggccaaaataataggcgcagatattcaaaacaccacttttataatagacggtccagatactccggaatgcccagatgaccaacgagcgtggaatatatgggaagtagaggattacggctttggaatatttacaacaaatatatggcttaaattgcgtgacagccatactcaaatgtgcgatcatcgattaatgtcagcagcaataaaggatagtaaggcggtacacgctgacatgggatactggattgaatcagagaaaaatgagacatggaaactggcaagagcaagttttatagaggtcaaaacctgtatatggcccaaatctcacaccctgtggagcaacggagtcctagaaagtgagatggtcattccaaaaatctacggaggccccatatcacaacataattatcgacctggttattttacacaaacagccgggccgtggcacttaggaaaactagaattagatttcgatctctgcgagggaacaaccgtagtagtggatgaacactgcggttatcgcggacccagcttaaggacgaccacagtaacaggtaaaatcatccatgaatggtgttgtcgatcatgcacattgccgccattgcgttttcgtggagaggacggctgttggtatgggatggagatcagaccagttaaagaaaaagaagaaaacttagtaaggtccatggtgtcagcaggttccggcgaaatggatagttttagtctaggtatcttatgtgtcagcattttgattgaagaagttatgaggtcaagatggagcagaaaaatgttgatgacaggtacgctcgcggtattctttttactaataatgggacaattaacatggaacgatttaatacgcttatgcataatggtaggggccaatgcatccgatagaatgggcatggggacgacatatttggcactgatggccacttttaagatgagacctatgtttgctgtagggctactgtttagaagattaacttctagagaagtgttattattgacagttggacttagtttagtggcgtcggtagaattaccaaattcattagaagaactaggcgatggtctagcaatgggaattatgatgctaaaactccttaccgattttcaaccacaccaattatggacaacactattgtctttaacatttatacgaacttcgctatcactagattacgcatggaagaccatggcaatggccttaagcatagtaagtcttttcccactttgtttatcaacaactagccaaaagacgacgtggctacctgtactactaggatcgttcggatgtaaacctctgacaatgttcctaatcacagaaaataagatttggggacgaaaatcttggccaatcaatgaaggaataatggcagtaggaatagtatccatcttgctttcaagcctactcaaaaacgacgtacctctagcgggaccacttatagccgggggcatgctaatagcatgttacgtcattagtggaagcagtgctgacttaagcctagagaaggcggcagaagtaagttgggaggaagaagcagaacactctgggacctcacacaatatacttgtagaagttcaggacgacggtactatgaaaataaaagacgaggaacgagacgataccctcacaatactattaaaggcaacactactagcagtatcaggagtttatcccatgtctatacctgctactctctttgtttggtacttttggcaaaagaagaaacaaagaagcggagtcttatgggacacacccagcccgcctgaagtggaaagagccgtactcgatgacggaatatatcgaatcttacaaagaggtcttctcggacgatcacaggtcggtgtgggagtatttcaagatggagtatttcatactatgtggcatgttacacggggagcggtattgatgtatcaaggtaaaaggttagaaccctcatgggcatcagtcaagaaagacttgataagctatggaggtgggtggagatttcaaggcagctggaacaccggagaagaagtacaagttatagcggtggagcccggcaaaaatcccaagaatgtacaaacaacgcccggtacgttcaaaacccccgaaggggaagtaggtgctattgctttagatttcaaaccaggaacttctggatcccccatagttaacagagaaggtaaaatagtcggattatatggcaatggagttgttacaacctcaggaacatacgtatctgcaatagcacaagcgaaagctacacaagagggaccattaccagagatcgaggatgaggtctttaagaaaaggaatctaacaattatggacctccatccgggatcaggtaaaacgagaaggtatctaccctcaattgtacgagaagctattaagcgaaaacttagaacccttatattggcgcctacaagagtggttgcatcagaaatggctgaagctcttaagggaatgccaattcgataccaaacaactgctgtgaaaagtgaacatactggacgcgaaatcgtggatctaatgtgccatgcgaccttcacgatgagactgttatctcctgtacgagtacctaattataatatgataataatggatgaggcgcattttaccgaccctgcatctatagcagcgcgaggttatatatctacaagagttggtatgggagaggcggctgccattttcatgacagcgactccgccgggaagcgtggaagcctttccgcaatcaaatgccgctattcaagacgaagagagggacatacccgagcgaagctggaacacaggatatgactggatcaccgactttcctggaaagactgtttggttcgtcccatctattaaatcagggaatgacatagctaattgtttaaggaaaaacggaaaacgggtaatacaactgtctaggaaaacgttcgatacagagtatcaaaagactaaaaacaatgattgggactacgtagtcacaactgatataagcgaaatgggggcaaactttcgcgcagatcgtgtaatagatccgcggcgatgtttaaaaccagttatactcaaggagggaccagagcgagtaatcttagccggacccatgcctgtaacggtggcatccgccgcacaacgacgcgggcggatcggaaggaatcaaaacaaggaaggtgaccaatacatatacatggggcaacccctaaataatgatgaggatcacgcacattggacggaagcaaaaatgttgttagataacataaatacaccagaaggcatcataccagccctgtttgaaccagaaagagaaaagagcgcggctatagatggtgagtacaggttacgaggagaagcacgaaaaacctttgtggaactcatgcgacggggtgatttaccggtttggttatcatataaagtcgcgagtgagggatttcaatatagcgatcgtcgatggtgctttgacggcgaaagaaataatcaagtgttagaagagaatatggacgtcgaaatatggacaaaggaaggagagaggaagaaacttagacctagatggctggatgcgaggacatattcggatcctttagctttaagagaatttaaagagttcgctgctggaagaagatccgtttcaggagacctaattttagagatcggcaagttgccccaacatcttacactgcgcgctcaaaatgctctcgataacttggtgatgctacataactcagaacagggtggtaaggcttatcgccacgcgatggaagaattaccagatacgatagaaacattaatgcttctcgctctaattgctgtgcttactggaggggtgacccttttcttcttatcggggaaaggtttgggaaaaacatcaataggactactatgtgtcatggcaagcagcgcactactatgggtagcatcagtggaacctcattggattgccgcaagtattattctcgaatttttcctaatggtactcctcatacctgaaccagatagacaaaggaccccacaggataaccaactggcttacgttgtaatcggcttattatttatgatactcacagtggcagccaacgaaatgggccttctcgagacaacgaagaaagatttgggaattggtcatgttgcagtagaaaatcaccaccacgccactatgttagacgtagatctaaggcctgcctctgcgtggactctgtacgccgtagcaacaacggtcataacacctatgatgaggcatacaattgaaaatactacagcaaatatcagcctaacagcgatagcaaatcaagcggccatactaatgggtttagataaaggttggcctataagtaaaatggatataggagtcccactgttagccttgggttgttattcgcaagtaaatcctttaacattaacggcagcagtactaatgttagtagcccattatgcaattataggtccggggttacaagctaaggctacccgtgaagcccaaaaacggacagcagcaggcattatgaaaaatccaactgtagatggaatagttacaattgacctcgacccagtagtatatgatgctaagtttgagaagcagcttgggcaaataatgcttctaatactatgcacctcccaaatacttttgatgcggaccacctgggcactatgcgagtcgatcaccttagctacaggacctcttacaacgctctgggaaggttcacctggaaagttttggaatacgacaatcgcggtcagtatggcgaatatctttcgaggttcatacctcgccggtgcaggcttagcattctcggtgatgaaaagccttgggggtggacgccgaggtactggagcccagggcgaaaccctaggtgaaaagtggaaaagacaactcaatcaactgtcaaaatcagaatttaatacctataagaaatccggtataatggaggtagacaggtcggaggccaaagagggtcttaaacgcggcgagactactaagcatgcggtaagtcgcggcactgccaagctaaggtggtttgtagaacgcaatctggtgaaacctgagggaaaagttattgatctaggttgtggtcgaggtggatggtcctattattgcgctggattaaagaaagtaacggaagtaaaaggatataccaaaggtggccctggacatgaagaaccaatacctatggctacatatggatggaatttagttaaattgcattcagggaaagatgtcttctttacgccaccagagaaatgtgatactttgttatgcgatataggagaatcctcacctaacccaaccattgaagaaggcagaacgcttagagtgctaaaaatggtcgaaccgtggttaagaggtaatcaattctgtatcaaaatattaaatccatacatgccgagtgtagtcgagacactagaacaaatgcagaggaaacacggcggtatgctcgtaagaaatccattaagcagaaactcaactcatgagatgtactgggtaagctgtggtacaggtaacatagtgtcggccgttaatatgactagccgaatgttactgaatcgattcactatggcccaccgcaaaccaacttatgagagggacgttgacctgggggccgggaccagacatgttgctgttgagcctgaagttgctaaccttgatattataggtcagcgcatagaaaacatcaaaaacgaacataaatctacctggcattatgacgaagacaatccatataaaacatgggcgtatcacggaagttatgaagttaaaccatctggatcagcatcatccatggttaatggagttgtcagactactcactaaaccatgggatgtgatcccgatggtgactcaaatagcaatgacagatacaacaccatttggtcaacagcgcgtttttaaggaaaaggtagatactagaactcctagagccaaacgaggaaccgcccaaatcatggaagttacagcaaaatggttatggggatttctgtctagaaacaaaaagccgagaatttgtactcgggaagagttcacaagaaaagttcgttccaacgccgcaatcggtgcggtatttgtggatgagaaccaatggaactcggcaaaggaggcggtagaagatgaacgcttctgggatttagtacatcgtgaacgtgaattacataaacaaggaaaatgcgctacttgcgtttataacatgatgggaaagagagagaagaaattaggagagttcggcaaggcaaaaggcagtagagctatctggtatatgtggctaggcgctagatttctagaatttgaagcattagggtttatgaatgaagaccactggttcagccgtgaaaactcactctccggagtagagggagaaggccttcacaagctaggctatattctccgggatatttcgaagattcctggaggtaatatgtatgcagatgataccgcaggatgggacacccgaataacggaagatgatttacagaatgaagctaaaataactgacataatggaaccggaacatgcactcctcgcaacttctatattcaaattgacttatcaaaataaagtagtaagagtccagcggccagcgaagtcgggtacagtcatggacgttataagcagaagagatcagcgcgggtcgggtcaagtcggcacatatgggttgaacaccttcacaaacatggaagtacagttgattagacagatggaatccgaggggatctttagcccatccgaattagaaacacctaacttggccaagaaagttctggactggttagaaaagcatggagctgaacgactgaagagaatggccattagtggagacgattgcgtagttaagccaattgacgatagattcgcgacagcgttaacagccttaaacgatatgggaaaagtaagaaaagacatacctcagtgggagccatccaagggatggaatgattggcaacaagtccctttctgtagtcaccattttcaccaattaattatgaaggatgggagagaaatagtagtaccatgtcgaaaccaggacgagctagtcgggagagcaagagtatcgcaaggggcgggctggtcactaagagaaacagcatgcctcggaaaatcatacgcccaaatgtggcaattaatgtattttcatagaagagatctaagactagctgccaacgccatctgttcagcagttcccgttgactgggttccaacgagtagaaccacatggagtatacacgcccaccatcaatggatgactaccgaggatatgctttctgtatggaatcgcgtatggattgaggaaaatccttggatggaagataaaactcacgtatcaagctgggaagaggtgccatacttaggaaaacgagaagatcaatggtgcggtagcctaataggattaactgctcgggcgacctgggcaacgaacatccaggtagctatcaatcaagttcgtcggttaattggcaacgagaattatctggattacatgacaagtatgaaaagatttaaaaacgaatcagatccggaaggagcattatggtaa

SEQ ID NO: 21112 - RNA, 9879 nt, synthetic construct
  misc_feature 1..9879: note = derived and/or modified CDS sequence (opt6) from DENV-1__KF971870__SS-prME
  source 1..9879: mol_type = other RNA
tcggtaactatgctccttatgctaatgccgactgcactagcttttcacctaactacaaggggaggagaaccgcatatgatggtttcaaaacaagaacgaggtaaatccttattatttaaaacttctgctggagtaaatatgtgcactctgatagcaatggatctaggcgaactctgtgaagacacaatgacatacaaatgcccaagaataactgaagcggaaccggatgatgtggactgctggtgtaacgcaaccgacacttgggttacttacggaacgtgttctcaaacaggagaacatcgtcgggataaaaggagtgttgctctcgcgcctcatgtgggattaggattggaaactcgaaccgaaacttggatgagtagtgaaggagcttggaaacaaatacaacgagtagaaacttgggcactaagacacccaggatttacagtaatcgctttatttctagcacatgcaataggaacatccatcacacaaaaaggaattatattcatactcttaatgctagtaacaccaagtatggcaatgagatgcgtcggtataggatccagagactttgttgaaggattaagtggagcaacatgggtagatgtagttttagaacatgggtcatgtgtaaccacgatggcaaaagataaacctacactcgacattgaacttttaaaaacagaagttacaaatcccgcagttctcaggaaactatgcatagaagcaaaaattagtaatacaaccacagattctaggtgtccgacacaaggagaagccactctcgtggaggaacaagatgcaaactttgtatgcagacggacattcgtcgacagaggttggggaaatggctgcgggttgtttggaaaaggctcattaatcacatgtgcaaaatttaaatgtgtaaccaaattagaaggaaaaattgtgcaatatgaaaatttaaaatattcagtaattgtaacagtacataccggagatcaacaccaggtcggaaacgagtcaacagagcatggaacaacagcaacaatcacgccgcaggcacctacgacggagattcagttaacagactacggagcattaacattagattgttcgcctagaactggactcgattttaatgaaatggtacttctcacaatgaaagaaaaatcttggctagttcacaaacaatggtttctagacttgccgcttccttggacaagtggagcatcaacttctcaagaaacatggaaccgccaagacttattagtgacattcaaaacagcgcatgctaaaaagcaggaagtagtagtattaggatctcaagaaggtgcaatgcatacggcgttaacaggagcaaccgagatacaaacatcagggacaacaaccatattcgctggccatttaaaatgtcggttaaaaatggacaaacttactttgaaaggaatgtcatatgtaatgtgcaccggatcatttaaactagaaaaggaggtagctgaaacacaacatggcacagttctcgtgcaaattaaatacgaaggaacggacgcgccctgcaaaatccctttcagtactcaggacgagaaaggggttacgcaaaatggaagattaataaccgcaaatcctattgtaaccgataaagaaaaaccagtaaatatcgaggccgagcctccttttggagaaagttatattgtaatcggagccggtgaaaaagcactcaaattaagctggttcaagaaaggcagttccataggaaaaatgttcgaagccacagcaagaggggcgagacgtatggcaatattaggagatactgcgtgggactttgggtcaattggcggggtattcacatcagtgggaaaattagttcaccagatatttggtacagcatacggagtccttttcagtggagtgtcgtggaccatgaaaatcggaatcggcgtgttgttgacctggcttggtttaaacagcaggagtacatctttaagtatgacatgtattgctgtagggctagtaaccctatatttaggtgtcatggttcaagcagattcagggtgcgtaataaactggaaagggagggagttaaaatgcgggtcgggcatttttgttaccaatgaagtacatacttggacggagcagtataaatttcaagccgacagtcctaaaagactctcggctgcgatcgggaaagcctgggaagaaggagtatgcggcataaggagtgctacaagactagaaaatataatgtggaaacaaattagtaacgagttgaaccatattttactagaaaatgacatgaagttcacagtagttgtcggagatgtggccggtattttagctcagggcaaaaagatgataagaccacagccaatggaatacaaatactcttggaaaagctggggtaaagcaaaaattataggcgccgacgtgcaaaacacaaccttcataatagacggccccaacacaccagaatgcccagacgaccaaagggcctggaatatctgggaagtcgaagactacggctttggtatattcacaaccaacatttggcttaaactaagggacagctatacgcaggtatgcgaccatcgattgatgtctagcgcgatcaaggattcaaaagcagtacatgcggacatgggttattggattgaatcagagaagaatgatacatggaaactcgctcgtgcatcttttatcgaagtaaaaacatgcatatggccaaagtcacataccctgtggtctaacggagtattagagtcagaaatgataatccctaaaatatacggcggacctatctcccaacacaattaccggccaggttatttcacccaaactgctggcccatggcatcttggtaaactggagttagactttgatctatgtgaaggaacaacagtagtggttgatgaacattgtggaaatcggggccctagcttgagaactaccacggtaacaggtaagattatacacgaatggtgctgtagatcatgcacactcccgccacttcgattccgcggagaagacggctgttggtatggcatggaaataagaccagtaaaagaaaaagaagaaaaccttgttaaaagtatggtctctgcaggctcaggtgaagttgactctttttcactggggttactttgcattagcattatgatagaagaagtaatgagaagccgctggtccagaaagatgctgatgatcggtaccctagctgtattcttcctgttaattatgggtcagttaacctggaatgatttgatcaggttatgtatcatggtaggggcaaacgcaagtgatcgaatggggatggggactacgtatctcgcacttatggctacatttaagatgagacctatgttcgcagtaggacttttgtttagacggttaacaagtagagaggttttactgttgactattggattgtcactggttgcaagtgccgaactgccaaattcattagaagagttaggagacggactggcgatgggaattatgatcttaaagttgttgacggacttccaatcacatcaactatgggctacattactaagtcttacattcataaaaactactttttcgctgcactacgcgtggaagacgatggccatggtactgagcatcgtaagtctgttcccattatgcctgagcacgacatcacagaaaactacatggcttccagtattacttggtagtctcggttgcaaacccttaaccatgttcctaatagccgagaataaaatttggggtagaaaaagctggccacttaacgagggaattatggctgtcggcatagttagcattttgctctcatcgttacttaaaaatgacgtacctttggcaggaccgctaatcgcgggaggtatgttaatagcttgctacgtgatatcagggagctcagcagatttatcgttggaaaaagcagcagaagttagttgggaggaggaagcagagcactcaggtgcctctcataatattttagttgaagtacaagatgatggaactatgaagattaaggacgaagaacgtgacgatacattgaccatacttctaaaggctaccttgttggcggtaagtggtgtgtttccattaagcatcccagcaacactgtttgtatggtatttttggcagaagaagaaacaaagatcaggcgttttatgggacacgccgtctccccctgaagttgaaagagcggtactggacgacgggatctataggataatgcaaaggggtttactcggacgttctcaagtaggagtaggtgtatttcaagaaaatgtatttcacacaatgtggcacgtaactcgtggagccgtcttgatgtaccagggcaaacgattggaacccagttgggcgagtgtcaagaaagatctaatatcttatggaggaggctggagattacaaggatcatggaataccggggaagaagtacaggtgatagcagtcgagcctggcaagaatccaaagaatgttcaaactgctcccggcacttttaaaacccctgaaggagaggttggcgccatcgcattggatttcaagcccggaacaagtggctcgcccattgtaaacagagaaggaaagatcgtaggtttatacggaaacggcgtagttactacctcaggaacatatgttagtgcaatagcgcaagccaaagcctcacaagagggaccattaccagaaattgaggacgaagtgtttcggaagagaaaccttacgataatggacttacatccagggtctgggaagaccagacgatacttacctgcaatagttcgagaggcaatcaaaaggaagttacgtacgctcattcttgctcctacgagagttgttgcttctgaaatggctgaagcattgaaaggtatgcccataagatatcagaccaccgcggtcaaaagcgaacacacaggaaaggaaatagttgacctcatgtgtcatgctacttttacaatgagattactgagtcctgttagggtccctaactataatatgattattatggatgaagctcattttactgaccccagctcaatcgcagcccggggatacatatcaacccgagtaggcatgggtgaggcagcagctatttttatgacagcgacaccgcctggatcagtcgaagcgtttccacagagtaatgcagtaattcaagatgaggagagagatattccagagcgtagttggaactcagggtatgaatggattactgattttcctggtaaaacagtttggtttgtacctagcattaaaagtgggaatgatattgcaaattgcctcaggaaaaatggcaaaagagtgatccaactaagcagaaagactttcgataccgagtaccaaaagaccaaaaacaacgattgggattacgtagttacaactgatattagcgaaatgggagcaaatttcagggctgatagagttattgacccaagaagatgccttaaaccagtaattctaaaagatggacctgaaagagttattctggctggtccaatgccggtaacagtagcatcagccgctcaaagacgagggaggattggtagaaaccataataaagaaggagaccagtacatctacatgggccaaccgttaaataacgacgaggaccatgcccattggacagaagctaaaatgctgttagataatataaatactcctgaaggaataattccggcattatttgaacctgaacgggaaaagagtgcggccattgatggagaatatagattaaggggcgaagcccgcaagacatttgtagaattgatgagaaggggtgatctaccggtatggttgtcgtacaaagtagccagtgagggtttccaatatagcgatcgaagatggtgttttgatggggaacgaaacaatcaagtactagaggagaacatggatgtagaaatatggaccaaagagggggagagagagaaattgcgaccacgatggttaggcgctcggacatactcggacccactagctctgagagacttcaaagaatttgcggcaggtcgaaggagcgtatcgggagacttaattctcgagatcggaaagttgccacagcacctaacacagcgtgcacaaaacgcattggataatcttgttatgctccacaacagtcagcaaggcgggagggcatatacacatgctatggaagaactgccagacactattgaaactctaatgctactcgctttaatagccgtactgactggtggtgtcacgctctttttcctaagtggaaggggactaggaaaaacatcgattggtctgctctgcgtaatggcgtcatctgtgctattgtggatggcatcagtagagcctcactggatagcagcctcaattatattggagttctttctgatggtacttttgattccggaaccagacaggcaaaggactcctcaggacaaccaacttgcatacgtagtgataggcttgctgtttatgatattgactgtggctgccaacgaaatgggtctattggaaacaactaagaaagacttaggaattggtcacgtcgccgttgaaaatcaccaccatgccgccatgctcgacgttgatctgcacccagcatctgcatggaccctgtatgccgttgcgacaacaataataactcccatgatgcgccacacaatcgaaaatacaactgcgaatatatcattgaccgcaatagcaaatcaagcggctatcttaatgggtttagataaaggttggcccatctcgaaaatggatattggtgtcccgctcttagcacttggttgctattcacaagtgaacccgctaactctaactgcagcagttttgatgctcgtggctcattatgctataatcggaccaggacttcaagctaaagccacaagggaagcccaaaaacgaactgctgccggtattatgaagaaccctactgttgacgggattgtagccatagatctagatccagtcgtgtatgatgcaaagtttgaaaaacaactgggacagatcatgttacttatactttgtacttcacaaatccttctaatgagaactacatgggcattatgcgaaagtattactcttgccacaggaccattaactacactttgggaaggttcaccggggaaattttggaataccaccatagcagttagcatggcaaacatttttaggggttcatatttggctggagcaggattggccttttcattaatgaagagtcttgggggcggaagaagaggaacgggggctcagggcgagaccttaggtgaaaaatggaaaaggaggttaaatcaattatcaaagtcagagttcaacacatataagagaagcggaatcatggaagtcgataggagtgaggccaaagaaggattaaaacggggtgaaaccacaaagcacgcagtgtcgcgagggactgcaaaattaaggtggtttgtcgagcggaatcttgtgaaacctgagggaaaggtgatcgacttaggatgtggaagaggtggatggtcatattattgtgcgggcttgaagaaagtgaccgaagttaaaggctacactaagggtgggccaggacatgaggaacctattcctatggccacatacgggtggaatttagtaaaattacactctgggaaagatgtattctttataccacctgaaaaatgtgatacgttactctgtgacattggagaaagtagcccaaatccaacaatagaagaaggtaggacattaagagttttaaaaatggtcgaaccatggttgagaggaaaccaattttgcataaaaatcctgaacccttatatgccgtctgtggttgaaactttagagcaaatgcaaagaaaacatggcggaatgctggtacggaacccgctatcaaggaactcaactcacgagatgtattgggtaagttgtggaacgggcaacatagtatcagccgtaaatatgacgtccagaatgctattaaacagatttacaatggcccatcggaaaccgacctacgaacgtgatgtcgatttaggcgcgggcactaggcacgtagccgtggagccagaggttgccaatctagatataattgggcaacgaattgaaaacattaaacatgaacacaaaagtacatggcactacgatgaagataatccgtacaaaacttgggcatatcatggaagttacgaagtgaaaccatccggcagtgcctccagcatggtaaatggagtagtaaaactattaactaaaccttgggatgtgatcccaatggttactcaaatagcaatgactgataccactcctttcggacagcaaagggtatttaaagaaaaagttgacactagaacacccaaagcaaaacgaggaacagcacaaatcatggaagtaacagcccgatggttgtggggctttttgtctagaaacaagaaacccagaatttgtaccagggaagagttcacaaggaaggttagaagtaatgcagctattggagcagtgtttatagatgaaaatcagtggaactctgccaaagaagctgtagaagatgaaagattctgggatctcgtccatcgtgaacgcgagttacataaacagggcaagtgcgcaacatgtgtatacaacatgatgggcaagcgtgagaagaaacttggagaatttggaaaagccaaaggaagtagggcgatttggtatatgtggctgggtgccagattcctcgagttcgaagcactaggattcatgaatgaagaccactggtttagtcgggagaatagcctcagcggagtagaaggagaaggacttcataagttaggttacatattgcgggatatctcgaaaatacctggtggaaacatgtacgctgatgatacggcaggttgggacacacgtatcaccgaagatgacttgcaaaacgaagcaaaaattacggacattatggaaccagaacacgcattacttgcaaaagcgatatttaaactaacatatcagaacaaggtagtccgagttcagagaccagccaaaaatgggacagtaatggatgtaatttcaaggagagatcaaaggggtagtggacaggtagggacatatggtttaaacaccttcactaatatggaagcccaattaattaggcagatggagtcagaaggaatcttttccccttctgaacttgagaccccaaatctggccgaaagagttttagattggttaggaaaatatggtgtagaaaggcttaagcgtatggcaatctcgggagatgattgtgtagtaaaacctattgatgatagatttgcgaccgcattaactgcattaaatgatatggggaaagtgcgtaaagatattccgcaatgggaacctagtaaaggatggaatgactggcaacaagtaccattttgtagtcatcattttcatcaattaataatgaaagacggtagagaaatcgtagtaccttgtagaaaccaagatgaattagtaggaagggctagggtttcacagggagccggctggtcactcagagaaacagcctgtttgggcaagagttatgcacaaatgtggcaattaatgtatttccatcgtagagacttgagactagcggcgaatgcgatatgttctgcggtgcctgtcgattgggtaccaacctcacgaaccacatggagcattcatgcacaccatcaatggatgacaactgaggacatgttgagtgtatggaaccgagtttggattgaggaaaacccgtggatggaagataaaacacacatatcaaactgggaagatgttccctacctcggtaaaagagaggatcaatggtgtggcagcttgattggccttacagctagggcaacttgggctaccaatatacaagtcgctataaaccaagtgaggcgtctcattggaaacgaaaattaccttgattatatgacgtcaatgaagcgatttaaaaatgaatcagatccagagggggctttgtggtaa

SEQ ID NO: 21113 - RNA, 9879 nt, synthetic construct
  misc_feature 1..9879: note = derived and/or modified CDS sequence (opt6) from DENV-1__KF971871__SS-prME
  source 1..9879: mol_type = other RNA
agcgtaactatgttattaatgctgatgcctacggcgttagcatttcacttaacgacacgagggggagaacctcatatgatggtctcaaaacaagaaaggggaaaaagtttgttatttaaaacctctgcaggagtgaacatgtgcacccttatcgcaatggacttaggtgaattatgtgaagacactatgacttataaatgcccgcgtataacggaagctgaaccagatgacgttgattgctggtgcaacgccaccgacacatgggtgacatatgggacatgcagtcaaacaggtgaacatagaagagacaaacggtcagtggcattggcaccacacgttggcttaggtttggaaactcgtacagaaacttggatgagtagcgaaggagcttggaaacaaatacaacgtgtagaaacttgggctttacggcatccgggatttacggtaattgcgctattcttagcgcacgccatcggaacaagtatcacacaaaaaggtatcatattcattttgcttatgctagttacccccagcatggcaatgcgctgtgtgggaataggttcacgagattttgtagaagggctttccggagccacatgggtagacgtagttctagaacatgggagttgtgtcaccactatggcgaaagacaaaccgacccttgacattgaactactgaaaactgaagtcacaaatccagccgtattaagaaaactatgcattgaagccaaaatctccaataccaccactgattccaggtgtccaactcaaggagaagcaacacttgttgaggaacaagacgcaaatttcgtatgtaggcgtacattcgtagatcgcgggtggggaaacggatgtggattatttggtaaaggaagcctaataacttgtgcaaagttcaagtgtgtaacaaaactagaaggtaaaatagtccagtatgaaaatttaaaatacagcgtcatagtaaccgtgcatactggtgatcaacatcaagtagggaatgaatctacagaacatgggaccactgctactataacaccacaggcccctacaacagagattcaactaacggattacggggctttgactttagactgctcacccagaactggattggattttaatgagatggtcctacttacgatgaaagagaaatcatggctggttcataaacaatggttcttggatttacctctgccatggacgtcaggagccagcacttcacaagaaacctggaacaggcaagaccttctagtaacgtttaagacagcgcatgccaagaagcaagaagtagtcgtgctaggctcgcaagaaggtgctatgcatacagcactcacgggcgccactgaaatccagacaagtggtacaaccacaatatttgcaggacacctaaaatgtagactgaaaatggataagctgacgcttaaagggatgtcctatgtaatgtgtaccggtagttttaaattggagaaagaggtcgctgaaacacagcatggtaccgtccttgttcaaatcaaatatgaaggaacagatgcaccatgcaagattccattctcgactcaggatgaaaaaggagtaacacaaaacggacgattaattacagccaacccaatagttacggacaaagaaaaaccagttaacatcgaagccgaaccaccatttggagaatcgtatatcgtaataggggctggcgagaaagccttaaagctctcgtggtttaagaaaggatcatcgatcggtaaaatgttcgaagctacggcaagaggagcaaggagaatggcaatactaggtgatacagcgtgggacttcgggtctatcggtggagtattcacaagcgtcggaaaattagtccatcagatatttgggacggcatatggtgttttatttagtggggttagctggactatgaagataggcataggagtgttactaacgtggctgggacttaactcacgaagcacgtcactatcaatgacgtgcattgcagtaggtctagtcactctatatttgggcgttatggttcaagcagatagcggctgcgtaataaattggaagggacgggaactaaagtgcgggagtggtatctttgtaactaatgaagtacatacatggacagaacagtacaagttccaagcagactcacccaaaagattatcagctgcaattggcaaagcctgggaggaaggagtttgtggcataaggtcggcaacaagattagaaaatatcatgtggaaacaaataagcaacgaattaaatcacatcctcttggaaaatgacatgaaattcacagtagtagtaggagatgtagcaggcatcctagcacaagggaaaaagatgattcgtccacaaccaatggagtataagtattcatggaaaagctggggcaaagcaaaaataataggagcagacgtgcaaaatacgacatttattatagatggcccaaatacaccagaatgccctgacgatcaacgtgcatggaatatatgggaagttgaggattacggtttcggtatctttacaacgaacatatggctaaagctaagagattcctatacacaagtttgtgaccacagattaatgtcagcagctatcaaagatagcaaggccgtacatgcggatatgggttactggatagaaagtgaaaagaatgacacttggaaacttgctcgcgcttcttttatcgaagttaagacttgcatttggccaaaatctcatacactatggtctaacggggtattggaaagcgagatgataattcctaaaatttacgggggtcccatatcgcaacataattatcgccctggatactttacacaaacagcaggaccttggcacttagggaaattagaactcgactttgacttgtgcgaagggacgaccgttgtagttgatgaacactgcggtaataggggaccatcattaagaacgactacagtaacaggaaaaatcatacatgaatggtgctgccgtagttgtactttgccacccttacgattcaggggagaggatggctgctggtacggaatggaaattagacccgtaaaagaaaaagaagagaacttagttaagagcatggtttctgcaggttcaggcgaagttgactcctttagtttaggcttactctgcatatcaataatgatagaagaagtcatgaggtcacgttggtcaagaaagatgctaatgataggtacactagcagtattctttcttttaataatgggtcaactaacatggaacgacctaataagactgtgtattatggttggtgcgaatgcttcagacagaatgggcatgggtacaacatatctcgcactcatggccaccttcaaaatgcgacctatgtttgcagttggtttacttttccgacggttaacatcaagggaagtgctcttacttacgattggactaagcctggtagcttctgcagaactaccaaattcactagaagaattaggcgatggattggctatgggcataatgattctcaaactattgactgattttcagtcgcatcaactgtgggcgacattgttgagcttaacattcattaaaacaacgtttagcctccattacgcttggaaaacaatggctatggtattgtcaattgtttctctctttccgctgtgcctatcaaccacttctcaaaagactacctggttacctgttcttctagggtcactaggatgcaagcccctaactatgtttttaatagccgaaaataaaatctggggacgtaaatcgtggcccctgaatgagggaatcatggccgtcggcatcgtaagtatcttattgagcagtttgctgaaaaacgacgttccactagctggaccccttatagccggaggaatgttaattgcatgttacgtaatctcaggatcatcagctgacttatcgttggaaaaagcggcagaagtatcatgggaagaagaagctgaacactcaggtgccagccataatattctagtcgaagtacaagacgacggaactatgaaaataaaagacgaagaacgtgacgatacacttacaatcttactaaaggcaactttattagctgtgtctggggtattccctttatcaatacccgctactctatttgtgtggtacttttggcagaaaaagaaacaaagaagtggagtcctttgggatacaccctcgccacccgaagtggaaagagctgtacttgatgatggcatttatagaatcatgcaacggggattacttggtcgatctcaggttggagtaggcgtatttcaagaaaatgtctttcacacaatgtggcatgtaacaagaggcgccgtcctaatgtaccaaggcaaacgtctcgaaccatcatgggcttctgttaagaaagatttgatctcatatggaggaggatggagactacaaggaagttggaataccggtgaagaagtccaagtaatagcagtagaacctggtaaaaatcctaaaaatgtgcaaacagcaccgggaacatttaagactcctgaaggcgaagtgggcgcaattgcattagattttaaacccgggacctccggaagccccatagtaaacagagaaggaaaaatagtcggcttatatgggaacggtgtcgtcacgacatccggcacctatgtaagtgcaatcgcacaggctaaggcaagccaagaaggcccactacctgagatagaagatgaagtattcagaaaaagaaacttaacaattatggacttacatccaggtagcggaaagaccaggcgttatctccccgcaatagtgcgagaggctataaaaaggaaactaagaaccttaatcctagcaccgacccgcgtggtggcaagtgaaatggcagaggctttaaaaggaatgcccataaggtaccagacgaccgcagtaaagtcggagcataccggaaaagagattgtggatctaatgtgccatgcaacatttactatgcggcttctctcaccagttcgggtacccaactataacatgataataatggacgaagctcacttcaccgacccctcttccattgcggcacgaggttacatatcgacacgggtaggtatgggagaagcagcggccatatttatgactgctacccctcctggcagtgtcgaagcattcccccaaagcaatgctgtcatacaagacgaagaaagagatatcccagagaggtcttggaacagtggctacgaatggattacagactttcctggtaaaacagtatggtttgttccaagtataaaatctgggaacgatatcgcaaactgtttaaggaaaaatggaaaacgggttatacaactctcgagaaaaacttttgatactgagtatcagaaaacgaaaaataacgattgggactatgtggttaccacagatataagtgaaatgggagcaaatttcagagcagacagagtcatagatcctcgaaggtgtttaaaaccggtaattttgaaggacggaccagagcgagtaatcctagcagggccaatgccagtaacagtggcctcggcagcacaaaggcggggacgtataggacgtaatcataataaggagggagatcaatatatatacatgggtcagcctttaaacaatgacgaagatcacgctcactggacagaagcaaaaatgcttttagacaacataaacaccccagaaggcataatccctgcattatttgaacccgaaagagagaaatcagcagcaatagatggcgaatatcgtctgcgaggcgaagcaagaaagacatttgtagaactaatgagaagaggcgacctaccagtatggctatcttataaagtagcctcagaagggtttcagtattctgatagacgttggtgtttcgacggcgaacgaaacaaccaagtccttgaagagaacatggatgtagaaatatggactaaagaaggtgagcgtaagaaactacgaccacgttggttaggcgctcgtacgtatagtgatcctctcgccctccgagaatttaaagaatttgcagctggaagacgatcggtttcaggtgacttgatattagagatcggcaagctacctcagcatttaacgcaaagagcacaaaatgcactggacaatctagtaatgcttcacaacagtgaacaaggcggacgcgcatatagacacgcaatggaagaactgccagacacgatcgagacattaatgctgctcgcattaatagcagtcttaacaggtggagttactctattctttttaagtggcagaggactgggtaaaacaagtatcggactactctgtgtcatggcatcatcggttcttttatggatggcatcggtagagccacattggatagcagcctcaattatcttggagttctttcttatggtcctattgattcccgaacccgatagacaacgaactcctcaagacaatcaactagcttacgtagtcatcggtctcctatttatgatattaactgtggcagctaatgaaatgggactcctagaaactactaagaaagacctcggaatcggacatgttgcagtggaaaaccatcatcatgcagcgatgttagatgtggaccttcatccggcatctgcatggacactatatgcagtagctactacaatcataaccccaatgatgcgacatacaattgaaaacacaacagctaacatcagtcttacagctattgccaatcaagctgcaattttaatgggtcttgacaaaggttggccaatatccaaaatggatattggtgttccactgctcgctcttggatgttattcacaagtaaatccattgacattaacagcagcagtgttgatgctcgtggcgcattacgctataataggtccaggactacaggcaaaagctacaagagaagctcagaaaaggaccgcagcgggcataatgaaaaatccgaccgttgatggaatagtagcaattgaccttgacccagttgtgtatgatgcaaaatttgaaaaacaattaggacagataatgcttctaattttatgcacatcacagatcttattaatgagaacaacgtgggcgttatgcgaatcgataacactggctacgggacctttaacaactctttgggaaggctctcccggaaaattttggaacacgacaatagcggtatctatggccaatatatttcgaggaagttatcttgctggagccggtctagcatttagcttgatgaaatcgctaggtggcggacgaagaggtactggtgcacaaggcgagaccctaggcgagaaatggaagcgaagattgaatcaattatcaaagtccgagttcaatacatacaaaaggtcaggtatcatggaggttgataggtcggaagctaaggagggattaaaaaggggagagaccacaaaacacgcagtctcaagaggtacagcaaagctacgatggttcgtcgaacgtaaccttgtaaagcctgaaggcaaggttatcgacctaggttgcgggcgaggaggatggagctattattgcgcgggactaaagaaagtgactgaagttaagggatacacaaaaggaggtcctggacatgaagaacccatacccatggctacgtatgggtggaacctggtaaagctacatagtggaaaggatgtattctttataccaccagaaaagtgtgacacccttttatgtgacataggggaatcgagccctaacccaacgatagaggaaggcagaactctaagggtacttaaaatggtagaaccttggttacgaggtaaccaattctgtatcaagatactcaacccatacatgccaagtgttgtagaaacattagaacaaatgcagaggaagcacggagggatgctggtgagaaaccctctaagcagaaacagcacacacgagatgtactgggtaagttgtggcacaggtaacattgttagtgcagtaaacatgacatcacgaatgttgttgaatcgattcacaatggcacatcggaaaccaacctatgaaagagacgtagaccttggagccggcacgagacatgttgccgtagaaccagaagttgcaaaccttgatataataggacagagaattgaaaatataaagcacgagcataagtcgacgtggcactacgatgaagacaacccgtacaaaacttgggcttatcatggaagttatgaagtgaaaccctcaggttcagcttcgtcgatggtaaatggagtcgtcaaactactcaccaaaccatgggatgtaatcccaatggtcactcagatagctatgaccgacacaacgccgtttgggcagcaacgggttttcaaggaaaaagtggatactaggacaccaaaagctaagcggggaactgcacaaataatggaagtaacagcgaggtggttatggggtttcctgtcgcggaataagaaaccgcgaatatgtacgcgggaggagttcacccggaaagtaagatctaacgccgctataggagccgttttcatcgatgaaaatcagtggaactcagcaaaagaagcagtcgaggatgaaagattttgggatttggttcatagggaaagagaattgcacaagcaaggcaaatgcgcaacttgtgtttataatatgatgggcaaaagggagaagaaattgggggagttcggaaaagcaaaaggatcaagagccatttggtacatgtggcttggagcgagattcctcgagttcgaggctctgggttttatgaatgaggatcattggttcagcagagagaacagcctatctggcgtagaaggtgagggattacataaactcggatatattcttcgcgatatatccaaaatacccggaggaaacatgtatgcggatgatactgcaggatgggatactcggattactgaagatgacctgcaaaatgaggcaaaaataacggatattatggaacctgaacacgcgttactagcaaaggcgatatttaaactaacatatcaaaataaagtcgtcagagtgcaaagacccgctaaaaacggaactgttatggacgtcataagcagaagagaccaaagaggaagcggacaagttggtacctatggactaaatacatttacaaatatggaagcacagctgataagacaaatggagtctgagggtatatttagtccatctgaactagaaaccccgaatctagcagaacgagtactcgactggctgggtaaatacggtgtagaaaggctaaagagaatggcaatctcaggagacgattgtgtagtgaagccaatagatgatagatttgctacagcactgaccgcacttaacgatatgggaaaagtacgtaaggatatcccccaatgggaaccaagcaaaggttggaatgattggcagcaagtcccattttgtagccatcactttcatcagttgataatgaaagatggaagagaaatagtagtaccatgtagaaatcaggatgagttagtaggtcgagcgcgagtatcacaaggggctggttggtcattgagagaaacagcatgtctaggcaaaagctatgctcagatgtggcagttaatgtattttcatcgaagagatcttagactcgctgctaacgctatatgttccgcagtacctgttgactgggtaccaacatctaggacaacttggtctatacatgctcatcatcagtggatgacaacggaggatatgctcagcgtctggaatagagtatggatcgaagaaaatccatggatggaagataaaacacacatctccaactgggaagacgtaccctatctaggaaagagagaagatcaatggtgtggttccctgataggacttaccgctagagctacttgggcaaccaacatccaggtggcaataaaccaagtccgtcggttgataggaaatgagaactaccttgattacatgactagcatgaaaagattcaagaatgagagtgatccagaaggtgcgctatggtag

SEQ ID NO: 21114 - RNA, 9879 nt, synthetic construct
  misc_feature 1..9879: note = derived and/or modified CDS sequence (opt6) from DENV-1__KF971869__SS-prME
  source 1..9879: mol_type = other RNA
agcgtgacaatgcttctaatgcttatgccgacggcgttagcgtttcatttaactacacgtggcggggaaccgcacatgatggtatcaaaacaggaacgagggaaatctcttttgtttaaaacttcagctggagtaaatatgtgcacactaatagcgatggatctaggtgaattatgtgaagacactatgacttataaatgcccaaggattacagaagctgaacccgacgatgttgattgttggtgtaatgctacggatacatgggtaacttatggaacctgtagtcaaacaggagaacatcgccgtgataaacgcagtgtggctctagcgccacatgtagggttaggattagaaacacgtactgaaacatggatgtcgtcggaaggagcatggaaacaaatacagagagttgaaacgtgggctctacgccatcccggatttactgtaattgctctattcttagctcatgcaattggaacaagcataactcagaaaggtattatttttatattactcatgttagtcaccccatcaatggcgatgcgttgtgtgggaattggatctcgagatttcgtagaaggtctctccggagcaacttgggtcgacgtggttttagagcatggttcctgtgttaccacgatggcaaaagacaaacctacgctagacattgaattgttaaaaactgaagtaacaaatccggctgtactacgcaaattatgtattgaggccaaaataagcaataccacgaccgacagcagatgcccaacacaaggtgaggctaccttagttgaggagcaagacgcaaattttgtatgtcggcgcacctttgtagacagagggtggggaaatgggtgcggtctgtttgggaaagggtcacttataacgtgcgcaaaatttaaatgcgtaacaaaactagaaggcaaaattgtacagtatgaaaacttgaaatattccgtaattgtaacagtacatacgggagaccagcaccaggtaggaaacgaatccacagaacatggaactacagctacaataactcctcaggctcctacaacagaaatacaactaacggactatggcgccttaacgctcgactgctcaccacgcactgggttagattttaatgaaatggtattattaacaatgaaagaaaaatcctggctggtacacaaacaatggtttcttgatttgccattaccttggacatccggtgcctcaacatctcaagagacatggaatagacaagatcttttagtaacattcaaaacagcgcacgccaagaaacaagaagttgtggtacttggcagtcaagaaggtgcaatgcatacagctttaacaggcgctacggaaatacaaacgtccggaacaaccactatattcgcaggacacctaaaatgtcgccttaaaatggataagttaaccttaaaaggcatgtcgtatgtaatgtgtacagggtcattcaaactagaaaaagaggtggcggaaacacaacacgggactgttttagtgcaaataaaatacgaaggaacagatgcaccctgtaaaatacctttttccactcaggatgagaagggtgtaacgcaaaacggtagattaataacggcaaacccgattgtcacagataaagaaaaacccgtaaacatagaagctgaaccaccattcggtgagagttacattgttattggggcaggagaaaaagcacttaaactcagttggtttaagaaaggaagttctataggcaagatgttcgaagctactgccagaggggcccgaagaatggcaattctaggtgatactgcctgggactttggatcaataggtggggtattcacgtcggtcggaaagctagtacaccaaatattcgggacagcgtacggagtgctattcagtggcgtaagttggactatgaaaataggaataggagtgcttttaacctggctagggctaaacagtcggagcacatcattatctatgacttgcatagcagtgggattagtgaccctttatttaggggttatggtgcaagcagacagtgggtgcgttattaattggaaggggcgcgaactcaagtgtggttcaggtatcttcgttacaaatgaagtacacacttggacagagcaatataaattccaagcagactctccgaaaaggctgtctgcggcaataggtaaagcctgggaagaaggagtatgcggcatacgtagcgccacaaggttagaaaatattatgtggaaacagataagcaacgaattgaatcatatcttactagagaacgacatgaagtttacggtcgttgtcggcgatgtggccggaatactcgcacaagggaaaaagatgattagaccgcaacctatggaatataaatatagttggaagtcatggggaaaagctaagataattggagccgatgtacaaaacaccacctttataatagatgggccgaacacgccagaatgccctgatgatcaaagggcttggaacatctgggaagttgaggattatggctttggaatatttaccacgaatatttggttaaagctccgtgattcctatacccaagtgtgcgaccaccgtttaatgtcagcagctattaaagactccaaggcagtacatgcggatatgggctattggatcgaatctgagaaaaatgatacgtggaagctagcacgcgcaagttttattgaggtaaagacatgtatatggcctaaatctcatacactctggtcgaatggtgtcttagaatccgaaatgataatacccaagatatatggtggacctatcagtcaacataattatagacccggatattttacacaaacagcgggaccatggcacctaggtaaacttgaattggattttgatttgtgcgaaggaactactgtggtcgtagatgaacactgcgggaaccgagggccaagtttacgtacgacgacagtaacaggaaaaataatacacgaatggtgctgtcgaagctgcaccctgcctccgttacgttttaggggtgaagatgggtgttggtatggtatggaaatccgaccggtaaaggaaaaagaagagaacctagttaaatcaatggtaagcgcaggttcaggagaagtggatagtttctctctgggtttattgtgcatttccattatgatcgaagaagttatgaggagtaggtggagtagaaaaatgttaatgatagggacattagcagtcttcttcctcctgattatgggtcaactcacttggaatgatctcataaggctatgcataatggtaggggcgaacgcttcagaccgtatgggaatgggaacaacatacctggcgctaatggcgacttttaaaatgaggccaatgtttgcggtcggattgttattcagaaggcttacatcacgtgaagtacttctcttaactattggactttcattagtagctagtgcagaattgccaaattctctggaagaattaggagatggacttgcaatgggtattatgatactaaaattactcacggattttcaatcacaccaattatgggcaaccctgcttagcttaacatttataaaaacaacgttttcactccactatgcctggaagacaatggcaatggttttgagcatagtatcattatttcctctatgtctgagtactacttcacaaaagactacatggctgccagtactacttggaagtttaggatgcaaaccattgacgatgtttctcatagccgaaaataagatatggggacggaaatcatggcctctcaacgaaggaattatggcggttggcattgtgtcaatactattgtcaagtttgttgaaaaatgatgtaccgctagcaggtccattaatagccggtggtatgctcatagcctgctatgttataagcggttcttcagcagatctcagcttagagaaggcagccgaagtctcatgggaggaagaagctgaacacagcggcgcttctcacaatattttggtagaagttcaagacgatggtacaatgaaaataaaagatgaagagagagatgacaccctaactatactactaaaagcaacgctgttggcagttagtggtgtgtttccattaagtatacccgcaacattgtttgtgtggtatttttggcagaagaagaaacaaagaagtggggtattatgggacacacctagtccacctgaagtagaaagagcagtattggatgatggaatttacaggataatgcagagaggtctacttggaagatctcaggttggagttggagtattccaggaaaacgtcttccatactatgtggcacgtaacgcgaggagcagtcctgatgtaccaaggaaaacggctagaacccagttgggcttcagtcaagaaagacctaatatcatatggaggaggatggagattacaaggatcctggaatacgggagaagaggtacaagtcattgctgttgaacccggaaagaacccaaagaatgttcaaacagcgccaggcacctttaaaacgccagagggtgaagtgggcgccatcgctttagactttaaaccgggtacaagcgggtcccccatagtaaacagagaaggtaaaatagttggactatacggaaacggggtagtaacaacttccggaacatacgtgtctgcaatcgctcaggcgaaagcatcccaagagggacccctcccagaaatcgaagatgaagtgtttcgaaagagaaatttgactattatggatctccacccaggctcggggaaaacacggcgatatttacctgcaattgtgagagaggccattaagcgtaaactaagaaccctgatactggctcctacacgagttgtagccagcgaaatggctgaagcattaaaaggtatgccgattagatatcaaactacagcagttaaaagcgaacacacaggtaaagagattgtggacctaatgtgccatgctactttcacgatgcgccttctaagccccgtcagagtaccgaattacaacatgataattatggatgaagcacactttacggacccatcctcgatagcagctcgtggatatatttctactagagttggaatgggagaggcggctgcgatatttatgactgcgactccaccaggttcagtcgaagcatttccacaatcaaatgcagtaattcaagatgaggagagggacatacctgaaagatcgtggaactcaggctacgagtggatcacagattttcccggaaaaacagtatggttcgtcccttctataaagtctggtaacgacatcgcgaactgcttaagaaagaatggtaaaagagttatacagctgtctcgtaaaaccttcgacacagaatatcagaaaacgaagaacaatgattgggattatgtcgttaccactgatatatcggagatgggggcaaattttcgagcggatcgagtaatcgaccccagacgatgccttaagccagtaattttgaaagacggtcccgagagagtaatcctagcaggaccaatgcccgttactgtagcctctgccgcgcaaagaagaggccgtataggcagaaaccataacaaggaaggtgatcagtatatttatatgggccaacctttgaataatgatgaagatcatgcacactggactgaggcgaaaatgcttctggacaacattaacacccccgaaggaataatcccagcgttattcgaacccgaaagagagaaatcagcagctatagatggcgaatatcgattgaggggagaagcgaggaaaacattcgttgaattgatgagacgaggggatctaccggtatggctatcatataaggtagcttcagaaggatttcaatattcagatagaaggtggtgttttgatggagaacggaataatcaagttttagaagagaacatggatgtggaaatctggaccaaggaaggtgaaagaaagaaattaaggcccagatggttagacgcaaggacatatagcgaccctctagcgctcagagaatttaaagaatttgccgcaggacgacgtagtgtcagcggtgacctgatattagaaataggaaaacttccgcagcacctcacacaaagagcacaaaatgcactagacaacctcgtaatgctccataattccgaacaaggagggcgcgcgtatagacacgcaatggaggaattaccagacacaatcgagacgttaatgctattagcattaatcgcggttctgacaggaggagtaacattatttttcctatccggaagaggtttgggaaaaacttctatcgggctactctgtgtcatggcatcatcagtacttctatggatggcatccgtagaaccgcattggatcgcagcctcaataatactagagtttttcttgatggtattactgataccagaacctgatcgtcagaggacaccgcaagataatcaattggcgtacgtcgtcattggattgttattcatgatattaactgtcgctgcaaatgaaatgggacttttagaaacaacgaaaaaggacctggggataggtcacgtcgcagtcgagaatcaccaccatgcagctatgctagacgtagatctacatcctgctagcgcctggaccctatatgcagtggcaactaccattattacacctatgatgaggcatacaattgaaaacacaacggccaatatcagcttaaccgccatagcaaatcaagctgccatacttatgggattagacaagggatggccaatctcaaaaatggacataggtgtcccacttctcgctcttgggtgctattcccaagtaaaccctctcactttaactgcagcagtactcatgttagttgcgcattatgccattataggacccggacttcaagcaaaggcaacgcgtgaagcgcaaaaacggactgcagcaggaatcatgaaaaatccaacagttgatgggatagtagcgatagatctagatcctgtcgtatacgatgctaagttcgagaaacagttaggccaaattatgcttctaatcttatgcacttcgcaaatattattaatgcgaacaacttgggcgctatgtgagtcaatcacattagcaactgggcctttaactactttatgggaaggcagcccggggaaattttggaatacgactattgcagtatcgatggcgaatatttttagaggtagttacttggcgggagcgggactagcattttcgttaatgaagtcactagggggtggtcgtcgtgggaccggagctcaaggagaaacgctgggagaaaaatggaaaagaagattaaaccaattaagtaaatcagagttcaatacctataaaagatctggtataatggaagtggatcgatccgaagcaaaagagggactaaagcgaggggaaactactaaacatgcggtttcgagaggtacagccaaattgagatggtttgttgagcgcaatttagtcaaaccagaagggaaagtaatcgacttaggatgtggacgcggaggctggagctattattgcgctggtctcaagaaagtcacggaggtcaagggttacaccaaaggcggaccaggacacgaggaaccgatcccaatggccacgtatggctggaatcttgtgaagttacatagtggtaaagatgtattctttattccaccggaaaaatgcgacacactgctatgtgacattggggagtcatccccgaatccgactatagaggaaggacgcacgcttagagtattaaagatggtagaaccatggctccgaggtaatcaattttgtatcaagattctaaacccgtacatgccgtcagtagtcgagaccttagaacaaatgcaacgaaaacatggtggaatgctagtacgaaaccctcttagtcggaatagtactcatgaaatgtattgggtttcctgtggaaccgggaacatagtttcggcagttaatatgacgtcgagaatgctactgaatcgatttacaatggcacacaggaagcctacatatgaacgtgatgtcgatttaggagctggcactagacatgtagcagtagaaccagaggtagcaaacttagatattataggccagagaatagaaaacataaaacatgaacacaagagtacatggcattatgacgaggacaacccctataaaacgtgggcatatcatgggagctacgaagtaaaaccttccggtagtgccagtagcatggtaaatggggtagtcaaattattgactaaaccatgggatgttataccgatggtaacacaaattgccatgacagatacaaccccttttgggcaacagagagtattcaaagaaaaggtagacacaagaacaccgaaagcaaagagaggtaccgctcaaataatggaggtcaccgcacgatggctttggggatttttaagtaggaacaagaagcctcggatctgcacacgtgaagaatttacccgcaaagtaagatcaaacgctgcaataggagcagtattcatagacgaaaaccaatggaactctgccaaagaggctgtagaagatgagcgtttttgggatttagtacaccgagaaagagaactacacaagcaaggtaaatgcgcgacgtgtgtctacaacatgatgggaaaaagagagaagaaactaggtgaatttggaaaagcgaaagggtcaagggcgatatggtacatgtggctaggggcaaggtttttagagtttgaagccttaggctttatgaatgaagaccattggttttccagggaaaattcattgagtggtgtcgagggagagggtttacataaacttggatacatacttcgagatatatcaaaaatacccggaggaaatatgtatgccgatgatacggctggatgggacaccagaattacagaagatgatctgcaaaacgaagcaaaaataactgatatcatggaaccagaacacgcgttacttgcgaaagcaatattcaaattgacatatcaaaataaagttgtacgtgttcaacgaccggcgaaaaatggtactgttatggacgtaataagtcgtagagatcaacgcggttctgggcaagttggaacatatggtttaaatactttcactaacatggaggcacaactaataaggcaaatggagagcgaagggatattttcgccttcagaactggaaacaccgaacttagcagaacgagtcctagattggttaggtaaatatggagttgaaaggctaaagagaatggcgatatccggagacgattgtgtagttaagccgatcgatgatcgattcgcaaccgcattaaccgctttaaacgatatgggaaaggtgagaaaagatatacctcaatgggagccgagtaagggttggaatgactggcagcaagtaccattttgctctcatcactttcaccaactaataatgaaagatggacgtgaaatagtcgttccgtgcagaaaccaagatgagctagtagggcgagcaagagtatcacaaggagccggttggtcacttcgagagactgcttgtctaggaaaaagctatgcgcagatgtggcaattgatgtattttcaccggagagacctcagacttgcagcaaacgccatctgtagcgctgtaccagtagactgggtccccacgagtagaacaacgtggtctatacatgcacaccatcaatggatgacaaccgaagacatgttgagcgtgtggaatcgggtttggatagaagaaaacccgtggatggaagataagacacatattagtaattgggaagatgtcccttacttaggtaagcgcgaggaccaatggtgtggaagtttaataggcttgacagccagagcaacttgggctacaaatatacaagtggcaataaatcaggtcagacgattgataggcaatgaaaattatttagattacatgaccagtatgaagcgatttaagaatgaaagtgatcctgaaggtgcattatggtaa

SEQ ID NO: 21115 - RNA, 9879 nt, synthetic construct
  misc_feature 1..9879: note = derived and/or modified CDS sequence (opt6) from DENV-1__JN903578__SS-prME
  source 1..9879: mol_type = other RNA
tcagtaactatgctactaatgctactgcctacggcattggcctttcatttaactactagaggtggggaaccgcacatgatagtatcaaagcaggaaagaggtaagtcccttttgttcaagacatcagtgggagtcaatatgtgtactctaatagccatggatcttggggaattatgcgaagataccatgacatataaatgtcctcgtataacggaagcagaaccagacgacgtagactgttggtgtaatgcgaccgacacatgggtaacctatggtacttgctctcaaacaggcgaacataggcgtgacaaaaggagcgtggcattagctccacatgtaggactaggtttagaaacaagaacagaaacctggatgtcctctgaaggagcctggaagcaaatccaacgggtagaaacgtgggcactaagacatccaggatttactgtgattgctctctttttagctcacgcaatcggtactagcataacgcaaaaaggaattatcttcattctacttatgttggtaacaccaagtatggcaatgcgatgtgtggggataggtaatcgagattttgtggaaggtttgtccggagccacgtgggtagatgtagtccttgaacatggtagttgcgtaactacaatggctaagaacaagcctacgttagacatcgagctcctcaaaacagaagtaacaaatccggccgtactcagaaaactatgtattgaagcgaaaataagtaatacgaccacggactcacgttgcccaactcaaggtgaagctactttagtcgaagaacaagatgctaatttcgtctgtcgtagaacatttgttgatagaggatggggaaatggatgtggactatttggtaagggttctctcctgacgtgcgccaaattcaaatgcgtaacgaaacttgaaggcaaagttgttcaatatgagaatttgaaatattctgttatcgtaacagtacatacaggagatcaacatcaggtaggtaatgaaacgacagagcacggaactattgcaactattacaccccaggctccaacgtctgagattcaacttactgactatggtgcactaacactagactgcagtccgcgaacgggtttggatttcaacgaaatggtcctattaacaatgaaagaaaaatcttggctagttcacaaacaatggttcttggacctacccctaccttggacaagtggcgcttctacaagccaagaaacctggaacagacaagacctgttagtgacattcaaaacagcacatgccaagaaacaagaagtagtcgtactcgggtctcaagagggtgcgatgcatacagcactaaccggcgcaactgagatccaaacgtcaggaacaacaacaattttcgctggccatctaaaatgtagacttaagatggataaactaactttgaaaggtatgagttacgttatgtgtacggggtctttcaagctggagaaagaagtggcagaaacacagcatggaactgtgctcgtacaggtgaaatacgaaggaactgatgcaccatgtaagatccctttcttaattcaagatgaaaaaggggtaacgcaaaacgggcgattaataacagcaaatccaattgttactgacaaagaaaaaccagtaaacatagagactgaaccaccttttggtgaaagctacattgtcgtgggagctggtgaaaaggcactaaaactatctagattcaagaaaggatctagtataggaaaaatgtttgaagccactgccagaggggcacgtcggatggccatattaggcgataccgcgtgggacttcggttctatcggaggggtgtttacatccgttggaaagctaatacaccaagtttttggtacagcatatggagtattattttcaggtgtatcatggaccatgaaaattggaataggtattctactaacatggttaggactaaacagtcgatcaacatctctatcaatgacatgtattactgttggaatggtaaccctatacttgggcgtaatggttcaggcagattctggctgcgttatcaactggaaaggaagagaattgaaatgcggatctggaatttttgtaaccaatgaagtacatacgtggactgaacaatacaaatttcaggcggacagcccaaaacggcttagcgcggctataggaaaagcatgggaagagggtgtatgtggaataagatccgcgacacgattagagaacataatgtggaaacaaatcagcaacgaactcaaccatattttactcgaaaatgatatgaaatttaccgtagtagtaggagatgcaaatggtatattagcccaggggaaaaagatgatacgacctcaaccaatggaacataagtattcatggaaaagttggggtaaagcaaagataataggagcagatatacaaaataccacattcattatagatgggccggatacacctgaatgcccggatgaccaaagagcgtggaatatttgggaagtggaagattatggttttggaatatttactacgaatatatggttaaaattaagagacagctacacacaaatgtgtgaccatagactcatgtccgcggcaataaaagacagtaaagctgtgcatgcagacatgggatattggattgagtcagagaaaaatgaaacctggaaacttgctcgtgcgtcgtttatcgaaatcaaaacatgtatatggccaaaatcgcatacattatggtctaatggagtcttggaaagcgaaatgattataccaaaaatatatggcggtccaatatcacagcataatcatagaccaggctatttcacacaaacggctggtccctggcatctggggaaacttgagttagactttgatgtttgtgaaggtacaacagtggtggttgatgaacactgcggaaatcggggaccttccctcagaactacaactgtaaccggaaaaatcattcatgaatggtgttgccgaagttgtacattacctccgctcagatttagaggagaagatggatgttggtacggaatggaaatacgcccagtgaaagaaaaagaagaaaacctagttcgaagcatggtatctgcaggaagtggcgaagtagactctttctcgctaggtttgctatgtgttagtattatgatagaagaagtaatgcgatcgaggtggagccgcaaaatgctcatgacggggacgttagccgtcttctttctcctcatcatgggccaactaacatggaacgatttgatacgattatgtataatggtaggagcaaatgtatctgatagaatgggaatgggaacgacctatctagcccttatggcaacttttaaaatgcgtccaatgttcgccgtggggctactattcagacggttaaccagtagagaagtattattattaacgataggattaagtttagtagcaagtgccgaactacccaattccttggaagaactcggcgatggtcttgcaatgggcataatgatgctaaagttactaactgattttcaaagtcatcagctatggacaaccttgctttcacttacttttattaaaactactctgagtttagactatgcctggaaaactatcacaatgatcctttctatagtcagcttattcccattatgtctctcaacaacgtcacagaaaaccacgtggctaccagtcttgttaggcagctttggatgcaaaccattaacgatgtttcttataactgaaaataagatatggggtcgaaaatcatggcccctaaacgaaggaatcatggctgtaggaattgtatcaattttgttgagctctctgctaaagaacgacgtgccactagcaggaccactgattgcagggggaatgctaatagcgtgttatgtgatctcgggatcttctgcagatctctcgctcgaaaaagctgcagaagtcagttgggaagaagaggctgaacacagtggtacttcacataatatattggtcgaggtacaggatgacggaacgatgaaaatcaaggatgaagaacgagacgatacgctaacgatattacttaaagcgacattactcgcagtgagtggtgtatatcctatgagcataccggcaacattgttcgtttggtatttctggcagaagaagaaacaacggagcggagtgttatgggatactccctcacctcccgaagtggaaagagcggtattggatgatgggatatacagaatcttacaaagaggcctccttggaaggtcacaagtcggtgtaggcgtattccaagacggcgtatttcatacaatgtggcatgttactcgaggagctgttcttatgtatcaaggaaaaagattagaaccatcctgggcttcagtcaagaaagaccttatttcatatggtggaggatggagatttcagggaagttggaatacaggcgaagaggtacaagtaatcgcagtagaacccggcaaaaatcctaaaaatgtgcagacaacgcccggaacttttaaaacccctgagggagaagtaggagctatagcattggattttaaaccaggtactagcggatctccaatagtcaaccgggagggcaaaattgtcggcctatacggcaacggggttgttacgaccagcggaacatatgtgagcgccattgcacaagcaaaagcaagccaagaaggacccctaccagaaatagaagatgaagtttttaaaaagagaaatctaactataatggatcttcaccccggttccggtaaaactaggaggtaccttcccgcaatcgttagagaagcaataaaacgcaaacttcgaactttaatactcgctccaacaagagtagtagcaagtgaaatggctgaggctttaaagggtatgccgataagataccaaacaaccgcagtaaaatcagagcacacgggccgcgaaatagttgacttaatgtgccacgcaactttcacaatgcgattactgtcacctgtgcgagtaccgaattataacatgataataatggatgaggctcatttcacagatccagccagcatcgcggcaagaggctacatttccacacgagttggaatgggagaagccgctgcaattttcatgacagcgacgccaccaggttcagtcgaagccttcccacaatcaaatgcagtaatacaggacgaagaaaaagacataccagaaagaagttggaactcaggttacgattggataacggatttcccaggaaaaactgtctggttcgttccaagtataaaatctggaaatgatattgcaaactgcttacgtaaaaatgggaaacgggttatacaactaagccgtaagacatttgacactgagtatcagaaaactaaaaataatgattgggattatgttgtgactacagatattagcgaaatgggcgctaatttccgcgccgatagagtaattgatccaagacgatgcctcaaaccagttattttaaaagatggtcctgaaagggtaattttggcaggacctatgcccgtcaccgtggcttcggcagcgcaacgccgaggaagaatcggtcgaaatcaaaataaagaaggagatcaatatgtctacatgggacaacctttaaataacgacggagaccatgcacattggacggaagcgaagatgctacttgacaatataaacacacctgaaggaataataccagcattatttgaaccagaacgtgagaaaagtgcagccatcgacggcgaataccgcttacgtggagaagctagaaaaaccttcgtagaattgatgagacgaggtgaccttccggtctggttatcttataaggtagctagtgaagggtttcaatatagcgacaggcgatggtgctttgacggagagagaaataaccaagttttagaagaaaacatggatgtagaaatctggactaaagagggagagaggaagaaattgagacctcgctggctcgacgcccgaacttattctgatccactggcccttagagaatttaaagaatttgccgccggtagaagatcagtatctggcgacctcattttggagatcggcaaacttccacaacatttaacgctaagggcacaaaacgccttggataatctggtaatgttacataattcagaacagggtggtaaggcttatagacacgcaatggaagaactacccgacaccattgaaacactaatgttactagctctaattgcagtactaacgggaggggtaaccttattctttctctcaggtaaaggcctagggaaaaccagcattggattattgtgtgtaatggcttcctctgctttactatggatggctagtgtagaacctcattggatagcagcatcgatcattttagaatttttcctaatggtacttctaatacctgaaccagacagacaaaggaccccacaagacaaccaactagcatacgtagtcatcggcctactatttatgatactgacagtcgccgcaaatgaaatgggcttgttggaaaccaccaagaaggacttaggtatcggacacgttgcagccgaaaatcaccatcacgccacaatgttagacgttgatctacgaccagcatcggcttggacattgtacgcggtcgcgacaacagtaatcacacccatgatgcgacacacaatagaaaatactacggctaacataagcctaaccgctatcgcaaaccaggcagcaattctaatgggactcgacaagggatggcctattagtaaaatggacataggagtacctctgttagcactaggttgttacagccaagtgaatccactaactctaaccgcagctgtacttatgttagtcgctcattacgcaataataggtccaggcctacaagcgaaagcgactagagaagcacagaaaagaaccgccgcaggtatcatgaaaaatccaactgtagacggtatcgtggcaattgatctcgaccctgtagtttatgatgcaaagtttgaaaagcaattggggcaaattatgctcctaatcctatgtacgtcacagattcttttaatgcgaacgacatgggcgttatgcgagagcataacattagcaacgggtcccttaaccacgttatgggaagggtccccagggaaattctggaacacaacgatagcagtttctatggctaatattttcagaggttcatacttagccggtgctggtcttgcgttcagcttaatgaagtcattaggcggtagccggcgggggacaggagcccagggggaaacgttgggggaaaaatggaaaagacaacttaatcaactatctaaaagtgaatttaatacgtacaaaaggagtggaataatggaggtagataggtcagaagcgaaagaaggacttaaaagaggagaaacaacgaaacacgcggtatcaaggggaacagcaaaacttcgttggtttgttgaaagaaacctggttaaaccagaaggcaaggttatagatctgggatgcggcagaggtgggtggtcatattattgtgctggactcaaaaaggtaacagaagtgaaaggctatacaaaaggcgggcccggtcacgaagaaccaataccgatggctacctatgggtggaacttagtaaaattgcacagcggtaaagacgtcttctttattcctccggaaaaatgtgatactttgttatgcgatatcggcgaatctagcccgaatccaacgatcgaagaaggaagaacccttagagtattgaaaatggttgaaccctggctgcgcggaaaccagttctgcataaaaatattaaacccatacatgccatctgtcgtagaaacattggaacaaatgcaaagaaaacatggagggatgcttgtacggaaccccctgtcaaggaactctactcatgaaatgtactgggtcagctgtgggaccggtaacatagtcagcgcagtgaatatgacatcccggatgcttctaaatagatttaccatggcacaccgaaaaccaacatacgaaagagacgtggatttaggagcgggaactaggcacgttgcggttgaaccagaagtggcaaacctggatataatcgggcagagaatagagaatattaaaaatgaacataaatctacatggcattacgatgaagacaatccttataaaacatgggcatatcacggatcgtatgaggttaaaccatctggatccgctagttccatggtaaatggtgtagttcgtctactcaccaagccatgggatgtaattccaatggtcacacaaatagcgatgacggatactaccccctttggtcagcaacgagttttcaaagaaaaggtagatacgcggactccacgagccaaaagagggaccgcacaaataatggaggtgactgcaaaatggctttggggttttcttagtcgcaacaaaaagccgagaatatgtacaagagaagagttcactcgtaaggtaagatcgaacgctgctatcggggctgtattcgttgacgaaaatcaatggaacagtgcaaaagaagcagttgaagatgaacgattttgggatctagttcatagagagcgtgaattacataagcagggaaagtgtgcaacgtgcgtttataatatgatggggaagagagagaagaaactaggagaatttggaaaagcgaaaggatcaagagcaatatggtatatgtggctaggtgcccggttcttagagttcgaagcactgggatttatgaacgaagatcattggtttagcagggagaatagtctgagcggggtagagggagaaggtctccataaattaggatatatattacgcgatatttcgaaaattcccggagggaacatgtatgctgatgacacagcaggatgggacacacgcataacggaagacgatttacagaacgaagcaaaaataaccgatattatggagcccgaacacgcgttactagcgacttcaattttcaaattaacttatcaaaataaagtcgtaagagtacaaagacccgctaaatcaggaacagttatggacgtaataagtcgacgcgatcaaagaggaagtggacaagtaggtacatatggccttaatacttttacgaatatggaagttcagctcatcaggcagatggaatcggagggtattttccttccatcggaattagagactcctaatttagctaaacgagtcttagattggttagaaaaacatggagcagaacgtttaaaaagaatggcgatatcaggggacgactgcgtagtaaaaccgatcgacgatagatttgcaacagctttaacggcgctaaacgatatgggtaaagtgaggaaagatatcccacagtgggagccatcgaaaggttggaacgattggcaacaggtgcccttctgctcacaccattttcatcaactaataatgaaagatggaagagaaattgtggtaccttgtaggaatcaagacgagctagtaggcagagcacgcgtatcgcaaggtgcaggatggtctttacgagagacagcttgtttaggaaagtcatatgctcaaatgtggcaactgatgtattttcaccgacgagatttaagactggcagctaacgcaatctgttcggcagtacctgtagactgggttcccacgagcagaacaacatggagtattcatgctcatcatcaatggatgacgacagaagacatgttatcagtttggaatcgggtctggatagaagaaaacccatggatggaggataaaactcacgtttcttcgtgggaagaagtcccgtacctaggcaagagagaagatcaatggtgtggtagtttaattggtttaacagctcgagctacgtgggcaacaaatatacaggtagcaataaatcaagtacgaagacttataggtaatgaaaattacttggattatatgacaacaatgaagcgttttaaaaacgagtccgatcccgaaggcgcattgtggtaa

SEQ ID NO: 21116 - RNA, 9879 nt, synthetic construct
  misc_feature 1..9879: note = derived and/or modified CDS sequence (opt6) from DENV-1__JN903579__SS-prME
  source 1..9879: mol_type = other RNA
agtgtaacaatgttacttatgttgttacccacagcattagcatttcatctgacaacaaggggtggagaaccgcacatgatagttggtaaacaagagcgaggaaaaagtctattattcaaaaccagtgctggagtaaatatgtgtacgctgatagcaatggacttgggagaattatgcgaagataccatgacttacaaatgtccaaggattacagaagcagaaccagatgatgtagattgctggtgtaatgctacagacacttgggtcacatacggcacctgttcccaaactggggaacacagaagagataaaagatccgtggcattggcacctcatgtaggccttggattagagacaagaaccgagacctggatgtcatcggagggcgcctggcgtcaaatacagaaagttgagacttgggctttgcgtcaccctggattcacagtcatcgcattatttctagcacatgccataggaacgagcataactcaaaaaggaataatttttatcctgttaatgttagtaacgccgagtatggcaatgagatgtgtaggtataggaaaccgagatttcgtcgaaggcttatcaggggcaacttgggttgatgttgtactagaacacggatcgtgcgtgacaacaatggctaaaaataagccgacattagatatagaacttctcaaaactgaagttactaatccagcggtactaagaaaactttgtatagaagccaaaatatctaacactactaccgattcacggtgcccaacccaaggtgaagctactttagtagaagaacaagacgcaaattttgtgtgccgtcgtacttttgtagataggggctggggtaacggttgtgggttgtttggcaaaggatcgcttcttacctgcgctaaatttaaatgtgtcacgaaacttgaaggtaaaatcgtgcagtatgaaaatttaaaatatagtgtaatagttacagtacacactggtgaccaacaccaggttggtaatgaaactaccgaacacggtaccatagcaacgataactccgcaagctccaacttcagagatccaactaacagactatggagctttaactttggattgcagcccgagaacaggactagactttaatgaaatggtattgctcacaatgaaagaaaagagttggctagtacataaacagtggtttttagatttacctctaccatggacttcgggagctagcacatcacaagagacgtggaacaggcaggacttacttgtaacttttaaaacagcacacgccaagaaacaagaagtagtagtcctaggatcacaagaaggagcgatgcacactgcacttactggtgcaactgaaattcagacgagcgggaccaccacaatatttgcaggacacttgaaatgtaggttaaaaatggataaattgacactaaagggggtaagttacgtaatgtgcactggctcctttaaattggaaaaagaggtagctgaaacccaacatggaactgtattggttcaagttaaatacgaggggactgatgctccatgtaaaatacctttttccacccaagatgaaaaaggtgtgactcaaaatggaaggttgattaccgccaaccctatcgtaaccgacaaagaaaaaccagtgaacattgaaaccgagcccccattcggagaatcatatatcgtaataggggccggtgaaaaggctttgaaactaagttggttcaagaaagggtcaagtatcgggaagatgttcgaggccacagctaggggagctcgacgaatggcaatactcggagatactgcttgggattttggtagtataggcggcgtttttaccagtgtaggaaaattagttcatcaagtttttggaaccgcgtacggtgtactcttttctggagtttcgtggacaatgaaaatcgggataggaatattactcacatggcttggactaaattctcgatccacatctttgagtatgacttgtatagctgtcggtatggttacgttataccttggggtcatggtgcaggccgacaccggttgtgtaataaactggaaaggcagggaattaaaatgcggatcagggatcttcgtgactaacgaagtacacacgtggactgaacaatataagtttcaagcagactcgcctaaaagactaagtgcagcgatagggaaagcatgggaggaaggggtttgtggtatccgtagtgctactagacttgaaaatattatgtggaaacaaattagcaacgagctaaaccacatactattagaaaatgatatgaaatttaccgtcgttgttggagatgcgaacggcatattaacgcaaggtaagaaaatgattagaccccagccaatggaacacaagtatagttggaaaagctggggtaaagccaaaataattggtgccgatacacagaatacaactttcataatagatggcccagatacaccggaatgtccagacgaccagagggcttggaatatctgggaggtggaagactatggatttgggatatttacgacaaacatttggttaaagctacgagatagctatacacaaatgtgtgatcatcggctgatgtccgccgctatcaaagactcaaaagctgtccacgcagatatgggatattggatagaatctgagaaaaacgaaacttggaaacttgcaagagcatcattcattgaagtcaaaacgtgcatatggccaagatctcacacgctttggtctaacggagtcttagaatcagaaatgataatcccgaagatatatggcggcccgatatctcagcataactaccgaccaggatatttcacacaaaccgcgggcccttggcaccttggaaaactagagttggactttaatctgtgcgaaggaacaacagtagttgtagatgaacattgcgggaataggggaccgagcttacgtactacaacagtcacaggtaaaataatacacgagtggtgttgtagatcttgtacattacctcctttgagattccgtggagaagatggatgttggtatggtatggagattagacctgtaaaggagaaagaagaaaaccttgttagaagtatggtatcagctggaagtggggaggtggattctttttcacttggactcttatgcgtcagcataatgatcgaagaagtaatgaggagtcgttggagtagaaaaatgctgatgacaggtactcttgcagttttctttctattgataatgggacaattaacatggaacgatctcatcagactatgcattatggttggggccaatgtttctgaccgaatgggtatgggtacaacttatcttgcattaatggcgacgttcaaaatgcgaccaatgttcgctgtaggactattgttccgcagactcacaagtagggaagttctattacttacaattggtctctcacttgtcgccagcgcggaattacctaattcactcgaagagttaggagacggactcgctatgggtataatgatgctaaaattattaactgatttccaaagtcaccaattatggacaacactcctctcactaacatttattaaaacaacactatcactagattatgcatggaaaactatagcaatgatactaagtatcgtcagtctatttccactgtgcctatctacaactagccagaaaactacctggcttcctgtactgctaggatcattcggatgtaaaccgctaaccatgtttctaataacggaaaacaagatttggggtcgaaagtcgtggccactcaacgagggaataatggccgtgggaatagtgagcattctgttatcatccctgttgaaaaatgacgtaccgttagctggccccctaatagcaggcggcatgctaatcgcatgttacgttatttccgggagctccgccgatctatcattggagcgagcagcggaagtatcatgggaagaagaagccgagcatagcggcgcctctcataacattcttgtagaagtccaagatgacgggactatgaaaataaaagatgaagaacgtgacgatacactgacaatattacttaaagcaacgttgttagcagtttccggtgtatatccaatgagtataccagcgactctattcgtatggtatttttggcagaagaagaaacaaagaagtggggtactctgggacacaccttctccaccagaagtggaaagggccgtattagacgacggtatatataggatactgcaaagaggcttgttgggacgttcacaagtaggcgttggagtttttcaagacggcgtatttcacacaatgtggcatgtgacccgaggcgcagtcctaatgtaccaaggaaaaaggcttgagccatcctgggcaagtgtcaagaaagatctgatatcatacggcggaggatggaggtttcaaggaagttggaatacaggtgaagaagtacaagtaattgccgtagaaccagggaaaaatccaaagaatgtacagacaacccctggcactttcaaaactcccgagggagaggttggtgcaatagccctcgacttcaagccaggtacctccggatcacccatcgttaatcgcgaaggtaaaatagttgggttatatggcaatggcgtggtcaccacttcgggaacatatgtatcagcaattgcgcaagctaaagcaagccaagaaggccccttacccgaaattgaggatgaggtttttaaaaagcgtaatttaacaataatggatttacacccaggctcaggtaaaacccgcaggtatttgccagctatagtgagggaagcaatcaagcgaaagctgagaacgctaatacttgcaccgacccgagtagttgcgagtgaaatggccgaggctttgaaaggtatgccgataaggtatcagacaacagcagtgaaatcagagcacacaggaagagaaattgttgatctaatgtgccacgccacgttcacgatgcgcctactaagtcctgttagagttcctaactataatatgattataatggatgaggcacacttcacagatcccgcatctatagcagctagaggttacattagtacaagagttggaatgggcgaagcggccgctatatttatgacagctacgccaccgggttcagtagaggctttcccacaatcgaacgcagtcatccaagatgaagaacgagatatccctgaacgttcatggaatagcggatacgattggataacggattttcccggaaaaacggtttggttcgtaccatcaattaaaagtggaaatgacatcgcaaattgtctgcgaaagaacggtaaaagagtgatacagctaagtagaaaaaccatagatactgaatatcagaagaccaaaaataatgattgggactatgtggtaacaacagacattagtgaaatgggagcaaattttcgtgccgatagagtaatcgacccgaggagatgtttaaagcctgttatattaaaggatggacctgaacgtgtaatactcgctggacctatgcctgtaactgctgcttctgccgcccaacgaagaggccggattggaagaaaccaaaataaggaaggggaccagtacatatatatgggtcaaccccttaataacgacgaagatcacgcacattggacagaagcgaagatgctcttagacaatatcaacaccccagaaggtattataccggcattattcgaaccagaacgagagaaaagcgcggcaattgatggtgagtacagactcagaggagaggcacgaaagacatttgttgaactgatgcgacgtggtgatttgcctgtatggctttcatacaaagtagcaagcgaaggctttcaatacagcgaccggcgttggtgctttgatggcgagaggaacaatcaagtattagaagaaaacatggatgtagaaatatggacaaaagaaggagaacgtaagaaactacggcctcgttggctagatgcgcgaacctattccgatccattagcacttagggaatttaaagagttcgcagcaggaagacgatcagtatctggtgatctaatcctggaaattggaaaattgcctcaacatctaactttacgtgctcaaaatgcgttggacaacttagtgatgttgcataacagcgaacaaggaggtaaagcatatagacatgcgatggaagaactgccagatacaattgaaactttgatgttactagcattaatagcagtcttgacaggaggtgtgacgctattcttcctaagcggcaaaggattgggaaaaacatcaattggtctactctgtgttatggcatcatcagttttattatggatggcaagtgttgagccacactggattgcagcgagtatcattttggagttctttttaatggtactcctaatcccagaacccgacagacaaagaactccccaagataatcaattagcttacgtcgtaattggatctttgttcatgatacttacggttgcagcgaatgaaatggggcttctggaaacaaccaaaaaggatttgggtattggacacgtagtcgcggaaaaccatcaccacgctacaacactagatattgacctccaccccgcaagcgcgtggaccttatacgcagtcgcaacgactataataactccaatgatgagacacacaatcgagaatacaacagctaatatatctctaacagcaatagcaaatcaagccgcgatattgatgggactggataaaggctggcctataagtaaaatggatataggtgtgccacttcttgcgttaggatgctattcacaggtcaatcccttaacactaaccgctgctgtgctaatgctagtcgcccattatgcaatcatcggacctggactccaagcgaaagctacaagagaagcgcagaagagaaccgcagcaggcataatgaagaatcctacagtggacggaatagttgcaatcgacctagacccagtagtgtatgatgccaagttcgagaaacagctgggtcaaataatgctgctgatactatgcacaagccaaattcttcttatgcggacaacatgggcactttgcgaatcaattactctagctacaggacccctcacgacattatgggaaggcagtcccggaaaattttggaatacaactatagctgtaagtatggctaatatttttcgtggaagctacctagccggtgccggattagctttcagtctcatgaaaagtttaggaggaggtcgaaggggtactggagctcagggagaaactttgggtgaaaaatggaagcggcaacttaatcagttaagcaaaagtgaatttaatacgtataaacgaagtggcattatggaagttgaccgatccgaggcaaaggaaggcctaaaaagaggcgagactaccaaacacgcagtaagtcggggaacagctaaattacgatggttcgtagagagaaacttggtaaagcccgaaggaaaagtgatagatcttggctgtggaaggggaggctggtcctattactgcgcagggctaaagaaagtaacagaagttaaaggctatacaaaagggggaccagggcacgaagaacctattccaatggctacttatggctggaacatcgtaaaactccattcaggaaaagatgttttcttcacaccgccggaaaagtgcgacacactgttgtgtgatataggagagagttcgccaaatcctacgattgaagagggtcgcaccttacgcgtactaaaaatggttgaaccatggctacgaggtaatcaattttgtataaaaattttgaatccctatatgccttcagtagtggaaacgttagagcaaatgcaacgaaagcatggtggaatgctagtacgcaatccgttatcgagaaattcaactcatgagatgtattgggtcagttgcggcactgggaatatcgtttctgcagtgaacatgacgtctagaatgttgttaaacagattcacaatggcacacaggaaaccaacttacgaaagggatgttgacttgggagcaggcactaggcacgtagcggttgaacctgaaatagccaatttagacataatcggtcaaaggatagaaaatattaagaatgagcacaaatccacatggcactatgatgaggacaacccttataaaacatgggcttatcatggttcatacgaagttaaaccatctggctccgcatcatccatggttaatggggtcgtaaggctactcacaaagccatgggatgttataccaatggttacgcaaatagcaatgactgacacgacgccctttggccaacaacgtgtctttaaagaaaaagtagatacacgaacaccgcgtccgaaaagaggaaccgcccagattatggaagtaacggccaaatggttatggggttttctctctagaaacaagaaacccaggatctgcacaagagaagaatttacaagaaaagtaagaagcaacgcggccatcggggcagtctttgtcgatgaaaatcaatggaatagtgcaaaggaagctgtcgaggacgaaagattttgggatctagttcatagagaaagagagctccataaacagggcaaatgcgcaacatgcgtgtataatatgatggggaaaagagagaagaaattgggcgagtttggtaaggcaaaaggatcgcgagccatatggtatatgtggttaggagcgcgtttcctagagttcgaagcactaggattcatgaatgaggatcactggttttcaagagaaaactcattaagcggcgttgagggcgaaggtctctataaacttggctatatacttagggatataagtaaaatccctggcggcaacatgtacgctgatgacaccgcggggtgggatacaaggattactgaagacgacttgcagaacgaagctaaaatcaccgatatcatggaaccagaacatgcattactagcaacctcaatttttaaactaacataccaaaataaagttgtaagagttcaaagaccggctaagtcggggactgtaatggacgttatatcccgtcgtgaccaacggggctcaggacaagtaggaacttatggtctaaacacattcaccaatatggaagtacaattaataagacaaatggaatctgagggcattttctcaccttccgaactagaaaactcaaatttagcggaaagagtattagactggctcgaaaagcacggtgtggaaagacttaagcggatggcaattagtggcgatgactgtgttgttaaacctacggatgatcgttttgccactgcattgacggctttgaatgatatgggtaaggtaaggaaagacataccccaatgggaaccaagtaaaggctggaatgattggcagcaagtccccttttgttcacatcacttccaccagctaataatgaaggatggtagggaaatagtagttccttgcagaaaccaggacgagctcgtaggacgagctagagtatcacaaggcgccggatggtctctgagagagaccgcatgcttaggaaaaagttacgcccagatgtggcaacttatgtactttcatagacgagatttaaggcttgcagccaatgcaatttgttcagctgtgcctgttaattgggtaccgacatcacgtacgacatggagtattcacgcccaccaccaatggatgacaacagaagacatgttatcagtgtggaaccgagtgtggatcgaagaaaacccctggatggaagataaaacacacgtatctagttgggaggatgtaccatatcttggcaaaagggaagaccaatggtgtggctcactaatcgggctcacagcaagagccacgtgggcaactaacattcaagttgcaattaaccaggtaagaagattaattggtaacgaaaattactctgattacacaacaagtatgaaaaggtttaaaaatgaatctgaccctgaaggtgcactgtggtaa

SEQ ID NO: 21117 - RNA, 9879 nt, synthetic construct
  misc_feature 1..9879: note = derived and/or modified CDS sequence (opt6) from DENV-1__JN903580__SS-prME
  source 1..9879: mol_type = other RNA
agcgtcacaatgttgctaatgttacttcccactgctctcgcatttcatctgactacccgaggaggtgaacctcatatgatagtaagcaaacaagaaagaggcaaaagtttgttatttaaaactagcgcaggagtcaatatgtgtacattaatcgcaatggatctaggagagttatgcgaagacacgatgacatataaatgtccgcgaataacagaggctgaaccagacgatgttgactgctggtgcaatgctactgatacttgggttacatatggtacgtgtagtcaaacaggtgaacatcgaagagacaaacgatctgttgcactagcacctcatgtaggcctaggattggaaacaagaacagagacatggatgtcatcggaaggtgcgtggcgccaaatacaaaaagtagaaacatgggcactaaggcacccaggatttacagtaatagcactatttttggctcacgctattggtacttctataacccaaaaaggaatcattttcatattactaatgctagtcaccccgtcaatggctatgcgctgtgtcggtatcggtaatagagactttgtcgaaggattaagcggcgcaacatgggtggacgtcgtactagaacacggttcctgtgtaacaacaatggcgaaaaataaacccacattagacattgaactattaaaaacagaagtaactaacccagccgttctcagaaaattatgtatcgaagcgaagatatcaaatactactacagactctagatgtccaacgcaaggcgaggcaacactcgtagaggaacaggatgctaactttgtgtgtcgacgaactttcgtcgataggggctggggaaacgggtgtggcttattcgggaagggaagccttttaacctgcgccaaattcaaatgcgtcacaaaactagaaggaaagatagtacaatatgagaatctgaaatacagcgtaatcgttacggtacacaccggagatcaacaccaagtaggaaacgaaactacagaacatgggacaattgccacaatcacacctcaagctcccacctcggaaattcagctgacagactatggagccttaaccttggactgctcgccgcggacagggttagattttaatgaaatggttttacttacaatgaaagaaaaatcgtggttagtgcataagcaatggtttctagatctaccattaccgtggacttctggagcatctacaagtcaggagacatggaacagacaggatctgttagtaacattcaaaacggcacacgccaagaaacaagaggtggtggttctcggatcacaagaaggtgcaatgcatacagctttaacgggagcaacggaaatacagacatcaggtacgacaacaatctttgccggtcacctcaaatgcaggctaaaaatggacaaactaacattaaaaggcgttagttatgtcatgtgtactggcagttttaaactagagaaggaagtcgctgaaactcaacacggaactgtcctagtacaagttaaatacgaaggtaccgacgctccatgtaaaatcccattcagtacacaagacgaaaaaggagttacgcaaaacggccggctgataactgccaaccccatagtcacagataaagaaaaacctgtgaatatagagacggaaccaccattcggtgagtcttacattgtgattggagccggtgaaaaagccctcaagctgagttggtttaagaaaggttctagtattggcaaaatgtttgaagcaacagcacgtggtgcacgaagaatggccatcctcggagatactgcatgggattttggctctataggaggagtattcacaagtgttggaaaattggtacatcaagtgtttggcacagcttacggggtgttgttttctggagtaagttggaccatgaaaataggaataggaatcctactaacatggctaggactaaattcccgtaatacaagtttatcaatgacatgtatcgccgttggcatggtcacactttacttaggagtaatggtacaagcagatactgggtgcgtaataaactggaaaggtagggaattaaaatgcggctctggaatattcgtaacaaacgaagtccatacatggacagaacaatataagtttcaagcggattcaccaaaaaggctcagcgcagctataggcaaagcatgggaggaaggagtatgcggtatccgatcggcaacaagattagaaaatataatgtggaagcaaatatcaaacgagctaaatcatatactattagaaaatgatatgaagtttacagttgtcgttggcgacgccaatggaatattaacccagggaaagaagatgatacgaccacagcccatggaacataaatattcatggaagagttggggtaaggcaaaaattataggtgctgatacacaaaatacaacattcataatcgatggtccagatacgccggaatgtcccgacgatcagcgtgcgtggaacatatgggaagtggaagattatggctttggaatttttacaaccaatatttggctaaagctacgagactcttacacccagatgtgcgatcatcggctaatgtcggcagcgataaaagactcaaaagctgtacacgccgatatgggttattggattgagtcagagaaaaatgaaacatggaaactcgcaagagcgtcatttatagaagttaagacttgcatttggccaagaagtcacacactttggtcaaatggtgtgttagaaagtgagatgattattccaaaaatctatggaggaccaatatcccagcacaactacagaccaggatattttacacaaacagcaggcccttggcacctaggaaagttagagttagactttaatctatgtgagggaacgaccgttgtggtagacgaacattgcggtaacagaggccctagcttaagaacaaccaccgttacagggaaaataatacacgaatggtgttgtcgaagctgcacattgccaccactgagattcaggggagaagatggatgttggtacggaatggaaattaggccggtgaaggaaaaggaggagaacttagtgagaagcatggtatcggcgggatcgggagaagttgactcattttccttagggttattgtgtgtatctataatgattgaagaagtgatgaaatcaaggtggtccaggaagatgctaatgacggggactttagctgtattctttctcttgatcatgggtcaactaacatggaatgacctaatcagattatgcataatggtaggagctaatgtctcagacaggatgggcatggggactacatatctagcgctaatggccacctttaaaatgcgaccgatgtttgcagtaggattgctatttcgtagattaacgtctcgtgaagtccttctcctaacgataggcctaagtttagtagctagcgctgaactgcctaatagtttagaggaactaggcgatgggttagctatgggaatcatgatgctaaagttattgacagattttcaaagtcaccagctgtggactacgcttttatcattaaccttcattaagacgactcttagtcttgactacgcatggaaaacaattgcaatgattctctcaatagtaagcctatttcctctatgcttatcgacaacctcacaaaagacaacatggttaccagtactgttgggttcatttggctgcaagccactcaccatgtttcttatcaccgagaacaaaatatgggggcggaaaagttggccactcaacgaaggtataatggctgtcggaattgtatcgattttattatcttcactgttaaagaatgacgtccccctcgctggacctttaattgccggcggaatgctcatcgcttgctacgtcatatcaggttcaagcgcggatttatctttagaacgagcggctgaggtgtcgtgggaagaagaagcagagcatagtggcgcgtcccacaacatcttagtagaagtacaagatgatggtacaatgaaaataaaagacgaggaaagagatgatacacttactattcttttaaaagccacactattggcaatttctggagtctacccaatgtcgattccagcgacactattcgtgtggtacttctggcagaaaaagaaacagcgaagcggagtattatgggacacccctagtccgccagaggttgagagagcggtgttggatgacggcatctatcggatactgcagcgaggattgctaggcagatctcaagtgggagtcggcgtgtttcaagacggtgtatttaggacaatgtggcatgtgacacgaggagctgttctaatgtatcaggggaaacgtcttgaaccatcatgggcatcagttaagaaagacctgattagttacggaggagggtggagattccaagggtcatggaatacaggagaggaagtacaagtaattgcagtggaaccaggcaaaaatcctaaaaacgtacaaaccactccaggaacttttaaaacgcctgagggcgaagtgggcgcaatagctcttgactttaaaccaggaacaagtggtagcccaattgtgaaccgagagggaaagattgtcggattatatggcaatggggttgtgactacatctggcacgtatgtcagcgctatagctcaggcaaaggcgagccaggaggggcctttaccagagatagaagatgaggtttttaagaaacgcaatttaacaatcatggatcttcatcctggttcaggtaaaactcgtcgatacttacccgccatagtaagagaggcaattaagcgtaaactgcgaacccttattctagcgccgacaagagtcgtggcaagtgaaatggctgaagccctgaaaggtatgccgattcgctatcaaacaacagctgttaaatccgaacatacaggccgcgagatcgtagacctaatgtgccatgccacatttacaatgagattgctctcacctgtcagagttccaaattataatatgattataatggacgaggcacacttcaccgacccagcatctatcgccgctaggggatatatttcaacaagagttggaatgggagaggcggcggcaatcttcatgactgcaacaccgcccggctcggtagaggcctttccacaatcaaacgctgtcatacaggacgaagaaagagatattccagagagatcatggaatagtggatacgattggataacagattttccgggtaaaacagtgtggtttgtaccaagcataaagtcggggaatgatatagctaattgcttaaggaaaaatggaaagcgggttatacaactgagcagaaagactttcgacactgaataccagaaaaccaaaaataatgattgggactacgtggtcacaacagatatttcagagatgggggcaaatttcagagcggatagggttatcgatcctagaagatgtttaaaaccagtgatattaaaagacggacccgaaagagtcattctcgctgggccaatgccagtgacggctgccagcgctgcacaaagacgcgggcgtataggaagaaaccagaataaggagggagatcagtatatttacatggggcaaccattaaataacgatgaagatcacgcccattggactgaggcaaaaatgttattagataatataaatacacctgaaggtataattcccgcgctatttgaacccgaacgtgagaaaagtgccgccatagacggggaatataggttgagaggcgaggcgcgaaaaacatttgttgaattgatgcgaaggggtgatttaccagtgtggttatcgtacaaggtagccagtgaaggcttccaatattcagacagaagatggtgcttcgatggcgagcgtaataatcaggtactggaggaaaatatggatgtggaaatttggactaaggaaggagaacgaaagaaattgagaccaagatggcttgacgccagaacatactcagatccattagccctacgggagttcaaagaatttgccgcaggaaggagaagtgtatcaggagatttaatcctggaaatcggaaaactcccgcagcatctaacgttgagagctcagaacgcactagataacctagtcatgcttcacaatagtgaacaaggtggaaaagcgtatagacatgccatggaagaactacctgatacaatagaaacgttgatgctattggccctcattgcagtactgacaggtggagtgaccctcttctttctaagtggaaagggattagggaaaacaagtattgggctattatgtgtgatggcgtcgtctgtactactatggatggcttccgtagaaccccattggatagctgcttctataatattagagttctttctcatggttcttctaatcccagaaccagatagacaaagaacccctcaggacaaccaactagcatacgtagtaattggtctattgttcatgatactaacagtcgctgcaaatgaaatggggctattagaaacaaccaagaaagatcttggaattggccacgttgtggccgaaaaccatcatcatgcgacaatgcttgatattgatctacacccagcaagcgcatggaccctatatgcagtagctacaactattataacacctatgatgagacatacaattgagaatacgacagcaaacatcagcctaactgcaatagcaaatcaagctgcgatattaatgggactcgataaaggatggccaattagcaaaatggatattggggtgcctttattagcactaggttgttattctcaggtaaacccactaactttgacagcagcggtattgatgttagttgcgcattatgccattattggacctggtctacaagccaaggcaaccagagaagcacaaaaacgcactgctgcgggaattatgaaaaatccaacggtagatggaatagtagctatagatctagaccctgtagtttacgatgcaaaatttgaaaaacaactcggacagataatgctacttatcctatgtacctcccaaattcttcttatgcgcacaacttgggcactatgcgaaagcattactcttgcaacaggaccactgacgactttgtgggaaggtagccccggcaaattttggaacacaaccattgctgtgtctatggcaaatattttcagagggtcctatcttgcgggtgcagggctagccttttcattaatgaaatcgttgggtggtggcaggcgagatacgggggcgcaaggggaaactttaggcgagaaatggaagagacaacttaaccaattaagtaaaccagaatttaacacatacaagcgttccggaataatggaagtagatagaagcgaagccaaagaaggcttaaaacgtggagaaactacaaagcacgctgtttcacgaggtactgctaagttgagatggtttgttgaaagaaaccttgtaaaaccagaaggaaaagtaattgatcttggatgtggaagaggtgggtggtcttactattgtgctgggctaaagaaagttactgaagtaaaaggctatacgaagggtggtccaggacacgaagaacccataccaatggctacatatggctggaatatagtaaaattacattcagggaaagacgtgttctttacgcccccagaaaaatgtgatacattattatgcgatataggtgagtcatcgcctaatcctacgatagaggaaggccggacgctaagagttttgaagatggttgaaccctggctgcgggggaatcaattttgcataaaaatattaaatccttatatgccttcagtcgttgaaaccttagaacaaatgcaacgaaaacatggaggtatgcttgtaaggaatccactgagtcgcaactcaacgcatgagatgtattgggtctcatgcggcactggcaacatcgtgtcggcggtaaatatgacaagtcgaatgttactgaatcgtttcactatggcacacagaaaacctacgtacgagagagatgtagatctgggtgcagggaccagacacgtagctgtagaaccagaaatagcgaatttagatatcattgggcagagaatggaaaatataaagaacgaacataaaagtacgtggcactatgatgaagataatccatataagacatgggcatatcacggaagttatgaagttaaaccatcaggctccgctagtagtatggtcaacggcgtagttaggttattaactaagccttgggatgttattccgatggttacacagattgcaatgacagacacaacgccattcggacaacaaagggtttttaaagaaaaagttgatacacgaactccacgtccgaaacgtggaacagcacaaataatggaagtgacagccaaatggctatggggatttttaagtaggaataagaaaccaagaatatgtacacgcgaggagttcacaaggaaagtgcgaagcaatgcagcgataggagctgtgttcgtagatgaaaaccaatggaactccgctaaggaagctgttgaagatgaaaggttctgggatctagtacatagagagagagaattgcataaacaaggaaaatgcgccacatgcgtatacaacatgatgggaaagcgtgagaagaaattaggggaatttggaaaggcgaaaggtagccgggctatttggtatatgtggttaggagcaagatttctagaatttgaggcattgggatttatgaacgaagaccattggttttcacgcgaaaatagtctatcgggcgtcgaaggagagggactctataagctaggatacatcctaagggacatctctaaaataccgggaggcaatatgtatgcagatgatacggccggatgggacacaaggataacagaagacgatctacagaacgaagcaaagatcactgatattatggagcctgaacatgccctcctcgctacctcaatcttcaagctcacatatcaaaacaaagtggtacgggttcaacgaccggcaaaatcaggtacagtcatggatgtcatatctcgcagagatcaaagaggatcaggacaggtaggcacatacggactaaacacttttacaaacatggaggttcagctgatccgccagatggagtcagaagggatttttagcccaagtgaattagaaaattcaaatttagcagagcgtgtccttgactggctcgagaagcatggggtagagagattaaaaagaatggcaattagtggcgacgattgcgtagtaaagcctacagatgacaggtttgcaaccgcattaacggctctaaatgacatgggtaaggtcagaaaagatatcccacaatgggaaccatcaaaaggttggaatgactggcaacaagtacctttctgttctcaccatttccaccagttaattatgaaagatgggcgagaaatcgtagttccgtgtcgtaatcaagatgagctagtagggagagctagagtctcacagggcgctggttggtcattgcgcgaaacagcctgcctaggcaaaagttacgcgcaaatgtggcaactaatgtattttcacagaagagatcttcggttggctgctaacgcaatttgtagtgcagtacctgttaattgggtaccaacctccaggacaacttggtctatacacgctcatcaccaatggatgacgacagaggatatgctttctgtttggaatcgagtctggatagaagaaaatccttggatggaagacaaaacgcatgtaagttcttgggaagatgtcccctacttgggaaaaagagaagaccaatggtgtggtagcttaataggtcttacagccagggccacttgggcaactaacattcaagtcgccataaaccaggtaagaaggttaataggaaacgagaactatagtgactatatgacttcaatgaaaagattcaagaatgagtccgatccagaaggggccctgtggtaa

SEQ ID NO: 21118 - RNA, 9879 nt, synthetic construct
  misc_feature 1..9879: note = derived and/or modified CDS sequence (opt6) from DENV-1__JN903581__SS-prME
  source 1..9879: mol_type = other RNA
tcagttacaatgttattaatgttgttaccgactgccttggcttttcacctaaccacacgtggtggggaaccacacatgatagtgtcaaaacaagaacgtgggaaatcgcttttattcaaaacctcagccggggtgaacatgtgtacgctaatagcaatggatctaggggaattatgtgaagacacaatgacttataaatgccccagaataacagaagctgagcctgatgatgttgattgctggtgcaatgcgacagacacatgggtgacctatggaacctgtagtcaaacgggagaacatcgtagagacaaacgaagtgtcgcattggcgccacacgtcgggctgggattagaaacgagaactgaaacgtggatgagttcggagggggcttggagacaaattcagaaagtagaaacatgggcacttcgacaccctgggttcactgtaatagctttatttcttgcgcacgcaatcgggacatcgattacacaaaaaggaattatcttcattctattaatgctcgtaacaccgagtatggctatgaggtgtgtcggaatcgggaatagagatttcgtcgaaggtcttagcggagcgacatgggtagacgtagtgctagaacatggcagctgtgtaactacaatggccaaaaataaaccaacgttggacatcgaacttctgaaaactgaggtaactaatcctgcggtattacgtaaactatgtattgaagctaaaatctcgaacacgaccacagatagccgatgtccgacacagggggaggcgacattagtcgaagaacaggatgcgaattttgtgtgcagaagaacttttgtcgatcgtggatggggtaatggatgcggactattcggaaaaggtagtttactgacttgtgcaaaattcaaatgcgtaaccaaactcgagggtaaaatagtccaatacgaaaatcttaaatatagcgttattgtaaccgtacatactggagaccagcatcaggtgggcaacgaaactacagaacatggaacgatcgcaacaattacaccgcaagcgcccacatctgaaatacagctcacagactacggtgcactaacgttggactgttctccgcgtactggattagacttcaacgaaatggttctacttaccatgaaagagaaaagttggctggtccataaacaatggtttcttgatttaccattaccctggacatcgggagcttcgactagccaggagacgtggaacagacaagacttattagtcacattcaaaacagcacatgcgaagaaacaagaagttgtagtcttaggatcccaggaaggtgccatgcatactgctctaactggggctacggaaatccagacttcgggaacgacaacaatcttcgcgggacatctcaaatgtcgcctaaaaatggacaaattaacattaaaaggggtatcttatgtcatgtgtactggatccttcaagttggaaaaagaagtagcagaaacacaacatggcacagtgctcgtacaagtcaaatacgaaggcacggatgcaccatgtaaaattccgttttcaacacaggacgaaaaaggtgtaacccaaaacggcagactaatcaccgcgaaccctatagtcacagataaagaaaaaccagtaaatatagaaactgaaccacctttcggcgaatcatacattgtgataggggctggagagaaagccctgaaattgtcatggttcaagaaaggcagttctattgggaagatgttcgaggcaacagcaagaggtgctcgaaggatggctatcttaggagatacggcttgggattttggaagtataggaggcgtgtttacctccgtaggaaagttagtgcatcaagtctttggtacagcatatggggtattattttcaggtgtcagttggacgatgaaaataggaattggaatcctactgacttggctgggtctcaattctagaaatacttcgctatcaatgacgtgtatagcagtaggtatggtgacgttgtatttaggtgtaatggttcaagcagatacaggttgtgtaatcaattggaagggaagagagttaaaatgtggaagtggtatatttgtaacaaatgaagtgcatacctggactgaacaatacaaatttcaggcagactcgccaaagagactttctgctgcaatagggaaagcatgggaagaaggtgtatgtggaataaggtccgcaacaaggttagaaaatatcatgtggaagcaaatctcaaatgaactgaatcatattttgcttgaaaacgacatgaagtttacggttgttgtaggcgatgcaaacggaatactgacccaaggtaagaaaatgattagaccccaaccgatggagcacaaatattcatggaagtcatgggggaaagcgaagataatcggagcagacactcaaaatacaacgttcattatcgatggtccagacacccctgagtgccccgatgatcagcgagcgtggaatatatgggaagtcgaagattacggttttggcatctttaccacaaatatttggttaaaacttagagactcctatacgcaaatgtgcgaccacagattaatgtctgccgttatcaaagactctaaagcagtacatgctgacatggggtattggattgaatctgagaagaatgagacatggaaattagcgagagcatcctttattgaagtaaaaacatgcatatggccaagaagtcatacgctgtggtcaaatggtgttttagaatccgagatgataatcccaaaaatatacggaggaccaattagtcaacataattatcgcccaggatatttcacacaaactgcaggcccatggcatctcggaaagctcgaacttgactttaatttgtgcgaagggactacagttgtcgtagatgaacactgcggtaacagggggccatcactgcggaccactacagtaacaggcaaaataatacatgagtggtgttgtcgaagttgtacactaccgccactcaggtttcgcggagaagacggatgttggtatggaatggaaataaggcccgtaaaggaagaggaagaaaatctcgttcgatctatggtatcagctggcagtggtgaagtagacagtttctcgttgggtttactatgtgtttcaataatgatagaagaagtaatgaaatccaggtggtcaaggaaaatgttgatgactggcacccttgcagtattcttcttactaatcatgggacaattaacgtggaatgatttgatcagactctgtataatggtaggtgcaaacgtttcagacagaatgggaatgggaacaacatacttagcgcttatggcaacatttaaaatgagacctatgtttgcagtgggcttactcttcagaagattaacatctcgtgaggttttattattgacaattgggctctcactcgtagcaagtgcagaacttccaaactccttagaagaactaggagacggattggcaatggggataatgatgctaaaactccttgccgactttcaatcgcaccaactatggacaactcttcttagcttaacttttataaaaactacgttaagtttagattacgcctggaaaacaatcgctatgatccttagcatagtgtccttatttcctctttgtcttagtaccacgagccagaaaacaacctggttaccagtcttactcggctcgttcggctgcaaacccctaacaatgtttttaattaccgaaaacaaaatttggggacgaaaatcctggccattaaacgaagggataatggccgtaggtatagtatcaattcttttgagtagtttactaaagaacgatgtgcctttagccggcccgttgatagccggtggtatgctcattgcatgctatgtcatcagtggctcgtcagcagatttgtccttagagcgagcagcagaagtgtcatgggaagaagaagccgaacactcaggcgcttcacacaatatattggtagaggtacaagacgatggtacgatgaaaattaaagacgaagaacgggacgatacactcacaattcttttaaaagcgacattgctggctatttcaggggtttacccaatgtctattccggctaccttgtttgtatggtacttttggcagaagaagaaacaaagaagtggcgtcttgtgggacacaccctcacctcctgaagtcgaacgcgctgtacttgatgacgggatataccgaattttacagcgaggattactagggagaagccaagtcggagttggcgtattccaagatggagtattccacactatgtggcatgtaacaaggggagcagtgcttatgtaccaaggcaaacgattagagccatcatgggcttccgtcaagaaagatttaatttcgtacggaggaggttggagatttcaaggatcctggaatacaggtgaggaagttcaagtaattgcagtagaaccgggcaaaaatccaaagaacgtacaaacaacacccggaacctttaaaacgccagaaggggaagtaggggcgatcgcactagattttaaacccggtacatcagggtcgcctattgtaaatagagaaggtaaaattgtaggcttatacggagatggagtagttactacatcgggaacgtacgtatccgccatcgcacaagcaaaagcaagccaagaagggccattgccagaaattgaagatgaagtatttaagaaacgaaatttaacaataatggatctccatccgggtagtgggaaaactagaagatacctgccagcaatcgtcagagaagcaattaagaggaaattgagaactctaatattagctccaactagggttgtagcctctgagatggccgaagcacttaaaggaatgccaataagataccaaactacagctgtaaaatcggaacatactggacgggagatagtagatttaatgtgccatgccacatttactatgaggctactgagtccagtaagggtaccaaattacaatatgatcataatggatgaagcccacttcacagaccctgcgtccatagcagctagaggttatattagcacacgagtgggcatgggggaagctgctgcaatatttatgaccgctacgcccccaggttccgtggaggctttcccccagtccaatgctgtgatacaagacgaggaaagggatatccctgagcggtcgtggaactcaggatatgattggattaccgatttcccgggcaaaacagtttggttcgtcccgagtattaaatctggaaatgacatagcaaattgcctacgtaaaaatggtaaaagagttatacaactttccagaaagacatttgacactgaatatcagaaaaccaagaataacgactgggactatgttgtaacaaccgacataagcgaaatgggcgcaaattttagagcagaccgagtgattgaccccaggcggtgtttagaacccgtaatattaaaagatggacccgaaagagtgatcttagccgggcccatgccagttacagctgcgtcggctgcgcaacgacggggtagaatcgggagaaatcagaataaagaaggagatcaatacatttacatgggacaaccactaaacaatgatgaagatcatgctcactggaccgaggccaaaatgcttttagacaacataaatacaccagaagggattatcccagctctatttgaaccagaaagggaaaaatctgctgctattgatggagaatacagactccgtggggaggcccgaaaaacatttgtcgaactgatgagacgaggcgatttaccagtctggttgagttacaaagtcgcttccgaaggtttccagtattctgaccgacgttggtgtttcgacggcgagcgaaataatcaagtactggaagaaaatatggatgtagaaatttggacaaaagagggagagcgaaagaaactacggcctagatggctagatgcacgaacttacagcgacccgttagctctcagggaatttaaagagtttgcagccggaaggcgaagcgttagcggcgatttaattctagaaattggtaaactccctcagcatttaaccctacgagcccaaaatgcactagataacctagttatgttacacaatagtgagcaaggtgggaaagcctatagacacgcaatggaagaacttcccgatacaatagagactctaatgctattggctcttatcgcagttctaacaggaggagtcacattgttctttcttagtggcaaaggattaggaaaaacatcgataggccttctatgtgtcatggctagctctgtattactatggatggctagtgtagagccgcattggattgctgcatccataatattggagtttttcttgatggttctattaataccagaacctgatagacaaagaacacctcaagataatcaactagcctatgtagtaatcggcttgttgtttatgatattgacggttgctgctaacgaaatgggtctattagaaaccacgaagagagatttaggaataggacacgttgtggccgaaaatcaccatcatgctacgatgttagatatagatttacatcccgctagcgcatggacattgtatgctgtagcaacgactataattacccccatgatgcgacacactattgaaaatactactgcaaatatttcacttactgccattgcaaatcaagccgcaatactcatgggattagataagggttggccaataagcaaaatggatataggtgttccattactcgcattaggatgctactcgcaagttaatccattgacattaacggctgcggtcctaatgttagtcgcgcattatgcaataataggacccggcctccaggcaaaagctactagagaagcgcagaaacgaactgccgcaggaatcatgaaaaatccaaccgtagatggcatagtggctatagacctcgatcccgtggtgtatgatgccaaatttgaaaaacagttaggccaaataatgttgttaattttatgcacttcacaaatattactgatgaggacaacctgggcactatgcgaaagcataacgctagctacgggacctctcaccacattgtgggaaggctctcctggaaagttttggaatacaaccattgctgtcagtatggctaatatctttagggggtcatatttagccggtgcgggtttggcgttctccctaatgaaatcgttagggggtggacgtcggggaactggagctcagggtgaaacactcggggaaaaatggaagcgccaactgaaccaattaagtaaatctgagttcaacacttacaagaggtccggcattatggaagtcgaccgatcggaagcaaaggagggcttgaagcgcggagaaacaactaagcatgcagtttcaagaggtacagtaaaattacgatggtttgtagagcgaaatcttgtaaaaccagaaggaaaagtcatagatttaggctgtggacgtggcggttggagttattactgtgctgggctaaagaaagttacagaagttaaggggtacacaaaaggtggaccaggacacgaagaacccattccgatggccacgtatggatggaatatagtgaaactccacagtggaaaggatgtgttctttactcctcccgaaaaatgtgacacactattatgcgatatcggggaaagctcacctaaccctactatagaggaaggaagaacattaagggtcctaaagatggttgaaccatggctgcgtggtaatcagttttgcataaaaattctaaatccttatatgccctcagttgtcgagacccttgaacaaatgcaaaggaaacatggagggatgttagttcgcaaccccttatctagaaacagtacccatgaaatgtattgggtcagttgtggaactggtaatatagtttccgcagttaacatgacctcaagaatgcttcttaatagatttactatggcacatagaaaaccaacttatgaaagagatgtggacctaggcgcaggaacaaggcatgtagctgtggaacccgagatagccaatttagatataatcgggcaaaggattgaaaatatcaaaaatgaacataaatctacttggcattatgatgaggacaacccatataaaacatgggcatatcatggtagctatgaagttaaacccagtggaagtgcatcaagcatggtaaacggtgtagttcgtttgttaacgaaaccgtgggacgtaataccgatggtaactcaaatagctatgacagatactacgcccttcggccaacaaagagtttttaaagagaaagtagatacacgaacaccacgacccaagaggggaaccgcacaaattatggaagtaactgcaaagtggttatggggatttttatcaaggaataagaaacctagaatatgtaccagagaggagttcacaagaaaagtccgatctaacgccgctattggcgctgtttttgttgacgaaaatcagtggaatagtgctaaagaagctgtcgaggacgaacgattttgggatttggtgcatcgagaacgagaactacataaacaaggcaagtgcgctacctgtgtctataatatgatgggtaaaagagagaagaaattgggtgaatttggaaaagctaaaggaagcagagcaatatggtatatgtggttaggggcaagatttttagaatttgaagctctaggatttatgaatgaagaccattggttcagtagagaaaactccttgagtggggtagagggggaaggattatataaattagggtacatcctaagagatatttcaaaaataccaggcggaaatatgtatgccgatgatacggcaggatgggatactcgaattacggaagacgacctacaaaacgaagcgaaaattaccgatatcatggagcctgaacatgcactcctagcaacaagtatctttaaattaacttaccaaaataaagtagttagagttcaacgtccggctaagtcaggaacagttatggatgttataagcagaagggatcaaagaggatcaggacaagtagggacatatggcctcaacacgtttacaaatatggaagttcaacttataagacaaatggagtccgaaggtatctttagtccaagcgagttagaaaattcaaatctagcagaacgggtacttgattggctagagaaacatggagtggaaagattgaaaaggatggcgatttcaggcgatgattgcgtcgtcaaaccaacagacgatcggtttgccactgcccttacggcgttgaacgatatggggaaagtacgtaaagatattccccaatgggagcctagcaagggttggaatgactggcaacaagtcccattctgttcccaccattttcaccaattaattatgaaggacggccgggaaatagtagttccctgtcgaaatcaagacgaattagttggcagagcaagagtttcgcaaggggcgggttggtcactacgagaaactgcatgcctagggaaatcatacgcacagatgtggcaactcatgtattttcatcgccgagatttgaggttagccgctaatgcgatatgctcagccgttccagtaaattgggtaccaacgagtcgaacaacatggagcattcatgcccaccaccaatggatgacaactgaagatatgctatcagtatggaacagagtatggatagaagaaaacccatggatggaagataaaacacatgtctcatcatgggaggacgtaccatatttaggaaaacgcgaagatcaatggtgtggtagtctaataggattaactgcaagagccacatgggcgacgaacatacaggtagcgataaatcaagtaaggcggctcataggtaatgaaaattactcagattatatgacatctatgaaaagatttaaaaacgaatcagatccagaaggagcgttgtggtaa

SEQ ID NO: 21119 - RNA, 9879 nt, synthetic construct
  misc_feature 1..9879: note = derived and/or modified CDS sequence (opt6) from DENV-1__KX380796__SS-prME
  source 1..9879: mol_type = other RNA
tcagtaacaatgcttttaatgctcttaccgactgcattggcttttcatttgaccactcgaggaggagaaccacatatgattgtaagcaaacaggaacgcggcaaatcattactatttaaaacgtcagcgggtgtaaacatgtgtactctaatagcaatggatctaggagaactatgcgaagataccatgacttataaatgtccacgtataacagaagcagaacccgatgatgttgactgttggtgtaacgcaacagacacttgggttacttacggaacatgttcacaaaccggcgaacatcgacgtgataaacggagcgtagccttggccccacacgtcggattagggctagaaacaagaactgagacttggatgtctagtgaaggggcatggagacagatgcagaaagtcgaaacatgggctctgaggcaccctggattcacagtaattgcactctttctcgctcatgcgataggtacctcaattacacagaaaggcataattttcattttacttatgttagtcacaccgtcaatggctatgagatgcgtcgggatagggaatcgcgattttgtggaaggactaagtggggctacttgggtggatgtggttctagaacatggttcatgtgttacaacaatggctaaaaacaaaccgacgctggatatagaattactgaaaacggaagtaacaaacccagccgttctgcgtaaattatgcatagaggcaaaaatatcaaatactaccacggattcacgctgtccgacacaaggcgaagccaccctggttgaagaacaagatgcgaattttgtatgcagaagaactttcgtagaccgaggctggggaaatggttgtggtctctttggtaaaggttcactacttacatgtgctaaatttaaatgtgttacaaaactagaaggcaaaactgtacagtatgaaaatttaaaatacagtgtaatagtaactgtacacacaggggaccagcatcaagtcggaaatgagactacagaacatggtacaatagctacgataacaccacaagcgcctacaagtgaaatacaattaaccgattacggggcactgacattagactgcagtccaagaacagggttagacttcaatgaaatggtactcttaacaatgaaagagaaaagttggttagtacataaacaatggtttctagacctaccgctcccatggacgtctggagcaagtacatcacaagaaacttggaaccgtcaagatttattagtgacattcaagacagctcatgccaagaaacaagaggtagtagttttgggaagtcaagaaggagctatgcacacagcactcacaggtgcaactgaaatacagactagcggtacgacaacaatatttgctggacatctaaaatgcagactaaaaatggataaattaacactgaaaggcgtttcgtatgtcatgtgcacagggtcatttaaattggaaaaagaagtggctgaaacacaacacgggacagtattggttcaagtgaaatacgaaggtactgacgcaccatgcaaaatacccttctcaactcaagacgaaaagggagttactcaaaatggcagattaattacagcgaatccaatagtgacggataaagaaaaaccagtaaatatcgaaactgaacccccatttggggaaagctatatagtaataggagctggtgaaaaagcattgaaactaagttggtttaagaagggtagttcaatcggcaaaatgtttgaggcaacagcgagaggagcaagacgaatggcgatcctgggggatacggcgtgggatttcggatcaattggtggggtgttcacgtctgttggaaaactcgtccaccaagtttttggcacagcgtatggcgtcctttttaacggagtcagttggacaatgaaaattggaatagggatcctactgacatggttaggactaaattcgcgtagtacttcactatcgatgacatgtatagcggtgggtatggtaactctctatctaggagttatggttcaggcagattctggatgcgtcattaactggaaagggcgagaactgaaatgtggttcgggtatcttcgtcactaatgaagtgcatacgtggacggagcaatataaattccaggccgacagtccaaaacgactcagtgcagctattggcaaggcttgggaagaaggtgtgtgtggaatcaggagcgccactcgactagagaatataatgtggaagcagatctcgaatgaacttaaccatatcctgcttgaaaatgatatgaaatttacagtcgtagtgggagatgccaacggtatactaacacaaggtaaaaagatgatacgaccccaacctatggaacacaaatatagttggaaatcatggggaaaagccaaaataatcggcgcagacacacaaaatactacattcataatagacggaccagatacaccagaatgtccagatgaccagagagcatggaatatttgggaggttgaagattacgggttcggtgttttcactacaaacatatggttaaaattgcgtgactcgtatacccagatgtgtgatcacagactcatgagcgccgctattaaggatagcaaagcagtacatgcagacatggggtactggattgagagcgagaaaaacgaaacatggaaactggcccgtgcatcattcatcgaagtgaagacttgcatttggcccagatcacacaccctatggagtaacggagtcttggaatcagaaatgattataccaaagatctatgggggaccgataagtcagcataattatcggcctgggtatttcacacaaacagcaggaccttggcatctaggcaaattggaattagactttgatctatgtgaaggaacaaccgtagtggtagacgaacactgtggcaatagaggaccgagtcttagaactacgactgtcactggaaaaataatccatgaatggtgctgtcgcagctgtaccctcccacccttacgattccgtggagaagacggatgctggtatggcatggaaattcgaccggtaaaggagaaagaagaaaacttagtgagatctatggtttcagcaggaagtggagaggttgattctttttccttaggtcttctctgtgtcagtataatgatagaagaagttatgagatctcgctggtcacggaaaatgcttatgacaggaacacttgctgtgttctttcttctaataatgggacaattgacatggaatgatttaatcagactatgcataatggtaggggcaaatgtatctgacaggatggggatgggcactacttatttagcgttaatggcaacgttcaaaatgaggcccatgttcgcagtcggacttttattcaggaggttaacttcacgagaagttttacttttgacgataggactaagcctagttgccagtgtcgaactaccaaattcgctggaggaattaggggacggacttgcaatgggtattatgatgcttaaacttttaacagacttccagccacatcaattatggacaacactactcagcttgacttttataaaaaccactttatcactagactatgcctggaagaccatggctatggttctatccatagtctctttgtttcctctgtgcctcagtaccacgtcccagaaaactacatggcttccagtacttttaggttccttcggttgtaaaccactaacaatgtttctaataacagagaacaaaatatggggacgaaaatcatggccacttaatgaaggtatcatggccgttggtatagtatcaatcttgctctctagcctgctaaagaatgatgtccctttggccggaccacttattgcaggaggtatgttgatagcatgttatgtaatatcaggttccagcgctgacttatcattggaaagagccgcagaagtctcatgggaagaagaggctgagcattctggggcctcacacaacatactggtggaggtccaggacgatggaaccatgaagataaaagacgaagaaagagatgatacattaacaattctattaaaggctacactcctagcagtgagcggagtgtacccaatgagcattcctgccactttattcgtatggtatttctggcagaagaagaaacagcgatccggagttctttgggataccccatcaccacccgaagtcgaacgagcagtcttggatgacggaatctatagaatacttcagcgtggacttcttggaaggtcacaggtcggcgttggggtctttcaagacggcgtgtttcacacaatgtggcatgttactagaggagcagttttaatgtatcagggtaaaagattggaaccgtcatgggcttcggtcaagaaagatcttatatcttacggaggaggttggaggttccagggaagctggaacactggcgaagaagttcaagtcatagccgtagagccagggaaaaatcctaagaacgtacaaacgaccccaggcacgtttaagacacccgaaggagaagtaggagcgattgcattagattttaaacctggaacatcaggcagtccaatcgtaaatcgagaaggaaagattgtcggtctatacggcaatggcgtggtaacaacatcaggaacatatgtgtccgcgatcgcccaggctaaggcttctcaagaggggcctttgccggagattgaagatgaagttttcaaaaagagaaatctcacaattatggaccttcacccaggaagtgggaaaactaggcgatatcttcctgcaatcgtacgggaagctattaaacgtaaattacgcacactaatcttggctccaaccagagttgttgcttcggaaatggctgaggccttgaaaggtatgccaatcaggtatcaaacaactgctgtaaaaagtgaacataccggaaaggagatagtggatctcatgtgtcacgcgacatttactatgagactcctcagccctgtacgtgtgcctaattacaatatgattattatggacgaggcgcactttactgatccagcttccatagccgcaagaggctacattagtacaagagttggtatgggtgaagccgcagccatatttatgacagcaacgccgccaggatcggtcgaggctttcccacaatctaatgcagtcatacaagatgaggaacgtgacataccagaacgctcatggaactctggctacgactggataacagatttcccaggaaaaacagtgtggtttgttccttcgattaagtcaggaaacgatatagcaaactgcctcagaaagaacggaaaacgggtaatacaactatcgagaaaaacgtttgatactgaatatcagaaaactaaaaataacgattgggattacgtcgtaacaacagatatatctgagatgggagccaattttcgggcggatcgagtaattgatccgaggagatgtcttaaaccagttatcctaaaagatggcccagagcgagtaattctagctggtccaatgcctgtgaccgcagcatcggctgctcaaaggagaggtcgaattggtcgaaatcaaaataaagaaggagaccaatatatttatatgggacagcctcttaataatgacgaagaccatgcccattggactgaagcaaaaatgctattagacaacataaacactcctgaaggtataattccagcactattcgagccggaacgtgagaaatccgctgcgatagatggtgaataccgcctaagaggagaagcaagaaaaacatttgtagagttaatgcgaaggggtgatttgccggtatggctatcctacaaggtcgcatctgagggttttcaatattcagaccgaagatggtgtttcgacggggaacgaaataaccaggttttagaagagaacatggatgtggagatctggactaaagagggggaaagaaagaaattaagacctcggtggctagatgctagaacatattctgatccgttagcgttaagggagttcaaggaatttgccgcggggcgaaggtctgttagcggagacctgatattagaaataggaaagctaccccaacacttaacgcttagagcccaaaatgcacttgacaacctagtcatgctgcacaattctgaacaaggaggaaaggcatacagacacgcgatggaagaattacccgatactattgaaactttaatgctactagcactaatcgctgtcctgaccggaggggttaccttattctttctttccggaaaagggttaggaaagactagcataggactcttatgcgtgatggcatcaagtgttcttctatggatggctagcgtagaaccacattggatagcagcatccataatattagagttcttcttaatggtcctactaatacccgaacctgacagacaaagaacaccacaagacaaccaattagcgtatgttgttataggacttctttttatgatactaaccgttgcagcgaatgaaatgggattactagaaacaactaagaaagacctaggtattggacatgtggttgctgagaatcatcatcatgcgactatgctagatattgatctacatcccgcaagcgcatggacattgtatgcagttgcgaccacaataattactccgatgatgagacatacgatagaaaatacaaccgctaatatttccttgacagctatagcaaatcaagctgccatactcatgggactcgataaaggatggccaataagcaaaatggatataggtgtgccattgttagcactgggatgttattcacaagtgaatcccctaaccctcacagctgctgttctaatgctagtagcacactatgcaattataggacctgggctacaagcaaaagcaactagagaagctcagaaaagaacggccgcagggataatgaagaatccaacagtcgatggaatcgtggcgatagacttggaccctgtcgtctacgacgcaaagtttgaaaaacaattagggcagatcatgctactaattctctgtacatcacaaatcctactaatgcggaccacctgggcactatgcgaaagcataacgttagcgacgggtccgttaacaaccctgtgggaaggaagcccaggcagattttggaatacgacaatcgccgtgtccatggccaatatatttcgggggtcgtacctggcgggtgctggactggctttctcactaatgaaatccttgggcggtggtaggaggggaacgggagctcaaggagaaacacttggtgaaaaatggaaaagacaacttaatcaactaagtaaaagtgaatttaacacttacaaaagaagtggaattatggaagttgatcgctcagaagcaaaagagggcctaaagcgaggtgaaacgacgaagcatgctgtatcacgtggaacggcaaaattgagatggttcgtagaaagaaaccttgtgaaacccgaagggaaagtgatcgatctaggatgcggtagaggcggatggtcctattactgcgcaggtctcaagaaagttacagaggttaaagggtacacaaaaggtgggcctggacacgaagaacctatcccaatggcaacgtacggctggaacatagttaagttacatagtgggagagatgttttctttacacctccagaaaaatgcgacactctactctgtgatataggagagtcatcaccaaacccaacaatagaagaaggccggacccttagggtactaaaaatggtagaaccatggttaagggggaatcaattctgcatcaaaatcctaaacccatatatgccttctgtggtagagaccttagaacaaatgcaaaggaaacatggaggtatgttagtaagaaatccattgagtcgaaattctactcacgagatgtactgggtatcatgtggtacagggaatatagtaagcgccgtaaacatgaccagtaggatgttgctcaatagattcaccatggctcaccgcaaaccaacatatgaacgtgacgtagaccttggcgcagggacgaggcatgtagccgttgaacctgaaatagctaacttagacatcataggacaacggattgaaaatatcaaaaatgaacataaaagtacttggcattacgatgaggacaacccatacaagacctgggcgtaccacgggtcgtatgaggtaaagccctcaggttcagcgtctagcatggtaaatggagtggttagactcctaactaagccgtgggacgtaataccaatggtcacgcaaattgctatgactgacacaacaccttttgggcagcagagagtcttcaaagagaaagtggatactagaactccaaggccaaaaagaggaactgctcaaatcatggaagtaacagcaaagtggctgtggggcttcttatccagaaataaaaagccacgcatatgcacaagggaggagtttactcgtaaagtacgctctaatgctgccattggggcggttttcgtcgacgaaaaccaatggaactcagcgaaagaagcagttgaagacgaacgcttctgggatttagttcatcgagagcgagaactccacaaacaaggtaagtgcgcaacatgcgtgtacaacatgatgggaaaacgagagaagaaattaggggagtttggcaaagctaagggcagtcgagccatatggtatatgtggctcggtgctcggtttctggagtttgaggctttaggatttatgaatgaagatcactggttttcacgagaaaactccttatcgggagtcgaaggtgaaggcttacataaacttggctatattttacgggatatatcaaaaataccaggtggtaacatgtatgctgacgacacggcgggatgggacacaagaataacggaagacgatctacaaaatgaagcaaaaattacagacataatggagccagaacacgcacttcttgcgactagcatctttaaactaacctaccaaaacaaagttgtgcgcgtacagcgccccgcgaaatctggaactgttatggatgtgataagccgtagagaccaaagaggttcgggacaagttgggacctacggtttaaatactttcaccaacatggaggtgcagttaatacgacaaatggaatcagaaggcattttcagcccatcagaactagagaactcgaatttggcagaaagggtcttagattggctagaaaagcacggtgttgaacgtttaaaaagaatggcaatcagcggagatgactgtgtcgttaagcccacggacgatagatttgcgacagccttaaccgcattaaacgatatgggtaaggtaagaaaggacataccacaatgggaacctagtaaaggctggaacgattggcaacaggtacccttctgtagtcaccattttcatcaattaataatgaaagatggccgtgaaatagtagttccttgccgaaatcaagacgaactcgtaggacgagcaagagtatcccaaggtgcagggtggtcccttagagaaacagcatgcctcggtaaatcatacgcacaaatgtggcaattgatgtattttcaccgccgtgacctcagactagcagctaatgcaatatgtagtgcagtacctgtcaactgggtgccaactagcaggactacatggagtatacatgcacatcaccaatggatgactaccgaggacatgttatctgtttggaatagagtttggatagaagaaaacccatggatggaggataaaacgcatgttagctcttgggaggatgtaccatatctcgggaaaagggaggaccaatggtgcggatcattaatagggctaacagcccgtgcgacatgggcgaccaatatacaagttgcgattaatcaggtcagaagattgataggtaatgaaaactacttagactatatgacctccatgaagagatttaagaacgaaagcgatccagaaggcgcactttggtag

SEQ ID NO: 21120 - RNA, 9879 nt, synthetic construct
  misc_feature 1..9879: note = derived and/or modified CDS sequence (opt6) from DENV-1__KX380799__SS-prME
  source 1..9879: mol_type = other RNA
agcgtaacaatgttactaatgttattacctacggctcttgcgtttcatttaacaacaagaggaggtgaaccacatatgatcgttagcaaacaagaacgaggaaaatcactactctttaaaacgtcggctggcgtcaatatgtgtacgctcatagcaatggatctaggagaattatgcgaagacacaatgacatataagtgcccaagaatcacagaagctgaacctgatgatgttgattgctggtgtaatgctacagacacttgggtcacctatggcacttgttctcaaacaggtgaacacagaagagataaaagaagtgttgctttagcaccacacgtaggcttgggactcgaaactagaactgaaacatggatgtcttcagaaggagcttggcgacaaatacaaaaagttgaaacctgggcactacgacacccaggattcacagtaatcgccctatttcttgcacatgcgatcggtacttctatcacacaaaaaggaattattttcatcttactgatgctagtaacacccagtatggcaatgagatgcgtaggaataggaaacagagattttgtggaaggtttgtcaggagccacctgggtagacgtagtactagaacatggttcatgcgtaaccactatggctaaaaataaaccgaccttagatatagaactactaaagacagaagttaccaatccagcagtcctacgaaaactatgtatagaagcaaaaatttctaacacaactactgattcgagatgtccaacccaaggtgaagcgaccttagtagaagaacaggacgccaatttcgtttgtcgcaggacattcgttgaccgtggttggggaaatggatgtggactctttggcaaaggttccctattaacgtgtgcaaaatttaaatgtgtgacaaaacttgaagggaaaatagttcagtatgaaaaccttaaatattcggttattgtaacagtccacacaggagatcaacaccaggttggaaacgaaacaactgaacatgggactatagcaactataacgcctcaagcgcccaccagtgaaattcaattgaccgattatggagcattgaccctagactgttcaccaagaacgggactggactttaatgaaatggttttgctaacgatgaaagagaaaagttggttagtgcataaacagtggttcttagatctaccgctcccatggacgtcgggtgcgtcaacaagtcaagaaacctggaaccgacaagatttattagtaacttttaaaacagcacacgctaagaaacaggaagtagttgtgttaggcagtcaagaaggagcaatgcataccgccctcaccggagctacagaaatacaaacttctgggaccaccaccatattcgccggacacttgaagtgccgactaaagatggataaacttactttaaagggggtgagttatgttatgtgcacaggtagtttcaaattagagaaagaagtcgcggagacacaacatggcactgtattagtacaagttaaatacgagggtacagatgcgccatgtaaaataccaatatcaacgcaagatgaaaaaggtgtgacacagaatggacgtttaataactgctaatccaatagtaacagacaaagagaaacctgtaaatattgaaacagaacctccttttggtgagtcgtatatcgtaataggggctggagaaaaggcattgaaattgtcgtggtttaagaagggatcaagtataggaaaaatgttcgaagccacagcaagaggtgccagaagaatggcaatattaggtgacactgcttgggactttggcagtatagggggtgtgtttacatcagtaggtaaattagtacatcaagtttttggcacggcttatggggtactattttccggtgtgtcatggacaatgaaaatcggaattggtatcttattgacatggcttggtctaaattcccgcagtaccagtttaagtatgacttgcatagcagttggtatggtaacactttatttaggagtcatggtgcaagcagattccggctgcgttataaattggaaagggagagagcttaagtgtggatctggtatatttgtaacgaatgaagtgcacacttggaccgaacaatataaatttcaagcagattcacctaaacggcttagtgctgctataggaaaagcgtgggaagaaggggtatgtgggatccgaagtgctacgagactagaaaatataatgtggaaacaaataagtaacgaattaaatcatatattgttagaaaacgatatgaaatttaccgtcgtagtaggagatgcaaatggaatcctgactcaaggcaaaaagatgatacgacctcaacccatggaacataaatactcatggaaatcatggggaaaagccaaaataataggtgcggacacgcagaatacgacgtttattatagacggtccagacactccagagtgtccagatgaccagagggcgtggaacatatgggaggtagaagactatggatttggagtgttcacaacaaacatttggctgaaattgcgcgattcttacacgcaaatgtgcgatcatagattaatgagtgcagctatcaaagattcgaaagcagtacacgccgatatggggtattggattgagagtgagaaaaatgagacgtggaaattggcacgcgccagcttcattgaagtgaaaacctgcatttggccccgaagtcatactctatggtccaacggtgttcttgaaagcgaaatgattatacctaaaatctacggaggcccgataagccagcataattataggcccggctattttacacaaactgcaggtccatggcatctaggcaagttagagctagatttcaacctgtgcgaaggcacaacagtggtagttgatgaacattgcggtaatcgaggaccatcgcttagaaccacgacggtcactggaaaaatcatccatgaatggtgctgcagaagctgtacactacctcccttaagatttcgaggagaggatggttgctggtatggaatggagatacgacccgttaaggaaaaagaagaaaatctagtgagatcgatggtctcagcaggatcaggtgaggtcgatagcttctccttaggactattgtgtgttagcattatgatcgaggaggtaatgagatcacgatggtccagaaagatgctgatgacaggaacattggcagtattctttttactcattatggggcaacttacttggaacgatttaatccgcttatgtataatggtgggagccaatgtatccgatcgaatgggaatggggacaacttatctagcattgatggccacatttaagatgagaccgatgtttgctgttggactgctatttaggcgattgacgtcgcgtgaggtacttctacttacaataggcctgtccttagtagcaagcgttgaattaccaaatagtttggaagagttaggcgacgggctggcaatgggaataatgatgttaaaattactcaccgattttcaatctcatcagctatggaccaccctattatccctaactttcataaaaacaactctttctttagactatgcctggaagacaatggcgatggtgttaagcatagtctcattattccccttgtgtttaagtacaacgagtcagaaaacgacatggcttcctgtacttttagggtcattcggctgcaaaccactgacaatgtttcttatcacggagaataaaatatggggacgtaaatcatggcctcttaatgaaggcattatggcagtgggaatagtaagcattcttttaagctctctgctcaaaaacgacgtgcctctagcaggccccttgatcgcaggcggaatgctaatagcatgttatgtaatttcaggttcatctgcagacttatcactagaaagagccgctgaagtatcgtgggaagaggaagcagaacattccggcgcttcacacaatattctggtagaagtacaagatgacgggacgatgaaaattaaagatgaagaacgagatgatacactaactatcttattaaaagcaacactcttagcagtgagtggcgtgtatcccatgtcaatacccgcgactctgtttgtatggtatttttggcaaaagaaaaagcaaagatcaggcgtcctatgggacacgccgtcaccacctgaagttgagagggcagtgctagatgatggcatatacagaatactccagcgtgggttactgggaagatctcaagtcggtgtcggtgtatttcaagacggagtatttcatacgatgtggcacgtaacacgcggggctgttttgatgtatcaaggaaagagattagaaccaagttgggcaagtgttaagaaagacctaatttcatatggtggaggctggagattccaaggatcctggaacacgggagaagaggtacaagtcattgcggtcgaaccagggaaaaatcctaagaatgtacaaacaactcccggaacttttaaaacgccagaaggcgaagtaggggcaatcgctctggacttcaaaccaggcacaagtggatctccaatagtaaatcgcgaaggtaaaatagttggtctgtatggaaatggcgttgttacaacctctggtacatatgttagtgcaatagcccaggcaaaagcatcgcaggaaggaccattaccagaaatagaagatgaagtgttcaagaaacggaatttaaccataatggaccttcaccctggctctggtaaaacacgcaggtatttaccagcgatcgtaagagaagcaatcaaaagaaaattaagaactttaatattagccccaactagagtagtagctagcgagatggcggaagccttaaaaggaatgccgatacggtaccaaactaccgcagttaagtcggaacacaccggtaaagaaatagtggacctaatgtgccacgcaacatttactatgagattactttccccggtaagagtacctaattacaatatgattattatggacgaagcacattttacggacccagcatcgatcgcggccagaggctacatttccactcgcgtaggcatgggagaagctgctgcaattttcatgacagcaacacccccaggttctgtcgaggcttttccgcaaagcaacgctgtcattcaagatgaagaaagggatattcccgagcggtcctggaactcagggtacgattggatcacagattttccgggaaaaacagtatggttcgtgccatccattaagtctggcaatgatatagcgaactgtcttaggaaaaatggaaaaagggtaattcagttaagcaggaaaacatttgacaccgaatatcagaaaactaaaaataacgattgggattatgtagtcacgactgatatttcagagatgggtgctaacttcagggcagacagagtaattgatccacgccgatgcctcaagcctgttattttaaaggatggacctgagcgggtaattcttgcaggcccaatgccagtgaccgctgcatctgcagcacagcgtagaggacgtattgggcgaaaccagaacaaagagggcgatcaatacatatatatgggacagcctctaaataatgacgaagatcacgcccattggacagaggcaaagatgttattggacaacatcaataccccggaagggataattcccgctctctttgaacctgaacgtgaaaagagcgctgcaatagacggtgaataccgattaagaggtgaagcacgaaaaacatttgtagagttgatgaggagaggggacttaccagtttggttatcttacaaagttgcttcagagggtttccaatacagtgatcgaagatggtgcttcgatggcgaaagaaataatcaagtactagaagagaacatggacgtggaaatctggaccaaagaaggtgagagaaagaaactaagacctagatggttagatgcacgaacctacagcgacccgctcgcccttagggaatttaaagaatttgcagctggcaggagatccgtttccggggatctgatattagaaattgggaaattgccccaacacctaacactaagagcccagaatgctctcgataacttggtaatgctccataattccgagcaaggaggaaaagcatacagacacgccatggaagaattgcccgacacaattgaaaccctgatgctattggcacttatagccgtcttgactggaggcgtgactctatttttcttgagtggtaagggactaggaaaaacgagcatcggcttattgtgtgtaatggcgagctcagttctactctggatggcctccgtagaaccacattggatagcagcaagcataatattagagttctttttaatggtactactcatcccggagcctgataggcaacgcacaccacaggacaatcaacttgcctacgtagtaatcggcttattgtttatgatcttaaccgtagcagcgaacgaaatgggtctactagaaactactaaaaaggacttaggaatcggacatgtagttgccgagaatcaccatcacgcaacaatgcttgacatagacttgcaccctgcttctgcatggaccttatacgccgtcgccaccaccatcattacccctatgatgaggcatacaatagaaaatactacagccaacatttcactaaccgccattgctaatcaagctgctatacttatgggcctggataaaggttggccaattagcaagatggatataggcgtaccattattagcattaggctgttactctcaggtcaatccgttgacgctaacagccgctgtcttgatgttagttgcacattacgcaataataggtcctggattacaagcaaaagcaaccagagaagctcagaaacggacggcagcaggaattatgaaaaaccccacagtagatggaatcgttgcaatcgatctagaccccgtagtatatgacgcaaaattcgaaaagcaacttggacaaatcatgctcttaatcctctgtacatcacaaatattattaatgagaacaacatgggcactatgtgagtcaataacactagcaacagggcctctaacaactttatgggaaggatcgcctggtagattctggaacacaacaatcgccgtatcaatggctaatatatttagaggctcatacttagccggtgcaggccttgctttctcattaatgaaatctttaggaggtggtaggagaggtacaggagcacaaggggagacactgggagaaaaatggaaacgtcagctaaatcagctatccaaaagtgagtttaatacttataagaggagtggtatcatggaagttgatagaagtgaggccaaagaaggactaaagcggggagaaacgaccaaacatgctgtgtcgagaggaacagcaaagctgagatggtttgtcgagcgaaatctagtgaaaccagaaggtaaagtcatagatcttggatgtggcagaggagggtggagctattactgtgctggcctcaaaaaggtgactgaggtaaagggatatacaaagggcggacctgggcacgaagaaccaattccaatggctacctacggctggaatatcgtaaaactacacagcggaagagatgtattctttaccccgcctgaaaaatgtgacaccttgctgtgcgatatcggcgaatcgagtcctaatcctacaatcgaggagggaaggacattgagagtgcttaaaatggtagaaccttggttacgaggcaatcagttttgtataaaaatcctaaacccatatatgccgagtgtcgtagaaacactggaacaaatgcaaagaaaacatggaggaatgttggtaagaaacccactaagcagaaactccacccatgagatgtattgggtctcatgtggaacaggtaacatagtaagcgccgtgaatatgaccagcaggatgctcttaaataggtttacgatggctcaccgcaaaccaacctatgaaagagatgtcgatctgggcgcaggaaccagacacgttgctgtagaaccagaaatagctaatctagatattatcggccaacgaatagaaaacataaagaatgaacataaatctacttggcactacgatgaggataatccgtataaaacctgggcttaccatggttcatatgaagttaaaccttcaggatcagcctcgagcatggtcaacggcgtcgtgcgacttctcacaaaaccatgggacgtgatacccatggttactcaaattgcaatgactgatacaactccctttgggcaacagagggtgttcaaggaaaaagtggatactagaaccccacgtccgaagcggggcaccgctcaaattatggaagtaaccgcaaagtggctatggggatttctgtctcgaaacaagaaaccccgaatatgtacaagagaagaatttacacgaaaagtacgaagtaatgcagctattggtgcggtttttgtcgatgagaaccaatggaactctgcgaaagaggcagtcgaagacgagagattctgggacctagtccatcgcgagagggaactccacaaacagggaaaatgtgctacatgcgtatataatatgatgggaaaacgtgagaaaaagctaggcgaatttgggaaggcaaaagggtcgcgagcaatttggtacatgtggctgggggctagattcttagaatttgaagctctcggttttatgaatgaagaccactggttttctcgggaaaattccttgtctggagttgaaggggaagggctacataagttagggtacatacttagagacatatcgaaaatccccgggggaaacatgtatgcagatgatactgcaggatgggatactcgtataactgaagatgacttacaaaacgaagcaaaaattacagatataatggaaccggaacatgcgttattagcaacatctatatttaaattaacttaccaaaacaaagtggtgagagtacaacgtccagctaagagtggaactgtaatggacgttatttcacgcagagaccagcgtggttcggggcaagtaggtacttatggactcaacacttttacaaacatggaagtgcaattaatacggcaaatggaatcagaaggtattttctctccatcagaactcgagaactccaacttagcagaaagagtactggattggttagaaaaacacggagttgaaagactaaagcgaatggccataagcggagatgactgcgtcgtgaagcctaccgatgatcggtttgcaacagctctcacagcgcttaatgacatggggaaagttcgaaaagacataccacaatgggaaccctccaaaggatggaacgattggcaacaagtaccgttctgttctcatcactttcaccagttaataatgaaagacggtcgcgaaattgtcgtaccttgtagaaatcaagacgaacttgtgggccgcgccagagtaagtcaaggtgcaggatggtcgttgagagaaacggcatgcctgggtaaatcttacgcccaaatgtggcaactaatgtactttcatcgtagggacctgcgattagcggcaaatgctatctgtagtgcagtaccggtgaattgggtaccaacatcaagaactacatggtcaatacatgcacatcaccaatggatgacgacagaggatatgctaagtgtctggaatagagtatggattgaagaaaatccttggatggaagataaaacgcacgttagtagttgggaagatgtaccttacctaggcaaaagggaggaccagtggtgcggtagcctaatcggattgacagccagggcgacgtgggcgacgaatatacaagttgccataaatcaagtacgaagattaattggaaacgagaattatcttgattacatgacatcgatgaaacgatttaaaaatgaatctgatcccgaaggagcattatggtaa

SEQ ID NO: 21121 - RNA, 9879 nt, synthetic construct
  misc_feature 1..9879: note = derived and/or modified CDS sequence (opt6) from DENV-1__KX380800__SS-prME
  source 1..9879: mol_type = other RNA
tccgtgaccatgttactaatgttattacccactgcactagcctttcacctaactactaggggtggagaaccgcacatgattgtatcaaaacaagaacgtggtaaatcgcttttatttaaaacatcagctggtgtgaatatgtgcaccttaatagcaatggatttaggagaactctgtgaagacactatgacatacaaatgcccgaggattacggaagcagaacccgatgatgttgactgctggtgtaatgcaactgatacctgggtcacatatggaacttgttctcaaacaggtgaacatagaagagacaaaaggtctgtagcactagctccacacgtaggacttggactagaaacaaggactgaaacctggatgtcctctgaaggagcatggcggcagattcaaaaagtcgaaacgtgggctttgagacaccctggctttacagttatcgcgctatttttagctcacgccattgggacatcaataacacaaaaaggtataatttttatattattgatgctagtaacaccaagcatggctatgagatgtgttggaattggcaacagagattttgttgagggattaagtggcgcgacctgggtcgacgttgttttggaacatggttcatgcgtaactacaatggctaaaaataaaccaacgctggacattgaactgttaaaaactgaggtaaccaatccagccgtacttagaaaattatgtatagaagctaaaattagtaatacaacgaccgattccaggtgcccgacacaaggtgaggctactttggtagaagaacaagacgctaactttgtatgtagaagaacatttgtggacagaggatggggaaatggatgcggattattcggaaaaggatccctcctcacatgtgcaaaattcaaatgtgtcactaaattagaagggaaaatagtacaatacgaaaatttgaaatactcggtcatcgtaacagtacataccggcgaccaacatcaagttggtaacgagacaacggaacacgggacgatcgccacaatcacaccacaagcaccaacatctgaaatacaattgaccgactacggagctcttactttagactgcagtcctaggacaggccttgatttcaatgaaatggtactgttaaccatgaaggagaaaagttggttagtacataaacaatggttcctcgacctcccacttccatggacaagcggggctagcacctcccaagaaacttggaatagacaagacctgttggtcaccttcaagaccgcacatgccaagaaacaagaagtggttgttttagggtcccaagagggagcgatgcatacagctcttacaggagcaacggaaattcaaacgtcaggaacaacaacaatattcgcggggcacctcaaatgcagactgaaaatggataaattgacattgaaaggggtttcgtatgttatgtgtactggctcatttaaattagaaaaagaagtagctgaaactcaacatggcacggtcctagtacaagtaaaatacgagggcactgacgcaccgtgtaaaataccgatctctacccaagatgaaaagggtgtaactcagaacggccgtctgattacagcaaatccaatagttacagacaaggaaaaaccagtgaatattgagacagaaccaccatttggggagtcctatattgtaataggtgccggcgagaaagcattaaaactaagctggttcaagaaaggatcatcaataggaaaaatgtttgaagccaccgccagaggtgcaagacgcatggctatacttggagatactgcttgggatttcggatccataggaggagtcttcacaagcgttggcaagttagtacatcaagtattcggaactgcttatggggtccttttctctggagtcagttggactatgaaaataggaataggaatccttcttacatggttaggtctgaacagtcggagtacttctctgagcatgacatgtatagcggtcggaatggttactctatacttaggagtcatggtacaagcagattcaggttgcgtaattaattggaagggccgagaattgaaatgcggtagcgggatatttgtcactaacgaggtccacacatggacagaacaatacaagtttcaagcagattccccaaagcgcttgtcagcagcaatcggaaaagcgtgggaagaaggcgtatgcgggatacgcagtgcaactcgcttggaaaatataatgtggaaacaaataagtaacgaactcaatcatatcttattagaaaatgatatgaaattcacagtagtagtcggtgatgccaatggcatcctcactcaaggtaagaagatgattagacctcaaccaatggaacataagtacagctggaaatcatggggtaaggccaaaataattggcgccgacacgcagaacactacattcatcatcgacggaccagacactcctgaatgcccagacgatcaacgcgcatggaacatatgggaagttgaagattacggttttggagtatttactacgaatatatggttaaaactccgtgactcttacactcaaatgtgcgatcatcgcttgatgtcagctgcaattaaagacagtaaagcggtccatgcagacatgggatattggatagagtccgagaagaatgagacctggaaattagcaagagcaagtttcatcgaggtaaagacttgtatatggcctaggtctcatacgctatggtcaaatggggtactagaaagtgagatgattattcctaaaatctacggtgggccaataagtcaacataattaccgacctggatattttacacaaacggcaggaccatggcatctaggcaaactggaattagactttaacttatgtgaaggtactacagtggtggtagatgagcactgtggtaataggggtccatcattaagaacaacaactgtcacaggaaaaattatccacgaatggtgctgtaggtcttgtacccttccacccttgagatttagaggagaggacggctgttggtatgggatggaaatacgccctgtaaaggagaaggaggagaatctagtgagatcgatggtttctgcaggttcgggagaagttgacagcttttcattgggcttactctgcgtttccataatgattgaggaagttatgcgatcgcggtggagcagaaaaatgttaatgacggggactctcgccatattctttctgctaatcatgggccaactgacatggaatgatcttataaggctttgcataatggtaggggcaaatgtttcagataggatgggtatgggaacgacttacttggcgctcatggcgacgttcaagatgagaccaatgtttgctgtaggactactctttcgtaggttgaccagcagggaggttttattgttaacgattggattaagcctagttgcaagtgtcgaactgcctaattctttagaggaactaggcgacggtttagcaatgggtataatgatgctaaagttattaaccgattttcaatcgcatcaattgtggacaaccctccttagtctcacctttataaagacaacactaagcctagattacgcttggaagactatggcaatggtactctccattgtttctttatttccgttgtgcctaagcacgacatctcagaaaactacatggttgcctgttttactaggtagttttggttgcaaacctctgactatgtttctcatcacggaaaataaaatatggggtcgaaaatcatggcctcttaatgaaggcattatggcagttggaattgtttccatattactgagttcacttttaaagaatgacgtgccattggccggccctttaatagctggagggatgttaatagcttgttacgttatttcagggagttccgctgatctcagcctagagcgagcggctgaagtatcttgggaagaagaggcggaacattctggagcaagccacaatattcttgttgaagtgcaggatgacggtactatgaaaattaaagatgaggaaagagatgatactttgacgatattattaaaagcgacgctcctagcagtaagtggcgtctaccccatgtcaatacctgcaacgttatttgtctggtacttctggcaaaagaagaaacaacgcagtggggtgttatgggacacgcccagccctcctgaagtggaaagagcagtacttgacgatggtatttatcgaatactacaaaggggactattggggagatcacaggtaggagtaggggtatttcaagatggagtatttcatacgatgtggcacgttactaggggagcagtcctgatgtatcagggaaaacgactagagccctcgtgggctagcgtcaagaaagaccttatttcgtatggaggaggatggagattccagggcagctggaatacgggcgaagaagtccaagtcatagctgtcgaaccaggcaaaaatcccaaaaatgtccaaacgactcccgggacattcaaaacgccagaaggcgaagtcggcgccattgcattggatttcaaaccagggacgagcggttcaccaatagttaacagagaaggcaaaatagtaggattgtatggaaatggtgtggttacaacctcgggaacttatgtatcagctatcgcccaagccaaggcaagtcaagaaggaccattacctgaaattgaagacgaggtcttcaaaaagagaaatttgacaatcatggatctacatccaggtagtggcaaaacacgcaggtatctcccagctatcgtccgtgaagcgattaaaagaaaactacgcactcttatccttgcgccaactcgtgtggtagctagtgagatggcagaagcccttaaaggaatgccgatacgttaccaaacgactgccgttaaatctgaacatacaggtaaagagatcgtcgatctcatgtgtcacgctacgtttacgatgagactacttagtccggttcgcgttcctaattataatatgattattatggacgaagcacactttacagacccggcaagtatcgcggcccgagggtacatcagtacccgcgtaggaatgggagaagcagccgcaatatttatgactgcaacaccacccggaagtgttgaggcttttccccaatcaaatgctgtcattcaagacgaagaacgtgatattccagaaagaagttggaacagcggatatgactggattacagactttccaggtaaaacagtatggtttgtcccctcaattaagtctggaaatgacattgcaaattgtttaaggaaaaacgggaaacgtgtaatacaattaagtagaaaaacatttgacactgaataccagaaaactaaaaacaatgattgggattatgtcgtaactacagacataagcgaaatgggagcaaatttcagagctgatcgggtaatagacccaaggcgctgtttaaagccagtaattctgaaggatggaccggaacgggtaatacttgcaggcccgatgccagttacagcagcctctgcggcacaaaggcgaggacgcataggaaggaaccaaaacaaagaaggcgaccaatatatatatatgggacagccattaaataacgatgaagatcatgctcattggaccgaagcgaaaatgttgttagacaacataaacactcctgaaggaataatacctgctctattcgaaccggaaagggaaaaatcagctgctatagatggtgaatatcgattgcgtggtgaagcacgaaagacatttgttgagttaatgcggagaggggacctgcccgtatggttgagctataaagtcgcgagcgagggatttcagtacagtgatagacggtggtgttttgatggtgaacgaaacaatcaggtattagaagaaaatatggacgtagaaatttggacaaaagagggagaacgtaagaaacttagaccacgctggcttgatgcaagaacctatagtgatccgctagctctccgtgagtttaaggaatttgcagcgggacgcaggagcgtttcgggcgatctgatcttagaaataggaaaacttcctcaacatctaactcttagggcccagaatgcgctagacaatctcgtcatgttacataactcagagcaaggtggaaaggcatatagacatgctatggaagaactcccagacacaatagaaacattaatgttacttgctctaattgccgtgctaacgggtggggttacactgttctttttatccggtaagggattaggaaaaacgtcgatcggattactatgtgtaatggccagcagtgttttattatggatggcttcagtagaaccgcactggatagctgcgtcaatcatattagaatttttcctaatggtgctgttgatcccagaacctgaccgccaaagaacacctcaggacaaccagctagcttatgtcgtcataggattattatttatgatattaactgtcgcagctaatgagatgggcttactagaaacgacgaagaaagacctcggtataggacatgttgttgcagagaatcatcatcatgcaacgatgttagacatagatctgcatcctgcgagcgcttggactttgtatgcagtagccacaacaattataactccaatgatgcgtcacacgatagagaacacaacagcaaatataagcctaacggctatcgcaaatcaagcagctatactaatgggattagacaaaggttggccaataagtaagatggatattggagtccccttactggccctaggttgttactcgcaagtaaatcctttaacacttacagcagctgtattgatgttagtagcacattatgctataatcggtccgggactccaagcaaaagcaacacgggaagcacaaaaacgaactgcagctggtattatgaaaaatcctactgtagacggaatagtagcaattgacctagatccggttgtttacgatgcaaaattcgaaaaacaattaggccaaattatgctactaatattgtgcacaagccaaatactattaatgaggactacctgggcactttgcgaatcaattacactagccacaggcccacttaccacattatgggaaggttcaccaggtaagttttggaatactacaatcgcagtatcaatggccaatatattcagaggaagctatctcgcgggagccggtcttgctttttcgctaatgaaatctctgggcggtggtcgacgcggaacaggtgcgcaaggtgagactctaggagaaaaatggaaaaggcagctaaatcaattatcgaagagtgagttcaatacctataagaggagcgggattatggaagtggataggagcgaagccaaggaaggtctaaaaaggggtgaaactacaaaacacgcagtatccaggggtacagctaaactgagatggttcgtggagcgtaaccttgtcaaaccagaaggcaaggtgattgatctaggatgcggcagaggcggttggtcctactattgtgctggtcttaaaaaggtcaccgaagttaaaggatatactaaagggggaccaggtcacgaagaacctataccgatggctacttacgggtggaacatagtcaaacttcactcaggacgcgatgtatttttcacacccccagaaaagtgcgatacattattgtgtgatataggcgagtctagtccaaaccctacgatagaagagggaagaacgttgagagtactgaaaatggtagaaccctggttaagaggtaatcaattttgtatcaaaatactgaatccatatatgccctccgtggttgaaacactggaacagatgcaacgaaaacacggaggaatgctcgtcagaaaccccctctcaagaaattcaactcacgaaatgtattgggtatcctgtggaacaggtaatatcgtgtcggcagttaacatgacatcgcgtatgttactaaaccgttttacaatggcacacagaaagcctacatatgaacgggatgttgatctaggagccggaaccagacatgttgctgtggaaccagagatagcgaacttagatatcataggacaacgtattgaaaatataaagaatgagcataaatcaacttggcactatgacgaagacaacccatataaaacgtgggcctaccacggaagttatgaggtaaaaccttcgggaagtgcgtcatcaatggttaatggggtggtgcgattgttaactaaaccgtgggatgtaattcccatggtaacacagattgctatgactgacactactccattcggacagcagagagtttttaaagagaaggtcgatacgaggacaccacgaccgaaacgcggtacagctcagattatggaagtaacagcaaaatggctgtggggttttctttctaggaataagaaaccgcggatttgcacacgtgaagaatttactagaaaagtaaggtcaaatgcagcgataggtgccgttttcgtggacgagaatcagtggaactctgctaaagaggcagtagaagacgaaaggttttgggatttggtgcatagggaaagagagcttcacaaacaaggaaaatgcgcgacgtgtgtttacaacatgatggggaaaagggaaaagaagttgggtgagttcggaaaagcaaagggttcacgagcaatttggtacatgtggctcggcgcacgattcctcgaatttgaggctttagggttcatgaatgaagatcactggttcagtagggaaaattcactttctggagttgaaggagaagggctccataagctaggctacatacttagagacatctccaaaatacccggcggaaacatgtacgcagacgacacagcaggttgggatacaagaattaccgaagatgatttacaaaacgaggcaaagataaccgacatcatggagcctgagcatgcacttcttgcgacaagtatctttaagttaacttatcagaataaagtcgtaagagtgcaacgacccgcaaaaagtggtacagtaatggacgttattagcagacgcgatcaacggggcagtggacaagttgggacatacgggttgaatacctttacaaacatggaagttcaattaattcgtcaaatggaatctgaaggaatattcagtccatctgaacttgaaaatagcaatttagcagaacgtgtgctagactggttagaaaaacatggggtggaaagactcaaaagaatggctattagcggggatgattgtgttgtaaagccaacggatgatcgttttgcaaccgcacttaccgcactgaacgatatgggaaaagttcgaaaggacataccacaatgggaaccgtctaaagggtggaacgattggcagcaagtcccattttgctcacatcactttcatcagttaataatgaaagatggtagagaaatagtggtaccatgtagaaaccaagatgaacttgtagggagggcccgggtcagtcaaggagcaggttggtcactacgtgaaacggcatgtttgggtaagtcctacgcacagatgtggcaattgatgtactttcatagacgtgatttaagactggctgcgaatgctatatgtagcgcagtaccagtcaattgggttccaacatctaggacgacttggtcaattcacgcacaccaccaatggatgacaacagaagatatgcttagtgtttggaatcgggtttggatagaggaaaatccatggatggaagataaaacacacgtaagctcttgggaagacgtcccatatcttggtaagagggaggatcaatggtgtggttctctaattggactcactgctcgggcaacttgggcaaccaatatacaggtagcgataaatcaagttcgtcgtctaatagggaatgaaaattacctcgattacatgacatcaatgaaacgttttaaaaatgagtctgatccagaaggagccctatggtaa

SEQ ID NO: 21122 - RNA, 9879 nt, synthetic construct
  misc_feature 1..9879: note = derived and/or modified CDS sequence (opt6) from DENV-1__KX380802__SS-prME
  source 1..9879: mol_type = other RNA
tcggttacaatgttattaatgctgcttccaacagctctcgcttttcatttgacaacacgcggtggtgaacctcacatgatcgtatcaaaacaagaaaggggaaaatctctgttgtttaaaacatcagctggtgttaatatgtgtacactcattgctatggatttaggggaattgtgcgaagacacgatgacttacaaatgtccgaggattacagaagcagaaccggacgacgtggactgttggtgtaatgcgacggatacgtgggtaacttacggcacatgtagccaaaccggggaacacagacgcgataaacgtagtgttgcattagctcctcacgtgggattaggattagaaacccgcacggaaacctggatgagcagtgaaggcgcttggaggcaaatacaaaaagtggaaacatgggcgttacgccatcccggattcacagttatagcattattcttagcgcatgcaataggaacatcaattacccaaaaaggaattatattcattctacttatgttagtaacgccatccatggcaatgcgctgtgtaggaattggtaatcgggacttcgttgaaggcctttcaggggccacatgggttgatgtggtattggaacatggatcatgcgtaacaactatggccaaaaataaaccaacattggatatcgaattattaaaaacagaagtaaccaacccagcggttttgagaaaactatgcatcgaggctaaaatttccaataccactacagatagtcgatgcccaacacaaggtgaagcgaccttagtagaagaacaagatgctaattttgtatgtaggaggactttcgtagatcggggctggggaaacgggtgtggcttattcgggaaaggaagcctgctgacttgtgccaaatttaaatgcgtcacaaagctagagggaaagatagtccagtatgaaaacctcaagtacagcgttatcgtaacagtgcacacgggtgatcaacatcaagtaggaaacgaaacaacagagcatggtacgatagcgaccattacacctcaggcgccaacgagcgagatccaattgactgattatggggcattgacgcttgattgtagtcccagaacaggacttgactttaatgaaatggtattgctaacaatgaaagaaaaatcttggctagtacataaacaatggttcttagatttgcctctaccatggacgagcggagcctctacgagtcaagaaacatggaacagacaagatcttctagtcaccttcaagacggcgcatgccaagaaacaagaagttgtagtgctagggagtcaggagggtgctatgcataccgcactcacaggagcaaccgaaatacaaacatctggtactacaactatatttgctggccatttaaagtgtcgccttaaaatggggaaattgacgctcaaaggtgtctcttatgtcatgtgtacaggctcctttaaattagaaaaagaagttgctgagacgcaacatgggaccgtacttgtacaagttaaatatgaaggcactgacgcgccttgtaaaatacctataagcacacaagatgaaaaaggcgtcacgcaaaacgggcgtcttataacagcaaatcctatagtaacagataaagaaaaaccggttaacattgaaacagaacctccatttggagaatcatacatagtaatcggagcaggcgaaaaagcacttaaattatcatggttcaagaaagggagttctattggtaaaatgttcgaggcaacagcaaggggtgccagacgcatggcaatcttaggtgataccgcctgggactttggtagtatcggcggagtgtttacaagtgtaggaaaattggtacaccaggtttttggcacagcatacggagttttatttagtggagtatcatggactatgaagataggcatcggaatattgctcacatggctaggattgaactcacgttctacaagcctaagtatgacttgcatagcagttggaatggttactctttatctgggtgtcatggtacaagcggattccggatgcgtaattaattggaaaggcagagaactgaaatgtgggagtgggatatttgtaactaacgaagtccacacctggacggaacagtataaatttcaagccgacagcccaaaaagactcagcgcagcaataggcaaagcatgggaggagggagtgtgcggcattagatctgcaactagattagaaaacatcatgtggaaacaaatttctaatgaactaaatcatatattactagaaaatgatatgaaattcacagtggtagtcggtgatgctaatggtatactaacccaaggaaagaaaatgataagaccacagccgatggaacataagtatagttggaaatcctggggaaaagcaaaaataattggggcagatactcagaatacgactttcataatagacggaccagatacgccggagtgtcctgacgatcaaagagcgtggaatatatgggaggtggaggattatggcttcggggtctttaccacaaatatctggctcaaattaagagattcttatacacaaatgtgtgatcacagattaatgtcagcggcaattaaagatagcaaggcagtacatgcagatatgggatattggatagagagtgagaaaaatgagacatggaaattagcgagagcatcctttattgaagttaagacgtgtatatggccaagaagccacactttatggagcaacggggtcttagaatcggaaatgataataccaaaaatatacggtggaccaataagtcaacacaattacagacccggatattttacacaaactgcaggaccgtggcatctaggaaaattagaattagacttcaatctgtgcgagggtacaacagtagtcgtggacgaacactgtggaaataggggaccgtcattaagaacgacaacagtcaccggaaagataattcatgagtggtgctgtcgtagttgtacgctgcccccgctgaggttcagaggcgaagatggatgttggtatggtatggaaataagacccgtgaaggaaaaagaagagaatctagtcaggagtatggtatcagccggctctggcgaagtagacagctttagtctcggtctactatgtgtatcaataatgatagaagaggtgatgaggagcagatggagtcgtaagatgttaatgactggaaccctagctgtgttctttttattaataatgggacaattaacttggaacgacctaatcagactgtgtataatggtcggtgccaacgtttcagatcgaatgggtatgggaactacatacctggcattgatggcgacgtttaaaatgagaccaatgtttgccgtgggcttactattcagaagattaacctcacgggaagttctacttctcactatagggctctcgttagtagcctcagttgaattgccaaattcactagaagaattaggcgatggattggcgatgggaattatgatgcttaaactactgactgatttccaatctcatcaattatggactaccttattatcattgactttcataaaaacgacgctatccttggattatgcgtggaaaacgatggcgatggtcttatcaattgttagtctttttcctttatgccttagcacgacctcccagaaaacaacatggcttccagtcttgctaggatcttttggctgcaaaccacttactatgtttttaatcacagaaaacaaaatatggggcagaaaatcgtggcccctaaatgaaggcatcatggcagtaggtattgtgagcattttattatcttctttgttaaagaacgatgtaccactagcaggaccattgatagctggaggcatgcttatagcttgctacgtaatatcgggctcaagtgctgatttaagcctagagcgagcagcagaagtgtcgtgggaagaagaggcagaacatagtggcgctagtcacaatatcttagttgaagtccaagatgatggaacgatgaaaatcaaagacgaagaacgtgatgataccctgactatcctattaaaagcaaccctcttagctgtctctggggtgtatcctatgagtattcctgccaccttgttcgtttggtacttctggcagaagaagaaacagcgatcaggggtcctctgggatacaccctcacctccagaggtagaacgggcagtactcgacgacggaatatacagaatattacagcgcgggttactgggacgaagtcaagtgggtgtaggagtattccaagatggtgtattccatactatgtggcacgtcaccagaggcgcagttttaatgtatcagggcaaaagactagaaccctcgtgggcttctgtcaagaaagatcttataagctacggaggtggttggcgatttcagggatcctggaacaccggtgaggaagtacaagtcatagcagtggaaccaggtaaaaatcctaaaaatgtccaaaccactcctggaacttttaaaacccctgaaggtgaagtaggtgccatagcgcttgattttaaacctggcacatctgggagtccaattgtgaacagagaagggaaaatcgtaggactctacggaaatggtgtcgttaccacatccggaacctatgtgagcgccatagcgcaagcaaaggcctcacaagaaggtccactaccagagatagaggatgaagtatttaagaaaagaaacttaacgattatggatctacacccaggatcaggaaagacaagacgatatctacctgcaattgttcgtgaggctataaaaaggaagctaaggactttaattctagcacctacacgagtagtagcgtctgaaatggcagaggcgctaaaaggaatgcctattcggtatcaaacaacagccgtaaagtcggaacatacgggtaaagagattgttgacttgatgtgtcacgcaaccttcactatgaggctactgtccccagttcgtgttcctaattataatatgattataatggatgaggcgcatttcactgatccggctagtatagctgcccgtgggtatatcagtacgcgagtaggcatgggtgaagcagccgccatatttatgaccgcgacaccgccagggagtgtcgaggctttcccgcagtctaacgcggtaatacaggatgaggaaagagatatacctgagcgttcatggaactcggggtatgattggataacagatttcccaggaaaaacggtttggttcgtgccatccatcaaaagcggaaatgacatcgcaaactgtcttagaaagaatggtaagagagtcatccaactgagtaggaaaaccttcgatacggaatatcaaaagaccaaaaataatgattgggactacgtagtaactactgatatctctgagatgggagcaaatttcagagcagatagggtaatcgacccaagacgctgtctaaaacccgtcattctgaaagacggacctgagagagtaattttagcaggcccaatgcctgtcactgcagcgagcgcggcacaaaggcgagggagaattggtaggaaccaaaataaggaaggagatcaatacatttatatgggacagccattgaataatgatgaagaccatgcacactggaccgaagctaagatgctattagataacataaacactccagaaggaataatcccagccctttttgaaccagaacgagagaaaagcgccgccatagacggtgaatatcgacttcgcggtgaggcgagaaaaacatttgttgagctcatgcgacggggcgatctcccagtgtggctatcgtacaaggttgcctccgaaggttttcaatactctgatcgacgttggtgcttcgatggagaacgtaataatcaagtattagaagaaaacatggatgtagaaatatggacaaaggagggcgagaggaagaaactccgaccaagatggttagatgcacgaacatattcagatccgcttgctttaagagagttcaaagagtttgctgctggacgacgttctgtatcaggagacttaattttagagattggaaaactacctcagcacttaactttacgagcacaaaatgctttagataacttagtcatgctccacaatagtgaacagggaggaaaagcctatagacatgcaatggaagaactgccagacacgatagaaacgctgatgttattagctctaattgctgttttaacgggtggcgtaacacttttctttttgagtgggaaaggtctcggtaaaacatcaataggactactatgcgtaatggcatcaagtgtattactctggatggcctctgttgaacctcattggattgctgcatccatcatattagagttctttttaatggttttactaataccagaaccggatagacaacgtacaccacaagacaaccaattagcatacgtagtgataggtttgttgtttatgatcctaacagtcgcagccaatgaaatgggcctgcttgagactacaaagaaagatctaggcataggacatgttgttgctgaaaaccatcaccatgcaactatgttggatattgatctacacccggcgagtgcatggacactttatgcagtcgccacaaccataattactcctatgatgagacatacaattgagaacactaccgcaaatattagcttgaccgcaattgctaaccaagcagcaatcttaatgggattagataagggatggccaatttcaaagatggatatcggagtacccttgttagcactaggctgctatagccaagtcaacccattaacactaactgcagctgtattaatgttagtagcccattatgcaatcataggccccggactacaggcaaaagcaaccagagaagctcagaaaagaacagcagcgggtataatgaaaaatcctaccgttgacggaatagtagcaatagacttagatcccgttgtttatgacgcaaaatttgaaaagcaattaggacaaattatgttattaattttatgtacaagtcaaattttactaatgcgtacaacttgggcactctgtgagtcaattacattagccactgggccattgaccacgttgtgggaaggcagcccaggaaaattctggaacactacaatcgccgtcagcatggccaacatattcagaggaagctatttggcaggcgctggattagcattctctttgatgaaaagtttaggcggagggaggcgagggacaggagcgcagggagagacactcggtgaaaaatggaagcgccaactaaatcagctctctaaaagcgagttcaatacatacaaaagatcaggcataatggaagtagatagatcagaagccaaggaaggactaaagagaggagaaacgacaaagcacgcagttagccgaggtacggctaaacttcgctggttcgtagagcgaaatcttgtaaaaccagaggggaaagtaattgacttgggatgtggacgcggaggctggagttattattgcgccggacttaaaaaggtcactgaggttaagggttatacaaaagggggaccgggacacgaggaaccaatacctatggctacgtacggatggaacatagttaaacttcattcaggtagagatgtctttttcacgccgcccgaaaagtgtgacaccttattgtgtgacattggagagtcatcaccgaaccctacaatagaagaagggagaacactaagagtcttgaagatggtagaaccatggttacgaggcaaccaattctgtataaagatactgaatccctacatgccaagcgtcgtagaaacactggaacaaatgcaaagaaaacatggcggaatgttagttagaaaccctctgagcagaaatagtacgcacgagatgtattgggtttcatgtggtacaggaaatatcgtttcagctgttaatatgacgagccgaatgttattaaatcgttttactatggcacacaggaaaccgacctacgaaagggacgtggacctaggggcaggaaccaggcacgtcgctgttgaaccggagatagcaaacctcgacatcatagggcaaagaatcgagaatattaaaaacgaacataaaagtacatggcactacgatgaggataacccatataaaacctgggcttaccatggatcatatgaagtaaaacccagcgggtcagcttctagcatggttaacggtgtagtacgattgttaacgaagccttgggatgttattcccatggtgacccaaatagcaatgacggacacaacgccatttggacaacagcgagttttcaaagaaaaagtcgataccagaacaccaagaccaaaacgaggtacagcccagataatggaggtaacagcaaaatggctgtgggggttcctatccaggaataagaaaccgcgtatatgtacaagagaagagttcactagaaaagtgcgttccaacgctgctattggagctgtatttgtggatgagaatcagtggaactcagcaaaggaagccgtagaggatgaacgattttgggatttagtccatagagaacgtgaattacataaacaaggtaaatgcgccacttgcgtctacaacatgatgggcaaacgtgagaagaaacttggagaatttggcaaagcaaaaggtagccgggcaatatggtatatgtggcttggagctagattcttagaatttgaagcattaggattcatgaatgaagaccattggttctcgagagaaaactcattatcaggtgttgaaggagaagggttacataagttaggatatatattacgcgatatttcaaaaataccaggaggtaacatgtacgcagatgatactgccggttgggacactcgaattacggaagacgacctacaaaatgaagctaaaattactgacattatggaaccagaacatgcgctgctagctaccagcatattcaagctaacataccaaaataaggttgttagagtgcaaagacccgcaaaatcgggtacagtaatggatgtaataagtcgcagagatcaacgaggctctggacaagtaggaacgtacggcctgaatactttcacgaatatggaagtacagttaataagacagatggaatcagagggaatattttcaccctctgaactggaaaatagtaatctcgcagaaagagttctagactggctcgaaaaacatggagttgaacgcctaaaacgaatggccatttctggtgacgattgtgtagtaaaaccgaccgatgatcgttttgccacagcactaacagcgctgaatgatatgggcaaagttagaaaagatattccacagtgggaaccaagtaagggatggaatgattggcaacaagtacctttctgcagccatcattttcatcagctaatcatgaaagatggcagagaaattgttgtaccgtgtcgcaatcaagatgaattagtaggccgagctcgtgtttcacagggggcgggatggagcttgcgggaaacagcctgtctcgggaaatcctatgcgcagatgtggcaacttatgtactttcacagacgggatcttcgattagccgctaacgcgatctgtagtgccgttccagtaaattgggtaccaacatcgagaacaacgtggtcgatccatgcacatcaccaatggatgactacggaagatatgttaagcgtttggaatcgagtttggattgaagaaaacccctggatggaagacaaaacgcatgtttccagttgggaagatgtcccttatctagggaaaagagaagatcagtggtgtgggtccttgatcggtttaactgcaagagctacttgggcaacaaatatacaagttgcaataaatcaagtaaggaggctgatcggaaatgaaaattacctagactacatgacatcaatgaaaagatttaagaacgaaagcgatcctgaaggggcattatggtag

SEQ ID NO: 21123 - RNA, 9879 nt, synthetic construct
  misc_feature 1..9879: note = derived and/or modified CDS sequence (opt6) from DENV-1__KX380797__SS-prME
  source 1..9879: mol_type = other RNA
tcagtgactgttttactaatgctgttgcccactgctttggcattccatctaaccactcgagggggagaaccgcatatgatagtatcgaaacaagaaaggggcaaaagtcttttattcaaaacatctactggagtgaatatgtgtacactaatagcaatggatctcggcgaattatgtgaagacacgatgacatataaatgcccccgaattacagaaacggaaccggacgatgtcgattgttggtgcaatgctactgaaacttgggtaacgtatggaacatgcagtcaaacaggagaacatcgcagagataaacgaagtgtagcgttggcgcctcatgtaggacttggactagagacaaggacagagacatggatgtcttctgaaggtgcatggaggcaaatccaaaaagtagaaacctgggcattgaggcatccagggttcaccgttatagcactattccttgctcacgcaatcggtacttcaataacacaaaaaggcatcattttcatattacttatgcttgtaacaccctctatggcaatgcgttgcgttggcatcggcaacagagactttgtagagggattgtcaggtgctacatgggttgacgttgtactcgaacatggtagttgtgtaaccaccatggcgaaagacaaacctacactagatatcgaactactaaaaacggaagttactaacccagcagtcctaagaaaactatgtatcgaagctaaaatctcaaatacaacaacagattctagatgccccacccaaggagaagctactctagtcgaagaacaagatacaaacttcgtgtgcagacggacgcttgtagatagaggttgggggaacgggtgtgggttatttggaaaagggtccctaataacgtgtgcaaaatttaaatgtgtcaccaaacttgaagggaaaatcgtgcaatatgaaaatttaaaatattcagtaatagtaactgttcacaccggagatcaacatcaagttggaaatgaaacaacagaacatggaaccacagcgactattaccccacaagctccaacaagcgaaattcaattaacggactatggcgcgttaactttagattgctctccgagaacaggtctcgatttcaatgagatggtgttgctaacaatgaaagaaaaatcctggttggtacacaaacagtggttccttgatttgccacttccatggacgtctggagctagtacaagtcaagaaacgtggaaccgtcaagacttgcttgtaacttttaaaacagcacacgctaaaaagcaagaggtagttgtactaggatctcaagaaggagctatgcatactgctttgacgggagcgactgagatacaaacgtccggcacgacgactatattcgcaggtcatctaaaatgcaggctaaagatggataaactaacgcttaaaggagtctcctatgtaatgtgcacagggtcgttcaaactcgaaaaagaggtagctgaaactcaacacgggacagtcttagttcaagtaaaatatgaaggcacagatgcaccctgtaaaatacccttcaccagccaagacgaaaaaggagtcacacaaaatggccgactcataacagctaacccgattgtaacggacaaagagaagcccgtaaacatagaagcagaaccacccttcggagagtcttatttagtagtaggcgccggagaaaaagcacttaaactgtcctggttcaagaaagggagtagtataggaaaaatgtttgaagcgacagcaagaggtgcacgaagaatggcaatattgggagatactgcatgggattttggtagcattggtggagtgtttacatctgtagggaaacttattcaccaaattttcggaaccgcatacggagtacttttctccggagtcagctggaccatgaaaataggcattggtatattactcacatggttgggactaaatagtagatcgacatccttgagtatgacttgtatcgcggtggggatggtaaccctatacctgggagtaatggtccaagcggactctggttgtgtaatcaactggaaaggaagagagttaaagtgcggatcgggtattttcgtaacaaatgaagtacatacatggacagagcaatacaagtttcaggccgacagtcctaagagactctctgctgcaatcgggaaggcatgggaagaaggggtatgcgggataagatcagcgacaaggttggaaaatattatgtggaaacaaattagtaatgagcttaatcatatactgttagaaaatgatatgaaattcaccgtcgtggttggggacgtgaatgggatcttagcgcaagggaaaaagatgatacgcccacaacctatggaacataaatatagttggaagtcatggggtaaagcaaaagtaattggtgcagatgtacaaaattcaacatttataattgacggacccaacacacctgaatgtccagatgatcaacgagcatggaacatatgggaagttgaagactacggtttcggaatttttacaacaaatatatggttaaaactcagagatagctatacacaagtgtgcgatcacagacttatgagcgcagcaatcaaagactctaaggcagtacatgccgacatgggatattggatagagtcagaaaagaacgaaacatggaaacttacccgagccagctttatagaagtcaaaacatgcgtatggccaaaatctcacacattatggtcgaatggggtattagaatcggagatgataatacccaaaatttacgggggccctatatcgcaacacaattatcgtcctggatattttacccaaacagcaggtccatggcacttaggaaaacttgaacttgattttggtctctgtgagggaactacagtagtagtggacgagcattgcgggaatcggggtccgagcctgcgaactacaaccgtcacaggcaaaataattcatgagtggtgttgtcgatcttgcactttaccaccgctacggttcaaaggagaagacggttgttggtatggaatggaaatccgtccagtaaaagaaaaagaggagaacctagtaaagagtatggtatctgcgggaagtggagaggtggacagtttttcacttggtttactttgtatatctattatgatcgaagaagtaatgagaagtaggtggtctagaaaaatgttaatgaccggcaccttagcagttttcctactattaattatgggtcaactaacatggaatgatctaatacgtttgtgcatcatggtcggggccaatgcatcggataaaatggggatgggtacaacatacctagcactcatggccaccttccgaatgagaccaatgtttgctgtcggattactattcagaagattgacttcacgagaagtactattacgtagtgttggtttgtcgcttgtagctagcgtcgagcttccaaactccttggaagagttgggagatggacttgctatgggaataatgatgttaaaattgctaacagatttccagtcacaccagttatgggcagctttactctcccttacttttgtcaaaaccacattctcattacattatgcctggaaaacgatggcaatgatattatcaatagtttcattatttcccctctgtttatccactacgagtcaaaagacaacatggctcccagtacttctaggatcgttaggatgtaaaccgctgacgatgtttctaattacagaaaacaagatttggggtagaaaaagttggccccttaatgagggtatcatggccgttggcatagtgtcgatactactatccagcctcttaaagaatgacgtcccacttgctgggccgttaattgcaggagggatgttaattgcatgctatgtaatttcagggtcaagtgcagatctcagcttagaaaaagcggcagaagtatcatgggaagaggaggctgagcatagcggtgcctcacataatattcttgtggaagttcaggacgacggaaccatgaagattaaagatgaagaacgcgatgatacccttacgattttactaaaagcaactttactggcaattagtggagtctaccccatgagtatccccgctactctttttgtatggtatttttggcagaagaagaaacaaagatcaggggttctatgggatacacctagtccccctgaagtcgagcgggcagtactagatgacgggatatacagaatattgcaaagaggattgcttggtaaaagccaagtaggtgttggtgtctttcaagagggtgtatttcacactatgtggcatgtgacgcggggtgcggttctgatgtatcaaggtaaacgattggaaccctcatgggcaagcgttaagaaagatctaatatcttatggaggaggatggcgttttcaaggatcgtggaatacaggggaggaggtacaagtgatagcggtagagcccggtaaaaacccaaagaatgtacagactgcaccaggtaccttcaaaacaccagagggagaagtcggggcaatagcgttagattttaaaccaggaacatcaggaagcccgattgtaaatagagaaggaaaaatagtcggtttatatggaaatggagtggtaactacaagcggtacatatgtatcagcaatagcacaagccaaagcatcccaagaaggcccattaccagaaatagaagacgaggtatttcgcaagagaaatttgacaataatggacttgcatcctggcagcggaaaaacaagaagatacctaccagcgatcgtccgtgaagcaatcaagagaaaattacggacgctagtattagcgcccactagagtagtggcatccgaaatggctgaggcacttaaaggaatgccaattaggtaccaaactaccgctgtaaaaagcgagcataccggaaaagaaatcgtcgacttaatgtgtcacgccacttttacaatgagattattaagtccagtcagagtacctaattataacatgataataatggacgaagcacactttacagatcctgcttcaattgcagcgcgagggtacatctctacaagagtaggaatgggagaggcagctgccatatttatgaccgccactcctccaggctcgatggaagcattccctcaatctaatgcagctatacaagatgaagaaagagatataccagagcgctcttggaactcgggatacgattggatcactgatttcccgggcaaaactgtatggttcgtaccatcaataaagtcaggcaacgatatcgctaattgccttaggaaaaatggaaaacgagttgtgcagttatctcgaaagacatttgacactgaatatcagaaaactaaaaacaatgattgggattacgtggtaacaacagacatatcggaaatgggcgcaaacttcagagctgaccgtgttatagaccctagaaggtgtttaaaacctgttattctcaaagacggccctgaacgtgtcatcctagcgggaccaatgcctgtcaccgtagccagcgcggctcaaagacggggacgtattggtagaaatcaaaacaaagaaggagaccagtatatttacatgggacaaccactaaataacgatgaagatcacgcacactggacggaagcaaaaatgctcttagacaacatcaatacaccggaagggataataccagcattattcgagcccgaacgcgaaaaatcagcagcaatagacggtgaataccgcctacggggtgaagcacgaaaaacgttcgtagaattgatgagaagaggagacttacctgtatggctatcttacaaggtagcatccgagggtttccaatatagtgacaggagatggtgttttgatggagaaaggaataaccaagttctagaagaaaacatggacgttgaaatctggacaaaagagggtgagaggaagaaattacgtcctcgatggctcgatgcacgtacctatagtgacccattggcgctgagagaatttaaagaatttgcagctggaagacggtcagtgagcggtgatctaattctagaaatagggaaacttccccagcatctaacccaaagggcccaaaacgcactggataatctggtgatgctacataattctgaacagggtggtaaagcgtatagacatgcaatggaagaattacctgacacgatagagaccctcatgctacttgcgctaattgctgtacttacaggcggcgtcacgttattctttctgagtggaaggggcctcggaaagacaagtataggtctcttgtgtgtaatggcttcgtcagcgttgctatggatggcaagtgtagaaccgcactggatcgcggcatcgattatactagagttcttcttgatggtcctattaatacctgaaccagatcgtcaacggacgccacaagacaaccagcttgcatacgtagtaataggtctactgtttatgatattgaccgtagccgcaaacgaaatgggactacttgaaacgaccaagaaagacttaggtatcggacatgtggcggctgagagtcaccaccatgcagcaatgctagatgtcgatctgcacccagcatcagcatggaccctatatgcagtagctaccacgataataacacctatgatgaggcatacaatagaaaatactactgcaaacatcagcttaaccgcaattgctaatcaagcagcgatactaatgggtttggataaaggctggccaataagcaaaatggatataggcgtgccgctattagctctgggatgttatagtcaagttaatcctttaactttaaccgccgctgtattaatgctagtcgcacactatgcaataataggtccgggtttacaggccaaagctacacgagaagctcagaaaagaactgcagcaggaattatgaagaatcctacagtagacggaatcgtagctatagatctagatccagtcgtatatgatgcaaaatttgaaaaacaactaggacaaataatgcttttgatattatgtacaagccaaatattattaatgcgtacaacgtgggctttgtgtgaatccataactttagccacgggacctttaacaactttatgggagggttcaccaggtaaattctggaatactacaatagcagtttcaatggctaacatatttagaggtagttatctagccggtgctgggttagctttttcgttaatgaagtccctcggaggtgggcgtcgaggaacaggtgcacaaggagagactctcggagagaaatggaaacgccaactaaatcaattaacaaaaagtgaatttaatacatataaacggtcagggataatcgaagttgacaggagtgaagcgaaggaaggtttaaaaagaggagaaacgactaaacatgcagttagtcgagggaccgcaaaacttagatggttcgtcgagcgtaacttagtgaagccagaaggtaaggtcatcgaccttggatgcggaagaggagggtggtcatactattgcgccggactaaagaaagttacagaagtaaaaggatacactaaaggtggcccggggcatgaagaaccaattcctatggctacctacggatggaatttggtcaaactttatagtggcaaagacgtattctttacacctcctgaaaaatgcgatacgttactatgtgatataggcgaaagtagcccaaatccaacaatcgaggagggaagaacgttaagagtactaaaaatggtagaaccctggcttcgtgggaaccaattttgtattaaggtacttaacccatatatgccgtcggtggttgaaactctcgagcaaatgcaaagaaaacacggtggcatgctagtgagaaatcctctctctagaaactcaacacacgagatgtactgggtaagttgtggcactggaaacatagtgagcgcggttaatatgacaagtagaatgctgcttaacagatttaccatggctcaccgtaaacctacttatgaaagagatgttgatcttggcgcaggaacccgtcatgtggcagttgaaccagaagttgcgaacttagatatcataggtcagcgaattgaaaacatcaagaacgaacacaaatctacatggcattatgatgaagataatccctataaaacttgggcctatcatggatcttatgaagtcaaaccttcaggttccgcgtcgagtatggttaatggagtcgtaagattattaacaaaaccttgggatgttataccgatggttacacaaatagccatgacagatacgacaccgtttgggcaacaaagagtatttaaagaaaaagttgatactcgcaccccaaaggcaaaacgcggcacagcccagataatggaagtaactgcacgctggttatggggattcttgagtcgcaataagaaaccacggatctgtactagggaagaatttacacgaaaagtacgatctaacgcagccattggggcggtgttcgtcgatgaaaatcaatggaactcagccaaagaggccgtcgaagatgaacgattttgggacttagtgcatcgggaacgagaacttcacaaacaaggtaagtgtgcaacgtgtgtatataacatgatgggtaaaagggaaaagaaactaggtgagttcgggaaagcaaaaggatcgagggcgatatggtatatgtggcttggagctcgctttctggagtttgaagcattggggtttatgaacgaggatcactggttctcacgagaaaattcattgagtggggttgaaggtgaaggtcttcacaagctggggtacattttacgtgacatctcgaagatcccgggaggtaatatgtacgcagacgacacagcaggatgggatacccgtataacagaagacgacttacagaacgaagctaaaataacagacataatggagcctgaacatgctttgctagcaactagcatattcaagctaacttaccagaacaaagtagtccgggtacaacggccagccaaaaacggcactgttatggatgttatatcccgtcgggaccaaagaggaagcggacaagtagggacctacggacttaatacgtttacaaacatggaggcacaattaattaggcaaatggaaagtgaaggcatctttctaccaagtgaattagagactccaaatttggcagagagagtactcgattggttagaaaaatatggcatcgagagattaaaaagaatggctatcagtggcgatgattgcgtcgtcaaaccagtggatgaccgatttgcaacagcccttacagccctgaatgacatgggaaaagtaagaaaggacataccacaatgggaacctagcaagggctggaacgattggcaacaagtcccattttgctcccatcactttcaccaactcattatgaaagacggacgagagatcgtagtgccttgcagaaatcaagacgagctagtaggtcgtgcgagggtaagtcagggcgcgggatggtcactcagagagacggcatgtctgggaaaatcatacgcccagatgtggcagctaatgtattttcatcgacgtgatcttcgactcgcggcaaacgccatatgctcggcagtacccgtagactgggtacctacttcacgcactacatggagtattcacgctcaccaccaatggatgactactgaagacatgctttcggtatggaatcgagtatggatagaagaaaatccatggatggaagataaaacgcatgtctcaagttgggaagatgtgccgtatctcggtaaacgtgaggaccaatggtgtgggtcattaataggcttaacggcaagggcaacttgggctaccaatattcaggtagcaattaaccaagttcgtcgcttaataggtaatgaaaactacctggattacatgacatcaatgaaacgtttcaaaaacgaatcagatccagaaggggcattatggtaa

SEQ ID NO: 21124 - RNA, 9879 nt, synthetic construct
  misc_feature 1..9879: note = derived and/or modified CDS sequence (opt6) from DENV-1__KX380805__SS-prME
  source 1..9879: mol_type = other RNA
agcgttactatgttactaatgttattgcccactgctcttgcgtttcatctcacaacacggggtggggaaccgcatatgattgtatcaaaacaagaacgtggaaaaagtttattgtttaaaacctctgcgggcgttaacatgtgtaccctcatagctatggatctaggagaactatgtgaagataccatgacatataaatgtccccgaataactgaggcagaaccagatgacgtagattgttggtgcaatgctacggatacttgggtaacttacggaacatgctcacaaactggtgaacaccgacgagataaacgatcagtagctctagcgccacatgtagggttaggattagagacaaggactgagacttggatgtcctcggaaggagcatggaggcaaatacaaaaagtggaaacatgggcacttcggcacccaggctttacagtcatagctttgtttttagcacatgcgatagggacttcaattacgcaaaaaggtataatttttatactgctaatgcttgtcacgccaagtatggcaatgaggtgcgtaggtataggtaaccgagattttgtcgaaggactgagcggagcaacatgggtagatgtggttttagaacatggaagctgtgtgactacaatggccaaaaataaaccaacattggacattgaattactaaaaacagaagtaactaacccagccgtattacggaaattgtgcatagaagcaaaaattagtaataccacgactgactcacggtgtccaactcaaggagaggcaactttagtagaagaacaagatgccaattttgtgtgtcgacgcacgtttgttgatcgaggctggggtaatgggtgcgggctatttgggaaagggtctcttttgacatgtgcaaaattcaaatgtgtaactaaacttgaaggaaaaatagtccaatatgaaaacctaaaatattcggtgattgtaactgtgcatactggagaccaacatcaagttggcaatgaaaccactgaacatggtaccatcgcaaccataactccgcaggcacctacgtcggaaatacaactaacagattacggtgcacttaccctggattgcagtcccagaactggactagattttaacgaaatggtcttgcttactatgaaagagaaaagctggttagttcataaacaatggtttttagaccttccactaccttggacaagcggagctagtacatcacaggagacttggaatagacaagatctcttagtaacattcaaaaccgcacatgctaagaaacaagaggtcgtagttttaggttcacaagaaggtgccatgcatacggcactaacaggtgcaacagaaatccagacttcaggtacgactaccatcttcgcgggtcacttaaaatgccgattgaaaatggataaacttacgttaaaaggtgtaagctacgttatgtgcaccgggtccttcaaattagaaaaagaggttgcagaaactcaacatggtaccgttctagtacaagtaaaatatgaaggaactgatgctccgtgtaaaattcccatttcaactcaagacgaaaaaggagtaactcaaaacggcagattaataactgcaaatccaatagtgacggataaagaaaaacctgttaatatagaaacagaaccaccgttcggcgaatcatatatagtcattggagctggagaaaaagcactaaaactgtcttggttcaagaaaggctcctccatagggaaaatgttcgaagcaacagcacgcggagccagaagaatggcaatcctaggtgataccgcttgggattttggaagtataggcggagtgtttacgtcagttggaaagttagtacatcaagtatttggaaccgcatacggcgttttattttctggagtgagctggacaatgaagataggtatcgggatcttattaacatggctaggacttaattctcgatcaacctcgttaagcatgacatgtatcgctgtaggcatggtcacactatacttaggagtaatggtacaagcagattcagggtgcgtcattaattggaaagggcgtgagttaaaatgcggatcaggtattttcgttactaatgaagtacatacgtggacagaacaatataaattccaggcggactctccaaaacggctatccgcagcaataggcaaggcttgggaggaaggggtatgtggaatacgaagcgctacccgactagagaacattatgtggaagcagatcagcaatgaattgaaccacatactattggagaatgatatgaaatttacagtcgttgtaggcgatgcaaatggaatacttacacaaggcaagaaaatgatcagaccacagcccatggagcacaaatactcttggaagagttggggaaaagcgaagataattggagcagacacccaaaacactacatttataattgacggacctgataccccggaatgcccggatgatcagcgtgcttggaatatatgggaggttgaagactacgggttcggagtattcaccaccaatatttggcttaagctccgagactcatatacacaaatgtgtgaccataggctaatgagtgcggcgataaaggactccaaagctgtacatgccgatatgggttactggattgaaagcgagaaaaatgaaacgtggaagttagctcgagcaagtttcatcgaagtcaaaacctgtatttggccaaggtcacacactctttggtcaaatggagttttggaaagtgaaatgatcataccaaaaatctacggtgggccgattagccaacataattatagaccaggatattttacacagactgccggaccatggcacctaggaaagctagaattagactttaatctatgcgaaggtacaactgttgtggtcgatgagcactgtggaaaccgaggacctagtctcaggaccactactgttaccggaaaaataatccatgagtggtgttgccgaagctgtacattgccacccttaagattccgcggtgaagacggatgttggtatgggatggaaatcagaccagtaaaagaaaaggaggaaaatttagtacgaagtatggtctctgccgggtcgggcgaggtggattcttttagtctgggcctactaagtgtctccattatgattgaagaagtcatgcgttcgagatggtcaaggaaaatgcttatgactgggacattagctgtattctttttactaatcatgggacaattgacatggaatgacctaatacgactgtgtataatggtaggtgccaacgttagtgaccggatgggcatgggtacaacctaccttgcattaatggctacctttaagatgcgacctatgtttgcggtaggattattgtttcggagactgacatcgcgtgaagtattgctattaactataggattgtcactcgtcgcgtccgtagaactacctaattcccttgaggaactaggagacggacttgcaatgggaataatgatgcttaaacttctaaccgactttcaatcgcatcaattatggacgaccctattgtcattgaccttcataaaaactacactatccctagactatgcatggaagaccatggcgatggtgctatcaatagtctccctatttccactctgtctatcaactacgagtcaaaagacaacctggctgccagttcttttaggtagctttggatgtaaacctctaacaatgttccttatcacggaaaataaaatatggggtagaaaaagttggccactaaacgaaggcatcatggctgtaggaatagtgagtatacttttgagttcactgctgaaaaatgatgtaccactagcagggccactaatagcaggcggaatgctgatcgcctgctatgttataagtgggtcaagcgcggacttatccttagaacgggctgcggaagtgagctgggaagaagaagctgaacacagtggggcatcacataatatcctagtagaggtccaggatgacggtacgatgaaaataaaagacgaggagagagacgacactctcacaatactactaaaagcaactttactggccgtctccggtgtctacccgatgagtataccagccacacttttcgtctggtatttctggcagaagaagaaacaacggtcgggagttttatgggacacgccaagtcctccggaagttgaaagggcggttttagatgatgggatatatcgaattttacaacgtggtttactaggacgaagccaggtgggcgtaggagtattccaagacggggtcttccatacaatgtggcatgtgacacgaggagcggtattgatgtatcaaggaaaacgacttgagccatcatgggcaagcgtcaagaaagatcttatttcatacgggggaggttggcgctttcaaggaagctggaataccggagaagaagtgcaagtaatagcagtggagcccggtaagaaccccaaaaacgttcagacaactcccggtacatttaaaacaccggaaggcgaagtaggagcgattgcactcgactttaaaccggggacttcaggctcgcccattgttaacagagaggggaaaatagtcgggttgtacggaaatggagtagtgactacatcaggtacgtatgtatcagccatcgcacaggctaaggcgtcgcaagagggacctttaccagagatagaagatgaggtatttaagaagagaaacttaacaatcatggatttgcatccaggaagcggaaaaactagaagatatctaccggctatagtcagagaagctattaagaggaaattacgcaccctcatattagcaccaacaagagtagtagcgagcgaaatggcggaagctcttaagggtatgccaataagataccagactaccgccgtaaaatcagaacataccggtaaggaaattgtggacttaatgtgtcacgcgaccttcacgatgaggctattatcacctgtaagagtccctaattataacatgattataatggacgaggcacatttcacagatccagcttcaatagcagctcgtggatatataagcacgagagtgggaatgggagaagctgcagccatattcatgacagcaacaccccctggcagcgtcgaggcttttccgcagtcaaatgcagtaatacaagatgaagaaagggacataccagaaagaagttggaacagtggatatgattggattaccgactttccaggcaagactgtttggttcgttccttctattaaaagcggtaatgatattgccaactgtttaaggaaaaacggaaagagggtaatacagctctcaagaaagacttttgacacagaatatcagaaaactaagaacaatgattgggattacgtagtaacaactgatatcagcgagatgggggctaattttagagccgacagagttattgatccaagacggtgcttaaaacccgtaatattaaaagatggacccgagagagtaatcctagctggccctatgccagtaacagccgcttcagcggcgcaacgtaggggaagaattggaaggaaccaaaacaaagaaggagaccaatatatttacatgggtcaaccattaaacaatgacgaagatcatgcgcattggactgaggcaaaaatgctgttagacaatatcaacacaccagaaggaatcataccagccttatttgaacccgaacgagagaaatccgccgcaatagatggggaatacagacttaggggagaagcgcgaaagaccttcgtcgaattaatgagacgtggagacttacctgtatggctttcatacaaggtggcaagcgaagggttccaatacagcgaccgaagatggtgctttgacggtgaaagaaataaccaagtgctagaggagaacatggatgtggaaatatggaccaaagaaggagaaagaaagaaactccgaccaaggtggttagatgctagaacatacagtgatccactagcgctgagagaatttaaagaatttgcagccgggagacgtagtgtaagcggagatcttatcctagaaataggtaaattgccacagcatctaaccttaagagcacaaaatgcattagacaatctcgttatgttacacaactcagaacaaggtggtaaagcatatcgtcacgctatggaggaactgcccgatacaatcgagaccttaatgctgttagcactaatagcagtattaacaggaggggttactttgttctttctatcaggtaaggggttggggaaaacgagtatcgggttattgtgcgtcatggcctcttctgtattactttggatggcctcagtagaaccccactggattgcagcaagcatcatattggagttctttttgatggttttattaattcctgagcctgacaggcaaagaacaccacaagataatcaactcgcgtatgtcgttatcggtttactattcatgatcctaacagtcgcagctaacgagatggggttactagagactaccaagaaagatctagggataggacatgttgttgctgagaatcaccaccatgcaacaatgttggacattgatcttcatcctgcatcagcttggacattatatgctgtagctaccacaataattacccccatgatgagacataccatagaaaataccacggcgaatatctcgctcacagctattgcaaaccaagcagctatactcatggggctagataaaggttggcctatctcgaaaatggacattggcgtaccgctattagcattaggatgctatagccaagttaatccactaacactaactgctgccgtattaatgcttgttgcgcattatgcaatcatcggtcctggattgcaagcaaaagccacgagagaagctcaaaagagaaccgccgcggggattatgaaaaatcccaccgtagacggaatagtagctatagacttggatccagtagtttatgatgcaaagttcgaaaaacaattaggacaaatcatgcttttgatactgtgcacaagtcaaatcttactgatgaggacaacctgggcgctgtgtgagtcaataactttagccacaggaccactaactacattgtgggaaggttccccaggtaaattttggaatacaacaatagccgtctcaatggctaatatctttcgagggagctatctcgccggtgctggactggctttttctcttatgaaatcattagggggaggaagaagaggaacaggggctcaaggcgaaacattaggtgaaaaatggaaaagacaactaaatcaactctcaaagtctgagttcaatacgtataaacgatccgggataatggaagttgacagaagtgaagctaaggaaggtttaaaaagaggggaaactaccaagcatgccgtaagccgcggcacggccaagttaagatggtttgtcgaacgaaatttagtcaagccggaaggtaaagtaattgacctagggtgcggaagagggggatggagttactattgtgcgggtcttaagaaagttacagaggttaaaggatatacaaaaggaggaccaggccacgaagaacccataccaatggccacttacggttggaacatagtcaaacttcattcgggaagagatgttttctttaccccgccagagaaatgcgatacactcttatgtgatattggagagtctagtcctaaccccactattgaagagggtagaacattacgcgtactgaaaatggtcgagccttggctcagaggcaatcaattctgtataaaaatactgaatccatacatgccatcagtagtagaaactttagaacaaatgcaaaggaaacatggaggaatgttagttagaaaccctctcagccgtaactcaactcatgagatgtattgggtttcttgtggtacaggtaacatcgtttcagcagtaaatatgactagccgaatgctattaaatcgcttcaccatggctcatagaaaaccaacgtatgagcgcgacgtggacctaggagcaggtacaagacatgtcgcggtagaaccggagattgctaacttagacataatagggcaaagaatagaaaatattaaaaatgagcataaaagtacatggcactatgacgaagataacccgtataaaacgtgggcgtatcatggatcatatgaagtgaaaccatcggggtccgcgtctagtatggttaacggcgtagtgcgactactaacaaaaccttgggatgttataccgatggtgacacaaatcgcaatgactgatacgacacctttcggccaacagagagtttttaaagaaaaggtagataccagaacaccccgaccaaaaagaggcacggcccaaataatggaagttacagccaagtggctatggggatttttgtcacgtaataagaaaccccgtatctgtacaagggaagagtttacgcgcaaagtaagatccaatgccgccataggagcggtttttgtagatgaaaaccagtggaactcagcaaaagaagctgtggaagatgaacgtttctgggatctggtacatagagaaagagaattacataagcaaggaaagtgtgcaacttgcgtctacaacatgatggggaaacgagagaagaaactaggagaatttggtaaagcaaaggggtcacgagccatatggtacatgtggctaggagcgcggtttttagagtttgaggctctaggcttcatgaacgaagatcattggttttctagagaaaactccctatctggcgtagagggtgaaggacttcacaaactcggctatattctaagagatatctcaaagatcccgggtggcaacatgtatgctgacgataccgcaggctgggacacgagaataacggaagacgatttgcaaaacgaagccaagatcacagatataatggagccagaacatgcattattggcaacatcgatatttaaacttacttatcaaaacaaggttgtcagggtgcagagacctgcaaaaagcggaaccgtgatggatgtcataagtcgtcgagatcagcgaggatctggacaggtgggcacttatggcctaaatacatttacgaatatggaagtacagcttataagacagatggagtctgaagggatattttcaccctctgaactagaaaatagtaatttagccgagcgtgtattggattggttagaaaaacatggagttgaaaggttaaaaagaatggcaatatcaggcgacgattgcgtggttaaaccaaccgacgatagattcgcgaccgcgcttacggctttaaatgacatgggcaaagtacgaaaagacataccacaatgggagcccagtaaaggctggaatgattggcaacaagtaccattttgttcacaccatttccatcaacttataatgaaagacggacgagaaatagtcgtaccatgtaggaatcaagatgagttggtcgggcgagcacgagtttcacagggagcaggctggtcactaagggaaactgcatgtcttggtaaatcatatgcccaaatgtggcaacttatgtatttccatagacgagatctgagacttgccgctaacgctatttgcagtgctgttccggtcaattgggtaccaacaagtagaacaacatggtctattcatgcgcaccatcaatggatgacaacagaagatatgctatcagtctggaaccgggtctggatagaagagaatccatggatggaagacaaaactcatgtgtcaagctgggaagacgtaccttatcttgggaaaagagaagaccaatggtgtggttctttgataggattaactgcccgggctacatgggcaactaatatacaggtagctataaaccaagttcgacgcttaatcgggaatgaaaattacttagactatatgacttcaatgaagagatttaaaaatgaaagcgatccagaaggagccctctggtaa

SEQ ID NO: 21125 - RNA, 9879 nt, synthetic construct
  misc_feature 1..9879: note = derived and/or modified CDS sequence (opt6) from DENV-1__KX380798__SS-prME
  source 1..9879: mol_type = other RNA
tctgtaactatgttactaatgttaatgccaacggcactagcctttcatttaacgacgcgtggaggtgaaccgcatatgatagtatccaaacaagaacgaggaaaatccctattatttaaaaccagcgcgggagtaaatatgtgcacgctaattgcaatggacttaggagaactttgcgaagatactatgacttataaatgtccaagaataactgaagcagaacctgatgatgtcgattgctggtgcaacgctaccgatacgtgggtcacgtatgggacatgttcgcaaacaggagaacatcgcagagataaaagatcggtcgcactggcgccgcatgttggtttaggtttagaaacacggacagaaacttggatgtcttcggaaggagcttggaaacagattcaaagagtcgaaacttgggccttaagacatcccggattcactgtaattgcactgtttttggcacatgcgattggtacttctataactcaaaaagggataatttttattctacttatgttagttacacctagtatggctatgagatgtgtgggaatcggatcaagagatttcgttgaaggtttaagtggtgctacatgggtagacgtagtgttagaacacggaagttgcgtaaccacaatggctaaagataaaccgactttagacatagaactattaaaaacggaagtgacaaacccagcaatattgaggaaattgtgtatcgaagcaaaaataagtaatacaacaacagacagtcgctgtcccactcaaggtgaagctaccttagttgaagaacaagatgcaaatttcgtgtgtagaagaacatttgtcgacagaggttggggtaacgggtgcggcctatttgggaaaggttccctaataacatgcgcaaaatttaaatgtgtaacaaaattggaaggtaaaatagtacaatacgaaaatctaaaatatagtgtgatagtcactgtgcacaccggtgaccaacatcaggtgggtaatgaatcaacggagcatggaacaacggcaactattacaccacaagcaccaactacagaaatccaactaacggattacggagcccttacccttgactgctcacccagaacgggcctagactttaatgagatggtcttgctaacaatgaaagaaaaatcttggttggtacacaaacaatggtttcttgacttacctctaccgtggacatctggtgcttctacttcgcaggaaacatggaaccggcaagacttattggttaccttcaaaacagcccatgctaagaaacaggaagtcgtcgtcctaggaagccaagaaggagcaatgcacactgctctaacaggcgcgactgaaatccaaacatcaggaacgactactatttttgccggccatttgaaatgcaggttaaaaatggacaaacttaccttaaaaggcatgtcatatgttatgtgcaccggcagtttcaagctcgaaaaggaagtcgctgagacccagcacggtactgtcttagtacaaattaaatacgaaggaacggatgcaccttgtaaaataccattttctacccaggacgaaaaaggtgtgacgcagaacggtcgactaataactgctaaccctatagttactgacaaagagaaaccagtgaatatagaagctgagcctccattcggtgaaagttatattgttataggtgcaggggaaaaggctttaaaattaagttggtttaagaaaggatcctctatagggaaaatgtttgaagcgacggcgcgtggggcacggcggatggcgatactaggtgacactgcatgggatttcggatccataggaggagtgtttacttctgttggaaaattagttcatcaaatatttgggacagcatatggcgtacttttctctggagttagctggacaatgaaaatcggaataggtgtactgttgacatggctaggattaaactccaggtcaacgtctttaagtatgacatgcatagccgtgggactcgtaacactatacttaggagtgatggttcaagcagactcaggatgtgttattaattggaaaggacgagaactgaagtgcggctcgggaattttcgtcactaacgaagtgcacacatggactgaacagtataaattccaggcagattccccaaagagactatctgccgccataggtaaagcctgggaagaaggggtatgcggaatacgctctgcgacgcgccttgagaacataatgtggaaacaaatatcaaatgaactaaaccacatactgctagaaaacgatatgaaattcacggtagttgtgggtgatgttgccggaatattagcacagggcaagaaaatgattcgcccccaaccaatggaatataaatatagctggaaatcctggggcaaggcaaaaataattggggctgatgtccaaaatacaactttcataatagacggaccaaacacaccagaatgtccagacgatcagagggcgtggaatatctgggaggttgaagattatggatttggcatatttaccactaatatctggcttaaattaagagatagttatacccaagtctgtgatcatcgtctgatgagtgcggcaataaaggacagcaaagcagttcacgcagacatggggtattggatcgaatccgagaaaaacgaaacttggaagctagcacgagcctcgtttatagaagtaaaaacgtgcatatggccaaaatcccatactctctggtccaacggtgtcctagaaagtgagatgataataccaaaaatttatggaggaccaattagtcaacacaattaccgaccggggtattttacacaaactgccggcccttggcatttgggtaagctagaattagactttgatttatgcgaaggaacaaccgtcgtagtagatgaacactgtgggaatcgagggccttcactacgtacaacaacagtaaccggaaaaataatccacgaatggtgctgtaggagctgtacattaccccctctaagatttagaggagaagacggttgctggtatggaatggaaataaggccggtcaaggaaaaagaagaaaatctggtaaaatcaatggtctcagctggaagtggcgaagtagattcattctctcttggtttactctgcattagtatcatgatagaagaagttatgcgttcgcgttggagccggaagatgctcatgacaggcactcttgcagtttttctcttgttgataatgggccaacttacctggaatgatttgatccgactttgtattatggtaggggcgaatgcatcagatagaatgggaatgggtactacatatctagcgttgatggctacctttaaaatgcgaccaatgtttgccgtcggactactatttcgtcgtttaacttcacgggaagtactactgttaacgataggactaagtcttgtagcatccgtcgaattaccaaactcacttgaagaactgggggacggtttggcaatgggaataatgatactaaagctgctcacggattttcagagtcatcagctctgggcaacattattatcactgacatttatcaaaaccacattttctctccactatgcgtggaagacaatggcgatggtgctgtctatagtgagtctattcccactttgtttgagcacaacctcacagaaaaccacctggctgcctgtactactgggttctcttgggtgtaagccgcttacgatgttccttatagctgaaaataaaatatggggtcgtcgcagttggcccttaaatgaagggataatggcagtaggaatagtctctatattgttgtccagcctacttaaaaacgacgtgccactagctggtccacttatagctggtggaatgttaatagcttgttatgttatatctggtagtagcgcggacctgagccttgaaaaagcagctgaagttagctgggaagaagaggccgagcatagtggtgcatcacacaacattttggttgaagtacaagacgacggaactatgaagatcaaggacgaagaaagagatgatacactaacaattttgttaaaagctacgcttctggcagtcagtggggtatatcctctaagtataccagcaactctatttgtatggtatttctggcaaaagaagaaacaacgttccggagttctctgggataccccgagcccacccgaagttgaacgcgcagttttagacgatggaatatacagaattatgcaacgcggattattagggagatctcaagtcggtgtaggagtctttcaagagaacgttttccatactatgtggcatgtaacccgaggagctgtcttaatgtatcaaggaaaaagattagagcccagttgggccagcgttaagaaagacttaatcagttatggtggaggttggaggctacaagggagttggaacacaggtgaagaggttcaggtaattgcagtcgaaccaggcaaaaaccccaaaaatgtccaaactgccccaggaacattcaaaacgcctgaaggggaagttggagcaatagcattggattttaaacccggaacatcggggtcgcctattgtaaacagagagggaaaaatcgtcgggctctatggcaatggagtggtgacaacgtctggaacgtacgtcagcgcgatagcacaggcaaaggcatcgcaagaaggccccttaccggagatagaagacgaggttttcaggaaaagaaacttgactataatggatttacatcccggaagtgggaagacgagacgatatctgccagcgatagtgagggaagcaataaaaagaaaactgcgaacattgatcttggctccgacacgtgtagttgcatctgaaatggctgaagcacttaaaggaatgccaattaggtaccagaccacagcagtaaaaagtgaacacactggcaaggaaatcgtagatttgatgtgccacgcgacttttactatgagactcttaagccccgtaagagttccaaactacaacatgattatcatggatgaagctcatttcacagatccatctagtatagcagcacgaggatatatatcaactagagttggaatgggagaagcagcagcaatattcatgactgctacccctccagggtccgttgaggcttttccacaatcaaatgcagttatccaagatgaagaacgtgatatacccgagagaagttggaactcgggatatgagtggatcaccgactttccaggtaaaactgtttggttcgtcccatcaataaaatctggtaatgatattgcaaattgcttacggaaaaacggtaaaagagtaattcaattgtctcggaaaacatttgataccgaataccaaaagacgaaaaataacgattgggattacgtagtcaccactgatatctccgaaatgggggcgaattttcgagcggatcgtgtaatagacccccgtcgatgtttaaaaccagtaatcttgaaagacggcccagaaagggtaattctagccggtccgatgcccgtaacagtggcatcagctgcccagcgaagaggtagaattggtcgaaatcacaacaaagaaggcgatcaatacatatacatgggacagccacttaataatgacgaagatcatgcgcattggacagaagcaaagatgctcttagataacattaatacaccggaaggaatcattccagcattattcgaacctgaacgtgagaaaagcgctgcgatcgacggagagtaccgattacgcggagaagccagaaaaacctttgtagaattgatgagacggggagatttgcctgtttggcttagttataaggtagcctcagaaggttttcaatatagtgatcgaagatggtgctttgatggcgaaagaaataaccaggttttagaagagaacatggacgtagagatatggacaaaagaaggagaacggaagaagctacgccctcgatggctcgatgcacggacttacagtgacccacttgcgttgcgggagtttaaagaatttgctgcaggcaggcgaagtgtatcaggcgatctgattttagagattggcaaacttccccaacatctaacacaacgtgcacagaacgcactagataacctcgtaatgttacataatagcgagcaaggaggcagggcgtatcgacacgcgatggaagaattacctgatacaatagagaccctaatgctcctggctctcatagccgtattgactgggggcgtaacattattctttttaagtggacggggattaggaaaaacgtcaataggactactatgcgtcatggcatccagcgtacttttatggatggccagtgttgagccgcattggattgctgctagtataattcttgagttctttttaatggtattattaatacccgaaccggacaggcaacgtacgcctcaagataatcaactggcttatgttgtaatcgggttactatttatgatacttaccgtcgctgccaatgaaatgggacttctcgaaacaactaaaaaggatctgggcattggccacgtggccgtcggcaaccatcaccacgcagccatgttagatgtagatctccaccctgcaagcgcatggacactatatgccgttgcgacaacaatcataacacccatgatgagacatactattgaaaatacaacagcaaacatctctttaacagcaattgcaaatcaagccgcaatcctaatgggcttagacaaaggatggcccatatcaaagatggatataggcgtacccttgcttgctctaggttgttatagccaagttaatccactaactctaaccgctgcagtcttaatgttggtagctcactatgctataataggacccggattgcaagccaaagccacaagagaagcacagaaaagaacagcggcaggaataatgaagaacccaacagtcgacgggatagtagcaatcgacttagacccggtagtctatgatgcaaaatttgaaaaacaactaggccaaatcatgttgttaatcctatgtacttcacaaattcttttaatgagaacgacttgggctttatgcgaaagtattacattagcaactggtcccctcacgacactctgggaaggatctccgggaaaattctggaacacaaccattgcagtatcaatggccaacatttttagaggttcgtatttggcgggagcggggttggcctttagtctaatgaaatctttaggtgggggtagacgagggacgggcgcacaaggtgaaacactaggcgaaaaatggaagagacagcttaatcaactatccaaatctgaatttaatacgtataaaagatctggtataatggaagttgatagatcagaagccaaagagggattgaagcgtggagaaactactaaacacgccgtaagccggggtaccgccaagctacgatggtttgtagaaagaaacctagtaaaacctgaaggcaaagtaatcgacttaggttgtggacgtggaggatggtcatattactgtgctggtctcaagaaagtgaccgaagtaaaaggatataccaaaggaggacccggacacgaagaacccattccaatggctacttatggatggaatctggtaaaacttcatagtgggaaagatgtctttttcataccccctgagaaatgtgataccctactatgtgatattggagagtcaagccccaaccctacaatagaagaaggcagaactttaagagtccttaaaatggtagaaccgtggcttcgaggtaaccaattctgtatcaagatcttaaacccatatatgcctagtgttgtagaaaccttagaacagatgcaacgtaaacatggtgggatgttagtccgaaatcctttatcacggaatagtacacatgaaatgtactgggtctcgtgtggcactggaaatatagtgagcgcagtaaatatgacaagcaggatgttacttaaccgatttacgatggcccatagaaaaccgacatatgagagagatgttgatcttggggctggtacgcgccatgtagccgtagaaccagaagtcgccaatttagacataatcggacaaaggattgaaaacatcaaacacgaacataaatcaacttggcactatgacgaagataatccttataagacctgggcataccatggaagttacgaagtaaaaccgagtgggagtgcttcaagtatggtaaatggcgtagttaaattgctaaccaaaccatgggatgtaatcccgatggtcacacaaattgctatgacagatactactcctttcggacaacaacgcgtattcaaagaaaaagtagatacacgaacaccaaaggcaaaaagaggtacagcacaaatcatggaagtgaccgccaagtggctatggggctttctatctagaaacaagaaacctaggatctgcaccagggaggagtttactcgaaaggtacggtcgaacgcggctattggagctgtatttgtagacgagaaccaatggaatagtgccaaagaggccgttgaagacgaaagattctgggacctggttcacaaagagagagaactacataaacagggtaaatgtgcaacatgtgtatataatatgatgggaaaacgagagaagaaattaggggaatttggaaaagcaaaaggatcacgagcaatatggtatatgtggcttggagcaagatttctagaatttgaagcactaggattcatgaatgaagatcattggttttcgagggaaaactctttatccggcgttgagggtgaaggactacacaaactaggatatattttaagagatatctccaaaatcccaggcggaaacatgtatgcagatgacactgcaggatgggataccagaattacagaggacgatctacagaacgaagcccgcattactgacattatggaacctgaacatgccctattagccaaaagtatatttaaattaacttatcaaaacaaagtcgttcgcgtgcaacggcctgccaaaaatggcacagttatggatgtcatttctcgacgagaccaaagagggagcggtcaagttggtacttatggcttaaataccttcacaaacatggaagcacagcttattcgacaaatggagtcggaaggaattttctcaccgtcagaattagaaactcctaatttagctgaacgagttttagattggctagaaaagtatggagtagagcgcttaaaaagaatggcgatatcgggagatgattgcgtcgttaagccaatagatgataggttcgcaaccgccttaacggctctcaacgacatgggaaaagtaaggaaggatattcctcaatgggaaccatcaaaggggtggaacgattggcaacaggttcccttttgtagtcaccacttccatcaactaataatgaaagacggacgtgaaattgtcgtaccatgtagaaatcaagatgagctagttggtcgagcacgggtatcacagggggccggctggagtcttagagaaacggcatgcttaggtaaatcctatgcacaaatgtggcaattgatgtatttccataggcgtgacctaagacttgctgccaatgccatatgcagtgccgtaccggtggattggatccccacatcaaggacgacatggagcatccatgctcaccatcaatggatgactacagaagacatgttatcagtttggaaccgagtatggatagaggaaaatccttggatggaggataaaacacatataagctcttggggtgatgttccgtaccttggcaagagagaagaccaatggtgtgggagtcttataggactcaccgctagagccacgtgggccactaatatccaagttgcaataaaccaagtaaggagactgataggtaatgaaaattatctggactacatgacttcaatgaagcgtttcaagaacgaatcggatccggaaggggcactatggtag

SEQ ID NO: 21126 - RNA, 9879 nt, synthetic construct
  misc_feature 1..9879: note = derived and/or modified CDS sequence (opt6) from DENV-1__KJ649286__SS-prME
  source 1..9879: mol_type = other RNA
agtgtaacaatgctgttaatgcttctgccaaccgttcttgcattccacctaacaactcgtggaggagaaccccacatgatcgtgacaaaacaagaacgtggaaaatcgcttctctttaaaacatccacgggggtgaacatgtgtactttaatcgcaatggacctcggtgaactttgcgaagataccatgacgtataaatgccctaggatcactgaagcagaaccagacgacatagattgctggtgtaatgcaactgacacatgggtcacttatggtacttgttctcaaaccggcgaacatcgacgagacaaacggtcggtcgcactcgctcctcacgtaggtttgggactcgaaacccgaacagaaacttggatgtcgagcgaaggtgcttggaaacagatacaacgcgtagaaacttgggcattaagacaccccggatttactgtgacagccctattcctagcccacgcaatcggaacgagcattactcagaaaggaataatattcatcttactaatgctagtgacccccagtatggcaatgagatgtgtgggtatcggaaatagagacttcgttgaaggcttatcaggagccacttgggtagacgtggtcttagaacacgggtcttgcgttactacaatggcgaaagacaaaccaacacttgacattgaacttttaaagacagaagtgacaaacccagcagttttaagaaaactatgcattgaagcaaaaatatctaatacgacaacagacagccgctgtccaacccaaggcgaagccacgctagtagaagaacaagatgccaattttgtctgcagaagaacatttgtcgatcgcggatggggaaatggctgtggactctttggtaaggggagtctaataacatgtgccaagtttaaatgtgtaacaaaattagaaggtaaaatagtacaatacgagaatttgaaatactctgtaatagtcacagttcatacaggagatcagcaccaggttggtaatgaatcaactgaacatggcactacagcaactattacaccacaggcacctacttcagaaatccaattgacagattatggagctttgaccctagactgctcgcctagaaccggtctggatttcaatgaaatggtgttactaacgatgaaagagaaaagctggctagtacataaacaatggttcttggatctacccctaccttggacaagtggggccacaaccagccaagaaacttggaatagacaagatctgctagttaccttcaagacggcacatgccaagaaacaggaagtcgttgtgttaggatcacaagaaggagcaatgcataccgccttaactggggcgactgaaatacaaacatctggtacaacaaccatattcgcaggtcatctaaaatgtaggctaaaaatggacaagctcacactaaaaggtatgtcatatgtcatgtgtaccggttcttttaaattggaaaaagaagtcgttgaaactcaacatggaactgtgctagtacaagtaaaatacgaagggacagacgccccttgtaaaataccttttctcacacaggatgagaaaggagtcactcaaaatggacgagtgattactgccaatcccattgtaacagataaagaaaagccagtgaatatcgaagcggagccgccattcggcgaaagctatattgtcgttggagcaggagaaaaggccttgaagttgtcatggttcaaaaagggatctactatcggcaaaatgttcgaagcaacggctcgtggagcacgaagaatggcgattttaggtgacaccgcatgggattttggttcgataggtggagtatttacgagtgtcgggaaacttgttcaccaaatattcggaacagcctatggggtactattctcaggtgtttcctggactatgaaaataggcattggcgtattactaacatggttaggactaaattccagatcaacgtctttgtcaatgacatgtatagccgtcgggctggtaacactatacttgggagtaatggttcaagctgattcaggctgcgtaataaattggaagggtcgcgagctcaaatgtgggtccggcatattcgtcacaaacgaggtacacacgtggacagaacaatataaatttcaagcggactcaccgaaaagactaagtgcagcaatcggtaaggcttgggaagaaggagtttgcggaataagaagtgctactagacttgagaacatcatgtggaaacagataagtaatgagcttaatcacatccttttggaaaatgacatgaaattcaccgtagtagttggcgatgtttctggtattttggctcagggcaagaaaatgatacggccacaaccaatggaacacaaatattcctggaaaagctggggtaaagcaaaaataataggagctgatgtacagaacagcactttcatcatagatggccccaacacaccagaatgtccggatgaccaaagagcgtggaacatttgggaagtcgaagattatggcttcggaatcttcaccactaacatctggttaaaattaagagattcttatacccaagtctgtgatcacaggctgatgagcgccgcgataaaagatagtaaagcggtccatgcggatatgggatattggatagagtcagagaaaaatgaaacctggaagctagcgagagctagttttattgaggttaaaacgtgtgtatggcccaaatcacacactctatggtcaaacggagtactagaatcggaaatgattattccaaaaatatatggcggacctatatcacaacataactacagacctggttatttcactcaaaccgctggcccgtggcacttaggtaaactagagttagactttgatttatgcgaaggaacaacagtggtggtagatgaacactgtggcaatcgcggcccatcactgagaaccaccactgtgacaggaaaaattatacacgaatggtgctgtcgttcttgtactctccctccacttcgatttaagggcgaggatggctgctggtatggcatggaaatcaggcccgtaaaagaaaaagaagaaaacttggtaaaaagtatggtcagtgcaggctcaggagaagttgacagctttagcttgggtctgctatgtataagtattatgatagaagaagtcatgagaagccgctggagtagaaaaatgctaatgacgggaacgttagctgtatttcttttactcatcatgggccaactgacgtggaatgacctaattaggttatgcataatggtcggggctaacgcatcggatcgaatgggaatgggaacaacctatctagcgttgatggctacattcaaaatgagacctatgttcgcagtggggcttcttttcagacgtctgacttcgcgtgaagtcctccttttaaccatcggtctgtcattagtagctagtgtagaattaccgaatagtcttgaagaactaggagacggattggcgatgggaataatgatattaaaactactaacagactttcaaagtcaccagctttgggcagcgttgttaagtctcacctttatcaaaaccacttgcagtttacattacgcgtggaagacaatggcgatggtactttcaatagtctctttgtttccactttgtatgagcacaacatcccagaagacgacatggttacctgtattattagggtccctaggatgtaaaccactaacaatgttcttaatagctgaaaataaaatatggggtagaaaaagctggccactcaatgaaggcattatggcagtagggattgtgagtatcttattatcatccctgctgaagaatgatgtgccattagcgggccctttagttgcaggaggtatgcttatagcgtgttatgtaataagtggatcctcagcagatctatctctagagaaggcagccgaagtctcatgggaagaagaagctgaacatagcggagcatcccacaatatcttagtggaagtgcaagacgacggcacaatgaaaattaaagatgaagaaagggatgatacactaactatcttattaaaagctacgttattggcagtttcaggggtttatccattatcaattcccgcaacactatttgtatggtatttttggcaaaagaagaaacagagaagtggagttttatgggatacgccatcgccacccgaggttgaaagggcagttttggatgacggaatctaccgtataatgcaacggggacttttaggacgcagccaagtaggtgtcggggtttttcaagaaaacgttttccataccatgtggcatgtcacaagaggtgcagtgttaatgtacaagggaaaaagactagaacccacgtgggcttcagtaaagaaagacctgatatcatacggaggaggctggagattacaaggaagctggaacactggggaagaagttcaagtaatcgctgtagaaccaggcaaaaaccccaaaaatgtgcagacagcaccggggacgttcaaaacacctgaaggtgaagtaggcgctattgcattagattttaagccaggcacatctggatctcccatagtgaatagggaggggaaaattgtgggactatatggaaatggagtcgtgactacaagtggaacatatgtttcagcgatcgctcaagcgaaggcttcgcaagaaggcccgctaccagaaatagaggatgaagtttttagaaaaagaaatctaacaataatggatttgcatcctggctcagggaaaaccagacgatatctgccagcaatagtaagagaagcaataaaaagaaaactccgaactcttatattggctccaaccagagttgtagcaagcgagatggccgaagcacttaaaggaatgcctattagataccaaactacagctgtcaagagtgaacacactggaaaagaaatcgtagatctaatgtgccatgcaacattcaccatgcgattattaagtccagttcgtgtaccaaattacaatatgattataatggacgaagctcatttcacagacccgagttcgattgcagccagaggatatatatcgacaagggtaggaatgggtgaggcggctgctatatttatgacggcaacgccacccggttcggtagaagcgtttccccagagtaatgcagtaatccaagacgaagaaagagacatacccgagcgatcttggaactcaggatatgactggataaccgattttccgggtaaaactgtatggtttgttccatcgattaagtctggaaatgatatcgcaaactgccttcggaaaaatggaaaacgcgtaatccaactttccagaaaaacatttgatacagaatatcagaagaccaaaaataacgattgggattacgtagtgacaacagacataagcgaaatgggcgctaattttcgcgctgaccgagtgatcgatcccaggcgatgcctaaaaccggtcatcctcaaggacgggccagaaagggttatacttgctggtcccatgccagtcacagtagctagcgcagcacaacgaagaggtcgcattgggcgaaaccaaaataaagagggcgatcaatatatttacatgggacagccactaaacaacgatgaagatcatgcacattggaccgaagctaaaatgttgttagataacataaacacgcccgaaggtataataccagccttatttgaacctgagagagagaaatctgccgcgatcgatggagaatacaggctaaggggtgaagcaaggaaaacttttgttgaattaatgagacgaggtgacttgccggtttggctttcctacaaagtagcaagcgaaggctttcaatatagcgaccggagatggtgctttgacggggaaagaaataatcaggttttagaggagaatatggatgtagaaatatggacgaaagagggtgaaagaaagaaattaaggcccagatggctagacgcccgcacttactctgaccctttagccttgagggaatttaaggagttcgctgccggacgaagatcggtctcaggtgacttaatcttagaaataggtaaacttccacagcatctgactcagagagctcaatcagcactagataatttggtaatgttacacaattccgaacaaggaggaagggcttatcgacatgctatggaggaattaccagacacgatagagacattaatgttgttagcgttaatagctgtccttactgggggagtaaccttattctttctatctggtaaagggctaggcaaaacctcaatcggtttattatgcgtaatggcttcgtcaatgcttctctggatggcctccgtagagcctcattggatagccgctagtataatcttagagttctttcttatggtacttcttataccagaaccagatagacaaaggaccccacaagataatcagctagcttacgtagtaataggattattgttcatgattttaactgttgcggcaaatgaaatgggactattggaaactacaaagaaagatttaggaataggtcatgtcgcagtagaaaaccatcatcacgcgacgatgttagatgtcgacctgcatcctgctagcgcttggactttgtatgcagtcgcaacaacaataatcacccctatgatgagacacaccatagaaaatacaaccgcgaatataagcctaactgctatagccaaccaagccgctatactaatgggcttagataaggggtggccgattagtaaaatggacataggcgtaccgctattagcgctaggatgttattcccaagtgaacccaatgaccttaacagccgcagtgttaatgctagttgcgcactatacaataataggtccaggtcttcaagcaaaagcaactagagaagcacaaaaacggacagccgcaggtataatgaagaatccaacggtcgacggaatcgtcgctatagacctcgaccctgtagtttatgacgccaaatttgaaaaacaactcggtcaaataatgttacttatcttatgtacttcccaaatattattaatgcgaacgacgtgggcgctatgtgagagtatcacccttgcaacaggcccgctaacaacactatgggaaggatcacctggaaaattttggaatactacgatcgcggtcagtatggctaacatcttcaggggatcgtaccttgctggagcgggcttagctttctcactaatgaaaagtctgggaggaggcagacgtggtacgggtgcacaaggagaaactctcggagagaaatggaagagacaactaaatcaattaagcaaatcggagttcaacacatataagcgcagcggtattatcgaagttgatcgaagtgaagcgaaagaaggcctcaaacgaggggaaacaactaagcacgcggtaagccgtggaacggcaaaattaagatggttcgtcgaaagaaaccttgtgaaaccagaagggaaagtgattgatctaggatgcggaagaggaggttggagctattattgtgcaggtcttaagaaagtaactgaggtaaaaggatataccaagggaggagctggtcatgaggagccaatacctatggctacatacggatggaacctcgtaaagttgcactcagggaaagatgtattctttatacccccagaaaaatgtgacacattgctttgtgacattggtgaatcgtcgcctaatcctactatcgaagaaggtcgcacattaagggtattgaaaatggtggaaccgtggctaaggggaaaccaattttgcatcaagattttaaacccttatatgcctagcgtcgtagaaaccttagagcagatgcaacgaaaacacggaggaatgttagtacgtaaccctctttcacgaaatagtactcatgaaatgtactgggtcagctgtgggacaggtaatatcgtttcggctgttaatatgacaagtagaatgttgctaaatagatttacgatggctcatcgaaaaccaacatatgaacgagatgtagatctcggagctgggacacgtcatgttgcagtagaacccgaggtagcaaatcttgatataatcggacagcgtatcgagaatattaagcatgaacataaatcaacttggcattacgatgaagataatccatataaaacgtgggcatatcacgggtcttatgaggtcaaaccttctggctcagcttcatcgatggtcaacggtgtagtcagactactcacaaaaccctgggatgttatccctatggtcacacaaatagcgatgactgacacaacaccatttgggcaacaaagggtattcaaggaaaaagttgatacaagaacaccaaaagcaaagagggggactgcacaagttatggaagtaacagctaggtggttatggggttttctaagtaggaacaagaagccacggatatgtacgcgggaagagttcacacgcaaggttagaagcaatgcagcgataggggcggtctttgttgacgaaaatcagtggaacagcgctaaagaagccgtagaagacgaacgattttgggatctagttcatagagaaagagagctgcacaaacaggggaaatgtgcaacatgcgtttacaacatgatgggaaagagagagaagaaacttggcgagttcggtaaagcgaaaggatcgagggccatatggtatatgtggctgggtgcgagattcctagagttcgaggcactggggttcatgaatgaagaccactggttttcaagggagaatagcttatccggggtagagggagaggggctgcaccgcctaggttacatattacgagacataagcaaaattcccggaggaaatatgtatgcagatgatactgctggctgggatacaaggatcactgaagatgacctacaaaatgaagcaaaaataacagatataatggagccagaacacgctctgctagctacgagtatatttaaattaacatatcaaaacaaagttgtgcgagtacaacgccctgccaaaaacggaaccgttatggatgtaatctcaagaagagaccaacgaggttcaggacaagtaggaacttatgggttgaatacatttactaatatggaagcacaattgattagacaaatggaatcagaaggcttgttctccccatcagaactggagacgcccaatttggctgagcgagtactcaattggttaggtaagtacggagtggagcgtttaaaaagaatggcaatcagtggagatgattgtgttgtaaaaccaatcgacgacagattcgccacagctctcacagccttaaatgacatgggaaaagttcgtaaggatatacctcagtgggagccaagcaagggatggaatgattggcaacaagtccctttttgttctcaccactttcaccaactcattatgaaggacggaagagaaattgtagtcccctgtcgaaatcaagatgaacttgtagggagggctagagtgagtcaaggtgcaggatggtcattaagagagacagcgtgcttaggcaagtcctacgcacaaatgtggcaacttatgtactttcaccgaagagacttacgtttggcagcgaacgcaatctgcagtgcagtcccggtcgactgggtgccaacgagcagaacaacctggtcgatccatgctcaccatcagtggatgacgacagaaaacatgctaagtgtatggaaccgtgtgtggattgaagaaaatccatggatggaagataaaacacatgtaagttcctgggaagacgttccatatctggggaaaagagaagatcaatggtgcggaagcctcatagggttaacggctagagctacgtgggccacaaatatacaggtagcgattaatcaagtccgtaaacttatcggaaacgaaaactacctggattacatgacatcaatgaaaagattcaaaaatgactctgatcctgaaggagcactctggtaa

SEQ ID NO: 21127 - RNA, 9879 nt, synthetic construct
  misc_feature 1..9879: note = derived and/or modified CDS sequence (opt6) from DENV-1__KF887994__SS-prME
  source 1..9879: mol_type = other RNA
agtgtaactatgctactaatgctgatgcctactgctctcgcattccatttgactacccgcggtggggaaccacatatgattgtatcaaaacaagaacggggcaaaagtctactattcaaaacgagcgccggtgttaacatgtgtacattgatcgcaatggacctcggagaactatgtgaagacaccatgacctataaatgtccaagaattactgaagcagaacctgatgacgttgactgttggtgcaacgcgacggatacatgggtcacttacgggacttgctcacaaaccggcgaacatagaagagacaaaagatctgttgctctagctccacacgtaggattaggtcttgaaacccgcacagaaacttggatgagctcagaaggcgcttggaaacaaattcaaagagtagaaacttgggctctacgtcatccgggattcactgtgatcgctttgttcctagctcacgctattggcacctcaatcacacaaaaaggcattatcttcattctgttaatgttagtaacaccctccatggctatgagatgcgttggtattgggtcacgcgactttgtagaagggcttagcggtgctacctgggtggatgttgtattagaacatgggagctgcgtcacaactatggcaaaagataaaccgacactcgatatagaacttcttaaaacggaagtaacgaatccagcaatattacggaaactatgtatcgaagctaaaatatcaaacactacaaccgattctagatgtccgacacaaggggaagcaacgctagtagaagaacaagacgcaaatttcgtatgtagaagaaccttcgtggacagaggttggggaaacggttgtggactatttgggaaaggatcgcttataacatgcgcaaaattcaagtgtgtgactaagttggagggtaaaattgtccaatatgaaaacttaaaatattcagttattgtgaccgtacacactggcgaccaacaccaagtaggaaatgaaagtacagaacatggaacaacggctacaataacaccgcaagcccccaccacagaaatacagcttacggattacggtgcgttaactctagactgcagtcctagaacaggtttggacttcaacgagatggtgttgcttacaatgaaagaaaaatcatggttagtacacaagcaatggttccttgatttaccattaccttggacatcaggcgcaagcacgagtcaagaaacttggaacaggcaagatttgttagtgactttcaaaacagcacacgcgaagaaacaagaagtcgtagttctaggtagtcaagaaggggcgatgcatactgcccttacaggagccactgagatacaaacaagcgggaccacgactatattcgcaggacatcttaaatgtcggcttaagatggacaagttaacgttaaaaggaatgagctatgtaatgtgtacaggctcatttaaactggaaaaagaggtggccgaaacgcaacatggaactgtcttagtacaaattaaatatgaaggaacagatgctccttgtaagatccccttttcaacacaggatgaaaaaggagttacgcaaaatggaagattaattacagctaaccctattgtaactgacaaagaaaaacctgtgaacatcgaagcagaacctccgttcggcgaaagctacatagtcataggagcaggcgaaaaggctctgaaattatcctggttcaagaaagggtcttctatcggaaagatgctagaagctacagcccgaggcgcacgaaggatggccattttaggagatacagcctgggatttcggaagtattggaggtgtatttacatctgtaggcaaattagtccatcagatatttggtaccgcatatggagtattatttagcggcgtttcatggactatgaaaatcggtataggtgtcttattgacctggctaggacttaacagtagaagcacatcactgagtatgacgtgtatagcagtgggccttgtaacactgtacttaggcgttatggttcaagcagatagcggttgcgttataaattggaagggaagagagttgaagtgtgggtccggtattttcgtcacaaatgaagtacacacttggactgagcagtataaatttcaagcagattctcctaagagattgagcgccgcaattggtaaggcgtgggaagaaggggtgtgtggaatacggtccgccactagactcgaaaacataatgtggaaacaaatttccaacgaattaaaccatattctcttagagaacgatatgaaatttacggtcgtagtaggtgatgtggccgggattcttgcacaaggaaagaaaatgatacgcccccaaccgatggaatacaaatattcatggaaaagttggggcaaagctaaaataataggtgccgacgtacaaaacacgactttcataattgatggaccgaatacacctgaatgtccagacgatcaaagagcttggaacatctgggaagtagaggactatggatttggaatcttcacgaccaacatatggctaaaactacgagattcatatacacaggtgtgtgaccataggctaatgagtgctgcgattaaagactcaaaagctgtccatgccgacatgggatattggatagaaagtgaaaagaacgaaacctggaagttagcgcgtgcttcttttatagaagtaaaaacttgcatctggccaaaaagccatacattatggtccaacggtgtacttgaaagtgagatgattatacccaagatttacggcggaccaatatcgcaacataattaccgaccagggtattttacacaaactgctggcccctggcatctcgggaaactcgaattggattttgacttatgtgagggaacaactgtagtagttgatgaacattgtggcaatcgcggaccgtcattgcggaccactactgtaactggaaaaataatccatgaatggtgctgtagatcatgtacactacccccgttaagatttaggggagaagatggctgctggtatggcatggaaattcggccggtaaaagaaaaagaggaaaatttagtaaaaagtatggtctctgccggatccggagaagtggattctttctcgctaggattactatgcatttcaataatgatagaagaagtaatgagatccagatggagtagaaaaatgcttatgaccggcactttggctgttttcttactacttattatcgggcaactaacatggaacgatttaattaggctttgcattatggttggagcaaacgcctcagaccggatgggtatgggcactacgtatcttgcactaatggcaacttttaaaatgagaccaatgttcgctgtcggactgctgttcagaagattgacaagtcgcgaagtcttgttattaactatcggattatcattgatggcttcggtcgagttacctaactctctggaggaattaggagatggtttagcaatgggtattatgatactaaaattattaactgatttccaaagtcaccagttatgggcgaccctattatctcttacttttatcaaaacaactttttcactacactatgcatggaaaacaatggcaatggttctaagcattgtaagcctatttccgctgtgcctgagtacgacatcgcagaaaaccacgtggctgccagtactcctcggtagtttagggtgcaaaccactcaccatgttcttaattgcagaaaataaaatatggggcagaaggtcatggccgctaaacgagggcatcatggcagtaggaatcgtatctatacttttaagttcactacttaaaaacgatgttccattggcaggaccattaattgcgggtggaatgttgatcgcatgttatgtaatatctgggtcctcagccgatctttcattagaaaaagccgctgaggtcagttgggaggaggaagcggaacactcaggtgcatctcataatatattagtagaagtacaagatgatgggaccatgaaaatcaaagatgaggaacgagatgatacgttgacaatccttctaaaagcaaccttactagccgtaagcggagtgtaccctttgtcgatcccggcgacgttatttgtatggtacttttggcagaagaagaaacagaggagcggagtgttgtgggacacaccaagcccaccggaagtggaacgagctgttttggatgatgggatatatcgcattatgcaaagagggttattaggtcgaagtcaggtgggagtgggagtatttcaagagaatgtctttcataccatgtggcacgtaacaagaggagctgtactaatgtaccaaggaaaaagattggaacccagctgggcaagtgtgaagaaagacttaatttcttatggaggaggatggcgtctacaaggatcctggaatacaggggaagaagttcaagtcatcgcagttgaacccggtaaaaatcccaaaaatgtacaaactgcaccaggaacattcaagacgcctgaaggagaggtaggtgccatcgcattagactttaaaccaggaacttcgggatcacccatagtcaaccgagaaggaaagatagtgggtctgtatggtaatggtgtagttactacatctggaacatatgtaagtgccatcgcacaagctaaggcgagtcaggaaggtccacttccagaaatagaagatgaagtattccgcaaaagaaatcttacaattatggatttacatcctggtagcggaaaaacaagacgatatctacccgctatcgtgcgagaagcaatcaaaagaaagctcaggacattaatattagctccaacgagggtagttgcttcagaaatggctgaagcattaaaaggaatgccaataagataccagaccactgcagttaaatccgaacacactggaaaagaaattgtagatttaatgtgtcacgctacttttacaatgagattattgagcccagtgcgtgtaccaaactataatatgatcataatggacgaagcgcactttacggatccttcctcaattgcagctcggggatatatatcaactagagtcggtatgggtgaagcagcagccatctttatgactgcaacacctccgggatcagtagaagcatttcctcaaagtaatgcagtgattcaagacgaggaacgggacataccggagaggtcgtggaactcaggttatgagtggataacggatttcccggggaaaaccgtctggtttgtcccatcgattaaaagcggaaatgatatcgcaaattgcttaaggaaaaacggtaagagagttattcagcttagccggaaaacatttgatactgaataccagaaaactaagaataatgattgggactatgtagttacaacagacataagtgagatgggggcgaatttccgagctgaccgagtaatagacccacgccgttgtcttaaaccggtgatacttaaggacggaccagaacgggtaattctagcaggaccaatgcccgtgacagtagcaagtgctgcgcaacgaagagggcgcatcggtagaaaccataataaagaaggagatcagtacatatatatgggtcaacctctaaacaatgacgaagatcacgcacactggacagaggcaaaaatgctcttagacaatatcaataccccagaggggatcatacctgcactctttgagcccgaaagggagaaatccgccgccatagatggggagtatcgactgaggggtgaagcaagaaagacctttgttgaactcatgagaagaggagatcttccagtctggttgagctacaaagtagctagcgaaggttttcagtatagtgatcgaaggtggtgttttgacggagaaaggaacaaccaagtgttagaggagaatatggacgttgagatttggaccaaggaaggtgagaggaagaaactgcgcccacgctggcttgatgctagaacgtacagtgatccacttgctttaagggaatttaaagaatttgcagcaggtagacgaagcgtttcaggtgatttaatactcgagattggcaaactgccacaacatttaactcagagggctcaaaacgcattagacaatctagtcatgcttcacaactccgaacaaggagggagagcgtatcgccatgctatggaggaactacccgatactattgaaaccctaatgcttctagctctcattgccgtactaacaggaggagtcacattattctttctatcagggagaggacttggaaaaacaagtattggtttgctctgtgtaatggctagtagtgtgttattgtggatggccagtgtagaacctcattggatagcggcatctataattctagaatttttcctaatggtattattaatccccgaaccagatcgtcagcggactccgcaagacaaccaattagcatatgtagtcatcggattactatttatgatattaactgtcgcagcgaacgagatgggactgttagagacaacaaagaaagatttaggaattggtcacgttgctgttgggaatcatcaccacgcagctatgctggatgtagacctacaccctgcctctgcatggacgttgtacgctgttgccacaactataataactccaatgatgagacacaccattgaaaatacaaccgcaaatatatctctaactgccattgcaaaccaggccgcgatacttatgggcctagataaagggtggccaataagcaaaatggatattggcgttccgctactggcattaggctgctattcgcaagtaaatccactcacccttaccgctgcggtgttgatgcttgtagcacactatgcaatcataggaccaggactccaagctaaagcgactcgggaagctcaaaagcggactgcagcgggtattatgaaaaatccgaccgtggacggcatagtagctatagatctcgatccggttgtttatgatgcaaaatttgaaaaacaattaggtcagataatgctcctaatattatgtacgagtcagatcctacttatgcgaaccacgtgggcgctgtgtgaaagtataacactggccacaggtcctctgacaacattgtgggaaggatctccaggaaaattttggaacacaaccatagctgtgtcgatggctaatatttttcgagggtcctacttagcaggggccgggctcgctttttctctcatgaagtcacttgggggaggacgccggggtacaggagctcaaggcgaaaccttaggggaaaaatggaagagacagcttaaccaactctctaaaagtgaatttaatacgtacaaacgctcaggtataatggaagtcgatagaagtgaggctaaagaagggttgaaacggggcgaaaccacgaaacatgcagtttcgagaggcaccgccaagttaaggtggtttgtagaacggaacttagttaagccagaagggaaagtaatagatttaggctgtggaagaggaggctggagttattactgcgcaggcttaaagaaggttactgaagtcaaaggttatacaaaaggaggacctggtcacgaagaaccgataccaatggcaacatatggatggaacttggtgaaattacactcaggtaaagacgtgttctttatcccaccggagaagtgtgacacacttctatgtgatataggagaaagtagtcctaacccgaccattgaagaaggacgcaccttacgagtgttgaaaatggtagaaccttggctacggggaaaccagttctgtataaaaattttgaatccgtatatgccatcagttgttgaaaccttagaacagatgcaaagaaaacacggtggaatgttagtcaggaatccgctaagcagaaattcaacgcatgagatgtactgggtttcttgcggtactgggaatattgtctcagcagttaatatgacaagtagaatgcttctgaatcgctttacaatggcccatcgtaaacctacttatgaacgtgacgtagacctgggagcaggaacgcgccatgtcgcagtcgagccggaagtagccaatcttgatattataggccaaagaatcgaaaatataaaacatgaacacaagagcacatggtactatgatgaagacaatccctacaaaacctgggcctaccatggtagctacgaggtaaaacctagtggatcagcaagttcaatggtaaatggggttgtgaaacttctgaccaaaccttgggacgttatacctatggttacacagatagcaatgaccgataccactccatttggtcaacaaagagtctttaaagagaaggtagacacccgcacacctaaagcaaagcgaggaacagcgcaaataatggaagtaacagcgaagtggttatggggatttctttcaagaaataagaaaccccgaatctgtacccgggaagagttcacaaggaaagtcaggagcaacgcagccataggcgcagtttttgtggacgaaaaccaatggaactccgctaaagaggcagtggaagatgaacgattttgggatttagtacacaaagaacgtgaattacataaacaaggtaaatgcgctacgtgtgtatataacatgatgggcaaaagagagaagaaactgggtgagttcgggaaagcgaaaggaagtcgtgcaatatggtatatgtggctaggagccaggttcctagaatttgaggcattaggatttatgaacgaagatcactggttttcacgggaaaattcattctcaggtgttgaaggtgagggtctccacaaattagggtatatactacgtgatatcagtaagataccgggaggaaacatgtacgctgacgatacggcaggctgggacactagaattactgaagatgatttacaaaatgaagcccgtataacagacattatggagccggaacacgccttattggctaaatcaatatttaaacttacatatcagaataaagttgtgagagtccagagaccagccaaaaacggaactgtcatggacgtagttagtcgaagggaccaaagaggaagcggacaagttgggacctacggactaaatacatttacaaacatggaagcccagctaataagacagatggaatcggagggtatattctcgccgtcggagctggaaactccaaatctagcagaaagagtcttagcttggttggaaaaatatggagtagaacgattaaagaggatggctataagtggcgatgactgcgtagtcaagccaatagatgatagattcgcaacagctttaaccgcactaaatgatatgggtaaggtaagaaaagacatcccacagtgggagcctagtaaaggatggaacgattggcaacaggtgccattctgtagccaccactttcatcaactgataatgaaagatggaagagaaattgtagtgccgtgtcgaaaccaagacgagctagtagggagagctagggtatcacaaggggcaggatggagcctcagagaaacggcttgcctaggaaaaagttacgcccagatgtggcaattaatgtatttccatcgtagagatttaagactcgctgctaacgccatttgtagtgccgttccagtaaattggatacccacatcaaggacaacttggtcaattcatgctcatcaccaatggatgactaccgaagacatgctgtccgtttggaatagagtatggattgaagaaaatccttggatggaggataaaacacatatttcatcttggggagacgtaccatacctagggaagagggaagatcaatggtgtggatcactcattggactaacggctagggcgacgtgggctactaatatacaagtagccatcaaccaagtcagaaaattaataggtaacgaaaattatcttgattatatgacatcgatgaaacggttcaaaaatgaatcagatccagaaggagcactatggtga

SEQ ID NO: 21128 - RNA, 9879 nt, synthetic construct
  misc_feature 1..9879: note = derived and/or modified CDS sequence (opt6) from DENV-1__JQ675358__SS-prME
  source 1..9879: mol_type = other RNA
agcgttactatgctcctaatgttgcttcctaccgctctagcattccatttaactaccagagggggagaaccccatatgatagtatcgaaacaggaaagaggaaagagcttattgtttaaaacaagtgcaggggtaaatatgtgtactctaatcgcgatggacctcggcgaattatgcgaagacactatgacctataaatgccctcaaattacagaagcagaacccgacgacgtagactgttggtgtaatgcaacggacacctgggtcacatatggaacttgtagtcaaacaggagaacatagaagagacaaaagatcggtagccttagctccacacgtcgggctaggactagagacccggacggaaacatggatgtcatccgaaggagcgtggaaacaaatacaacgtgtagaaacatgggcactgagacatcctgggtttacggttattgcattatttttggcacatgctattggtacaagcatcacacaaaaaggaatcatattcatattactgatgttagtgacaccgtcaatggccatgagatgtgtaggtattggtaacagagattttgtggaaggcctatccggcgcgacatgggtagacgtagttctcgaacatggttcctgcgtaacaacaatggccaaaaataaacctactttagatatagaattgttaaaaacagaagttacaaatccagcaatactacggaaactatgtatcgaggcgaaaatctccaatactaccacagacagtcgatgtccgacgcagggtgaagcaacattggttgaggagcaggacgctaactttgtatgtcgtcgcacgtttgtagacagaggctgggggaatggatgcgggctatttggaaaaggttcattattaacgtgcgcgaaattcaaatgtgtaactaaactagaagggaaaattgtgcaatatgaaaatttgaaatattccgttattgtaacagttcacacaggtgatcaacaccaagtaggaaacgaaactactgaacacggtactattgccaccattacgccccaagcgcccacctcggagatacaactaacagattacggtgccttaacgctggactgctccccaagaacgggtttagatttcaatgaaatggttctattaactatgaaagaaagatcatggctagtccataaacaatggtttctagatttgccactaccatggaccagcggggctagtacgtctcaggaaacatggaacagacaggatcttttggttacattcaaaacagcacatgctaagaaacaagaagtcgttgtattaggatcacaagaaggagccatgcacactgctttgacgggtgcaaccgaaattcaaacctccggaacaactacgatatttgcaggacatttaaaatgcaggttgaaaatggataaactaactctaaaaggaacctcttatgtgatgtgtaccggaagtttcaaactagaaaaagaggtagccgaaacacagcacggtacggttttagtacaagtaaaatatgaaggtactgacgcaccatgtaagattccctttagtacacaggatgaaaaaggtgtgacccagaatggaaggttgataactgcaaatccaatcgtcactgataaagaaaaacctgtgaatattgaaacagaacccccgttcggcgaaagttatattgtagtcggagcaggagaaaaggcgttaaaactaagctggtttaagaaaggatcttccataggtaaaatgtttgaagcgaccgcaagaggtgcgagacggatggcgatactaggagacacagcatgggatttcgggtcaatagggggagtctttacatcagtaggaaaattggtacaccaagtgttcggaactgcttacggtgtactatttagcggcgtgtcttggacgatgaagataggtattggaatcttattaacttggttgggtctaaattcacgatcgacgtcattatccatgacctgtatagccgtcggtatggtaactttgtatctaggtgtgatggtacaagcagatagcggttgcgtaataaattggaaaggaagagagctaaaatgcggtagcggcattttcgtcacaaatgaagtacatacatggacggaacaatacaagtttcaggctgattcgccaaagcgattgagcgccgcaattggtaaggcttgggaagagggcgtttgcggcattcggagtgccaccaggctagaaaatataatgtggaaacaaatatcaaacgaattaaatcacatattattagaaaatgatatgaaattcacagttgtagttggcgatgcaaacgggatactggctcaggggaagaaaatgatccgcccgcagcccatggagcacaagtattcttggaaaagttggggaaaagcgaaaatcataggtgctgatatacagaatactacttttataattgacggacccgacacaccagaatgtccagacaaccagcgagcatggaacatatgggaagtcgaggactacggatttggtatatttacaacaaacatatggttgaaattaagagatagctatactcaaatgtgtgatcatcgattaatgtcagctgcgataaaagattcaaaggccgtccatgcagacatgggatactggatagaatcggagaagaatgaaacatggaaactcgctagggcttcgttcattgaagttaaaacatgcacatggcctaaaagtcacacattatggtccaacggtgtattagaatcagaaatgataatacccaaaacttacggtggtcccatcagtcaacataactaccgtccgggatattttacacaaacagcgggcccatggcatctcggtaagttagaattagattttgatttgtgtgaaggaacaaccgtcgtagtcgacgaacactgcggaaatagaggaccttcattaagaacgactacggttacgggaaaaattatacacgaatggtgctgcagaagttgcacattaccaccactcaggtttcgaggagaagatggatgctggtatggaatggaaatccgaccggtaaaggaaaaagaagaaaacttagtaagaagtatggttagcgctggaagtggagaggtcgactccttctccctaggcatattatgtgcatctattatgatagaagaagttatgagaagtagatggagtaggaagatgttaatgaccggaacactagccgtatttttattattaataatgggtcagttgacgtggaatgacctaataagattatgtataatggtaggagcaaatgcatcggatcgtatggggatgggcaccacatacttagcattaatggcaacgtttaaaatgagaccgatgtttgcggttgggctattatttaggcgccttacatcaagggaggtcttacttttaacaataggtctaagcctggttgcgtccgtcgagttaccaaattcgctagaggagctaggagatggcttagcaatgggtataatgatgctaaaattattaactgaatttcaaccgcatcaactatggacaaccctcctgtcgttgacatttattaagacaaccttgtcattagattatgcatggaagacaacagcgatggcactaagtatcgtcagtctatttccattatgtctttccactactagccaaaagactacttggctaccagtcctccttggctccttcggttgtaaaccgcttacaatgtttttaattacagaaaacaaaatctggggacgtaaatcatggcccttaaatgaaggcattatggccatcgggatagtcagtttgctacttagctcattactgaaaaacgacgtaccactggcaggtcctttaatagcagggggaatgcttatcgcttgttacgttatttcgggcagttctgcggacttaagtttagaaaaagcggctgaagtaagttgggaacaagaagcggaacacagtggcacgtcacacaatatattggtagaagtacaagacgatggaacaatgaagataaaagatgaggagcgggatgacacgcttacgatcttagtaaaggcgaccctcttagccgtaagtggagtatatcctatgtcgatcccagcaacacttttcgtttggtatttttggcagaagaagaaacagagatctggtgttctatgggacacaccttcgccacctgaagtcgaacgcgctgtattagacgatggaatttatcggatcttacaaagggggttactagggagatcccaagttggtgttggcgtatttcaagacggcgttttccatactatgtggcatgtcacaaggggagccgtacttatgtatcaaggcaaaagattagaaccgagttgggcctctgtaaagaaagaccttatttcttacggaggaggatggagatttcagggatcatggaataccggagaagaggttcaagtcattgctgtggaacctcgtaaaaatccgaagaacgttcagacaactccgggcacttttaaaacgcctgaaggtgaagtaggagcaattgcgttagactttaaaccaggtacatctggaagtccaattgtaaaccgcgaaggaaaaatagtaggactctacggaaacggggtagtcacgacatccgggacttatgtatcggccattgctcaagcaaaagcgagccaagaaggaccattaccggaaatagaggatgaggtgtttaaaaagcgaaatctaacaattatggacttgcatcctggctccggaaaaacaagacgttacttacccgcgatagtacgcgaagcgattaaaagaaagctcagaacactgatactggcaccaactcgggtcgtagcatctgaaatggcagaagctctaaaaggcatgcccattaggtaccaaacgactgccgtcaagagcgaacatacggggagggaaattgtagacctgatgtgccacgcaacatttactatgaggcttcttagtcccgtcagagtgcccaattataatatgataattatggacgaagctcacttcaccgatccagcgtctatagcagcaagaggatatattagcacaagagtaggaatgggagaagctgcagcaatattcatgacggccacaccacccggatcagttgaggcttttccacagtcaaatgccgtgatacaagatgaagaaagggatataccagagcgatcatggaactcaggatatgattggattactgattttccaggcaaaactgtatggtttgttccgtcaattaagagcggaaatgacatcgcaaattgcctcaggaaaaatgggaaacgtgtcatacaactgagcagaaaaaccttcgacactgagtaccaaaagactaagaacaacgattgggactacgtcgtcacaacagatatatccgaaatgggggcaaatttcagagcagatagggtaatagatcccagacgctgcctaaaacctgtcatcctcaaggatggtcctgaaagagtgatattggcaggaccgatgccggtcactgttgcaagtgcagcgcaacgaagaggaagaataggacgaaatcaaaacaaagaaggagaccaatatgtatacatggggcaacctctgaataatgacgaagatcatgcgcattggacagaagcaaaaatgttgttagataatataaacacgcccgaaggaatcatcccggctctatttgagcctgaacgcgaaaagagcgcagcaatagatggggaataccgcctgcggggcgaagcgcggaaaacttttgttgagttaatgagaagaggagacttaccagtatggttgtcttataaggttgcgtcagaaggatttcagtacagtgatagacggtggtgttttgatggagaacgcaacaaccaagtgttagaagagaatatggatgtagaaatatggacaaaggaaggcgaacgaaagaagctacgtccaagatggttggatgctcgtacctatagtgatccgcttgccctgagggagttcaaggagttcgcagccgggcggcgaagcgtatcaggagatctcatcttggaaatcggaaaattgccacagcatctaacattgagagcgcaaaatgcgctagacaacctagttatgctgcataatagtgaacaaggcggaaaggcttatagacatgcaatggaggaactacccgacactatagaaacattgatgctcctagctttaatagctgtactaactggcggggtgacgctattctttttaagcggaaaaggattaggaaaaacctcaattgggcttttatgcgtaactgcttcttctgctttgttatggatggcctcagttgaaccacactggatcgcagcttcaataatcttggaatttttccttatggttttgcttatacccgaaccagaccgccaacgaacaccacaagataaccaactagcatatgtcgtgattggattgctttttatgatacttacggttgctgctaacgaaatggggctcctcgaaacaactaagaaagaccttggtatcggacatgtcgcggccgaaaatcaccagcatgcaacaatgcttgatgtcgacttgagacccgctagcgcctggacgttgtatgccgtagccacaactgtaattactccaatgatgagacatacaatagagaacacaacagcaaacatatcattgaccgcgatagccaaccaggccgcaatactaatgggacttgataaaggttggcctatatcaaaaatggacatcggtgttccattgctcgcacttggttgctattcgcaggtaaacccactaacactaacagctgctgtattaatgttagtcgcacactacgccataataggccccggattacaagcaaaagcaactagagaggcacaaaaacgtacagcagcaggtattatgaaaaatccgactgtggacggtatagtagcaatagatttggatcccgtagtatatgatactaagttcgaaaagcaattaggacaaatcatgttactaatattgtgtacttcacaaatattgctgatgagaacgacttgggcactttgtgaaagcataacgcttgccacaggtccactaacgaccctttgggaaggaagccccggaaagttctggaataccaccatagcggtttcaatggcgaatatctttagaggtagttacttggccggtgcgggtctcgctttctctttaatgaaatctgtaggtggcgggagaagaggtatgggcgcccaaggcgaaacgctcggggagaagtggaagagacaacttaatcagctaagtaaaagcgagttcaatacatataaacgttcaggtattatggaagtcgaccgttctgaggcaaaagaagggctaaaacgaggagaaacaacaaaacatgccgtttccaggggaaccgcgaaactgaggtggtttgtagaaagaaatttagtcaaaccagaagggaaagtgatagatttagggtgcgggaggggaggatggtcttattattgcgcgggccttaaaaaggtaactgaagttaaaggatacacaaagggaggacccggacatgaagaacctatacccatggcaacatacggttggaatctcgttaagttacatagtgggaaagacgtattctttatgccacctgagaaatgtgacacactactatgcgatatcggtgagagctcaccaaatcctaccatagaagagggacgaacattgcgggtcctgaaaatggttgaaccttggttacgagggaatcaattttgtattaaaatattaaacccatacatgccaagtgtagttgaaacactggaacaaatgcaaaggaaacatggaggtatgttagtccggaatccactatctcgaaatagcacgcatgaaatgtactgggtgagttgtggaacaggaaacatcgtgtcagcagtgaacatgacaagtagaatgctcttaaataggttcacaatggcacatagaaaaccaacttatgaaagggatgtcgatcttggtgcgggtactcgtcatgtagcagtagaaccagaggttgctaacctggatataatcggacaacgaatcgaaaacataaagaacgaacacaagagcacatggcactacgatgaggacaatccttacaaaacatgggcatatcatgggtcatatgaagttaaacctagcggaagtgcaagctccatggtcaacggtgtcgttcgactgctcactaaaccatgggacgtaatacctatggtcactcaaatagctatgacggataccacaccattcggacaacaacgagtcttcaaagaaaaagttgatacacgaacacccagagctaaacgtggaacaacgcaaatcatggaagttacggcaaagtggttgtggggctttttgagtcgtaacaaaaagccaaggatatgcacgagagaagaatttacgaggaaagtcagatcaaatgcagctattggggcggtcttcgtcgatgaaaatcaatggaactctgccaaagaagcagtagaagacgaacgattctgggatctggtacatcgagaaagagagctacataaacaaggaaaatgtgccacgtgtgtatataacatgatgggcaaacgggagaagaaattaggcgagtttggaaaagctaaaggatcaagggctatctggtatatgtggcttggagcccgttttctggagtttgaagcattgggttttatgaacgaggatcactggttcagtagagaaaatagtctatcgggagtagaaggggagggactgcataaactcggttatatacttagggatataagtaagattccgggaggcaacatgtacgctgatgacaccgcaggctgggacacccggataacagaagatgaccttcagaatgaagcgaaaattacagatataatggaaccggaacatgctcttttagctacaagtatatttaaattgacatatcaaaacaaagtagtgcgcgttcaaaggcccgcgaagaatggaactgtaatggatgtaatttcgagacgtgaccaaagaggttccggccaagttgggacgtatggattgcatacatttacgaatatggaagttcaactgattcgacaaatggaatcagaaggtatatttttaccttcagaactagaaacgccaaatttggctgaaagagtactagattggctagagaagcatggagcagaaaggcttaaaagaatggcgatctcaggagatgactgcgtagttaagccaatagatgacaggttcgctacagcgctcactgcgctgaacgacatgggaaaggtccggaaagacataccccaatgggaaccttctaaagggtggaatgattggcaacaagtcccattttgttcacatcactttcaccagcttatcatgaaagacggaagagaaatagtcgtaccctgtcgaaaccaggacgaattagttggacgagctcgagtaagtcaaggagcaggatggtccctacgagaaacagcttgtcttggaaaatcgtatgcacaaatgtggcagctgatgtactttcatcgaagggatctcagactagcagccaatgcaatatgttcggcggttccagtggattgggttcctacaagtcggaccacttggtccatccacgcacatcatcaatggatgacgaccgaagatatgttaagtgtgtggaatagggtgtggattgaggaaaatccttggatggaggacaagacccatgtttcatcatgggaagaagtcccatatttaggcaaacgtgaggatcagtggtgtgggtctttaattggcttaactgcgagagctacatgggcaaccaacatacaagtagcaatcaatcaagttcgccgcttaattggtaatgaaaactacctcgattacatgacgtccatgaagcgcttcaagaatgagtcagatcccgaaggtgctctatggtag

SEQ ID NO: 21129 - RNA, 9879 nt, synthetic construct
  misc_feature 1..9879: note = derived and/or modified CDS sequence (opt6) from DENV-1__FJ850070__SS-prME
  source 1..9879: mol_type = other RNA
agtgttactatgttactaatgttgcttccgacagcattggccttccatctaactacccgcggtggagaaccgcatatgattgttagcaaacaagaaagaggaaagagcttattattcaaaacgtcggtgggagttaatatgtgtacgctaatagcaatggacttaggcgaactctgcgaagataccatgacctataaatgtccaagaataactgaagccgaaccagacgatgttgactgttggtgtaatgcaacagacacgtgggtaacgtacggaacttgttcacaaacgggagaacaccggagagacaaaagatcagtagctcttgccccgcacgtaggtctaggcctagaaacgcggacagaaacatggatgagtagtgagggcgcatggaaacaaatacaaaaagtggagacttgggcattacgtcacccaggatttacggttatagcacttttcttagcgcatgcaatcgggactagcataacccaaaaaggtataatatttatacttttaatgttagtcaccccttccatggcgatgagatgcgttggaatcggaaaccgagattttgttgaaggactttcaggagcaacatgggttgatgtcgtattggaacatggatcgtgtgtaacaacaatggccaaaaacaaaccaacccttgacatagaattattaaaaactgaagttacaaatcccgctgtcctaagaaaattgtgcatagaggcaaaaataagcaataccacgactgatagtagatgccccacgcaaggtgaagctaccctagtagaggaacaagatgctaacttcgtgtgcagaagaacttttgtagataggggctggggaaatggctgcgggctatttggaaaaggttcgttactaacatgcgcaaaatttaaatgcgtaacgaaactggaagggaaaattgttcaatacgagaacctaaaatacagcgtaatagtaacagtgcacactggagatcaacatcaagtgggcaatgaaacaacggaacacggaacaatcgctacaataactccacaagcgccaacttcagaaatacaacttactgactacggtgcactgaccttagattgttcacctcgcacagggcttgacttcaacgaaatggtactccttaccatgaaagagaaaagttggcttgtacataagcaatggtttctcgatctgccactcccgtggaccagcggagcatcaacatcacaagaaacctggaaccgccaagatctccttgtgacctttaaaacggctcacgccaagaaacaggaagtagtagtattaggatcacaagagggagcaatgcatacagcattaaccggtgcaacggagattcaaacctcgggaacaaccaccatattcgcggggcacctgaaatgtaggttgaaaatggataaactaactttgaaaggaatgagttacgtaatgtgtactggcagttttaagctcgaaaaagaggttgccgaaactcagcatggtacagtgctcgtccaagtaaaatatgaaggaacagacgctccttgcaagatcccgtttctcacacaagatgaaaaaggagtcactcagaatggcagactcattacagctaacccaatcgtaacagataaagaaaagcctgtaaacatagaaacagagcctccttttggcgagtcatatatcgttgtcggcgcaggagaaaaagcactgaagctatcttggtttaagaaagggtccagcataggcaaaatgttcgaagcgactgctaggggtgccagacgcatggcaatactaggggatacagcgtgggattttggaagcattggaggtttattcacaagtgtcggaaaacttattcaccaagtttttgggacagcatatggagttttattttcgggcgtaagttggacaatgaaaataggtattggtatcttactcacatggttaggcctgaatagtcggtcaacgtctttgagtatgacatgcattgccgtgggcatggtaactctttatctgggagtgatggtacaagcagacagtggttgtgtgattaattggaaaggtagagaactaaaatgcggtagtggtatatttgtaaccaatgaagtacatacatggactgaacagtataagttccaagcagattctccgaaacgactttcggccgcaataggaaaggcttgggaagaaggggtatgcggaataaggagcgcgacaaggttagagaatattatgtggaagcaaatttccaacgaattaaattatatcctactagaaaatgacatgaaattcacagttgtcgttggtgacgctaacggcattctagcacaaggaaagaaaatgataagacctcagccaatggaacataaatatagctggaaaagttggggtaaagcgaaaataatcggcgcagacatacaaaatactacctttataattgacggtccggacactccggaatgtcccgatgaccagagagcttggaacatatgggaggtggaagattacggcttcggaatctttactaccaacatctggctaaaacttcgagactcgcacacccaaatgtgtgaccatcggctgatgagtgctgcaataaaagatagcaaagctgtccatgctgatatgggatattggattgaatctgagaagaacgagacctggaaattggcgcgtgctagctttatagaagttaaaacatgtatctggccaaaatctcatactttgtggtcaaatggagtcttggaatcggaaatgatcattccaaagatatatggcggtccaatctcgcaacataactataggcccggctattttacgcaaacagctgggccgtggcacctaggaaaattagaattagattttgatctatgtgaaggaacgacagtcgtggtagatgaacattgtgggtataggggccccagcctcaggaccacaactgtaacaggtaaaattatacacgaatggtgctgcagaagttgcacattgcctccactaagatttaggggtgaggatggatgttggtatggaatggaaattagacccgtaaaagaaaaagaagagaacttagtccgttccatggtatcagccgggtcgggagaagtagactctttctcattaggcatactctgtgtatcaattcttattgaggaagtaatgcgtagccggtggtcacgaaaaatgttaatgactggaacgttagcggtatttctcctcttaattatgggacaattaacctggaatgatctcatacggctatgtattatggtaggagcaaatgcctcagaccgcatgggaatgggtactacatacttggctctaatggcaactttcaaaatgcggcccatgtttgctgtgggattgttgttcaggcgattaacctcccgtgaagtacttcttttaactattggcctcagtctggtagcgagtgtagaattaccgaacagtttagaagaactaggagacggccttgctatgggtataatgatgttgaagctacttactgatttccaacctcatcaattatggacaacgttattaagtctaacttttataagaacaagtttgtcattagattacgcatggaaaacaatggcgatggcactatcaatagtgtccttatttcctctctgtttgtccacaaccagtcaaaagaccacttggttacccgttctgttgggatcatttggatgcaaacccttgactatgttcttaattacagaaaacaagatatggggaagaaaaagttggccaattaatgaaggaattatggcggttggaatagtgagtatactcttaagcagtttactcaaaaatgatgtacctctagccggtcccttgatagcgggaggaatgcttattgcctgttatgtaatatctggatcatctgcagacctttcactagaaaaggctgctgaagtaagttgggaggaagaggctgagcacagtggcacctcccataatatattagtagaagttcaagatgacggaacgatgaaaattaaggatgaggaaagagacgatacattaacaatattattaaaagcaacccttttagcagccagcggagtttacccaatgtccatcccagcgaccctattcgtatggtacttctggcagaagaagaaacagagatcaggagtcctctgggacacaccttccccaccagaagttgaaagagctgttctggatgacggcatttatagaatccttcaacggggtttactaggaagaagtcaagttggtgttggagtatttcaggatggcgtatttcatacaatgtggcacgttacacgcggtgccgtgttgatgtatcaaggaaaacgattagaaccaagttgggcttccgtcaagaaagatctcataagctacgggggaggctggagattccagggtagttggaatactggagaagaagtgcaagtaatagccgtagaaccagggaaaaaccccaaaaacgttcaaacaacccccggtacctttaagacaccagaaggtgaagtaggagcaatcgccttagatttcaaaccagggacatctggatctcccatagtaaatcgagagggaaaaatagttggcttatatggaaacggggtggtaacaaccagtggaacatacgtgtcagctatcgcgcaggccaaagcgtcacaagagggaccactcccggaaatcgaagatgaggtctttaagaaacgtaatctaacgataatggatttgcatccgggcagtggaaaaactaggagatatttaccagctatagttcgcgaggcgataaagagaaaattacgaaccctgatactagctcccactcgtgtagtagcaagtgagatggcggaggcactgaaaggaatgcctatccgataccaaacaacggcagtaaaatcagaacacacagggcgagaaatcgttgacctaatgtgtcatgccacattcactatgcgtctactttcaccagttcgggttccaaattataacatgataatcatggatgaagcacactttaccgatcctgcgtcaatagcggctcgtggatatatctcgacaagagtaggaatgggagaagccgcagcaatttttatgacagctacgccaccgggatctgtcgaggcttttccacaaagtaacgcggtcattcaagatgaagaaagagacataccggaaagatcttggaactccggatacgactggattacggactttccgggcaaaaccgtatggtttgtacccagtatcaagagcggaaatgacatagcgaactgcttacgaaagaacggtaaaagggtaatccaacttagcagaaaaacattcgataccgaatatcaaaagactaaaaataacgattgggattatgttgttactaccgatataagtgagatgggcgcgaattttagagcggacagggtgatcgaccctagaaggtgtctaaaaccggtgatccttaaggacggaccggaacgtgtaatcctagccggacctatgcccgtgactgtagccagtgccgctcagagaagaggtcgtattggcagaaatcaaaacaaagaaggtgatcaatacatttatatgggacaaccacttaataatgacgaagatcacgctcattggactgaagccaagatgctcttagataatattaacacgccagaaggaataataccagcgctattcgaacccgaacgcgagaaaagcgcagcaatagatggagaatatcgattaagaggcgaagcacgcaagacatttgtagaactgatgaggcggggtgatctacccgtttggctatcatacaaagtggccagcgaaggctttcaatatagtgatcgtcgatggtgctttgacggggaaaggaataaccaggtcttagaagaaaacatggacgtagaaatatggacgaaagaaggagagcgcaagaaacttagaccccgatggcttgacgctcgtacgtactcagatcctttagcactccgggaatttaaagaatttgcagcgggaaggagatctgtgtcaggcgatcttattttagaaattggaaaacttccacaacacttaactcttagagctcagaatgccttagataatctggtgatgctacacaacagtgagcaaggaggcaaggcttacagacacgcgatggaagagttgcctgatacaatagaaactttgatgctactcgcactcatagcagtactgacaggtggagtaacgctatttttcctatcaggaaaaggtctgggcaaaacctcaataggactgttatgtgtaatggcttccagcgctcttttatggatggcgtctgttgagccgcattggattgcagcatctatcatattggagttctttttaatggtacttttgatacccgagcccgaccgacaaagaactcctcaagacaaccaattggcatatgttgttatcggactcttattcatgattcttactgtagcggccaatgaaatgggtttacttgaaacaactaagaaggacctcggcataggtcatgtggccgcggaaaaccatcatcacgcaacaatgctcgatgtcgatttacatccagcatcggcatggacactatatgccgtagcaacgactgttataacacctatgatgagacacacaattgaaaacacaacggcgaatatttctttgaccgccatagctaatcaagcagccattctaatgggcctagataagggatggccaatatcaaagatggatataggagttcctcttctagcgctcgggtgctattcacaagtcaacccacttactctaaccgcagcggttctaatgctagttgctcattacgccataatagggccaggcctacaagcgaaggcaacaagagaagcccagaaaagaactgcagcggggataatgaaaaatccaactgtcgatggtatagttacgatcgatttagatcctgtcgtatacgacgcaaaatttgagaaacaacttggtcaaattatgctattaattttgtgtacctcacaaatattgcttatgcgcacgacctgggcgctgtgtgaatccatcacgctcgcaaccgggccattaacaaccttgtgggaaggatcaccaggtaaattctggaataccacaattgccgtatcaatggctaacatattcagggggagctacttagcaggagcgggattagctttctctcttatgaaaagtttagggggtgggagaaggggtacaggggcacaaggggaaactctaggtgagaagtggaaaagacaactaaaccaactaagtaagagtgaatttaacacctataaaaagtcgggcattatggaagttgatagatcggaggcgaaggaagggttaaaacgaggagagacaaccaagcatgcggtatctcggggcacagcaaagctcaggtggtttgtagaacgcaacctggtcaaaccagaaggtaaagtgatcgatttgggatgcggccgcggcggatggagttattattgtgctggactaaagaaagttacagaagtcaagggttacacgaaaggtggcccaggtcatgaagaaccaataccgatggcgacgtacggttggaacctagtaaaattgcacagcgggaaagatgtattctttacaccgccagaaaaatgtgacacactcctatgcgacattggagaatcctccccaaaccctaccatagaggagggaagaacattgcgagttttaaaaatggttgaaccatggttaagaggaaaccaattctgtattaaaatattaaacccttatatgccaagtgtcgtggagactttagaacaaatgcaaaggaagcatgggggaatgttggttagaaaccccttaagtcgaaattcaacccatgaaatgtactgggtgagctgcggaacaggaaatatagtcagtgccgtgaatatgacatctagaatgctactaaatcgatttaccatggcacatcgtaaaccaacctatgaaagagacgttgatttaggcgcaggaactcggcacgtcgcggtcgaaccggaagtagctaaccttgacatcattggacaaagaatagagaacattaagaatgaacataaaagcacctggcactatgacgaagataatccgtataaaacatgggcctaccatggaagctacgaggttaagtcctctggatctgcttcgagcatggtaaacggtgtcgtacgattgcttaccaaaccctgggatgtcatacctatggtcactcagattgcgatgacggatacaacacccttcgggcaacaaagggtctttaaagaaaaagttgatactagaacccctagagcgaaacggggaactgcccaaatcatggaggtaactgctaaatggctatggggattcttatcaagaaacaagaaacctagaatttgcacgcgggaggaatttacaagaaaggtaagaagtaatgcagccattggtgcagtatttgtcgatgagaatcaatggaactcggctaaagaagcggttgaagacgaaaggttttgggacctggtacaccgtgaaagagagctacataagcagggtaaatgcgccacatgtgtttataatatgatgggcaaaagagagaagaaacttggagaatttggaaaagctaaggggagtagagcaatatggtacatgtggttaggtgcgagatttctggagtttgaggcactaggattcatgaatgaagatcattggtttagtagagaaaattctctgtctggggttgaaggagaagggctgcacaaactaggctacatcctgagggatatatccaagatcccaggtggtaatatgtatgcagatgacacggcgggatgggatacgagaataacagaggatgatttacaaaatgaagcaaagattactgatataatggagcctgagcacgccttgttagcaacaagtatatttaaactgacataccaaaacaaagtagtacgggtccaacgtccagcgaaaagcggcacagtaatggatgtgatatcaagaagagatcagcgaggttctggacaagttggaacttatggtcttaataccttcactaatatggaggtacagctcattagacagatggaatcggaaggcatcttttccccttccgaacttgagacacctaatcttgcaaagcgtgtattagattggttagaaaaacacggagctgaacggcttaaaagaatggcaataagtggagacgactgcgtggtcaagcctatagatgacagatttgcgaccgcacttactgccctaaatgacatgggaaaagtcagaaaggacattcctcaatgggagccttcgaaaggctggaacgactggcagcaagtaccattttgtagtcatcattttcatcaattaattatgaaggatggtagagagatagtggtcccatgtaggaaccaagatgagctggtaggcagggccagagtctcacaaggagctgggtggtcactacgagaaactgcatgtttaggtaaaagctacgctcaaatgtggcaattaatgtactttcatcgtagagaccttcggctggccgcaaatgctatctgtagcgcagttccagtggattgggtcccaacttcgagaacaacatggtctatccatgcgcatcatcagtggatgacaaccgaggatatgctctcagtgtggaatagagtatggatagaagagaatccttggatggaggataaaacacatgttagcagctgggaagaagtaccatatctagggaaaagagaggaccagtggtgcgggtctcttatcggattgactgcgagagcaacttgggctacgaacattcaagtagcaataaatcaggttcgcaggttaataggtaacgaaaattacttagattacatgacgagtatgaaaagattcaaaaacgaaagtgatcctgagggagcattatggtaa

SEQ ID NO: 21130 - RNA, 9879 nt, synthetic construct
  misc_feature 1..9879: note = derived and/or modified CDS sequence (opt6) from DENV-1__FJ850071__SS-prME
  source 1..9879: mol_type = other RNA
agtgttactatgttattgatgttattaccgacggctttagccttccatttaacgactagaggaggagaaccccatatgatagtatcaaaacaggaaagaggaaaaagtttattatttaaaacatcagtcggagtgaacatgtgcacactaattgctatggacctcggcgaactttgcgaagatactatgacatataaatgtccgagaataaccgaagctgagcccgacgacgttgactgctggtgtaatgctacagacacctgggtaacatatgggacgtgctcgcaaacaggagaacatcgaagagataaacgcagcgtagcgttagctccccatgtgggcttaggactagaaacacgaacggagacttggatgagtagtgaaggcgcctggaaacaaatacaaaaagtagaaacatgggcacttcgacatcctggttttaccgtcatagctttgtttttagcgcacgctatcggtacaagtataactcaaaaaggaataatattcatcttactaatgttagtcaccccttcgatggcaatgagatgtgtcggaatagggaatcgcgacttcgttgaaggattatcaggagccacttgggtcgatgtagttctagagcacggatcctgcgttactacaatggccaaaaataaaccaacactagacattgaacttttgaaaacagaagtaacaaatcccgctgtacttcgaaaattatgcattgaagcaaaaattagtaacacaaccacagacagccgctgcccaacccaaggcgaagctactctagtcgaagaacaagatgcaaatttcgtctgcagacgaacttttgtagatagaggctggggaaatggttgtggtctgtttggcaaaggtagtctgttgacatgtgccaaatttaaatgcgttaccaaactagaaggtaaaattgtacaatacgaaaatctaaaatacagtgtaattgtcacagttcatacgggagaccaacaccaagttgggaacgaaactacagaacatggaacaatcgcgactataacaccacaagcaccaactagcgaaatacaactaaccgattatggtgcactaacacttgattgctcaccccgtactggactagattttaacgaaatggtactactaacgatgaaagagaaaagttggttggtacataaacaatggtttcttgatctacccttaccttggaccagtggcgcatcaacatcgcaagaaacttggaataggcaagatctattggtaacatttaaaacagcgcatgccaagaaacaagaagttgtcgtcttaggaagccaagaaggtgcaatgcatactgcattgactggggcaactgaaatccaaacatcggggacaacgactattttcgccgggcatctgaaatgcaggcttaaaatggataaactgacattaaaaggtatgagttacgtaatgtgtaccggatcttttaaattggaaaaggaagtcgccgaaactcaacatggaacggttctggtgcaagtaaaatatgaaggtactgatgcaccgtgcaaaataccttttcttacacaagacgagaagggcgtaacacaaaatggaagattaatcacagcaaatcccatagtgactgacaaagagaagcctgttaatattgagaccgaaccgccatttggagaatcttacatagtggtaggagctggtgaaaaagctctcaagttaagttggtttaaaaagggaagttctattggtaaaatgttcgaagcaacagcccgcggtgcaagacgtatggctattctcggggatacagcttgggatttcggaagcataggcggtctattcacttctgtaggaaaattaatccatcaagtgtttgggacagcgtacggcgtacttttcagcggtgttagttggacaatgaaaatcggaattggaatattattgacatggctaggtttaaattcgcgcagtacatcattgtctatgacttgtattgccgtagggatggtaacactatatctaggagttatggtacaagcggatagtggttgtgtcattaactggaagggacgagaactgaaatgcggatctggcatatttgttacaaatgaagtacatacctggacagaacaatataaatttcaagcagatagcccaaagaggctcagcgcagcaataggcaaagcgtgggaagaaggtgtctgtggaatacgaagtgcgactagattagaaaatataatgtggaaacagataagcaatgagctaaactatatccttttagaaaatgatatgaaatttacggtagtggtaggagatgcaaatggtatactcgctcaaggcaaaaagatgatacgaccacagccaatggaacacaagtactcatggaaatcatggggcaaagcgaaaataattggagctgatattcaaaatacaacctttatcatcgacggaccagataccccagaatgccccgacgatcaacgtgcttggaatatatgggaagttgaagattatggatttggcatatttaccacaaacatctggttaaaactcagagattcccatacccaaatgtgtgatcatcgattgatgtcagctgcgattaaagatagcaaagctgtacacgcagatatggggtactggatagaaagcgaaaagaatgagacttggaaattagcacgagcgagttttatagaagtaaagacatgtatatggcctaaaagccacacattgtggtccaatggtgtattagagagtgagatgattatccccaaaatttacggaggacctatatcgcagcataactatagaccaggatatttcacccaaacagctggaccttggcacctcggaaagctcgaattggactttgacctctgtgaaggtactacagttgtagtcgacgagcattgtggttatcgagggccgtccttaagaaccactaccgtaaccgggaaaatcatccacgaatggtgctgccgttcgtgtacattgccacccttacgttttaggggcgaagatggatgctggtacggcatggagataaggcccgttaaagaaaaggaagaaaatttggttcgatccatggtgagtgcaggtagcggcgaggtagattcatttagccttggcatcttgtgtgtaagcatattaatcgaggaggtgatgagaagtagatggtctagaaaaatgctcatgaccggcactttggcagtctttttcttattgattatgggacagcttacctggaatgatttaataagactttgtataatggtcggcgcgaacgccagtgatcgtatgggaatgggtactacatatctagcgttaatggcaacctttaaaatgagacctatgttcgctgtgggacttttatttcgaaaattaacgtcaagggaagttttacttctaactatcggattgagcctagttgcctcagtagaattacctaactcgttagaagaattaggagacggtcttgccatgggaattatgatgctaaagctcttgacagatttccaaccgcaccaattgtggacaactctccttagtttaacttttatacgcacaagcctcagcttagactacgcgtggaaaactatggccatggcgttatcaattgtatcactcttcccactctgcctgtccacgacatcacagaaaacaacttggctacctgtactacttggttcgtttggctgcaagccactaacaatgtttttaattacagaaaataaaatctggggcagaaagtcttggccgatcaacgaaggtataatggctgtaggaattgtatctatattgctgtctagcctattaaagaacgacgtgcctctggccggaccgttgatcgcaggaggcatgctaatagcgtgttatgtaatctctgggagctcagcagatttatctttagaaaaggcagctgaagtctcatgggaagaagaggcagaacatagtggcacaagtcataacatactggtagaagtacaagacgacgggacaatgaaaataaaggacgaggaacgtgacgatacactaactatacttctcaaagcaacattattagcagtaagtggagtatatccgatgtcaatacccgcaacactgttcgtttggtacttttggcagaagaagaaacagagatctggcgtactctgggataccccttccccgccagaagtcgagagggcagtcttagacgacggtatctataggatattgcaaagaggattgttaggcagatctcaagtaggtgtgggagttttccaagatggtgtatttcacaccatgtggcatgtaacacgtggtgccgttctaatgtatcaagggaaaagattggaaccttcatgggcgtctgtcaagaaagatttaatctcttatggaggcggatggcgatttcaaggttcttggaatacgggggaagaagtacaagttatcgctgtggaacctggcaaaaatccaaagaacgtacagacaacgccaggaacatttaagacccccgaaggggaagtaggagccattgccctggattttaaacctggtacaagtgggagtccaattgtaaatagggaaggaaaaatagtgggtctctatggtaatggagtagtcacaacaagtggaacatacgtgagtgccattgcccaagcaaaggcatcacaagaagggcctctcccagaaattgaagatgaagtatttaagaaaagaaatctgacaataatggatctgcatccagggtctggcaaaacgagaagatacttacctgctatcgttcgcgaagcaataaaaaggaaattaagaaccttaattctagctccaactcgcgtggtagctagtgaaatggcagaggcgttaaaagggatgccaataagataccaaactacagcagtgaaaagcgaacacactggtcgagaaatagttgatttgatgtgtcatgccacattcacaatgcgcctgttgtcaccagtaagagtaccgaactataacatgataatcatggatgaggctcacttcaccgacccagcttcgatagctgccagaggctatattagcacacgagtcggtatgggagaagcggcagctattttcatgactgcaactccgcctggtagtgtggaggcatttccacaatcaaatgcagtaatacaagacgaagaacgtgatattcccgagcgatcctggaatagtggatatgactggattacagactttccaggtaaaactgtatggtttgttccgtctatcaagtcaggaaatgacatagcaaattgccttcgtaaaaatggaaagcgtgtgatacagctaagtaggaaaacgttcgataccgaatatcagaagactaaaaacaatgattgggattatgtagtgactacggatatatccgagatgggggcaaacttcagagcagacagagtcattgacccaagaagatgcttaaagcctgtgatattgaaagacggacccgagagggtaattttagctggtcccatgccggtaactgtcgcgagtgccgcccaaagacgaggacgaataggccgtaaccaaaacaaggaaggtgaccaatacatctatatgggacaacccttgaataatgatgaagatcacgcacattggacagaagcgaagatgcttttagataatattaatacaccggaaggcataataccggcactgtttgagccggaaagggagaagtctgctgctattgatggtgaatataggcttagaggggaagcaaggaaaacttttgtcgaactaatgcggaggggcgatttgccagtttggttaagttacaaggtagcatccgaagggtttcaatattcagatcgacgttggtgttttgacggagaaagaaacaaccaagtactagaagaaaacatggatgtggagatatggacgaaggagggtgaacgcaagaaattacgacctcgttggcttgacgccagaacctattctgacccactcgcgttgcgagaatttaaagaatttgctgcaggcaggagaagcgtgagcggcgacctaatactcgagatcggcaaactgcctcaacatttgacattgcgcgcacaaaatgccttagataatcttgtaatgctccataattcagaacagggtggtaaagcctatcggcacgctatggaagagttaccagatacaatcgaaacgctaatgctgttagcattgatagcagtactgacagggggagttacattgttctttctttctggtaaaggtttaggtaagacgtctatagggcttctttgtgtgatggcatctagcgcgctattatggatggcatcagtagaaccgcactggatagcagcatctattatcctagagttctttctgatggttcttctaataccggaacccgatagacagcggaccccacaagataatcaattagcgtacgtagttataggcctattgttcatgatcctaacagttgctgcgaacgaaatgggtttattagaaacaacgaagaaagatttgggaatcggacacgtcgcggctgaaaatcatcatcatgctaccatgttagacgtagacttgcgaccagctagcgcttggacactttacgcggtagcaacgactgtaataacccccatgatgagacacacgatagaaaacacaactgcaaatatatcacttactgctatagccaaccaagcggctatattaatgggtctcgataaaggatggccaatctcaaaaatggatattggtgtcccactactcgccctcggttgctacagccaagttaacccgttgacattaacggcggctgttctcatgctcgttgcacattacgcaataattgggccaggtttgcaagctaaagcaacaagggaagcacagaagagaacggcagcaggaataatgaaaaatcccacagtagatggcattgtaactatagacctagacccagtagtttacgatgcaaagtttgagaagcaacttgggcaaataatgttgttaattctatgcacatcccagatattactaatgcgaacaacatgggctctatgtgaatcaataacactagcaaccggaccattaactaccttatgggaaggatcgccaggcaagttttggaacactacaatcgcggttagtatggcaaacatatttcgaggttcatatttagctggtgcaggacttgcttttagcctaatgaaatctttgggcggaggaagaaggggtactggcgcacaaggagaaacgctcggagagaagtggaagagacaactcaatcaactctctaaatctgaatttaatacgtataagaaaagtgggattatggaagtcgatagatctgaagctaaagaaggattaaaaagaggggagaccacaaaacacgcagtcagcagaggcacagcaaaacttcgatggttcgttgaaagaaatctagtgaagcctgaagggaaagtcatagacctcggatgtggacgcggaggttggagttactattgcgcgggactaaagaaagtcacggaggttaaaggctataccaaaggaggtcctgggcacgaagaacccattcctatggctacatatggatggaatctagtaaaacttcattcaggaaaggatgttttctttacaccacccgaaaaatgtgacacgctcttatgtgacataggcgaatcatcgcctaatccaactatcgaagagggtagaacccttcgagtacttaagatggtagagccatggttgcgcggtaatcaattctgtataaagattttgaacccttacatgcctagcgtagtcgagacactagagcaaatgcaacgcaaacacggtggcatgttagttagaaacccgctatcccgaaactcaacccacgaaatgtattgggtgtcttgtgggacaggtaacatcgtttccgcagtaaacatgacgtctcgcatgttgctgaaccgcttcacaatggctcaccgaaaacctacatatgaaagggacgtagatctaggagccggtactaggcatgtggccgtagaacctgaagtggcgaatttagacataataggtcaacgaatagaaaatatcaaaaatgagcacaaaagtacctggcattacgacgaagacaacccttataaaacttgggcataccacggtagttatgaggtaaagccgtctgggtctgcgtcttccatggtcaacggcgtcgtacggctcttaacgaaaccatgggacgtgataccaatggtaacacagattgcaatgaccgatacaacgcccttcggacagcaaagagtttttaaagagaaagttgatactagaacaccacgagccaaaaggggaacggcacaaattatggaggtaactgcgaaatggttatggggattcctaagtcgaaataagaaaccaaggatatgtacccgcgaagagttcacccggaaggtaagaagcaacgcagctattggagcagtattcgtggatgagaatcaatggaactcagcaaaagaggccgtagaagacgaacgtttttgggacttagtgcatagagaaagggaattacacaagcaaggaaaatgtgcaacatgcgtttataatatgatgggaaaaagggagaagaaattgggagaatttggtaaagcaaagggttccagggcgatatggtatatgtggctaggagccagatttctagagttcgaggccttaggatttatgaatgaagaccactggttcagtcgtgaaaactccttaagcggtgtcgagggggaaggtctccataaattggggtatatcctccgggatattagtaaaattcctggaggaaacatgtatgcagacgatacagctggatgggatacaagaattacagaagatgatttacagaatgaagcaaaaattactgatataatggaaccggaacatgctttattggcgacaagcatctttaaattaacttatcaaaacaaagtagtaagggtccaacgacctgcaaaatctggtacagtaatggacgttatatcaagaagagatcagagaggcagtgggcaagtagggacttacggattaaatactttcacaaatatggaagtacaattaataagacaaatggaatcggagggaatattttcacctagcgaattggaaacacctaatttggcaaaacgcgtgttagattggttggagaaacatggggcggaacgacttaaaaggatggcaatatcaggcgacgattgcgttgtaaaaccaatagacgatcgatttgctactgcgcttactgctttgaatgacatgggcaaagtaaggaaagacatcccacaatgggagccatccaagggatggaatgattggcagcaagttccattttgctcgcatcatttccaccaattaataatgaaagacggacgagaaatagtcgtaccatgccgaaatcaagatgaacttgtcggtagagcacgtgtatctcaaggcgctggctggtctctccgtgaaactgcttgtctaggaaaatcatacgcacaaatgtggcaactgatgtattttcacaggcgcgacctcagattggcagcaaatgcaatatgttcggcagtgccagtcgattgggtaccaaccagtaggacgacttggagtattcatgcccatcatcaatggatgactaccgaagatatgctatcggtatggaatcgcgtatggattgaagaaaacccgtggatggaagataaaacacatgtctccagctgggaagaagtcccctatttgggtaaacgagaagatcaatggtgcggtagtttaatcgggctaactgcaagagcaacctgggcgacgaatatacaagtagctatcaatcaagtgcgtagactaattgggaatgaaaactatctggattatatgacaagtatgaagcgctttaaaaatgagagcgatccggaaggcgcgctttggtaa

SEQ ID NO: 21131 - RNA, 9879 nt, synthetic construct
  misc_feature 1..9879: note = derived and/or modified CDS sequence (opt6) from DENV-1__FJ850073__SS-prME
  source 1..9879: mol_type = other RNA
tcggttactatgctattaatgctgttacctacggcacttgcatttcatttaacgactcggggtggggaaccgcatatgatagtttcgaaacaagagagaggaaaatctctgctctttaaaacatcggctggggttaatatgtgtacgttaatagctatggatcttggtgaactatgcgaagatacgatgacttataaatgccctaggatcacggaagcagagcctgatgatgtagactgttggtgcaatgcaactgacacgtgggttacatatggaacttgtagtcaaaccggagaacacaggagggataaaaggtcggtagcccttgcaccgcacgttggccttggactggaaacccgcactgagacctggatgagttcggaaggagcatggaaacagattcaaaaagttgaaacttgggcgttaagacatccagggttcactgtaatcgctctattcttggctcacgcaataggaacaagtataacacaaaaaggcatcatctttatacttctgatgctcgtaaccccgagtatggcgatgcgatgtgttggcataggaaaccgagatttcgtagaaggattaagtggagcaacttgggtagatgttgttctagaacatggctcatgtgtaacaacaatggccaaaaataaacctaccttagatatcgaacttttaaaaacggaagtaacaaatcctgctgttctacgaaaattatgcatagaggccaaaattagtaacacaactactgactcacgctgtccaacacaaggcgaagcaactttagtggaagaacaagacgccaacttcgtttgtaggaggacttttgtagatagaggctggggaaacggctgtggactatttggaaaaggatcattattaacgtgtgccaaatttaaatgtgtaacaaaattagaaggaaaaattgtacaatacgaaaatcttaaatattctgtaatagtaacggttcacacaggggaccaacatcaagtaggtaatgagacaactgagcacggaactatcgcaactattacgccacaggcacccacgtccgagattcaattgacagactacggggcgcttacactcgactgttcaccgcgaacaggattagatttcaatgaaatggtattgctaactatgaaagaaaaatcatggttagttcataaacagtggttcctagacttaccgctaccgtggacaagtggagcgagcacttcacaggaaacttggaacagacaggatttgttagtgacctttaaaacagctcacgccaagaaacaagaagtcgtagtacttgggtcgcaagaaggagccatgcatactgcattaacgggagccacagagattcaaacatcaggaactaccactatatttgctgggcacttaaaatgtcgattgaaaatggataagttgacacttaaaggaacttcttacgtcatgtgcacaggatcatttaaactcgaaaaagaagtcgctgaaactcaacacggtaccgtattagttcaggttaaatacgagggtacagatgcgccatgtaaaattccctttagtactcaagatgagaaaggtgtaacacaaaacggaagacttattacagcaaacccaatagttactgacaaagaaaaaccagtcaatatcgaaactgaaccaccattcggggagagttatattgtcgtcggggccggagaaaaagcactaaaattatcctggtttaaaaagggttccagcatagggaaaatgttcgaagctaccgcaaggggtgcaagacgaatggctatactaggagacactgcctgggattttggaagcataggaggggtttttacaagcgtcgggaagttagttcatcaagtatttggcacagcgtatggcgtcctgtttagcggggtaagctggactatgaaaataggaattggtattttattaacatggctgggacttaattcccgatctacctctctaagtatgacttgcatagctgtgggcatggtgactctctatcttggagtaatggtgcaagccgacagcgggtgtgttataaattggaaaggtagagagctaaaatgcggtagcggaattttcgtaactaacgaagtacatacatggacagaacagtacaaatttcaagccgacagccctaagaggctctctgcggcaatcggaagggcatgggaggaaggcgtgtgtggcatacgaagcgcaacccgactagaaaacatcatgtggaaacaaatttcaaatgagctaaatcacatcctgttagaaaatgatatcaagttcaccgtagtggtaggcaacgcagatggcattttggcacaaggtaagaaaatgatacgaccacagccgatggaacacaagtattcatggaagtcttggggaaaggcaaagataataggggcagatattcaaaatacgacatttatcatcgacggacctgatacattagaatgtccggacgaacaacgcgcttggaatatttgggaagtagaagattacggttttggtatctttacaacgaacatttggctaaaactacgcgatagctatacacaaatgtgtgatcataggctaatgtcagctgcaataaaggattcaaaggctgtacatgctgatatgggatattggatagaatcagagaaaaatgaaacgtggaaattagcccgcgccagcttcatagaggtcaagacatgtatatggcctaagagtcacaccctttggtcaaacggggtattagaatctgaaatgataataccaaaaatgtatggaggacctgtttcccaacacaattaccgtcccgggtattttacacaaacagctggtccctggcacttgggtaaattagaacttgatttcgacctatgtgaaggaaccaccgtcgtagtagatgaacattgtgggagtaggggtccatcgttgagaacaacaacggtaaccggtaaaatcattcatgaatggtgttgtaggtcctgcacattaccgccgttaagatttagaggagaggatggctgttggtatggaatggaaatacgaccagtcaaagagaaagaagaaaatctcgttagaagtatggtttctgcaggatctggagaagtagattcatttagtttaggcgtactctgtgtatccattatgattgaagaagttatgcgatccagatggagtcgtaaaatgctaatgacaggtacactagcagtatttttgttactaataatgggtcaactcacatggaatgacctaatccgattatgcataatggtgggtgccaacgcatctgacaagatggggatgggcactacttatctagccctaatggctactttcaagatgcggcccatgtttgcggtcgggttactttttaggcgacttactagcagggaagtactcctacttacgataggtctcagcttagtagcttcagtagaattacctaactccctagaggaactaggagatggtctagccatgggcattatgatgctaaaactattaacagaatttcaaccacaccagttgtggacgacacttctaagcctaacgtttataaaaacaacgttatctttagattatgcttggaaaacaacagcgatggtcctctcaatagtttctctatttcctttgtgtctatccacgacgtcacagaaaactacttggctacctgttttgttagggtcttttggttgtaagccattaacgatgttccttataacagaaaatgagatatggggaagaaaaagctggccattgaatgaaggcatcatggcgatagggatagtatcgattttgttatcgtctctcttgaaaaacgatgttccactcgcgggaccattaattgcgggcggtatgttaattgcctgttatgttataagtggtagtagcgccgacctatcattagagaaagcggctgaagtatcgtgggaagaagaagtagaacattcgggtacaagtcacaatatcctagttgaagtccaagatgatggtactatgaaaattaaggatgaagaacgcgacgacaccctgactatactactaaaagctacacttttagcagtgtcgggcgtgtatcctatgagcatccctgccactttattcgtatggtatttttggcaaaagaagaaacaacgaagcggagtattatgggatactccttcaccccctgaagtagagcgcgctgtcttggacgatggcatatacagaatcctccaacgggggttactcggaagatcacaagtaggagttggagtatttcaagatggagtatttcacaccatgtggcacgtaacccgcggagctgtgcttatgtatcaggggaaacgattagaaccaagttgggcttcggtaaagaaagatcttatttcatatggtggtggatggagattccaaggttcctggaacacgggagaagaagtacaagtaatagctgtagagccaggcaaaaatcccaaaaacgtccagacgacaccgggcacctttaaaacacctgagggagaagtaggagcaatagctctagattttaaaccgggcaccagtggaagtccaatagttaatagagaaggaaaaatagttggactgtatggaaacggtgtagtcacaacgagcgggacatacgtatcggctattgcacaagccaaagccagtcaagagggtccactgccagaaatagaagacgaagtatttaagaaacgaaacctaacaatcatggatttacacccaggatctggaaaaacacgaagatatctaccagcaatcgtcagggaagctattaaacgaaaattacgtacactaattctcgctccaaccagggttgtagcctcagaaatggcggaagcactgaagggaatgccaattcgatatcaaacaacagcggttaagagcgaacatacaggacgtgaaatcgtggaccttatgtgtcatgcaactttcactatgaggttactatctcctgtcagagtgccgaactacaacatgataattatggacgaggctcatttcaccgatcccgcaagcatagctgccagaggatatatatctactcgagtaggtatgggagaagcagcagcaattttcatgactgcgacccctccaggatcagtggaggcttttccccagtcaaatgcagtaatacaggacgaagagagagatattccggagcggtcgtggaacagtggatatgactggatcactgattttcctggcaagactgtctggtttgttcctagtataaaatcagggaacgatatagccaactgcttaaggaaaaatggcaagagggtgatacaattaagtcgcaagacatttgatacagaatatcagaaaactaaaaacaacgactgggattacgtggttaccacggatatatcggaaatgggagcaaattttcgagctgatcgtgtcatagacccacggcgatgcctcaaaccagtaatactaaaggacggtcccgagcgcgtaatattagcaggtcctatgccagttacagtcgcatctgcagctcaaagacgtggtaggattgggaggaaccaaaataaagaaggagatcaatacgtctatatgggtcaaccgttaaataatgacgaagaccatgctcattggactgaagcaaagatgttactggataacataaatacaccagaaggaatcatacctgcgctattcgagccagaaagagaaaaatctgcggcaatagacggtgagtatcgtctgcgaggtgaagcaagaaaaacatttgtcgaacttatgcgacggggtgatttaccagtatggctcagctacaaagtagcaagtgagggattccaatactctgacagacgttggtgtttcgacggggaacgcaacaatcaagtacttgaggagaatatggatgtagaaatctggacgaaggaaggcgaaagaaagaaacttcgacctcgctggttagatgctcgtacatacagcgatcctcttgcgttacgcgaatttaaggagttcgctgcagggagacgctctgtctccggagatctcattcttgaaattggtaaattaccccaacacttgactctacgcgcacaaaacgcactagataacctagtaatgttacacaattctgaacaaggaggaaaggcttatcgacacgcgatggaggaattaccagacacaattgaaactctaatgctgttagctttaatggcagtgctcacgggtggggtcacattattctttctatcaggtaaagggcttggcaaaacaagcattggactattgtgtgtaatggcttcaagtgcattattatggatggcaagtgttgaaccacattggatcgcagcatcgatcattcttgagtttttcttaatggttttactcatacctgaacccgatagacaaagaacaccacaggataaccaactagcttatgtagttataggtctcttgtttatgatccttaccgtagccgccaatgagatgggtctgttggaaacgactaagaaagatctagggataggacatgtggcggccgaaaatcaccaacacgctactatgttagatgtcgatttacatccggcaagcgcctggacactatatgcggttgcaacgacagtgatcaccccaatgatgaggcatacaatagaaaatactacagccaatataagtttaacggcaatcgctaatcaggcggctattctcatgggattagacaagggatggccaatatctaaaatggacctcggagttccattactggccttaggttgttatagtcaagttaacccgctaacgttgaccgctgctgtacttatgcttgttgcacattatgcaataatcggacccgggttacaagctaaagccaccagagaagcacaaaaacgaacagcggcaggcatcatgaaaaacccaacagtggatggtatagtagcaattgatctggaccctgtagtctatgatgccaaatttgagaagcaattaggacagataatgttactcatactttgtacgagtcagatattgttgatgaggactacatgggctctttgcgagtccataactttagctacagggcctctcactacactttgggaaggtagtccgggcaaattctggaacactactatagctgtaagcatggccaacatattccgaggatcctatttagctggagccggactggctttctcattaatgaaatctctcggcggtggtcgaaggggaacaggggctcaaggtgaaacactaggagaaaaatggaaaagacaactcaatcaattatctaaatcagaatttaacacttataaaaggtcaggcataatggaagtagatcggtcagaggcaaaagaaggcctaaaaagaggcgaaacaacaaaacacgcggtctctagaggaaccgccaaattaagatggtttgtcgaaagaaatctggttaaacctgaaggtaaggtaattgatctaggctgtggacggggtggctggtcctattattgcgcaggactgaagaaagtaactgaagtgaagggatataccaaaggagggccaggacacgaggagccaatcccaatggctacatacggttggaacctggtgaaattacacagcggaaaagatgttttcttcatgccacccgagaaatgtgacaccttattgtgtgatattggcgagtcatctcctaacccgacaatagaggaaggtagaacattgagagttctaaaaatggtagaaccgtggctaagagggaaccagttttgcataaaaatcctcaatccgtatatgccatctgtagtagaaactttagaacaaatgcaacgcaaacatggaggaatgttagtcagaaatcctttatcaagaaacagtactcatgaaatgtattgggttagttgtggcacaggcaacatagtttcagctgtaaacatgacatctcgtatgttattaaacagattcacgatggcccacagaaaacctacatatgaacgcgacgtcgatctcggtgctggaacgaggcatgtagcggtggaacctgaggtggcaaatttggatataatcggacaaagaatagaaaatataaagaacgagcacaaatcaacatggcactacgacgaagacaatccttacaagacgtgggcatatcatggttcatatgaagtaaaaccttctggttcggcatctagcatggtaaatggggtcgtcagattattgaccaagccttgggatgtaataccaatggttacacaaattgcgatgactgacaccacccctttcggacaacagcgagtgttcaaagagaaagttgatactcgtactccacgagctaagaggggaacagcacagataatggaagtaaccgccaaatggttatggggcttcctctctagaaataaaaagccaagaatttgtaccagggaagaatttacgcgaaaagttagatcaaacgctgcaatcggagcggtttttgtagacgagaaccaatggaacagtgctaaagaagcagttgaagacgaaagattttgggacctagttcatcgtgaacgggaattacataaacaaggtaagtgtgcgacatgtgtttataacatgatggggaaacgggagaagaaacttggcgagtttgggaaggcaaagggcagccgagcaatctggtatatgtggttaggcgctcgctttctggagttcgaagcactagggtttatgaatgaagaccactggttttcaagggaaaacagtctcagcggagttgaaggagaaggtttacataaactgggatatattctacgcgatatttcaaaaatcccaggaggaaatatgtatgcagatgacaccgctggctgggacactagaattacagaagatgacttacgcaatgaagcaaagataaccgatataatggaacctgaacacgcgctattagccacaagcatattcaaattaacgtatcaaaacaaagtagttagggttcaaaggccggctaaaaatggtacggttatggatgttatatcaaggagagatcagagaggatctggacaagtcgggacttacggattgaatacatttacaaatatggaagtacaactcatcaggcaaatggagtctgaaggcatattcttctcgtcagaacttgaatcccccaacttggcagagagggtgttagattggcttgaaaagcacggagcagaacgtcttaaaagaatggctattagtggcgatgactgcgtggtaaaacctatagatgaccgattcgcaacggccctcattgcgcttaacgacatgggtaaggtacgaaaggatatccctcagtgggaaccctcaaaaggctggaacgactggcaacaggtacctttttgttcacaccacttccatcaactaatcatgaaagacgggcgagaaatagtagttccttgtagaaatcaagatgaacttgtaggcagagcaagagtaagtcaaggagcgggatggagtctccgggaaaccgcttgcctcgggaaatcatatgcacagatgtggcaattaatgtactttcaccgacgggaccttcgactagcagccaacgctatttgtagcgcagtcccagtcgactgggttcccacaagtcgtactacgtggtctattcacgcgcatcatcagtggatgaccactgaggatatgttaagcgtatggaatagagtatggatagaagagaatccctggatggaagacaagacacacgtatcatcatgggaggaagtaccttatctcggcaaacgtgaagatcagtggtgtggaagtctcattggactaacagcacgagcaacatgggctactaacatacaagttgctataaaccaagtacgaagactaataggcaatggcaattacttagattacatgacgtcaatgaaaaggttcaaaaatgaatctgacccagagggagcactatggtag

SEQ ID NO: 21132 - RNA, 9879 nt, synthetic construct
  misc_feature 1..9879: note = derived and/or modified CDS sequence (opt6) from DENV-1__FJ850075__SS-prME
  source 1..9879: mol_type = other RNA
agcgttacaatgctccttatgttattaccaactgctctagcatttcatttaacaactagaggtggagaaccgcacatgattgtgtctaaacaggaaaggggaaaaagcttactgtttaaaacctcagttggtgtcaatatgtgcacactcatagcaatggacctgggtgaactttgtgaggataccatgacgtacaaatgtcctcgaatcactgaggctgaaccggacgatgttgactgctggtgtaacgcaacggacacctgggttacctacggcacatgttcgcaaacgggtgagcatagacgggataaacgctctgtagcactggctccccacgtaggattaggattggagacacgaaccgagacttggatgtcgtcagaaggagcatggaaacaaattcaaaaagtagaaacgtgggccctacgacacccgggattcacggtgatagctctgttcttggcccatgcaataggcacctcgataacacaaaagggaatcatcttcatactcctaatgttagtaactccttcaatggcaatgaggtgcgtggggattggtaatcgagattttgtcgagggcttgagtggggcaacatgggttgacgttgtcttagaacacggtagttgtgttactactatggcaaaaaataaacctacacttgatatcgaactattaaagacagaggttacgaatccagccgtgctaaggaaattgtgtatagaagccaaaatctcaaataccactacagattccagatgcccaactcaaggagaagccacccttgtcgaagagcaggatgcaaatttcgtttgtagaaggacgtttgtcgatagaggatggggaaacggttgtggcctcttcggtaagggaagtctactgacatgcgcgaaatttaaatgtgtaactaaactagagggaaaaattgtacaatatgaaaatcttaaatacagtgttatagtaacggtacacacaggagatcaacatcaggttggtaatgaaactacggaacacggcacaatagcaacgattactccacaggcgccaacatccgaaatacagctaactgactacggggctttgacattagattgcagtccgcgtacaggactggactttaacgagatggttctactaaccatgaaagaaaaatcatggctagtacataaacaatggtttctcgatcttcccctaccatggacaagcggggcaagcacatcgcaagaaacatggaacaggcaggacttactggtgacatttaagacggctcacgcaaagaagcaagaagttgtagtacttggatcgcaagaaggtgctatgcatacagcattaacaggagcgactgaaatacagacatcagggacaaccactatatttgcaggccatctcaagtgccggttgaaaatggacaagctaacgctaaaaggaatgagttatgtcatgtgcacgggttctttcaagctggaaaaagaagtcgccgaaacgcagcacggaacagtgcttgtccaagtaaagtatgaagggaccgatgctccatgtaaaattccgttcttgacccaagatgaaaagggtgtaacgcaaaatggccgactcatcaccgctaatcctattgtaacggataaagaaaaacctgttaacattgaaacagagccacccttcggggaatcatacatagtagtcggagctggtgagaaagcgttgaagctaagctggtttaagaaaggctcctcaattggaaaaatgttcgaagctactgctagaggagcaagaagaatggcgatcctgggtgatactgcatgggactttggttcaataggtggactattcacttccgttgggaaactcatccatcaagtatttggaactgcttatggggtactattctcaggtgttagttggacaatgaaaataggcattggaattttgttgacatggttggggttaaatagtcgatcgacttcactcagtatgacatgtattgcagtagggatggtaactttgtacctaggagtaatggttcaagcggactcagggtgcgttataaattggaaaggtagagagctgaaatgtggatctggcatatttgtgacaaatgaagtacatacatggactgaacaatacaaattccaggcggactcacctaaaagactctcggcagctatcggtaaggcctgggaggaaggcgtgtgcggcatcagatcagctacgagattagaaaatataatgtggaaacaaattagtaatgagcttaactatatcttattagaaaacgatatgaaattcaccgtcgttgtgggtgatgccaatggcattttagctcagggcaagaagatgatccgtccacagccgatggaacataaatattcgtggaaatcctgggggaaggctaaaattattggagcagacatccaaaatacgacttttataattgatggtccggatacaccagaatgtccggatgatcagagagcgtggaatatatgggaggttgaagactacgggtttggaatattcacgactaacatctggcttaaattaagagattcacacacgcaaatgtgcgaccatagactcatgtcggcagcaattaaagatagtaaagctgttcatgcagatatgggatattggattgaaagcgagaaaaacgaaacttggaaactagcaagagcatcattcatcgaagtaaaaacctgtatatggccaaaaagccatacgttatggagcaatggggtattagaatcagaaatgattatacctaagatctacggcggacctattagccagcacaattataggccgggctattttacgcagactgccgggccatggcacctaggtaaattagagcttgactttgatttatgcgaagggacaactgtagtagtcgatgaacattgtggctaccgagggccgagtctacgaacaactacagtgacaggtaaaacaattcatgaatggtgttgcagatcgtgtaccttaccgccgttacgattcaggggagaggacgggtgttggtatggtatggagatcagacccgtgaaggaaaaagaagagaatctagtacgatctatggtatccgccggaagcggcgaagtagacagcttttcattgggtatactatgtgttagtatattgatcgaagaagtaatgcgaagcagatggtcccgaaagatgttaatgacagggacactagcggtattcttactcctaatcatgggccaactcacgtggaacgatttaatcagattgtgtataatggttggagcgaatgcgagcgacagaatgggcatgggaactacatatctcgctctaatggcaacatttaagatgcgacctatgtttgcggtggggttgctatttaggcgactaacaagtagagaggttctactattgactatcggtctttcactcgtcgcaagtgtggaacttccaaactcattggaggagttaggggacggcttggctatgggaataatgatgctgaaacttctaactgatttccaaccccatcagttatggacaacgcttttaagtctcacgtttattcgtactagtttatcacttgactatgcgtggaagacaatggccatggccttatccattgtaagcttgtttccgttatgccttagcaccacttcccaaaaaacaacttggctaccagtattgctagggagttttggctgtaaacctctaacgatgtttttaataacagagaataaaatttgggggaggaaaagctggccaatcaacgaaggtattatggcggtaggaattgttagtattctattatcatctctattaaaaaatgatgttcctctagctggccctttaatcgctggaggaatgcttatagcatgctatgtaatttccggttcatctgcggacttgtcactggaaaaagctgcggaagtatcctgggaagaagaggctgaacacagcggcacatctcataacatactagttgaagtacaagatgacgggacaatgaaaattaaagacgaggaaagagatgatactcttactatcttgttaaaagcaacgcttttggcagtctcaggtgtgtatcccatgtcaatcccagcaactctttttgtttggtatttctggcaaaagaagaaacaacggtccggagtcttatgggatactccaagtccacccgaagtcgaacgggctgtactagatgatgggatatatcgtatactacaaagaggtctcctaggaaggtctcaagtgggagttggagtgttccaagacggagttttccatactatgtggcatgtaacgaggggagctgttctcatgtatcaagggaaaagactcgaaccttcgtgggcatcagtgaaaaaggacttaattagttacggaggcggatggaggtttcaaggttcatggaataccggtgaagaagtccaggtaattgctgtggagccaggcaaaaacccaaaaaatgttcagacaacccctggaacgtttaaaacaccagaaggagaggtaggtgcaatagctttagattttaaacctggtacatcgggatctccaattgtaaatcgagaaggtaaaatagtaggactttacggtaatggagtcgtgacgactagtggcacatatgtttcagcaatagcgcaagctaaagcatcacaggaaggccctctcccagaaatagaggatgaagtatttaaaaaaagaaacttaacaataatggatttacatccgggaagcggaaagacacgccgctatcttcctgccatcgtacgagaagcaatcaagaggaaattacgaacactaatattagcgccaacgcgtgtggttgcttcagaaatggcagaagcactcaaaggaatgcctataaggtaccagaccacagcagttaaatcagaacacacagggagagagatagtagatttaatgtgtcatgcgacttttacaatgagattattatcacctgtaagagtgccaaattacaacatgattataatggatgaagctcattttacagacccagcatcaatagcagctagagggtatatcagtacgcgtgtaggcatgggagaagctgcggctatattcatgacggctacacctccaggttctgtagaggcctttccgcaaagcaacgccgtaatacaagacgaagagagagatattcctgaacgatcatggaacagcggctacgattggatcactgatttcccgggaaaaacagtgtggtttgtcccgtcaatcaaatcgggaaacgacatcgctaattgtttacgaaagaatggaaaacgagtaatacaactctcaaggaaaacttttgatactgagtatcagaaaacaaaaaacaatgattgggattacgtagtaacaaccgatatatcagaaatgggcgctaattttagggccgacagagtaattgatccgaggcgctgtttaaaacctgtcatattaaaggacggcccagaacgggtgatactagcaggacccatgcctgtgaccgtagcatcggcggcccaaagaagaggacgtattggaagaaatcaaaataaagaaggtgaccaatatatttacatgggacaacctcttaacaacgacgaagatcacgcacactggaccgaagctaaaatgttattagataatataaacactccagaaggaattatacccgcattgttcgaaccggaacgtgaaaagagcgccgcgatcgatggcgagtacaggcttaggggcgaagcacgaaagacatttgtggaattgatgcgtagaggagatcttcctgtttggctatcgtacaaagtagcgagcgaaggatttcagtattctgaccgacgatggtgctttgatggcgaaaggaataaccaggtattggaagaaaatatggacgtagagatatggacgaaggagggggaaagaaaaaagttaaggccgagatggctcgatgcgagaacctattcggacccgctagcactaagagaattcaaagaatttgctgctggccgtagatcagtgagcggagacctaatactcgaaatcggaaaactaccacagcatttaacgttaagagcacaaaatgctttggacaacctggtaatgttacataactccgaacaaggaggaaaagcataccgccacgcaatggaggagctaccagatactattgagaccttgatgttgcttgcactaattgcagtccttacgggcggagtaaccctattttttttaagtggtaaaggacttgggaagaccagtataggcctcctatgtgtcatggcatcgtcagctttattatggatggcgagtgtagaaccccattggatagcagcatcaataatcctagaattttttcttatggtactgttaatacccgaaccagataggcaacgaacccctcaagacaaccagttagcatatgtagttatagggttgttattcatgatactcactgtcgccgcaaacgaaatgggtcttcttgaaactacgaaaaaagatttaggaataggtcacgttgctgctgaaaaccatcaccacgcaactatgttagacgtagacttaagacccgctagtgcatggacactctacgccgtcgcgactacagtaataacgccgatgatgagacataccatagaaaacacaacagcgaatatcagtttaaccgctatagcgaaccaagctgcaatactgatgggattagacaaaggctggccgatttccaaaatggatattggagtacctctactggcactagggtgctactcacaagtaaacccattaacgctcacagcagcagtactgatgcttgtagcacactacgcgataataggacctggtttgcaggccaaagctacgagggaggcacaaaagagaacagctgctgggattatgaaaaatcctacagttgatggtatagtgacgatcgatctagatccagttgtttatgatgcaaagtttgaaaaacaattgggacaaatcatgctgttgatcttatgcacaagccagattctacttatgagaacaacatgggctctatgcgaatctataacattagcaaccggaccccttactacgctatgggaggggagtccaggaaaattctggaatacaaccatagctgtgagtatggctaatatattccgtggaagttatttggcaggcgccggtctagcattttcattaatgaaatcattaggaggtgggaggcgcggaactggagcacaaggagaaacattaggagaaaaatggaaaaggcaactaaaccagctatctaaaagcgaattcaacacatataaaaaatcaggaataatggaagtagaccgatcagaagctaaagaaggtttaaaacgtggagagacaactaaacacgcagtctcaagaggcaccgcgaaactacgctggttcgtagaaagaaatctcgtaaaaccagaaggaaaagtaattgatctaggatgtggtcgaggtggttggtcatattactgcgcaggcctgaaaaaggtaaccgaagtcaaaggttatactaaaggtgggcccggtcacgaagagcctatcccaatggccacatatggatggaatctcgtaaaattacattctggaaaagacgtattctttacgccgcctgaaaaatgcgacaccttactctgtgatattggcgaatctagccccaatccgacaatcgaagaaggtcgaacacttcgggtattaaaaatggttgagccgtggttacgaggtaatcagttttgtattaagatattaaacccatatatgcctagcgtagttgagacgttagaacaaatgcagagaaagcatggtgggatgttagttagaaatcccttgagtagaaatagtactcatgagatgtactgggtatcttgcggaacagggaacatagtatcagcagtaaatatgacaagtcgtatgttattaaatcgatttaccatggcacacagaaaacctacgtacgagcgtgatgttgacctcggcgccggaacaagacatgtagcagtagaaccagaggtagcaaaccttgatataatcggccaaaggatagaaaatatcaagaatgaacacaagagtacttggcattatgacgaggacaacccttacaagacctgggcctatcacggttcatacgaagtaaaaccatcagggtcagcttcatcaatggtcaacggagtagtgcgtttattaacgaaaccttgggacgtcatcccaatggtcacacaaattgcaatgacagatacaacaccttttggccagcaaagggtttttaaagaaaaggtagatacacgtacaccaagagcaaaacgcggtacagcgcaaatcatggaagttacagcaaaatggttgtggggatttttatcaagaaataagaaaccacgtatatgtacacgcgaggagtttaccaggaaggtacggtcaaatgccgcgataggtgcagtcttcgtagacgaaaatcaatggaactccgctaaagaggcagtagaagacgaacgattttgggacttagtacaccgagaacgcgaactgcataagcaaggtaagtgcgcaacctgcgtatacaacatgatgggtaagagagaaaaaaaactgggtgagttcgggaaggcgaagggaagccgagcaatttggtatatgtggctcggagctcgtttcttagaatttgaagcattaggtttcatgaatgaagaccattggttctcaagggagaattcattatccggagtcgaaggtgaaggattgcacaaattaggatatattttaagggatattagcaaaattccgggagggaatatgtacgcagacgacacagcgggatgggatacaagaataacagaagatgatctacaaaatgaagccaaaattacagatataatggaacctgaacatgcactactggccacatccatatttaaactgacataccaaaataaagttgttagggtgcagcgtcctgccaagagtggaacagtaatggacgtaatttcgaggagagatcaacgaggatctggacaagtgggaacatatggcctaaataccttcactaatatggaagttcaactgattagacagatggaatctgaaggtattttcagtccaagcgaactggagacccccaatctagcaaaacgtgtgttggactggttagaaaaacacggggtagaaagactaaaaagaatggcaatatccggggatgactgcgttgtcaagcctattgacgacagattcgccacagccctaactgctttaaatgatatgggcaaagtacgtaaggatataccccaatgggagccgagcaaaggctggaatgattggcaacaggttcccttttgctctcatcactttcatcaactaataatgaaagatggccgtgagattgtagtaccctgtcgaaatcaagatgagcttgttggacgtgcaagagtatcccaaggagcggggtggagtttacgggaaacagcgtgcctaggtaaatcatatgcacaaatgtggcagttaatgtattttcatcggagggaccttcgcctagctgcgaatgctatatgttcggcggtacccgtagattgggttcccacgtcaagaactacttggagcatacatgcccatcatcaatggatgaccaccgaagacatgttatcggtttggaaccgtgtatggatagaagagaacccatggatggaggataagacgcatgttagttcttgggaagaagtaccgtatttaggcaaaagagaagatcaatggtgcggatctctgattggtttgactgcaagagcgacatgggccaccaatatacaagttgcaattaaccaagtaagaaggctgatcggaaacgaaaactacctagactatatgacaagcatgaaacgatttaaaaacgaaagcgatcccgaaggagcgttgtggtga

SEQ ID NO: 21133 - RNA, 9879 nt, synthetic construct
  misc_feature 1..9879: note = derived and/or modified CDS sequence (opt6) from DENV-1__FJ850077__SS-prME
  source 1..9879: mol_type = other RNA
tcagttaccatgttgttaatgttattaccaactgcacttgcattccacctcacgacgagaggaggagaacctcatatgatcgtctcaaaacaagaacgtgggaaatcattactttttaaaacttcagttggtgtgaatatgtgtaccctaatagctatggacttaggtgaattatgtgaagatacgatgacctataaatgtccccgaattacagaagtagaacccgatgacgtcgattgctggtgcaatgcaacagacacttgggttacatacggtacctgttcccaaactggagaacatagacgtgataaaagaagtgtcgcacttgcacctcatgtgggacttggattagaaacacgcacagaaacatggatgtcttctgaaggagcatggaaacaagttcaaaaagtagaaacctgggcactgagacatcccggattcacagtaatcgcattattcctcgctcatgctatcggaacgtcaattacacagaaaggaatcatattcatattactgatgctagtaacgccgagtatggcaatgagatgtgtaggaattggaaatcgagattttgtcgaaggattaagtggtgcaacgtgggtagatgtagtcttagaacatggcagttgtgtaacaaccatggcgaaaaataaaccaacattagatattgaacttcttaaaacagaggttactaatccggctgtacttagaaaactatgcatcgaagcgaaaatatcaaacacaaccacagactcgagatgtccaactcaaggagaggcaactctagtagaagaacaagatgcaaactttgtatgcagaaggacattcgttgataggggctggggaaatggatgcgggttatttgggaaaggcagcttactgacatgtgctaaattcaaatgtgtcaccaaactcgaaggcaaaatcgtccaatatgagaatttgaaatatagcgtgattgtcacagttcacacaggggaccaacatcaggtaggtaatgaaacaactgagcatggaaccattgcaactatcactccccaagcccctacgagcgaaatacaactgacagattatggtgcactaacattagattgttcaccacgcacaggactagatttcaatgagatggtactcctaactatgaaggaaaaatcctggctagttcataaacaatggtttttagacctgccgctaccatggacttcaggtgctagtacctcgcaggagacatggaatagacaagatctgttagttacatttaaaactgcgcatgctaagaaacaagaagttgttgtcctggggagtcaagaaggggccatgcataccgcactaacaggcgcaacagaaatacaaacctcaggtacaacgactatttttgctggccatcttaaatgtcgactaaaaatggataagttgacgttaaaagggatgagctatgtgatgtgtacaggatcttttaaattagaaaaagaagtggccgaaactcaacatggaaccgtgctggtacaagtcaaatacgaagggacggacgcgccgtgcaagattccgtttctaactcaggatgaaaaaggagttactcagaacggaagacttataactgctaatccgatagtcactgataaagaaaaaccagtgaatatagaaacagaaccaccctttggcgaatcctacattgtggtcggagctggagaaaaggctttaaaattaagttggttcaaaaagggctcgagcatcgggaaaatgttcgaagccacagctcgaggagctagaagaatggcaatactgggagatacagcatgggactttggctctataggaggtctattcacttcagtcggcaaattaattcaccaagtctttggaactgcatatggagtgctcttttcaggagtgtcatggacaatgaaaatcggtataggtatacttctcacatggctaggacttaactccagatcgacttcgttaagcatgacttgcatcgcagttggaatggtaacattgtatctaggcgtgatggtacaggcggatagcggttgcgtaatcaattggaaaggacgtgaacttaaatgcggaagtggaatatttgttacaaatgaagtacatacatggactgaacagtacaagtttcaagctgacagcccgaaacgacttagcgccgcgatagggaaagcatgggaagagggtgtatgtggtataagatccgcaacccgtttagaaaatataatgtggaaacaaatatcgaatgaattaaattacatattattagaaaacgacatgaaatttactgttgttgtaggcgacgcgaatggaatattaacacaaggcaagaaaatgattagaccacaaccaatggaacataaatactcttggaaatcatggggtaaagcaaaaataataggcgcagacatacagaatactacatttataatcgacggaccagacacaccagagtgcccggacgaccaaagagcgtggaacatctgggaagtcgaggattacggatttggcatatttacgacaaacatatggcttaaattaagagacagttacacacaaatgtgtgaccatagacttatgtcggcagcgataaaagatagcaaagccgtacacgcggatatgggttactggatagagagcgagaagaatgaaacatggaaattagctcgagcatcctttattgaagttaaaacgtgtatttggccgaaaagtcatacactttggtcgaatggtgttctcgaaagcgagatgattattccaaaaatttacggtggacctacctcacaacataactatagaccaggatacttcacccaaacggccggaccttggcatttaggtaaactggaattagactttgatttgtgtgagggaacaaccgttgtagtagatgagcactgtggataccgtgggccaagccttagaactacaacagtgactggtaaaatcatccatgaatggtgctgcagaagttgtactttaccaccgttgaggtttaggggcgaagacggatgttggtacggtatggaaatacgcccagtgaaagagaaggaggaaaatttagtaaggtctatggtaagcgcaggttcaggtgaagttgactcattttctctgggaattttatgtgtcagtattttaattgaggaggtaatgcgcagcagatggagtcgaaaaatgttgatgacaggaacactagccgtatttcttttactcatcatggggcaactaacgtggaatgatctaattagattatgtattatggttggtgctaacgcatctgatagaatgggaatgggaaccacttatttggcattgatggctaccttcaaaatgcgtccaatgttcgcggttggccttctattcaggaaacttacctctcgagaagttctattactcactatcggactttctttggttgcatcagtagaattaccgaactcccttgaagaactcggagatggtctggcaatgggaataatgatgttaaagttgttaactgattttcaaccacatcaactatggactactttactaagtttaactttcataagaacgtcgctgtccttagattatgcctggaaaactatggcaatggcactcagcattgtgtccttattcccactgtgcttatcaacaacgtctcagaagacaacgtggttacctgttcttttgggatccttcggatgcaaaccactaacaatgtttttaattactgaaaacaggatatggggtagaaaatcatggcctatcaacgagggcgtaatggctgttgggatagtaagtatattattatcatcattgctaaagaatgatgtcccgttggccggaccattaattgcaggaggaatgctaatagcatgttacgttatctctggtagtagcgctgacctgagcttagagaaagctgccgaagtgtcttgggaggaagaagcagagcactcaggcacttcgcataacatccttgtcgaagttcaagatgacggcacaatgaagataaaagacgaagaaagggatgatacattgacaatactattaaaagctacactgctcgctgtttcaggagtatatccaatgtcaatccctgcgaccttatttgtatggtacttttggcagaaaaagaaacaaagatcaggagttctatgggatacaccctctccaccagaagttgagagagcagtcctggacgatggcatttatcgaatccttcagagggggttgttaggcagatcacaagttggcgtcggagtgttccaagatggagtatttcacacaatgtggcatgtaactcgtggagccgttctgatgtaccaagggaaacgtttagaacccagctgggcctcagtgaagaaagacttaattagctacggaggaggttggcgatttcaagggtcctggaacacgggagaagaagtgcaagtaattgctgtagaaccaggcaaaaatcccaaaaacgtacaaacaactcctggaacatttaaaaccccggaaggagaagttggagcaattgcattagattttaagccgggaacgtcaggttccccgattgtaaatagagaaggaaagatagtaggactgtatggaaatggagtagtaacaacttctggaacctacgtaagtgcgattgcacaggctaaggcgtcacaagaaggcccgctacctgaaatagaagatgaagtatttaagaaaaggaaccttacaattatggatttacaccctggtagtgggaaaacgagaagatacctccccgcaatagtcagagaagcaatcaagcgtaaactcaggacactaatattggccccaacaagagtagtcgccagcgaaatggcagaagcactgaaaggaatgccaatcaggtatcaaacaactgcggttaagtcggaacatacaggacgagaaatagtagatttgatgtgtcacgctacctttacgatgcgcctcttaagtcccgtccgtgtacctaattacaatatgatcataatggatgaagcacactttaccgacccggcaagcatcgccgctagaggatacataagtacgcgagtgggtatgggtgaagcggcagcaatttttatgacagcaactccacctggatcagttgaggcttttccgcaatcgaacgctgtaattcaggatgaagaacgagatatacccgaaagatcttggaatagcgggtacgattggataaccgattttccaggcaaaacagtctggtttgtaccttcaattaaaagtggaaatgacatagctaactgtctaaggaaaaatggtaaaagagtcatacaattgagtagaaaaactttcgacacagaatatcaaaagacaaagaacaacgactgggactatgtagtaacaacagacatttcagaaatgggtgcgaactttagggcagatcgcgtgatagatcctagaaggtgcttaaaaccggtaattcttaaggatggccctgaacgtgtcattttagcgggcccaatgccggtgacggtcgctagtgctgctcagagaaggggtagaatcgggagaaaccagaataaagagggggaccaatacatatacatgggtcaacccctcaataatgacgaagatcacgctcattggactgaagcaaaaatgcttttagacaatataaacactccggaagggataattcctgcactattcgaacctgagcgagagaagtcagcagcgatcgatggtgaatacagactaagaggtgaggcgagaaaaaccttcgtggaattaatgagacgcggagatctaccggtatggttaagctataaggtcgcaagtgaaggcttccaatattcagacagaagatggtgttttgatggagaaagaaataatcaagttctagaagagaatatggatgtagaaatttggacgaaagaaggcgagcgcaagaagctaaggccaagatggctggatgctaggacgtatagtgatccgcttgcattaagggaatttaaagagtttgcagcaggacgccgttccgtttcaggagatctgattcttgaaattggaaaacttccacaacatcttaccttaagggctcaaaatgctcttgacaacctggtaatgctacataactccgaacaaggaggaaaagcatatcgtcatgcaatggaagaattacccgatactatagagactcttatgttactcgcattaattgcagtacttactggaggcgtaacacttttcttcttaagcggaaaaggcctgggaaagacctcaattggactattgtgcgtaatggcaagttcagcgctattatggatggcatcagttgaacctcattggatcgcagcttcaataatcctagagtttttcctcatggtattgttaatcccagaacctgacaggcagcgaactccccaagataatcaattagcttatgttgtcattggactgctattcatgattttgacagtagcagcaaatgagatgggtttattagaaacaacgaaaaaggacctaggcattggccatgttgccgctgaaaaccatcatcatgctactatgttagatgtagatttgaggccagcatctgcatggaccctatacgccgttgctacaacagttattactcctatgatgagacatacaatagaaaatactaccgcaaatatatccttgaccgcgatcgcaaaccaagcggcaatattgatgggcctagataaaggttggccaatatcaaaaatggacatcggcgttccactacttgcgttagggtgttactcacaggtaaatccactcacccttaccgccactgtcctaatgttagtggctcactacgcaatcataggaccaggattacaagcaaaagcgactagagaagcacagaaaagaacagcggctggtattatgaagaatcctactgtagatggaatcgtcacgattgacttggatccagttgtatatgacgctaaatttgaaaaacaactaggccaaataatgttattaatattgtgcacaagccaaattcttcttatgcgaaccacttgggcgttatgtgagagcatcaccttagcaactggacctctcacaacattatgggaggggtcaccaggaaagttttggaacacaactatagctgtctccatggctaatatctttcgagggtcttatttagcgggagcaggattagcgttctcattaatgaagtcattaggaggcggaagaagaggcacaggcgcgcagggtgaaactctaggtgaaaagtggaagagacaactaaatcaactcagtaaaagtgagttcaatacctataagaaaagcggtataatggaagtagaccgctctgaagccaaagaaggtttgaaacggggtgaaaccacaaaacatgccgtctcacgaggaacagcaaaattaagatggttcgtagaacgtaatctggtgaagcctgaaggtaaggtaatagatctaggctgcggacgtgggggttggtcgtactattgcgcagggctcaagaaagttacagaggtaaaaggctacaccaaagggggaccgggccacgaagaaccaataccaatggcaacatatggatggaatctagtcaaactgcactcgggaaaagacgtattctttacacccccagaaaaatgcgacacgttgctttgtgacatcggcgaatcatcgccaaatccgacgattgaagaaggaagaaccttgagagtactaaagatggtcgagccatggttaagaggaaatcaattttgtatcaaaatactcaatccttatatgccaagtgttgttgaaacattagagcagatgcaaaggaaacacggaggaatgctggtgaggaatcccctttcccgaaattcgacacacgagatgtattgggtctcctgtggcacggggaacatagtgtctgctgtaaacatgacctctcgaatgttactaaatcggttcacaatggcgcaccgaaagccaacatatgaaagggatgtagacttaggagctggtacgcggcacgtggcggtagaacccgaggtagcgaatctagatattataggtcaacgaatagagaacattaaaaatgaacacaaaagcacatggcactatgacgaggacaatccgtacaaaacatgggcgtaccatggatcatatgaggtaaaaccgagtggatctgcatcatcaatggtaaatggagtcgttcgattactcactaaaccttgggacgtaattcctatggtaacgcaaatagctatgacggacactacccccttcggacagcaacgggttttcaaggaaaaggtggacaccagaacacctagagctaaaagaggaaccgctcaaataatggaagtcacagcaaagtggctctgggggtttttgtcaagaaacaaaaagccccggatctgtacccgagaagagttcacaaggaaagttagatccaatgctgcaataggtgctgtctttgtggacgaaaatcagtggaactctgccaaggaagcagtcgaagatgaaaggttctgggacttagttcatagggaacgagaattacacaaacaaggaaagtgtgctacttgtgtatacaatatgatgggaaaacgggagaagaaattgggagagttcggtaaggcgaagggttctagagctatatggtatatgtggctaggagctagattcttagaatttgaagcattaggtttcatgaatgaggatcattggttctctcgagaaaacagtctaagcggagtagaaggggaggggcttcataagttaggttacatcttaagagacatatccaagattccgggaggaaacatgtatgctgacgacacagcaggttgggacactcgaataacagaagacgacttacaaaatgaggcgaaaattacagacattatggaaccggaacatgcattattggcaacttcaatattcaaactaacatatcaaaataaggtagttagggtacagaggccagcaaaatcgggtacggtcatggacgtaatttcaagaagggatcagagggggtctggacaagttggaacgtacggtttaaacacttttacaaacatggaagtccaattaatacgtcaaatggagtctgaaggcatcttcagtccttcagaactggaaactcccaatcttgctaaaagggtcctagattggttggaaaaacacggcgcagagaggctaaaacgcatggcaatcagtggcgatgattgtgtggtaaaaccaatagacgaccgatttgcgacagcccttacagcattgaacgatatgggaaaagtaagaaaagatatcccacaatgggaaccatcaaagggttggaatgactggcaacaagtaccgttttgttcacaccactttcaccaactgataatgaaagacggaagggatattgtagtaccttgtcgaaaccaagacgaattagtcgggagagctcgtgtatcacaaggtgctggatggagtctaagggaaaccgcgtgtctcggcaaatcatacgcacagatgtggcaactgatgtactttcatagaagagatctgagacttgctgcaaatgcaatatgtagtgcagtcccagtcgattgggtaccaacttcccgcaccacctggtcgatccatgcacaccaccaatggatgacaacagaagacatgttgagcgtatggaatcgagtatggattgaagaaaatccttggatggaagacaaaacacatgtctccagctgggaagaagtcccttatctagggaagagggaagaccaatggtgtggcagtttaatagggctgacagcgagagcaacatgggccacaaacatccaagtagctataaatcaagtacgacgcctcataggtaatgaaaactacttagattatatgacatcaatgaaaaggttcaaaaacgagtcagacccagaaggtgcgctctggtaa

SEQ ID NO: 21134 - RNA, 9879 nt, synthetic construct
  misc_feature 1..9879: note = derived and/or modified CDS sequence (opt6) from DENV-1__FJ850081__SS-prME
  source 1..9879: mol_type = other RNA
agcgtgacaatgttgttaatgctacttcctacagcactagcatttcatcttactacgcgaggaggtgagccacacatgatcgtgtcgaaacaagaacgagggaaaagtctattgttcaaaacaagcgtcggggtaaatatgtgcactttgattgcaatggatctaggcgagttgtgcgaagacacaatgacatataaatgcccaaggattacagaagctgaaccggacgacgtagattgctggtgcaacgcgacggatacgtgggtcacttacggaacttgtagtcaaactggagagcaccgtcgagataaacgctcggtggcactagcaccacatgtcggtctcggactcgagacacgaacagagacatggatgagttctgagggagcatggaaacaaatacaaaaagtcgagacgtgggctctaaggcatcctgggttcaccgttatcgcgctattcttagctcacgcgattggaacaagtataacccaaaaaggaataatctttatattactaatgctagtcactcctagtatggcaatgaggtgtgtagggataggaaacagagattttgtagagggcctaagcggagcaacatgggtagacgtagtgttagaacatggatcatgcgtgacaaccatggccaaaaataaaccaacattggatatcgaattgctaaaaaccgaggttactaatcctgcagtattacgtaaattatgtattgaagcaaaaataagcaatacgacaaccgactctcgatgtccaacacaaggagaggctaccttggttgaagaacaagacgcgaacttcgtctgtagacgtactttcgtggatagaggatggggcaatgggtgtggtttatttggcaaaggttcattattgacctgcgcaaaattcaaatgtgtcactaaactcgaagggaaaatagtgcaatatgagaatctaaaatatagcgttattgtcacggttcacacaggagaccaacatcaagtaggtaacgaaacgactgagcatggtactatagcaacaatcacccctcaagcgcccacttcagaaatacaattaaccgactatggtgccttaactctagactgttcgcccagaacgggcttagatttcaacgagatggttctgttaacaatgaaagaaaaatcttggctggtacacaaacaatggtttctggatctgcctctgccctggacaagtggagcgtcaacttcccaagaaacctggaatagacaggatttgttagtaacatttaaaactgcgcatgcaaagaaacaagaagtagtagtgttagggtcacaggagggggcaatgcataccgctttaacaggagctacagaaattcaaacttcaggaacaactactatatttgcaggacatctaaaatgtaggttaaaaatggataaactaacactaaaagggatgtcgtatgttatgtgcacgggcagcttcaagctcgaaaaagaagtagcagaaactcagcacggaacggtactcgtacaggtcaagtacgagggaactgatgcaccttgtaagatcccattcctaacacaagatgaaaagggcgtaacacaaaatggaagacttattacagctaatccaatagtgactgataaagaaaaaccggtgaatattgaaacagaaccaccttttggagagagctacatcgtagtaggggctggagaaaaagccctaaaactcagctggttcaagaaaggatcgagtattggaaagatgttcgaagcaacggcccgtggggctagacgaatggccatattgggggatacagcctgggatttcggcagcatcggagggttatttacatcggtcggtaagttaatacatcaagtcttcggcacagcatatggagttctatttagcggagtcagctggacgatgaaaatagggattggaatactacttacctggttagggctaaacagccgttctacaagtcttagtatgacctgcatagctgtcggaatggttacgttgtatctaggagtcatggtccaagcagacagcggatgtgtaataaactggaaaggacgagaattaaaatgcggcagtgggattttcgtaacaaatgaagttcatacttggacagaacaatataaattccaggcagattctccaaaacgtttgagtgctgcaataggcaaagcgtgggaggagggcgtctgtggaatacgttctgcaacccgactagaaaatataatgtggaaacaaatttctaatgaattaaattatatacttctcgaaaatgatatgaaatttaccgttgttgtcggggatgctaacggcattcttgctcaagggaagaaaatgatacgaccgcaacctatggagcataaatatagctggaaaagttggggtaaagcaaaaatcattggggcagatattcaaaatacaacatttatcatcgatggccccgatactccggaatgtcccgatgaccaacgagcctggaatatatgggaagttgaagattacggattcgggatattcacgactaatatatggttaaaacttagagacagtcacacacaaatgtgcgatcataggttaatgtcagccgcaataaaagattcaaaagcagtacatgcagatatgggatattggatagagagcgagaaaaatgaaacatggaaactagctagggcttcgtttattgaagtgaagacatgtatttggccaaagagccatactttatggtcaaatggagtgttggagagcgaaatgattattcccaaaatctatggagggccaatttcgcagcacaactatcgaccaggatattttacccaaacggcggggccatggcacttagggaaattagaactggactttgatctatgcgaaggaacaaccgttgttgtagatgaacattgtggatacaggggaccatcacttaggaccactactgtaacaggcaaaattatacatgagtggtgttgtcgtagctgcactctaccacctctcagattcagaggtgaagatgggtgctggtatggaatggaaatccgcccagttaaagaaaaagaagaaaatttagtaagatcgatggtttcagccgggagcggggaagtagattcattttcgttaggaatattatgcgtctcaatcttaatcgaagaagttatgaggtctagatggagtagaaaaatgttaatgacagggacactggccgtttttctattgttaataatggggcaacttacgtggaatgacctaatacgattatgcataatggtaggagcaaatgcttcagaccgtatgggaatgggtacaacctatctagccctcatggccacattcaaaatgcgtcctatgttcgcagtgggactattattcagaagattaacatctcgagaagtactattgctaacaataggtttatcactcgtagcttccgtagaactacctaatagcttagaggaattaggggacggattggcaatgggaattatgatgctaaaacttttaacagacttccaaccacaccagctatggaccactttactcagcttgacctttataaggaccagtcttagtctagattatgcttggaaaaccatggcaatggcattatccattgtttcattgttcccactctgtttaagtaccacctctcagaaaactacatggctacctgtcctgcttggaagtttcggatgcaaacccctaacaatgtttcttataacagagaataagatctggggtaggaagagttggcctatcaacgaaggaatcatggcggtaggaatagtcagtatcctactgagcagtttgctcaaaaatgatgtaccactagcaggaccattgatagccggtgggatgttaatcgcatgttacgtaataagtggaagcagcgccgacctatcactagaaaaggctgccgaagtatcgtgggaagaagaagcagaacactctggaacgtcacacaatatacttgtcgaggtgcaagacgatggaactatgaaaatcaaggacgaagaaagggatgatacattaaccatattattaaaggctacgcttctagctgtttcaggagtctatccaatgtcaatcccagctacactatttgtatggtatttctggcagaagaagaaacaaaggtcaggagtactctgggacacaccttcgccaccggaggtagaacgtgccgtgttagatgacggtatatatcgaattttacaacgaggactactaggccgatcacaggtaggtgtgggagtgttccaagatggggtgtttcacacgatgtggcatgtcacccgaggtgctgtcctgatgtatcagggtaagaggctggaaccttcttgggcaagtgtaaagaaagatcttatatcgtacgggggtggctggcggtttcaaggaagttggaacacaggcgaagaagtgcaagtaatagcggtagagccgggtaaaaatcccaaaaatgttcaaacaacgccaggtacattcaaaactcccgagggggaggttggtgcaatagcgcttgactttaaaccgggtacaagtggaagtccaattgtaaatcgagaaggaaaaatagtaggactatatggtaatggtgtcgttaccacatcggggacatatgtcagcgcaatagcacaggccaaagcaagccaagaagggcctcttcccgagattgaagatgaagtatttaagaaacgaaacctaactataatggacttgcatcccggaagcggaaaaacaagacggtatctgccagcaatagtacgagaggcaattaaaaggaaactgcgtacccttattttagctccaactcgagtagtggccagcgaaatggccgaagcccttaaaggaatgccaattaggtaccaaaccaccgcagtaaaatctgagcacacaggccgcgaaattgtcgatctcatgtgtcatgccactttcacaatgagacttttaagccccgttcgtgtaccaaattataacatgatcataatggacgaagcgcattttacggatcctgcatcaattgcagccaggggttatataagtactcgtgtaggcatgggagaagctgcggccatatttatgacagcgacacctccaggaagcgcagaagcatttccacaaagtaacgcggttatacaagacgaggaacgagatatccccgaacgatcttggaactcaggatatgactggattacagattttccaggcaaaactgtttggttcgtaccaagcataaagagtggtaatgacattgctaattgtctcaggaaaaatggtaagagggttatccagttgtccagaaaaacatttgatacagagtatcagaaaacgaaaaacaacgattgggactatgtggttacaacagacatatccgaaatgggtgcaaatttccgtgcagacagagtcatagatcctcgtcgatgcttaaaacctgtcatcctgaaggatggacctgaacgagtgatactagcaggcccaatgccggttaccgtagccagtgctgcacaaagaagaggtagaatcggacgtaatcaaaacaaggagggagatcagtatatatatatgggacaaccacttaataatgacgaagatcacgcacactggacagaagcaaagatgttacttgacaatattaacaccccagaaggaataataccagctttattcgagcctgaacgagaaaagtctgcagcgatagatggagaatacagactcagaggagaggccagaaaaacattcgttgaactaatgcgcagaggagatttacccgtatggcttagttacaaagtagcctcagaaggattccagtatagtgatcgaagatggtgtttcgacggcgaaagaaacaatcaggtactcgaagaaaatatggacgttgaaatttggactaaagagggtgaacgaaagaaactcaggccaaggtggcttgatgctcgtacatattcggatccacttgcccttcgtgaatttaaggagtttgctgcaggacggagatcagtatctggagacctcatcctggagatcggaaaacttccgcaacacctaacgctacgtgcacagaatgcactagataatctagttatgctccacaactcagaacaaggtggtaaagcatatcgtcacgctatggaggaactaccggatacaatagagactttaatgctcttagcactcatagcagtacttactggaggggtaaccctattctttctatcgggtaaaggattaggtaaaaccagtatagggcttttatgtgtaatggcatcatccgcactcttatggatggcgtcagtggagccacactggatagctgcatcaattatcctcgagttctttctcatggtattattaattccagaaccggacagacaaaggacgccacaagataatcagcttgcatacgtagtaattggcttgttattcatgattctcacggtggcggcaaatgaaatggggttacttgaaactacaaagaaagatctcggcattggacatgtagcagctgaaaatcatcatcatgcaaccatgctggatgtagatctaagacctgcttcagcgtggactttgtatgcagtggctactaccgttataactccaatgatgcgccacacaatagagaatacgactgcaaatataagcctgacagcgatagcaaaccaagctgcaatcttaatgggcctcgacaaaggatggcctataagcaaaatggatatcggggtaccattgcttgcattagggtgctatagccaagtaaaccccttgactctaacagccgcagtattaatgctagtagctcattatgcaataattggaccaggattacaagccaaagctactagagaagctcagaaaagaactgctgctgggattatgaaaaaccccactgtcgacgggatagtgactatagatcttgatcccgttgtatacgatgctaagtttgaaaaacagttggggcagattatgttattaatactgtgcactagccagattctgcttatgagaactacttgggctttatgcgaaagcatcactctagccactggaccgctcactacattgtgggaaggaagtcctggtaaattctggaatacgactatagcggtttcaatggcaaatatcttcagaggctcctacttagcaggcgctggtcttgcatttagcttaatgaagagtttaggaggaggaaggagaggcactggggcgcaaggtgaaacgctaggggaaaaatggaagagacaacttaaccaattatcaaagtctgaatttaatacatataagaaatcaggtattatggaggtggacaggtcagaggcgaaagaaggtcttaaaagaggagagacgacgaagcacgccgtcagcagagggaccgccaaattaaggtggttcgtcgagcgcaacttagtaaaaccagaaggaaaggtcatagacctaggttgtggacgaggcggatggtcatactactgtgcgggcttgaagaaagtcactgaggtaaaaggttatactaagggaggccctggtcacgaggaaccaataccaatggctacgtatggttggaaccttgtaaaactgcactccggaaaggacgtatttttcactccacctgaaaaatgtgatacattgctatgtgacattggtgaatcatcgccaaaccccactatagaagaggggcgtaccctaagggttctaaaaatggtagaaccatggctccgtggcaaccaattctgcataaaaatactaaatccttacatgccgtccgtagtagaaacgttagaacaaatgcaaaggaaacatggcggaatgctagtgcgaaatcccctaagcagaaattcaacccacgaaatgtattgggtatcttgtggaacagggaatattgtttcagccgttaatatgacaagcagaatgttattgaataggtttactatggcacacagaaaacctacttatgaacgggatgtagatctaggtgcgggtactagacatgtagcagtcgaaccggaagtggccaatttggatattataggacagcgaattgaaaacataaagaatgaacacaaatcgacgtggcattacgatgaagacaacccatataaaacgtgggcgtatcatggttcatacgaagttaaacctagcggaagtgcaagttctatggttaatggagtagtgagattacttacaaaaccatgggacgtgattccgatggttacacaaattgccatgactgatactacaccatttgggcaacaaagagtttttaaagagaaagtagatacgaggactccacgagcaaagagaggtactgctcaaataatggaagttacagctaaatggttatggggattcctatcaagaaataagaaaccaagaatatgcactagagaagaatttactcgaaaagtaaggtccaatgccgcaataggcgctgtttttgttgatgaaaatcaatggaactcggcgaaagaagcagtagaggacgaacgtttttgggacttagtccacagggagagggaactacataaacaaggaaaatgtgcgacttgcgtgtacaacatgatgggcaagagagagaagaaactaggagagttcggaaaagcaaaaggaagccgagcaatatggtatatgtggttaggggcacggtttctggagttcgaggcattaggttttatgaacgaagatcattggttcagtcgcgaaaattcactctctggagttgaaggagaaggactacacaaactgggatatatcttaagggacatcagtaagatcccaggcggaaatatgtatgcagatgatactgcaggctgggatacaaggattacagaagatgacctgcaaaatgaggccaaaattactgacataatggaacctgaacatgcactactagcaacgtctatatttaagctaacatatcaaaataaagtcgtgagagttcaaaggccagcaaagagtgggactgtaatggatgtgataagcaggagagaccaaagaggaagtggtcaggtaggaacctatggactcaatacgtttacaaatatggaagtccaattaataagacaaatggaatcggaaggaatattttcgccctccgaattggaaactccaaatttggctaaaagagtactggactggttagaaaaacatggagcggaaagattgaaacgtatggcgatatctggtgatgactgtgtagtgaaaccaatagacgatcgcttcgcaaccgcactaactgctttaaatgacatgggaaaagtaagaaaagatattccgcagtgggaaccgagcaaaggctggaatgattggcaacaggtacctttttgttcacaccattttcatcaactaattatgaaagacggacgtgaaatagtggtcccatgccgcaaccaagatgaacttgtaggaagggctagagtctcacagggtgcagggtggtctctaagagaaactgcgtgccttggtaagagctatgcacaaatgtggcaactgatgtattttcatcgccgagacctaagacttgcagcaaatgcaatttgttccgcagtgcctgtagactgggtcccaacttcaagaacaacttggtccatacatgctcaccatcaatggatgactaccgaggatatgttatcagtctggaatcgagtttggatcgaggaaaatccttggatggaagataagacacatgtgtcgtcatgggaagaagtaccatacttaggaaaacgagaagaccaatggtgcggttcgctaatcggattaacagcacgtgctacatgggccaccaacatacaagtagccataaatcaagtaagaagattgataggtaacgagaattatctagattacatgacaagtatgaaacgtttcaaaaatgagtcagatcctgagggtgccttatggtaa

SEQ ID NO: 21135 - RNA, 9879 nt, synthetic construct
  misc_feature 1..9879: note = derived and/or modified CDS sequence (opt6) from DENV-1__FJ850084__SS-prME
  source 1..9879: mol_type = other RNA
agtgtaacgatgctactgatgctactaccaacagctctcgcgttccatttaacaacgcgagggggagaaccccatatgattgtgtcaaaacaagagagaggaaaaagcctacttttcaaaacgagtgtcggagtgaacatgtgtacactaatcgccatggatctcggagaactgtgcgaagacacaatgacatataaatgtccgagaattacagaagttgagcctgacgatgtcgactgttggtgtaacgcaactgatacatgggtgacgtatggaacgtgctctcaaacaggcgaacataggcgggacaagaggtcggttgcactggcaccccacgtggggttaggactagaaacacggacggaaacatggatgagcagcgaaggggcctggaaacaaatacaaaaagtagaaacatgggctttacgacatcctggttttacagtcatagccctctttctagcccatgcgataggaactagcataacacaaaaaggcatcatattcatacttctaatgcttgtaacaccatcaatggctatgagatgtgtcgggattggaaaccgcgattttgttgagggattgtctggtgcgacctgggttgatgttgtactggagcatggctcttgcgtaacaactatggctaagaacaagcccacattggatattgaattgttgaaaacggaggtaacgaaccctgcagtgttaagaaagttgtgcatagaagcaaaaatatctaatacaacgacagactcaagatgtccaacacaaggcgaagctacgttagtagaagaacaagatgctaactttgtttgcagaagaacattcgtagacagaggatggggtaacggctgtggtttatttgggaaaggatccctcttaacttgcgcaaaattcaagtgcgtaaccaaactggaaggtaagatagtccaatacgaaaatctgaagtactctgtaatagtcacagtgcataccggagatcagcaccaagttggtaacgaaactacagaacatggaactattgctacaatcacacctcaagctccaacttcggagatccaactcacagattatggagcattgacgctagattgtagtccacgaacaggccttgattttaacgagatggtattactgactatgaaagaaaagtcatggctcgtgcacaagcagtggtttttagacctcccactaccatggacaagtggcgcatctacctcgcaggaaacatggaaccgccaggatctgctagtaacgtttaaaactgctcacgcaaaaaagcaagaagttgtagtcctaggtagtcaagaaggggctatgcataccgcacttactggtgccacagagatacaaacatcaggtacaacgactatctttgcagggcacttgaagtgtcgccttaaaatggacaaactaaccctgaaaggaatgagctacgtaatgtgtacagggtccttcaagctggagaaggaagtcgcagaaacacaacatggcactgtgctagttcaggttaagtacgaaggtacagatgcaccctgtaagattccgtttttaacccaggatgaaaaaggggtgactcaaaacggaagattgataactgcaaatcctattgtgactgataaggaaaaacccgtaaatattgagacagaaccaccattcggggagtcctatatagttgttggagccggtgaaaaggcgctaaagctaagttggtttaaaaaagggtcatcaattggaaaaatgtttgaagccacagccaggggggcaagacggatggcgatactcggtgatacagcttgggattttggatcgataggaggcctatttacttcagtagggaagttaatacaccaggtctttggggctgcatacggtgtattgttttccggcgtatcatggaccatgaaaatcggcataggcatactattaacctggttagggcttaactcacgttctacgtcccttagtatgacatgcattgctgtaggtatggtaacattatacttaggtgttatggtccaagcggattcaggatgtgttataaactggaagggaagagaattaaagtgtggaagtgggatattcgtaaccaatgaagtacatacatggactgaacaatataagtttcaagccgacagtcctaaacgactaagtgcagcaatagggaaggcatgggaagaaggagtttgtggaataagatcagccacaaggttagaaaacatcatgtggaagcaaatatccaatgagttaaattacatacttttagaaaacgatatgaagttcaccgttgtagtgggtgacgccaacggtattctgacacaagggaaaaagatgatccgtcctcagccaatggaacacaaatattcatggaaaagttggggtaaagcaaaaatcataggagccgacatacaaaacacaactttcattattgatggccccgatactccggaatgcccagacgatcagcgcgcctggaatatatgggaagtagaggattacggcttcggaatttttacaacaaacatatggctaaaattacgagactcgtacacgcagatgtgcgaccaccgattgatgagtgccgcaataaaagattcaaaagcagtacatgcagatatgggatactggattgaatcagaaaaaaacgagacctggaaactcgcacgagcaagcttcattgaagtgaaaacatgcatatggcctaaaagtcatactttgtggagtaacggggtattagagtctgaaatgataataccaaagatttacggtggcccgacttcgcaacacaattatagacctggatattttactcagactgctggtccctggcatctaggtaaattagaactggacttcgacctttgcgaaggaaccaccgtggtagttgatgaacattgtggatatagaggaccaagtctaaggaccactactgtcacggggaaaattatccatgagtggtgctgtaggagttgtaccctaccccctctcagatttagaggcgaagatggatgctggtatggcatggaaataaggcccgtcaaagaaaaagaggagaatcttgtgaggtcgatggtaagtgcgggatctgccgaagtagacagtttcagtttgggtatactatgtgtctcgattctaatcgaagaagttatgaggagtcgctggtctagaaaaatgcttatgaccggaacgctcgcagtattccttttgttgataatggggcaattaacttggaatgaccttattagattatgtatcatggttggtgctaatgcatccgatagaatgggaatgggcaccacctatctagcactaatggcaacgttcaaaatgcgtccgatgttcgcagtagggctattgttccggaaactaacaagtagggaagttttactcttaactataggcctgtcattggtcgcaagtgtagaacttccaaattcgcttgaagaacttggggatggcctcgctatgggcataatgatgctaaaattgctaaccgattttcaacctcatcaactctggactacgctactgtcacttacatttataagaacatcgttgagcctcgactatgcatggaaaaccatggcaatggcattgagcatagtatcattgttcccactatgtttaagtacaacatctcagaagacaacatggctacccgtcctcttagggtccttcgggtgcaaacctctaacaatgtttctgataacagaaaataaaatttgggggcggaaatcctggcccataaacgaggggatcatggcagtaggtattgtgtcaattttattatctagccttctcaaaaacgatgttccactggccggccctctaatagcgggaggtatgttaatagcatgttacgttatctcaggtagctctgccgacttatcattagaaaaagcagctgaagtctcctgggaagaggaggcagaacattcaggtacatcacacaacatactcgtggaggtacaagacgatggaaccatgaagattaaagatgaggaaagagatgacactttaacaatactactaaaagcgacgttactagccgtgagcggcgtataccccatgtctattccggcaacgttatttgtatggtatttctggcaaaaaaagaagcaaagaagcggagtattatgggatacaccaagcccaccagaagtcgaaagagccgtcttagatgacgggatttaccggatcttacaaaggggcctattaggacgttcacaagttggtgtaggagtgtttcaagacggggtatttcatacgatgtggcacgtaactcgaggagcggttttaatgtatcaaggaaaacggctcgaaccatcgtgggcctcagtaaaaaaagatctaataagttacggcgggggatggcgatttcaaggtagttggaatacaggtgaagaagtacaagtaatcgctgttgaaccagggaaaaacccgaaaaatgtgcaaacaacacctggaacttttaaaacaccagaaggtgaggttggagctatcgcactcgattttaagcccgggacaagtggcagcccaattgtcaatagggaaggaaagatcgtaggtctatatgggaacggggtggtgactaccagcggcacatacgtatcggctatagcacaggctaaagcgagtcaggaaggacctttaccggaaatcgaagatgaagtattcaagaaaagaaaccttactataatggatcttcaccctggttcaggcaaaacaagacggtatctaccggcaatagtaagggaagccataaaaagaaaactacgcactttaatcttagcacctactcgggtggtagcatcggaaatggccgaggctttaaaaggtatgccaattcggtaccaaacaaccgcagttaaaagcgagcatacaggaagagagatagtagacctaatgtgtcatgctacctttactatgcgattactctcacctgtaagagtcccaaattataatatgatcataatggatgaagcacatttcacagacccagctagtatagcagcaagaggatatatatctacaagggtgggtatgggtgaagcagcagcaattttcatgactgcaacaccgccaggtagtgttgaggcatttcctcaatcaaacgcggtaatacaagacgaagaaagagatataccagaaaggtcatggaacagcggctatgattggattactgacttccccggaaaaacagtttggttcgtcccatcgattaaaagtggcaatgatatcgcaaattgtctgcgaaaaaatggcaaaagagtcatccaactaagtcgaaaaactttcgacacagaatatcaaaagactaaaaacaacgattgggattacgttgttacaacagatataagcgaaatgggagccaactttcgcgctgatcgagtaattgacccaagaagatgtctcaaaccagtgattctcaaagatggtccggagcgagttattctagcggggccaatgccagtcaccgttgcatctgctgctcaacgacgaggtagaataggccggaaccaaaataaagaaggcgaccaatatatatacatgggtcaaccattaaataatgatgaggatcacgctcactggacggaagcgaaaatgcttttagacaatataaatacccctgaaggaataattccagcactatttgagcctgagagagaaaaaagcgccgctatcgacggagaatacaggttgagaggtgaggcaaggaaaacctttgtagaactaatgaggcgtggtgatttacccgtctggctcagttacaaagtggctagtgaaggctttcagtacagcgatcgcagatggtgcttcgacggagaaagaaacaaccaagttctcgaagagaatatggacgttgaaatatggactaaagagggtgaaagaaaaaagctcagaccaaggtggctcgatgcacgtacctatagtgatccattggcattacgagagttcaaagaattcgccgcaggaagaagaagtgtctccggagacttgatattagaaatcggtaaattgccccagcacttgacgttgagagcacagaacgccctagacaatctcgtaatgttgcacaattctgaacaaggtggaaaggcttatcgccatgcaatggaagaattgccagatacaattgagactttaatgttattagcactaatagcagttctaacaggaggcgttactctcttctttctctctggaaaaggactcggtaaaacttccataggattattgtgcgtcatggctagctcggctttactatggatggcgagtgttgagccacactggatagctgcttcaatcatattagaattctttttaatggtattgctcataccagaaccagatcgacagcgtacaccacaggataaccaactggcatatgttgttattggcctgctttttatgatactaaccgtagccgcaaatgagatgggattattagaaaccactaaaaaagatctaggaataggccatgtcgctgcagaaaatcatcatcacgctacaatgctggacgtagatcttagaccagcatcagcgtggacgttatacgctgtcgcgacaaccgtcataacacctatgatgagacatacgattgaaaatactactgcaaacatatcactgacagcaatagcaaatcaggcagccatattgatggggctcgataaaggatggccaattagcaaaatggatattggagtaccattattagcattgggatgttactcacaagtgaacccactgacactgaccgctactgtactaatgttagtggcgcattacgccatcataggccccggattacaagcaaaagcaacaagagaggcccagaaaagaactgcagctggcattatgaaaaatccaaccgtcgatggtatcgttacaatagatttagaccctgtagtttacgatgctaagtttgaaaaacagttaggccaaatcatgctgcttatcctatgcacgtcacagattctattaatgcgaacgacttgggccttatgcgaatcaatcactttagctactggccccttaactactttatgggaaggaagcccaggaaaattttggaacactacaattgctgtttctatggccaacatcttcaggggatcttacttagctggcgctggattagctttcagcttaatgaaaagcttaggcggtggccgtagaggaactggcgcccaaggagaaacattgggtgagaagtggaaacgtcaattaaatcagcttagtaagagtgaatttaacacctacaaaaaatcaggtataatggaagtagaccgttcagaagcaaaagaaggtcttaaacgtggagaaactacaaagcatgcggtatcacgagggactgctaaactgagatggtttgtagaaagaaatcttgtaaagccggaaggaaaagtaattgacctaggctgtggacgaggagggtggtcgtactactgtgcaggtttaaaaaaagtaaccgaggtcaaaggttatactaaaggaggcccgggtcacgaagaaccgatccccatggcgacatatggatggaatttagtcaaacttcattccggaaaagacgttttttttactcccccggaaaaatgcgacacacttctttgtgatataggagaatcttccccaaatcccactatagaagaggggaggaccttgagagttcttaaaatggtggaaccatggctaagaggtaaccaattttgtataaaaatattgaatccctatatgccaagtgtagtcgagacacttgaacaaatgcagcgcaaacacggaggtatgttagtcagaaaccctctgtcccgtaatagcacgcacgaaatgtattgggtttcatgcgggacaggcaatatcgtatccgccgtaaatatgacatcacgcatgctattaaatcggtttaccatggcacatcgtaaacctacatacgaaagagatgtcgatctaggcgcaggcacacgccacgtagccgttgagccggaagtagcaaatctagacataataggtcaaaggattgagaacataaaaaacgaacataaaagcacttggcactatgatgaagacaatccctacaaaacatgggcctaccatggaagttatgaagttaaaccaagcggcagtgcgtcaagcatggtcaacggtgtagtacgtcttcttacgaaaccctgggacgtaattcctatggtaacccaaatagcaatgacagacacaacaccatttggacaacaaagggtatttaaagaaaaagttgatactcgaaccccaagggctaaacgtggaaccgcacaaattatggaagtaacagcaaaatggttatggggtttcttgtcgcgaaataaaaaaccgcgaatttgcaccagagaagaatttactagaaaagtacggtcaaatgcggcaataggtgcagtttttgtcgatgaaaaccaatggaattcagccaaggaagcagtagaagatgagagattctgggatcttgttcatagagaacgtgagctacataagcagggcaaatgtgcaacttgcgtttataatatgatgggcaaaagagaaaaaaaactaggtgaatttggtaaagcaaaaggtagtcgagcaatatggtatatgtggttaggggcgcgattcttagagtttgaggcactaggtttcatgaatgaagatcattggttcagtcgagaaaattcactttcaggtgtcgagggagaaggacttcataagttgggctacatactaagagatatttcaaaaattcccggaggaaacatgtatgcggatgatacagccggatgggacactcgcataacagaagacgatttacaaaacgaagcaaaaataacagatataatggaaccagaacatgccctattagccacatcaatttttaaacttacctaccagaataaagtagtgagagtccagaggccagccaaatccggtactgtgatggacgtaatttctcgacgtgatcaacgagggtcaggccaagtaggaacctacggcttaaacacctttacgaacatggaggttcaattaattagacaaatggaatcagaaggaatattctcacctagcgaactagaaacacctaatttagctaagcgagtcctagattggcttgagaaacacggtgctgagcgactcaaacggatggctatctcaggcgacgactgcgtggtaaagccaatagacgataggttcgcaacggccctaaccgcactaaatgatatgggcaaggtaagaaaagacattccccaatgggagccaagcaaaggatggaacgattggcaacaagtgcctttttgcagtcatcattttcaccaacttatcatgaaagatgggcgtgatatagtcgtaccatgtcgaaaccaagacgaattggtaggaagagccagagtatctcaaggagcgggctggtcattacgtgagactgcctgtttagggaaaagttacgcacagatgtggcaacttatgtactttcacagacgcgatttaagactagctgcaaatgctatatgttcagctgtcccagtggattgggtaccgacgtctagaacaacatggagcatacacgcacaccatcaatggatgacaaccgaagacatgctctccgtttggaaccgtgtgtggattgaggaaaacccctggatggaagataagacacacgtctcaagctgggaagaggttccctatttaggtaaaagggaggatcaatggtgtggaagcttaatcggacttaccgcaagagcaacatgggctacaaatattcaagttgctattaaccaagtaagaagattaattgggaatgaaaattatctagactatatgacttcaatgaagcgattcaaaaacgagtcagatcctgaaggcgcgctatggtaa

SEQ ID NO: 21136 - RNA, 9879 nt, synthetic construct
  misc_feature 1..9879: note = derived and/or modified CDS sequence (opt6) from DENV-1__FJ850087__SS-prME
  source 1..9879: mol_type = other RNA
agcgtaactatgctcctaatgctattaccgactgcgcttgcctttcacctgacaactaggggaggagaacctcatatgattgtatcaaaacaagaacgaggaaaatcattactatttaaaacttccgttggagttaatatgtgtactctcatcgctatggatctaggtgaactatgtgaagataccatgacttataaatgtccgagaattaccgaagcagaacctgatgacgtagattgctggtgcaacgccacggatacttgggtcacttatggaacttgctcacaaacaggagaacatagaagagataaacgctcagtagcacttgcaccccacgtaggattaggattagaaacacggacggaaacctggatgtcgtcggaaggagcctggaaacaaatacaaaaagtcgaaacttgggcactaagacatccaggtttcactgtaatagcactatttttagctcatgcaattggaacttcaatcacacaaaaaggcatcatcttcatattattaatgttagtcacaccgtctatggcaatgagatgtgttggcataggcaaccgggatttcgttgaaggcttgagtggtgcaacttgggtcgacgtagtgctcgaacatggatcatgtgtaacgaccatggctaaaaataaacctacgttagacattgaactacttaaaaccgaagtgactaaccctgctgtccttagaaaactctgtatagaagcaaaaataagcaacacgacaacagacagtcgatgtccaacgcaaggcgaagctaccttagttgaagaacaagatgcaaactttgtgtgtagaaggacttttgtcgacagaggctggggcaatggatgtgggttatttggtaagggtagtttgctaacatgcgcgaaattcaagtgcgtaacgaaactggagggaaagattgtccaatatgagaatctaaagtattctgtcatcgtcacggttcatactggagaccagcatcaggttggaaacgaaacaaccgagcacggaactatagcaacgattacccctcaggccccaacatcagaaatacaattaacggactatggagcgttaacattagactgcagtcctcgtactggcttagattttaatgaaatggttttattaacaatgaaggagaaaagctggctagttcacaaacaatggtttcttgatcttccccttccatggacaagtggggcaagcacaagtcaagaaacctggaatagacaagacctattggtcacttttaaaaccgctcacgccaagaaacaagaagtagttgtattaggaagccaagaaggtgccatgcatactgctttgacgggagcaacagaaattcagacaagtggaaccactactatatttgctggccaccttaaatgtagattaaaaatggataagttaactctaaaggggatgtcttatgtaatgtgcacgggctcgtttaaacttgagaaggaagttgctgaaactcaacatggaacagtgcttgtacaagtaaaatacgaagggaccgacgcaccatgtaagatcccgtttctgacacaggatgaaaaaggagtaacgcaaaatggccgcctcatcactgccaatcctatagttactgataaagaaaaaccagtgaacatagaaacagaaccaccgtttggagaatcatatattgtcgttggtgccggtgaaaaagcacttaaactatcttggtttaaaaagggatcgagcataggcaagatgtttgaagctacagcaaggggtgcgcgcaggatggctatattaggtgacactgcttgggacttcggaagcataggcggcctgttcaccagtgtcggaaaattaatacatcaagtatttggaacagcatacggcgtcctcttctctggggtgtcgtggacaatgaaaataggaatcggaattttactgacctggttgggactaaattcaagatcaacttcattatctatgacgtgtatagcagttggaatggtcacattgtatctaggggtaatggtccaagccgatagtggctgtgtaataaactggaaaggaagagaattgaagtgtggaagcgggatatttgtaaccaatgaggtccatacatggacagagcagtataaattccaagcagattccccaaaaagactctcagcagctatcggaaaagcatgggaagaaggagtctgtgggataagatcagcaacacgactagaaaatatcatgtggaagcaaataagtaacgagttgaattacatactattggaaaatgatatgaagtttacagttgtagtaggggacgtaaatggaatattagctcaagggaagaaaatgatacgaccacagccaatggaacacaaatatagttggaaatcctggggcaaggcaaaaattattggagcggacatccagaacaccacattcattatagatggaccagacacacctgaatgtccagacgaccagagagcgtggaatatctgggaagtggaagactatggattcggtatcttcactacaaatatctggttaaagctaagggattcgcacacacaaatgtgcgaccacaggctcatgtcagctgccataaaagattcaaaagcagtccatgctgatatgggttactggatagaaagtgagaaaaatgaaacatggaagctcgctcgagcctcgttcatagaagtcaaaacttgcatatggcctaaaagtcacacactctggtctaatggtgtattagaatcagaaatggtaataccgaaaatttacggagggcctataagccagcacaattatcgaccagggtactttacacagacagcgggcccttggcatttaggaaaattagaactagactttgatttatgcgagggcaccacagtcgtagtagacgagcattgcgggtataggggtccatcccttagaactacgacagtaacaggaaaaataattcacgaatggtgttgtaggtcgtgtactttacccccactacgatttagaggtgaagatggatgctggtatgggatggaaattcgtccggttaaagagaaagaagagaatcttgttagatcaatggttagcgcaggatcgggagaagttgactctttttccctagggattctatgtgtgtcgatacttatagaagaggtcatgagatctcgatggtcacgtaagatgttaatgactggaacattagtagtgtttttactactaattatggggcagcttacctggaatgacttgattagattgtgtatcatggtaggagcgaatgccagtgacagaatgggtatggggaccacgtacctcgctcttatggcaactttcaagatgcgaccaatgttcgcagtaggactactatttaggcgacttaccagcagagaagtattgctgctcaccgtaggcttaagtttggtagcatcagttgagctacccaatagtttagaagaattaggagatggactggcgatgggaataatgatgttaaaattactgactgatttccagccccatcaattatggacgacattattgtctctaacatttattagaacaagtctatcgttggattacgcatggaaaaccatggccatggcactctctattgtgagcctattcccgctttgccttagtactacaagtcagaaaacaacatggctacccgtcctattagggagttttgggtgcaaacctctaacaatgttcttaataacggagaataagatatggggtcgaaaaagttggccaataaatgaaggaataatggcagtaggaatagtttcaatacttttatcatcactcttgaaaaacgacgttccgctagctggaccattgatagccggaggaatgttaattgcttgttatgtcatatctggatcgagtgcggacttgagcctagagaaagcagccgaggtcagttgggaagaggaagctgaacattcaggaacaagtcacaatattctcgtagaggtccaagatgatggtacgatgaaaattaaagatgaagaacgtgacgacacacttacaatactcttaaaggctacgctattagcagtaagcggtgtatatccaatgagcataccagcgactctatttgtctggtacttttggcagaagaagaaacaacgaagcggagttttatgggatacaccatcaccacctgaagtagaaagagccgtgttggatgatggcatataccgtattctacaaagagggctattaggtagaagtcaagtcggagtaggggtactgcaagatggtgtctttcacactatgtggcatgttacgagaggcgccgtactcatgtatcaggggaaaagattagaaccatcatgggcgtcggtcaagaaagatttaatatcatatggcggagggtggcgttttcaggggagctggaataccggggaagaagtgcaagttatagccgttgaaccgggcaaaaatcctaaaaatgtacaaactacgcctggaacgttcaaaacccctgaaggggaagtaggagcaatcgcactagattttaaaccgggaacaagcggttcgccgattgtgaatagagaaggaaaaattgtaggtttgtacggaaacggtgttgttacaaccagcggaacttacgtatcagcaatagcgcaagcaaaggcaacccaagagggaccgctacccgaaatagaagacgaagtatttaaaaagcgaaacttgacaattatggatttgcatcctggtagtggcaagacgcgaagatatcttcctgcaatcgtaagagaagcaatcaagagaaaattgcgtacactaatcctagctccaactagagtagtagcttccgagatggcagaagctctcaaaggcatgcctatacgctaccaaactacagctgtcaagtctgagcatacaggccgcgaaatcgttgacttaatgtgtcatgctacattcaccatgagattactcagcccagtaagagtaccaaattataatatgataataatggacgaagcacattttacagaccctgcaagtattgcagccagaggatatatctcaacaagagtgggaatgggtgaagcggccgcaatattcatgactgccacgccgccgggatcagtcgaagcctttccacagagtaacgcggtcattcaagacgaagaaagagacattcctgaaaggtcgtggaactcagggtacgactggattactgacttcccgggtaaaactgtatggtttgtccccagtataaagagcggtaacgatatcgcaaactgcttaagaaagaatggaaaaagagtgatacaactatcaaggaagacattcgatacggaatatcagaaaactaaaaataatgattgggattacgtcgttacaacggatatcagcgaaatgggtgctaattttagggccgatagggtaattgatccaagaagatgtttgaaaccggtgatattgaaggaaggaccagaacgcgtaattctagctgggccaatgccagtaactgtggctagtgccgctcaacgccggggtaggataggaagaaaccaaaacaaggaaggagatcagtatatctacatgggtcaaccgcttaataatgacgaggatcacgcacactggacagaggcaaaaatgttattagataatataaacacaccagaaggcattattccggcattatttgaacctgaacgagaaaagagcgctgccattgatggggaatatcgattacgtggtgaagcaagaaaaacattcgtggaacttatgcggcgaggggacctacctgtgtggttatcgtacaaagtagcatctgagggattccaatacagtgaccgccgatggtgttttgatggtgagagaaacaatcaagttcttgaagaaaacatggacgtggagatttggacaaaggaaggtgagcgaaagaaattacgcccgaggtggttggatgcacgcacttattccgacccgctggcgcttagagagtttaaagagttcgcggcagggagacgaagtgtgagtggcgacttaatactcgaaatagggaaactgccccaacatttaactcttagggctcaaaacgccttggataacctagttatgcttcataatagtgagcagggcggaaaagcatatagacatgctatggaagaattaccagatacgatagagacattaatgttactagctcttattgcagttctcacgggtggggttacactattcttcctatccgggaaagggcttggaaaaacatcgataggtttactctgtgtaatggcttcctcagcattactgtggatggcatctgttgaaccgcattggatcgctgcatccataattttggagttcttcttaatggtactgctaatacctgagccagacagacagagaacgccccaagataatcaattagcatacgttgtaataggtctgttgttcatgatcctgacggttgctgcaaatgaaatgggacttttggaaacgacgaagaaagacctcggaattggtcatgtggctgtagaaaatcaccaccacgcgactatgttagacgtcgacttaaggccagccagtgcctggacgctctacgccgtcgccacaaccgtcattacgcctatgatgcgccacacaatagaaaatacaacagctaacatatcattaactgcgatagcaaatcaagcagcgatacttatggggttggataaaggatggccaatctccaaaatggacattggcgtaccgctactcgcattgggatgttattctcaggtgaaccctttaacattaacagctgctgtccttatgttggtggctcattatgctatcattggtcctggtcttcaagctaaggccactcgcgaagcacaaaagaggacagctgcggggatcatgaaaaacccaacagtagatgggatcgtaactattgacttagacccagtggtgtacgacgcaaaatttgaaaagcaattagggcaaattatgttattaatcctgtgcacttcacaaatcctactcatgagaaccacatgggctttatgtgagtctataactttggcgacaggacctttaacgacattatgggaaggcagcccaggaaaattttggaatacaacaatagctgttagtatggctaacatatttcgtggctcgtatctagctggggcaggcttggcctttagtctcatgaaatcgcttggtggaggccgaaggggtacgggggcacaaggagaaactctaggcgaaaaatggaaaaggcagttaaaccagctaagtaagtcggagttcaacacatacaagaagtcaggtataatggaggtagatcgttcagaagcaaaagaaggtcttaaacgaggtgaaactacaaaacatgccgttagcaggggaactgcaaaactcagatggttcgtagaacggaatctcgtaaaacccgagggaaaagtcatagacctaggatgtggtaggggagggtggagctattattgcgcggggctgaaaaaggtaacagaggtaaaaggttacacgaaaggaggcccagggcacgaagaaccaatcccaatggctacctatggttggaatttagttaagttacattcgggtaaggatgtgtttttcactccaccagaaaaatgcgacactctcttgtgtgacatcggagagtctagcccgaatccaacaatagaagaaggcaggactctaagagtactaaaaatggtcgagccctggctgagagggaatcaattttgcataaaaatactgaacccatacatgcctagtgtagtggaaacgttagaacaaatgcaaagaaaacacggcgggatgctggtaaggaacccgttatcacggaactctactcacgagatgtattgggtatcatgtggaacgggtaatatagttagtgccgtaaacatgacctcaagaatgctattgaatcgatttacaatggctcaccgaaagcccacctatgaaagggatgtagacctgggagcgggcactcgtcacgtggcggttgaacccgaagtagctaatttagatatcataggacaaaggatcgagaacataaagaacgagcataaatcgacttggcactatgatgaagataacccctacaaaacctgggcatatcatggatcatatgaggttaaaccaagcgggagcgcatcgagtatggtaaacggagtcgtaagactgttgacaaaaccgtgggacgtcattccaatggttacccagatcgcaatgaccgacacaacacctttcgggcaacaaagggtttttaaggagaaagtggatactagaacccctcgagcaaaaagaggtactgctcaaatcatggaagtaacagccaagtggctttggggctttctaagtagaaacaaaaagccaagaatatgtacgagagaagagtttacccgaaaagtaaggagtaatgcagctattggagctgtatttgtcgatgaaaatcagtggaactcagcaaaggaggcagtagaagacgaaaggttttgggacttggttcacagagaaagggaattgcataaacaaggaaagtgcgccacgtgtgtttataacatgatgggcaaacgagagaagaaactcggtgagtttgggaaagctaaaggttctagagccatatggtatatgtggctaggcgcgaggttcttagagtttgaagcattgggctttatgaatgaagaccattggttttctagagaaaacagtttaagtggtgtagaaggagagggtctccacaaactcggatacatactaagagatataagtaaaataccgggagggaacatgtatgctgacgataccgcagggtgggacacacgtatcacagaagatgacttacaaaatgaagctaaaataactgacatcatggaaccagaacacgcattactagccaccagtatatttaaactaacttaccagaataaagtcgtgagagtgcagagaccagctaaatcaggaacagtgatggatgtaatatcgcgaagagatcaacgaggaagtggtcaggtcggaacgtatggtttaaatacatttaccaacatggaagttcaacttatacgacaaatggaatctgagggtattttcagccctagtgaattagaaacccccaacctagctaagaaagtcttggactggcttgaaaaacacggtgccgaacgactcaaaagaatggcaatttcaggagatgactgtgttgtaaaacctatagacgatcgatttgcgacggcgctaacagcacttaacgatatgggaaaagtacgtaaggatataccgcagtgggaacccagcaaaggatggaatgactggcagcaggtacctttttgttctcatcatttccatcaattaattatgaaagacgggagagagatagtcgtaccttgccgtaatcaagatgaattggtaggtcgggcacgtgtgagccaaggagcgggctggtctctaagagaaactgcatgtctcggaaaaagttacgcacaaatgtggcaattaatgtacttccatagaagagacctcaggttagcagcgaatgcaatatgttcagcagttccagtagactgggtgccaacatcaagaacgacctggagcattcatgcgcatcatcaatggatgactacggaagacatgttatcagtatggaaccgagtctggattgaagaaaatccatggatggaggataaaacccacgtcagttcatgggaagaagttccttatttaggcaaacgcgaggaccagtggtgcgggagccttataggattaactgcacgagcaacgtgggccactaatattcaagttgcgattaatcaggttagacggctaattggaaatgagaactacttagactacatgacatctatgaaacgttttaaaaacgaatcggacccggaaggagctctttggtaa

SEQ ID NO: 21137 - RNA, 9879 nt, synthetic construct
  misc_feature 1..9879: note = derived and/or modified CDS sequence (opt6) from DENV-1__FJ850090__SS-prME
  source 1..9879: mol_type = other RNA
agcgtaacaatgttacttatgctcctaccaaccgcattagcattccatttaactacccgtggaggagaaccgcatatgatagttagcaaacaagaacgaggtaaatcgttactatttaaaacaagcgttggcgtgaatatgtgcacactaattgctatggaccttggagagctctgtgaagacaccatgacttataagtgccctaggataaccgaagtagagcccgatgatgtagactgctggtgtaacgccacggatacgtgggtgacatacggcacatgctcacaaacaggagaacatcgacgagacaaacggtccgtagcactagcaccgcatgttggattgggtttagaaacaagaacagaaacctggatgtcctcagagggagcatggaaacaaatccaaaaagttgaaacttgggcactacgtcacccagggtttacagtaattgccctgtttctggcacatgccatcgggacatcaataacccaaaaaggaatcatattcatattgctcatgttggttactccttcaatggctatgcgatgcgtgggtatcggtaatagagactttgtagagggtttaagtggagctacttgggtagacgtggtcctcgaacatggatcatgcgtaaccaccatggctaagaataaacccacattagatatcgaactcttaaaaactgaagtaactaatccggcggttctcagaaaactttgcatagaagccaaaataagtaataccacaacggacagtagatgcccgactcaaggagaagcaactttagttgaggagcaagacgccaacttcgtttgccggagaacatttgtggatcgtgggtggggaaacggatgtggattattcggtaaaggctcactactaacgtgcgcgaaatttaaatgtgtgacaaaactggagggaaagatagtacaatatgagaacttgaagtactctgttattgtcactgttcatacgggagaccagcatcaagttggcaacgaaactactgaacatggcactatagcgacaattactccgcaagcaccaacctcggaaatacaactaactgattatggtgcactgacattggattgcagtccaagaaccggtttggactttaacgagatggtattgttaacaatgaaagagaaatcctggttagtgcataaacaatggtttctagatctcccattaccatggacttcaggtgcgagtacatcacaagaaacgtggaaccgccaagatttattagtaacgtttaaaaccgcgcacgcgaaaaagcaagaagtagtagtactggggtcacaagaaggagcaatgcatactgcacttactggagcaactgagatacaaacgtcaggcacaacgacaatttttgctggtcacctaaaatgcagactaaaaatggacaaacttacattaaaagggatgtcatatgttatgtgtacgggaagtttcaaactggaaaaagaagtcgctgagacgcagcatggtaccgtattagttcaagtaaagtacgagggaaccgatgcaccatgtaaaattccattcctaacccaagatgaaaaaggtgtaatacaaaacggtagactgataaccgcaaatcctatagtgacagataaagagaaaccagtaaatatagaaaccgaaccgccattcggcgaatcctatattgtagtaggggccggagaaaaagcactaaaactgtcatggtttaaaaagggctctagtatcggaaagatgtttgaagcaaccgcacgaggcgcaaggcgcatggcgattctaggggatactgcatgggatttcggaagtatcggaggactctttacttcggtgggaaaacttatccatcaagtttttggcacagcttatggggtgctattttccggggtatcatggaccatgaaaatcggaatcggaatcctcctaacgtggctgggattaaatagcagatcaacgagcctaagtatgacgtgtatagcagttggtatggtaaccctttacttgggcgttatggttcaggcagattcaggttgtgtaataaattggaaaggtagagagttaaaatgcggatcaggaattttcgttactaacgaggtacacacatggacagaacaatacaaatttcaggctgattcccccaagaggttgtctgccgcaatcggcaaggcttgggaggaaggagtatgtgggatacgctctgcgaccagactcgaaaatataatgtggaaacagatatcaaatgagctaaactacatcctcctcgagaacgatatgaagttcaccgtggtggtcggagatgctaacggtattctgactcaaggaaagaaaatgatacgaccgcaacccatggagcataagtactcctggaagtcatggggtaaagccaaaataataggcgctgacatacaaaacactacgtttattatagacggaccggatacgcctgagtgccctgatgaccaaagagcttggaatatctgggaagtcgaggactacgggttcggtatattcacaactaacatttggctaaaactccgggattcacatacccaaatgtgcgaccatcggttaatgagtgctgcgattaaagattctaaggctgtacatgccgatatgggatactggatcgaatcagagaaaaatgagacgtggaagctcgcgcgcgctagttttatagaggtaaaaacttgtatatggccaaaatctcatacactatggtcgaacggtgttctagaatcagaaatgataattcctaagatctacggtggacctacaagtcaacacaactatagacctggctattttactcagactgcaggcccctggcacctaggaaaactagaactcgattttgacctttgcgaaggtacgacggtagtagtagatgaacattgcggatacaggggaccatctctcagaactaccaccgttactggaaaaattattcacgaatggtgttgtagaagctgcactctgccgccactccgatttagaggtgaggatggctgttggtacggaatggaaatacgaccagttaaagaaaaggaagaaaatcttgtcagatctatggttagtgcagggtcgggagaagtcgacagtttttcgctaggaatactttgcgtctcaatcttaatagaagaagtaatgcgtagtagatggtctaggaaaatgttaatgaccggtacattagcggtatttttactattgataatgggccaattgacgtggaatgatctaatcagactttgtataatggtcggtgccaatgcgtcggaccgtatggggatgggaacaacatacttggctctgatggcgacatttaaaatgcgacctatgttcgctgtcgggctattatttagaaaacttacaagtagagaggtactactactaacgataggattatctctagtagcaagtgtcgaattacccaactcacttgaagaattaggcgatggactcgctatgggtattatgatgcttaaactccttacggatttccagccacatcaattatggacaacattactatctcttacattcataaggacgtcactatccttagattatgcttggaaaacaatggcaatggcactttctatagtgtcgctgttcccactatgtctttcgacaacatcccaaaagacgacctggctacccgtcttgttaggttcctttggttgcaaaccactaactatgttcctgattactgagaataaaatttggggaagaaaaagctggccaataaatgaaggtataatggcagtaggtatcgtatctatactactgtcatcgctactgaaaaatgatgtaccactagcgggcccgttgattgccggagggatgctaatagcatgttatgttatcagcggcagctccgccgacttaagcctggaaaaagcggcggaggttagttgggaggaagaggcggaacattcaggaacatcacataatatactggttgaagtccaggacgatggtacaatgaagattaaagatgaagaacgcgatgatacattaactattctcttaaaagcaactctgctcgctgtgagcggcgtgtacccaatgtcaatcccagcgacactctttgtttggtacttctggcagaaaaagaaacaacgaagtggagttctgtgggatacaccctcgccacccgaggtagaacgtgcagttttagacgatggcatataccgtatattacaacgaggtctactaggtcgctcacaagttggggtgggagtatttcaggacggggtattccacacgatgtggcatgtcacgcgcggagcagttttaatgtatcaaggaaaacgacttgaaccatcctgggcatctgtcaagaaagacttaatcagctacggcggaggatggagatttcaggggagctggaatacaggagaagaagttcaagtaatagcagtagaaccaggtaaaaatcctaaaaacgtccaaactacaccggggacttttaaaactccagaaggtgaagttggcgctatagcacttgatttcaaaccaggcactagcggaagccctatagttaacagagaaggtaaaattgtagggttatacggtaacggagtcgtaacgacttcaggaacatacgttagtgcaatagcacaagcgaaagccagccaagaaggacccctacctgaaatcgaagatgaagtatttaagaaacgtaatctaacaataatggatctacaccctggttccggaaaaacgcgcaggtaccttccagcaattgtccgtgaggcaataaaacgtaagctaaggacactaattcttgctccaacgagagtagtagcgagtgagatggcggaagcgctaaaaggaatgccgatcagatatcaaacaacagcagtaaaatcggaacacacaggcagagaaatagtggatttaatgtgtcacgcaacgtttacgatgagattattaagtccagtgcgcgttccgaactacaatatgattataatggacgaagcgcatttcacggaccccgcatcaatcgctgccagaggttatatatcaactagagttggaatgggtgaagctgcagcgatattcatgaccgcgacgccaccaggaagtgtcgaagcatttccacaaagtaacgcggtcatacaggatgaagaacgggatataccagagagatcatggaactcggggtacgactggattacagacttccctggaaaaacagtttggttcgtaccttctataaagtctggaaatgatatcgccaactgcctaaggaaaaatgggaaaagggtaatacaactctcacgcaagacattcgacacggaatatcaaaagactaaaaataatgactgggattatgtagtgaccacagacatatcagaaatgggagctaatttcagagctgatagagtcatcgatcctagaagatgtcttaaaccagtaatattaaaagatgggcctgaaagagtaattttagccggacctatgcccgtaacagtggctagcgcagcccaacgaagaggaagaataggtaggaaccagaacaaagaaggagatcaatatatctatatgggtcaacccctgaacaacgatgaagatcatgcgcattggacagaagcgaaaatgttattagacaatattaacacaccggaaggcatcataccagctttattcgaaccagaaagagagaaatctgcagcaatagatggcgaatacaggctaagaggcgaagcaagaaagacgtttgtcgaattaatgagaagaggcgaccttccggtttggctttcatataaagtagcttcagaaggctttcaatactccgatcgtagatggtgctttgacggcgaaagaaataaccaggtactcgaagaaaacatggacgtagaaatatggaccaaagagggggaaaggaagaaactacggccgcgttggctagacgcaagaacatattctgatccactggctctacgagagtttaaagaatttgcagcagggcgtcgatcggtcagtggcgatttgattctagaaataggaaaacttccacaacatctaacattacgagcccagaatgctctggacaatcttgttatgttacacaatagtgaacaaggcgggaaagcatatagacacgctatggaggaattacctgacactatcgagacactcatgctattagcattaattgcggtactaacaggtggcgttactctgttcttcctatccggtaaagggctaggaaaaacaagtataggactcttgtgcgtcatggcaagttctgcattactatggatggcttccgttgaaccacactggatagcggctagtattatcttagaatttttcctaatggtgttgttaatacctgagcccgaccgtcagagaacaccacaagataatcagcttgcttacgtagtaatcggcttattatttatgattctcacagttgcagcaaacgaaatgggactactagaaacaactaagaaagacctaggaatcggccatgtagcggcagagaaccaccatcatgcaacgatgcttgatgtagacttgagacctgcctctgcttggactctctatgcagtcgccacaacagtaatcacaccgatgatgcgacacacgatcgaaaacaccaccgccaatatctccttaacggcaatagcgaaccaagcggctatactaatgggtctggacaagggttggccaataagtaaaatggacattggagtacccctactagcattaggctgctacagccaagtaaacccactcactctcacagccacagtactaatgctagttgcacattacgccattattggaccgggactgcaagcaaaagctacacgagaagcgcaaaaacgaacagcagcggggataatgaaaaatccaacagtagatggcatagtaaccattgatcttgatcccgtagtatatgatgctaagttcgaaaagcaacttggacaaataatgttactcatattatgcacctctcaaatactgttaatgcgtacaacctgggccctctgtgaatctataacactagcaacaggaccgttaaccacattatgggaaggctccccaggaaaattttggaataccacgattgcagtaagcatggcaaacatctttcgaggatcctacttggctggagcgggattggcatttagcctgatgaagtctttaggtggtggtaggagaggaaccggagcgcaaggggaaacactaggggaaaaatggaaacgacaacttaaccaattaagtaaatctgaatttaacacgtacaagaaaagcggcatcatggaggttgatagaagcgaagcaaaagaaggcttgaagcgtggagaaactactaagcacgcagtttcgcgggggactgcaaaattacgttggttcgtggaacggaatttagtcaaaccggagggaaaagttatagatcttggatgtggaaggggaggatggtcctattactgtgctggacttaagaaagtaaccgaagtgaaaggttacacaaagggagggccagggcacgaagaaccaatcccaatggccacgtatggatggaacctggtcaaattacattcaggaaaagatgtattctttacaccgccggaaaaatgtgatacactcttgtgtgatatcggagaaagcagcccaaaccctacgatcgaagaaggaagaacattaagagtcttaaaaatggtcgaaccatggcttaggggcaatcaattttgcattaaaattctcaatccttacatgccaagtgtagtagaaactttggaacaaatgcaacgaaaacacggaggaatgttagtaagaaaccctttatcaagaaactcaacacacgaaatgtactgggtttcttgtggcacaggaaatatcgtatcagcagttaatatgacatcaagaatgcttttaaatagatttactatggcgcacagaaaacccacttatgaacgagatgtggatctaggggcaggaactagacatgtggctgttgaaccagaagtagcaaatttagatattattggacagcggatagaaaacatcaaaaatgaacacaagagtacatggcactatgacgaggacaacccctataaaacatgggcatatcacggcagttacgaggttaaaccgtcaggaagcgcatcctccatggtaaacggggtggtacgattactcactaagccatgggacgttataccaatggtaacgcaaatagcaatgactgatactacaccttttggccaacaacgggtcttcaaggagaaggtcgatacaagaacccccagagcaaaacgcggaaccgcacaaataatggaagtaacagcgaaatggctatgggatttcttatcaaggaacaaaaagccaagaatatgcaccagagaagagttcacccgaaaagtaagaagtaatgctgcgattggtgctgtatttgtggatgagaaccaatggaactcagcgaaagaggctgtcgaggatgagcgtttttgggatttagtacatagggaacgagagttacacaaacaaggaaaatgtgcgacatgcgtatacaatatgatgggtaagcgtgagaagaaacttggggaatttggtaaagcgaaaggaagtagagccatctggtatatgtggctcggagcccgatttctcgagttcgaggctttaggatttatgaatgaagatcactggttctcaagggaaaatagtctatccggtgtcgaaggagagggcttgcataaactaggatatatactacgtgatatttccaaaatacctgggggcaatatgtacgcggatgataccgcaggatgggacactcgtataacagaggatgatctccagaacgaggcgaaaattacagatatcatggaaccagaacatgcattgttggccacgagtatcttcaaattaacataccaaaataaggtagtaagagtgcagaggcctgccaaaagtggaaccgtaatggatgttataagtcgacgcgatcaaaggggctccggccaagttggaacttatggactgaatactttcacaaatatggaggttcaattgataaggcagatggaaagtgaaggtatcttctccccgagtgaattagaaacccctaacttagcaaaaagggtattggactggctagagaaacatggagcagaacgcttaaaaaggatggctatcagcggagacgactgtgtagtaaaacccatagatgaccggtttgcgaccgcattgactgccctgaacgatatggggaaggttcgaaaagatataccacaatgggagccaagtaaaggttggaatgattggcagcaagtcccattctgttcacatcatttccatcaactaattatgaaagatgggcgtgatatagtagtgccttgtaggaaccaagatgaacttgtcgggagagcgagagtgtcacagggcgcaggatggagtctcagggagacggcatgtttaggtaaatcatacgcccaaatgtggcagctaatgtactttcataggagagatctgcgtctcgcagcgaacgcaatttgttccgccgtgccagttgactgggtgcctacgtcaaggactacttggagcatccacgcacaccatcaatggatgacaacagaggatatgctctcggtttggaatagagtatggatagaagaaaatccatggatggaagacaaaacacacgtatcttcatgggaagaagtcccatacttggggaagagagaagatcaatggtgtggatcattgataggtctaactgcccgggcaacttgggctaccaacatccaggtagcaataaaccaggttagaagattaataggtaatgaaaattatcttgactacatgacatccatgaagagatttaagaatgaatctgatccagaaggagccttgtggtaa

SEQ ID NO: 21138 - RNA, 9879 nt, synthetic construct
  misc_feature 1..9879: note = derived and/or modified CDS sequence (opt6) from DENV-1__FJ850093__SS-prME
  source 1..9879: mol_type = other RNA
tctgtgaccatgttgttaatgctcttaccgacagctctggcatttcatttaactacacgcggcggagaaccgcacatgatcgtctccaaacaagaacgaggtaaaagtctcttatttaaaacaagtgctggtgttaacatgtgtaccttaatagccatggatttaggagagctctgtgaagatacgatgacatacaaatgccctagaatcaccgaagctgagcccgacgatgtagattgctggtgtaatgcgactgatacgtgggtaacatatggaacttgtagccaaactggcgaacaccgacgagataaaagatcggttgcattagctccccatgttggtctcggtttggagacaagaacagagacatggatgtcaagtgaaggggcgtggaaacaaattcaaagagtcgagacatgggctctaagacacccaggttttacagtaatcgctctattcttagcacacgcaataggtacgtcaataactcaaaaaggaattatattcatactattgatgttagttacaccctctatggctatgcgatgtgttgggataggtaatagagattttgtggaaggtttatcaggcgctacctgggttgacgtcgttttggaacatggttcatgcgtgactacaatggctaaaaacaaacctacactagatatagaactgcttaaaactgaagtcaccaatccagctgttctacgtaaactctgcatagaagcaaaaatcagcaatactactactgattcacgatgtcccacccaaggcgaagcaactctagtagaggaacaagacgcaaacttcgtctgtcgcagaacttttgtagaccgaggatggggaaacggctgtggtctatttgggaaaggctcattactaacttgcgccaaattcaaatgcgttactaagttagaagggaaaatagtacaatatgagaacctgaaatacagtgtgattgtcacagtacatacaggtgaccaacaccaagtaggaaatgagacaacagaacatggcacgattgcaactattacaccgcaagctccgacttccgaaatacaactaacagactatggtgcacttacgctcgattgtagtccaagaactgggttagattttaatgaaatggtattgctgacgatgaaggaaaagtcatggctggtacacaaacaatggttcctcgatctgcctctaccatggaccagcggggcatctaccagccaagaaacttggaaccggcaagatctattagtaacgttcaaaacggcgcacgctaagaaacaagaggtggtcgtattgggatcacaagagggagcaatgcacacagcacttacaggcgctacagaaattcaaacaagtggaacaacaacgatatttgcaggacatcttaagtgccgactcaaaatggacaaacttaccctcaaagggatgagctatgtaatgtgcacaggttcttttaaactcgaaaaggaagtagccgagacgcaacatggaactgtcttagtccaagtaaagtacgaagggacagatgcaccatgtaagataccattttccacacaagatgaaaaaggtgtgacacaaaatggccgactaataacagccaatcctattgttaccgataaagaaaagcctgtgaacatcgaaacggaaccaccctttggtgaaagttacatcgtcgtcggtgccggcgaaaaagcattaaaattatcatggttcaaaaagggatcctctattggtaaaatgtttgaagctactgcaagaggggctcgaagaatggcgatactcggagacacagcctgggattttggtagtatcggaggagtttttacctcagttggaaaattagtacaccaagtgtttgggacagcatacggtgtgttattctcaggagtaagttggactatgaaaataggaataggtatactattgacctggctgggactaaattccagatccacaagtcttagtatgacctgtattgctgttgggatggtcactctatatctaggagtaatggttcaagcggactccggatgtgttattaattggaaaggcagggagttaaaatgtggtagcggcattttcgtaaccaatgaagtccatacatggacggagcaatataaattccaagcagatagtccgaagagacttagtgcagcaatcgggaaggcttgggaggagggggtttgcggtataagaagcgcaacaagattagagaatatcatgtggaagcaaatatcgaacgaattgaaccacatccttcttgaaaatgatatgaagtttaccgtagttgtgggtgatgcaaatggaatattagcccaaggcaaaaagatgatccgaccacaacccatggaacacaaatactcatggaaaagttggggtaaagccaaaattattggagcagatatacaaaatactacctttatcatcgatggtcctgacactccggagtgcccggacggacaaagagcatggaacatttgggaggttgaagactatggattcggcattttcactacaaacatatggctgaagttacgcgatagttatacgcaaatgtgcgatcacaggctcatgtctgccgcaataaaagacagtaaggctgtacatgcagatatgggttattggattgagagcgaaaagaacgagacatggaaattagcgagagctagctttatcgaagtcaaaacctgcacatggccaaaatcacatacattatggtccaatggcgtattagagtctgaaatgataattccaaaaatctacggaggaccaataagccaacacaactatcgtcctggatatttcacgcaaacagccgggccctggcatttaggaaaacttgaattagacttcgacctgtgtgaaggaactactgtagtcgtcgatgagcattgtgggaacagggggcccagtctacggacaactacagtaaccggaaaaataattcacgaatggtgttgcagaagttgcacactaccaccccttcgatttcgcggcgaagatggatgttggtacggcatggaaattagaccagtaaaagagaaggaagaaaatctagtaagatctatggtttcggcaggatcaggagaggtagatagcttctcattaggaatactgtgtgtctcaatcatgatcgaagaagtgatgaggtcaagatggtcccgaaaaatgcttatgactggaactttagcagtctttttacttctaataatgggacaactaacctggaatgacctaattagactttgtattatggtaggtgcaaatgcatcagacaggatgggtatgggtacgacacatttggcacttatggctacgttcaagatgcgccctatgttcgcggttggcctgctctttaggcgcttaacatctagggaagtcttactactaactataggactatctttaatggcttcaatggagcttccaaatagcttagaagaactaggagatggacttgctatggggataatgatgttaaaactgttaaccgagtttcaaccccaccaattgtggacaactttgctatctctaacatttgtgaaaacgacgctatccttagattatgcttggaaaaccacggctatgattttatcaatcgtatcactcttcccactatgtctttcgacgacaagccagaaaacgacttggttaccagtattgttagggtcgtttggatgtaaacctctcacgatgttcttaataacggaaaataaaatatggggaagaaaatcatggcccttaaatgaaggtatcatggcgataggcatagtctcgatactattgagtagtctccttaaaaatgatgtacctcttgcgggaccccttatagccggaggtatgttaattgcatgctatgtaatctccggttcatccgcggatttatcactagagaaagctgcggaggtgtcatgggagcaagaagccgaacactcaggagcctcacataacatcctcgtggaggtccaagacgacgggactatgaaaataaaagatgaagaacgagatgacacgctcacgatcttgttaaaagcgacattattggccgtaagcggagtatacccaatgagtattccagctacgttatttgtgtggtatttctggcagaagaagaaacaacgctctggagtcctttgggatactcctagtccgccagaggtagaaagagcagtattggacgatgggatttaccgaatactacagagagggctcctgggaaggtcgcaagtaggggtcggtgtctttcaggacggggtatttcatacaatgtggcacgtcacacgtggagcagtactaatgtatcaaggaaaaagattagaaccatcatgggcgagcgttaagaaagatctgatctcatatggtggaggatggcgattccaaggcagttggaatacaggagaagaagttcaagtcatcgcagtagagcctggaaagaatcctaaaaatgtacaaacaactcctggaaccttcaaaacaccggaaggagaagttggcgcgattgcattagactttaaaccaggcacatccggtagtccgatagtaaatcgggagggaaagatagttggactgtacgggaatggagtggtcacaacatcaggtacatacgttagtgctatcgctcaagcgaaagcctcgcaagaggggccacttccggaaatagaggacgaagtatttaagaaacgtaatctaacgataatggatttacaccctgggtcaggaaaaacaagaagatatctgccagcgatcgtccgagaagcaataaaacgtaagctaagaactctgatactagcaccaaccagagtcgtggctagtgaaatggcggaagccctgaaaggtatgcccattagatatcaaactactgccgtaaagagcgagacgaccggacgagagattgttgatttgatgtgccacgcaacttttacaatgaggttactatcgccagtacgtgtgcccaattacaacatgataataatggatgaggcccatttcacagacccagcgagcattgctgctagaggttacatctcaacacgtgtaggaatgggtgaagcagccgcaattttcatgacagctacacccccgggtagcgtcgaagcgtttcctcagtcgaatgcagttatacaagacgaagaaagagatatccccgaacgatcctggaactcaggttacgactggattacagactttccgggtaaaacagtatggttcgtgccttccataaaaagcggtaacgatatcgcaaattgccttagaaagaatggaaaaagagtcattcaattgtcacgcaagacctttgacacagaatatcagaaaactaaaaacaacgactgggattacgtggttactacagatatctcagaaatgggcgcaaacttcagagcagatagagtaatagaccctcggagatgtttgaaacccgtcatattaaaggatggtccagagagagtcatcttagcgggacctatgccagtaacagtggcatctgccgcacagagacgcggccgaataggtagaaatcaaaataaagaaggtgatcaatatgtttatatgggacagcctttaaacaacgatgaagatcatgcgcactggactgaagcaaagatgttgctggataacattaatacacctgaaggtataattccagcattgttcgaacctgaacgtgagaaaagcgcagcgatagacggtgaataccggttaagaggagaagctcgaaagacattcgttgaactgatgaggaggggcgatctacctgtatggttatcgtataaggtcgcttcagaaggattccaatatagtgacagaagatggtgtttcgacggagaacgcaacaaccaggtcttggaggaaaatatggacgttgaaatatggactaaagaaggagaacggaagaaacttagacctagatggttagacgcaagaacatattctgatcctttagcccttcgagaatttaaagagtttgctgctgggcgtaggagtgtgagtggagacctaatccttgagatcggaaaattacctcaacatttaacgcttcgcgcccaaaatgccttagataatttagtaatgttgcataactcagaacaagggggtaaagcgtacagacatgccatggaagaactacccgacactatcgaaactctcatgcttcttgccttaattgctgtactaacaggaggcgtcaccttattctttctgtcagggaaaggcctgggaaaaacaagcattggtttactttgtgtaaccgcctcgagtgcattactatggatggcatcagtagaaccacattggatagcagcgtcgattatattggagttctttttgatggtgcttctaattccagaaccggatcgacagagaacaccacaggacaaccaactcgcatatgttgtaatcggattattattcatgattctgacagtagcggcaaatgagatgggattgctcgaaacaacaaagaaagatctcggaataggttatgtggcggcagaaaatcatcagcatgctaccatgcttgatgtcgacctacgtcctgccagtgcatggaccctctacgcggtagctacaacagtcattacacccatgatgcgccacactatcgaaaatacgacagcaaatatctccttgacagcaatagctaaccaagcggcgattctcatgggtctcgataaaggctggccaataagtaaaatggacataggcgtgcctttactagcattaggttgctacagccaagtaaacccgttaacattaactgcagcagtgctgatgctagtcgcacattacgctattatcggaccaggtttacaagctaaggcaacccgtgaagcacagaaaagaaccgcggcaggcatcatgaaaaatcctacagtagacggaatcgtcgctatagacttagatccagtcgtctacgatgcaaaatttgaaaaacagcttggtcaaattatgctactcatattgtgcacgtcacaaattttgctaatgcgaaccacgtgggctctatgcgaatctatcacactggctaccgggcccttaactacactgtgggaagggagccctggaaaattctggaatacgacgatagcagtttccatggcaaatatatttcgaggatcttatctagcaggagcaggattagcatttagtttaatgaagtcattaggaggagggcgaagaggtacgggggctcaaggggaaacattgggagagaaatggaaaaggcagttaaatcagttaagcaaaagcgagttcaatacttacaagcgaagtggaataatggaagtcgaccgatctgaagcgaaggaaggacttaaacgaggagaaacgactaagcatgctgtatctcgaggtaccgcgaaattgcgatggtttgtcgaaagaaatcttgtaaaacctgaaggaaaggtcatagatttgggatgcggtagaggaggatggagttattattgtgcaggtcttaaacgggtaactgaagtaaaaggttatacgaaaggtggacctggacacgaggaaccaataccgatggctacatacggatggaatttggtaaagctacattcaggaaaagatgtattcttcatgcccccagaaaaatgtgacacattattgtgcgatatcggggaatccagtcctaatccaacaatcgaagaaggtcgcacgttaagagtcctaaagatggtagaaccatggcttaaaggaaaccaattttgcattaaaatcctaaatccgtatatgccgtctgtagtggaaacactagagcaaatgcaaagaaagcatgggggtatgctagtacgcaacccattgagcagaaatagtacacatgaaatgtattgggtaagttgtggaacaggaaacatagtatcggcggttaatatgacaagtcgtatgttactaaatagatttacaatggcccacaggaaacctacttatgagcgagacgttgatctgggagcaggcacaagacatgtagcagtagaacccgaagttgctaatctcgatataattggtcaaagaattgaaaacattaaaaacgaacataaatcaacttggcattatgatgaagataatccttataagacatgggcctatcatggatcctatgaggtgaagccaagcggtagcgctagtagtatggtgaacggagtagtacgactactaacaaaaccctgggatgtgatcccaatggtaacacaaatagcaatgactgatacaactccctttggacaacaaagagttttcaaagaaaaagtagatacacgaactcctagagccaaaagaggtacgacgcagatcatggaagttactgcgaaatggttatggggtttcctatcaagaaataagaaacccagaatctgtacccgagaagaatttactcgaaaggtacggtcaaacgctgctataggagcggttttcgtcgacgaaaaccaatggaactcagccaaggaagcagttgaagatgagagattttgggatctggtccatagagaaagggaattacataagcaagggaagtgtgcgacctgtgtgtataacatgatggggaaaagagaaaagaaacttggagaatttgggaaagctaaagggagccgagcgatatggtacatgtggctcggagctagattccttgaatttgaagctctgggattcatgaatgaagatcattggttctcaagggaaaacagtctgtcgggtgtggaaggagaaggtttacacaaactaggatatattctccgagatatttctaaaataccagggggtaacatgtacgccgatgacacagccggatgggatactagaataaccgaggatgacctgcaaaacgaggcaaaaattaccgatatcatggaaccagagcacgcgctattagcaacgtcaatatttaaattaacttatcaaaataaagtcgttagagtgcagaggcctgcgaaaaatggcacagtaatggacgtaataagcagacgagatcaaagaggatcaggacaagttggtacctatggcttgaatacattcactaatatggaagtccaattaattcgacaaatggaatccgaaggcatatttctccctagtgaactcgaaactccgaatctggccgagagggtacttgattggctagaaaaacacggtgccgaaagacttaaaagaatggctataagtggtgacgactgcgttgtaaaaccgatagatgatcgtttcgctaccgcacttacagcccttaatgatatgggaaaagtacgaaaggatattcctcaatgggagccttcaaaaggatggaatgattggcaacaggtgcctttttgctctcaccactttcatcagttaattatgaaagatggcagagaaatagtagtaccttgtagaaaccaagacgaacttgtaggaagggctagagtgtctcaaggcgctgggtggtcccttagagaaacggcatgtttaggaaaatcatacgcccaaatgtggcaactaatgtattttcatcgaagagatttaagactagccgccaacgctatatgttcagcagtaccggtagattgggttccaacctcgcgtacaacgtggagcattcatgcgcaccaccagtggatgactactgaagacatgcttagtgtatggaacagagtatggattgaggaaaacccatggatggaagacaaaacacatgtgagtagttgggaagaagtaccatacctaggaaaacgtgaagatcagtggtgtggcagtcttataggactaactgctcgagctacatgggcaacgaatatacaagtcgctattaatcaggtaagacgtcttataggaaatgaaaattatttagactacatgacttcaatgaaaagatttaaaaacgaatcagatccagagggcgctctttggtaa

SEQ ID NO: 21139 - RNA, 9879 nt, synthetic construct
  misc_feature 1..9879: note = derived and/or modified CDS sequence (opt6) from DENV-1__GU131863__SS-prME
  source 1..9879: mol_type = other RNA
agcgttaccatgctcctaatgcttctaccaactgctctggcttttcacttaactacaagaggaggcgaacctcatatgattgtttcgaaacaggaaaggggcaagagcttactatttaaaacgagcgttggggtaaacatgtgtacactaattgcaatggatcttggcgaactatgtgaagacactatgacgtataaatgtccaagaattacagaagcggaacctgatgacgtggattgctggtgcaacgcaaccgacacttgggtcacatatggaacgtgttctcaaaccggagaacatcgacgcgataaaagatccgtagcactagcgccacatgtgggcctagggttagaaacgaggacggaaacatggatgtcaagtgaaggagcctggaaacaaatacaaaaagtcgaaacctgggccttaaggcatcccggattcacagtaatcgcactatttctggcccatgcgattggcacatcgataacccaaaaagggatcatttttatactattaatgctagtgacgccaagcatggcaatgagatgtgtcggtattggaaatagagacttcgttgagggcctttctggggcaacgtgggttgatgtagtattagagcatgggagctgtgtgaccacgatggccaaaaacaaaccaacattagatatagaacttttaaaaacagaggtaactaacccagcagtcctcagaaaattatgtatagaagctaaaataagtaataccaccacagattccagatgtcctactcagggagaagctactttggttgaagaacaagacgctaactttgtatgtagacgcacttttgttgacagagggtggggtaatggttgtggattgtttgggaaaggatcgttgctaacctgtgcaaaatttaaatgtgtcacaaaattggaagggaaaatcgtacaatacgagaatctaaaatattcggtaattgtaacggtacataccggagaccaacaccaagtaggaaacgaaaccacggagcacggcacgatcgcaacgattacgccgcaggcccctacatcagagatacagctgactgactatggggctttgacgctagattgttcaccacgcaccggcttagattttaacgagatggtcctgctcacaatgaaagagaaaagctggctagtacataaacaatggttcctagatctaccactaccttggacttcaggggcctcaaccagccaggaaacgtggaatagacaagatctacttgttacctttaaaacagcacatgcgaagaaacaagaagttgttgtactggggtcacaagaaggtgccatgcacaccgcactcacaggagctaccgaaattcaaacatcaggtacaaccactatatttgcaggtcacttgaaatgtcgactcaaaatggataaactaacgctaaaaggaatgagctatgtaatgtgcaccggttcattcaaactggagaaagaagtggctgaaactcagcatggaacagtgcttgtacaagtgaaatatgaaggaacagacgctccatgtaaaattccatttttgacccaagatgaaaaaggtgtgacacaaaacgggcgattaataacagcaaatcctatcgtaacagacaaagaaaaaccagtcaatatagaaacagaaccgccattcggggaatcgtacattgtcgtaggtgccggggaaaaggctttaaaactatcctggttcaagaaaggtagtagtataggtaaaatgtttgaggcaactgcgagaggagcacgaagaatggctattttaggagatactgcatgggatttcggtagtatagggggtttatttacctccgttggaaaattgattcaccaagtttttgggacggcctatggagtcctatttagcggtgtaagctggacaatgaaaattggtataggaattttactaacttggctaggcctgaacagtaggtcaacttcactttctatgacatgcatcgcagtaggtatggtgacgttatacttaggagtgatggtacaagctgactccggttgcgtaataaattggaaaggtagagagttaaaatgtggttcaggaatcttcgttacaaacgaagtacacacatggacagagcagtataaattccaggccgacagtccaaaaaggttgtccgcagccataggaaaggcttgggaagaaggagtatgtggtatcagaagcgcaacaagattagagaatataatgtggaaacaaatttctaatgagctaaattatatcctattagaaaacgatatgaaatttacagtcgtagtaggggacatcaatggcatcttagctcaaggcaagaaaatgatacggcctcaaccaatggaacacaaatacagttggaaaagttggggtaaagcaaaaataataggtgctgatattcaaaatacgacattcattatagacggaccagatacacccgagtgtccagacgaccaacgcgcttggaatatatgggaggtcgaagattatgggtttggaatttttactactaatatatggttgaaacttagagacagtcacacccaaatgtgtgaccacagattaatgtcggcagcgattaaagatagcaaagctgtacacgcggacatggggtattggatcgagagtgagaaaaatgagacctggaaattagccagggcgtcattcatagaggttaagacatgtatatggccaaaaagccatacattatggtcgaacggagttcttgagtctgaaatggttataccaaaaatatacggaggtccgataagtcaacacaattatcgtccaggatattttacacaaaccgccggtccatggcaccttggaaaactggagttggattttgatctttgtgagggaacaactgtagttgtcgatgaacactgcggatacagagggccttcactgcggaccacaacagtaacaggtaaaataattcacgagtggtgctgccggagctgtacgctccctccccttaggttccgtggtgaagatgggtgctggtacggaatggagatcagaccagtaaaggaaaaggaagaaaacttagtacgaagtatggttagcgcaggtagtggagaagtggattcctttagtcttgggatattatgtgtatcaatactaatagaagaagttatgagatctcggtggagtagaaaaatgctaatgaccggcacattagctgtattccttctcttgataatgggccaattaacctggaatgatctaattagactttgtataatggttggcgccaatgcaagtgatcgtatgggaatgggaacaacttatctggcactgatggcaacattcaaaatgagaccaatgttcgcagtcgggctgctattccgaaggttgacgagtcgcgaggtcttgctcttgacagtaggactgagcttagtagcgtcagtggaattacccaattctttagaagaattaggagacggactagcaatgggcatcatgatgcttaaacttttaacggactttcaaccgcatcaactttggacgacgttactcagtttaacatttatcagaacaagtctctctttggactatgcatggaagacgatggcaatggcactatctatcgtaagtttattcccactatgtttatcaacgacaagccagaaaactacatggctgcctgtgttacttggatcatttggatgcaagccactgactatgtttttaataactgagaacaagatttggggacgaaaatcatggcctataaacgaaggtataatggcagtaggcatcgtaagtattctgctctcatcgttactaaagaatgacgtaccattagcggggcctctaattgctggaggaatgttaattgcttgctacgttattagtgggtcttcagccgatctcagtttagaaaaagcagctgaagtatcttgggaagaagaagctgaacacagtggaacctcacataatattttagttgaagtccaagacgacggaaccatgaaaataaaggatgaagagagggatgatacacttaccatcctactaaaagcaaccctgctagctgtgtcaggagtgtatccaatgagtatcccagcaacacttttcgtatggtatttctggcagaagaagaaacagagaagtggtgtactctgggataccccctcaccacccgaggtagagagggcagtgttggacgatgggatttatcggatactccaacgagggcttctaggccgatcacaagttggggtaggcgtttttcaagatggtgtatttcatactatgtggcatgtaactaggggagcggtactaatgtatcaaggaaaacgactagagccttcatgggccagcgtgaagaaagatctcattagttacgggggcggatggagatttcaaggttcatggaatacaggagaagaagtgcaggtaatagcagttgaacccggtaaaaatcccaaaaacgttcaaactacaccaggtacttttaaaactccagagggagaggtaggggcaatagcactagatttcaaaccaggaacaagcggttcccctatcgtaaatagagagggaaaaatagtgggcttatatggtaacggtgtggtaaccacttcgggaacttacgtgagcgcaatagctcaggcaaaagcgactcaggaaggaccattacccgaaattgaagacgaggtatttaagaaacggaatttaacgattatggatcttcatcctgggtcgggcaaaacacgaaggtatttaccagcgatagttagggaagcaattaaaagaaaattacggaccctgatcctcgctccaacacgcgtagtggcgagtgagatggccgaagctctaaaaggtatgccaattcggtaccagacgacagccgtaaaatcagaacatacaggtcgagaaatagtcgatttaatgtgccatgctacatttaccatgcgtttactctctcccgtacgagtgccaaactataatatgattataatggatgaagcacacttcactgatcctgcttcaatcgcagcacgaggttacatctcaaccagagtaggtatgggagaagcagcagcaatcttcatgacagcaacgccgccaggatccgttgaagcgtttcctcaatccaatgctgtaattcaagatgaagaacgagatatacctgaaagatcatggaacagcggatatgattggattacagatttccctggcaagacggtatggtttgttccatctatcaaatcaggcaacgacatcgcaaattgcctaaggaaaaacggcaagagagttatacaactaagtcgaaaaacgtttgatacagaataccaaaagacgaaaaacaacgactgggactatgtggtgacaaccgatatcagcgaaatgggagccaactttagggcggatagagttatagacccaagacgatgtttaaaaccagtaatactgaaagaaggacccgaacgggtaatattggctggtcctatgcctgttacggtagcatccgccgcccaaagacgcggtcgtataggccgaaatcaaaataaggaaggcgatcaatacatctacatggggcaacctttaaataatgacgaggatcatgcgcattggaccgaggcaaaaatgttattagacaatataaatacgccagaaggaataattccagcgctttttgaaccagaaagagaaaagtcagcagctattgatggggaataccgactccgaggagaagctaggaaaactttcgtagaactcatgagacgtggagacctcccagtttggctatcatataaagtagcaagcgaaggatttcaatacagcgataggcgatggtgtttcgatggcgaaagaaacaaccaggtacttgaggagaacatggacgtggaaatctggactaaagaaggagaaaggaagaaattacgacccagatggcttgatgctcgcacatacagcgatcccctagccttgagagaatttaaagagtttgccgcaggcaggagaagcgtatcaggtgatctgatattggaaatcggaaaacttcctcaacatctaacattaagagctcaaaatgccttagacaacttggtcatgctacataacagtgagcaaggagggaaggcctatcgacatgccatggaagaattacctgacaccatagagaccctcatgctgctcgcattaatagctgttttaacgggaggggttacccttttcttccttagtggtaaaggattaggtaaaacaagtattggattactttgcgtcatggcatcatcagctttgctatggatggcaagtgttgaacctcactggatagcggcatcaattatattggagttctttttgatggttctgcttattccagagccagatcgacaaagaaccccacaggacaaccaattagcatatgtcgtaataggactactttttatgatattgacggtcgcggcaaacgagatgggcctattggaaacaactaagaaggacttaggaatcggccatgtggctgttgagaatcaccaccacgcaactatgcttgacgttgacttgcggccggccagtgcctggactctatatgctgtagccaccaccgtaattacaccaatgatgcgacacacgatagaaaacacgactgctaacatctcactaactgctatcgctaaccaagcagcaatattaatgggtctagacaaaggctggcctatctctaaaatggacataggtgttccattgttggcgttagggtgttacagtcaagtaaacccacttactctaacagctgcagtccttatgctagttgctcattacgcaataataggtcccggattacaagcaaaagccacgagagaggcacagaaaagaactgccgccggaataatgaagaatccaacggttgatgggatagtcacaattgacttagatccggtggtttacgatgctaaattcgagaagcaacttggccaaataatgctactcattttgtgtacctctcaaatccttcttatgcgaactacttgggccctatgtgaatctatcacattagcaactggaccgcttacgactttgtgggagggttcacccggaaaattttggaacacaacgattgcagtcagtatggcgaatatattccgtggatcttatctggctggagcaggactggcgttctcactgatgaaatcactgggcggcggtagaagaggtacaggagcacaaggagaaacgttaggtgaaaaatggaaaaggcaactgaatcaattaagtaaatccgagttcaatacgtacaagaaatccggtataatggaagttgatcgcagtgaggcaaaagagggtttaaaaagaggcgaaactacaaagcatgcagtatccagggggacggcaaaattacgttggttcgtggagaggaatttggtcaaacccgaagggaaagtgattgaccttggttgcggaagaggtggctggtcatattactgtgcaggcctgaagaaggttactgaagtaaagggttataccaaaggtggtccgggtcatgaagaacctattccaatggctacatatgggtggaatctcgttaaactacactccggcaaagatgtattctttacgccaccagaaaaatgcgatacattactctgcgatattggagaaagcagtcctaaccctacaattgaggagggtaggacactcagagtattaaaaatggtagaaccctggctacgaggcaaccaattttgtatcaaaatactaaacccatatatgccgagtgtagttgaaacattggaacaaatgcaacgaaaacatggaggcatgctagtcagaaatcctttaagcagaaatagcacacacgaaatgtattgggtttcttgtggaactggcaatattgtgtcggccgttaacatgacttcaaggatgttattaaacagattcaccatggctcacaggaaacccacatatgaaagagacgttgacttaggggcaggtacaagacacgtagccgtagaaccggaggtagcaaacttggatataatagggcaacgcatagagaatattaagaacgagcacaaaagtacttggcattatgacgaagataatccatacaaaacttgggcctatcacggatcatacgaagtaaaaccatcaggatcagcgtcatccatggtaaatggtgtagtacgactgcttactaagccatgggatgtcatacctatggtaacacaaatcgctatgacagataccacgccctttgggcaacaacgagtgtttaaggaaaaagtcgacacaagaaccccacgagcaaaaagaggaacagcgcaaattatggaagtaacggccaaatggctatggggcttcctatcaagaaataagaaaccaagaatctgtactagagaagagttcaccaggaaagtgaggtcgaacgctgctatcggggctgttttcgttgatgaaaaccaatggaactcagcaaaggaggcagtagaagacgaacgattttgggatctagttcatcgagaaagagaactccataagcaaggtaaatgtgctacttgtgtttataatatgatgggtaaacgagagaaaaagctaggagagtttggtaaagcgaaaggatctcgagctatatggtatatgtggctaggagcaagatttcttgagtttgaagccttgggatttatgaacgaagatcattggttttctcgtgaaaatagtttgtccggagttgaaggcgaaggattacataagttaggatacatattacgggacatatcaaagatacccggtggcaacatgtacgcagacgatacagcgggctgggacactcgcatcacagaggatgatttgcagaacgaggccaagattacagatattatggaaccagaacatgcgttgttggcaacaagtatatttaaacttacataccaaaataaagtagttcgagtacaaagacctgcgaaatcgggcactgtgatggatgtgataagccgacgagatcagagaggatcaggacaagtagggacatatggactaaacacattcacaaacatggaagtgcaattgattaggcagatggaaagtgaagggatatttagtcctagtgaattagaaacccccaacctcgcaaagaaagtactagattggttagagaaacacggtgcggagcgccttaaaagaatggctatatcaggtgacgactgtgtagttaaacctatcgatgatcgatttgcgacagctctaaccgctctaaacgacatgggaaaagtaagaaaggacataccacaatgggaaccctctaaagggtggaatgactggcaacaagttcctttttgttctcaccactttcatcagttaataatgaaagatgggagagaaatagtagtaccctgtaggaaccaagacgaattagtagggagagcacgagtatcccaaggagctggatggagcttgagagaaacagcttgtctaggaaaatcttacgcacaaatgtggcagttgatgtatttccatagaagagatctcaggctcgcagccaatgccatttgttcagctgttcccgtagactgggtccctacaagtaggactacatggtctatccatgcccaccaccaatggatgacaacggaggacatgctaagtgtttggaatcgagtgtggattgaagaaaatccttggatggaggataagacgcatgtatcgagttgggaagaagtaccctacttaggtaagagagaagatcagtggtgtggaagtctgataggactaacagcgagagcgacatgggctaccaatatacaggtagccattaatcaggttaggagattaataggaaatgaaaactatcttgactatatgaccagcatgaaaaggttcaaaaatgagtccgatcctgaaggtgctctctggtaa

SEQ ID NO: 21140 - RNA, 9879 nt, synthetic construct
  misc_feature 1..9879: note = derived and/or modified CDS sequence (opt6) from DENV-1__GQ868559__SS-prME
  source 1..9879: mol_type = other RNA
tccgtgacaatgcttctaatgcttctacccacagcattagctttccatttgacaacacgcggaggtgaaccacatatgatagttagtaaacaagagagaggcaaatctctactgttcaaaacatctgcaggcgtcaacatgtgcacattaattgctatggatctaggagaactatgtgaggacactatgacatataaatgtccaagaataactgaagcggaaccagatgacgtcgattgctggtgcaatgcaacagatacatgggtaacttacggaacatgtagccaaacaggggagcacagaagagataaaagatcggttgcgctcgcaccgcatgtcggattaggattagagacacgaaccgaaacttggatgagcagcgaaggagcatggaaacaaatccaaagagtagaaacatgggcattaagacatcctggatttaccgtgattgcgctattcttagcacatgcaataggaacatcgataacgcaaaaaggcattatttttatactccttatgctggttacaccaagcatggccatgagatgcgtaggcataggcaatcgtgattttgtagaggggttaagtggtgcaacatgggtagacgtagtattggaacacggcagttgtgttacaactatggccaaaaacaaaccgaccctagatattgaactactgaagacggaggttacaaaccccgctgtactacgaaagttgtgtatcgaagcaaaaatcagtaacaccaccacagactccagatgcccgacacaaggtgaggctacattagtcgaagaacaagacgcaaacttcgtatgtagacgaactttcgtagaccgtggctggggaaatggatgtggtctcttcgggaagggcagcctcctaacatgtgcaaaatttaagtgtgttaccaaattagaaggaaaaattgtacaatacgaaaatttaaagtattcggtgattgtgacagtgcacacaggagatcaacaccaagttggtaacgagactactgagcatggtacaatagcaacaattacaccacaagcgccaacatcagaaatacaattaactgattatggagcgctgaccctcgactgttcaccaagaaccggcctagattttaatgaaatggtgctactgacaatgaaggagaaaagttggttagtgcataaacagtggttccttgatttacccctaccgtggaccagtggagctagtacctcacaggaaacatggaatcgccaagatctgttagtaacatttaaaacagcacatgcgaagaagcaagaggtggtcgtattaggatctcaggaaggagcgatgcataccgcgctcactggtgcaacggaaatacaaacatcgggtaccactactatatttgctggtcatctaaaatgcaggcttaaaatggataaacttactctaaagggtatgtcatatgttatgtgtacagggagctttaaactagaaaaggaggtagctgaaacacaacacggcacagtcctcgtccaagtgaagtatgagggaacggatgctccatgcaaaatacctttctctacacaagacgaaaaaggagttacacagaatggaaggttgatcaccgctaatccaatcgttacagacaaagaaaaaccagtaaatatagagacagaacctccgttcggcgaatcatatattgttgtgggggcaggcgaaaaagccctcaaattaagttggttcaagaaagggtctagcatcgggaaaatgttcgaagccactgctcgaggggctagaagaatggctattttaggagacaccgcctgggactttggatcgataggaggtgtgtttacttcggtagggaaattggttcatcaagtttttggaactgcatacggtgtcttattcagtggtgtaagctggactatgaaaattggaattggtattcttctaacctggctcggacttaatagcagatctacatcgttgtctatgacctgcatcgccgttggcatggtaacattatatttaggcgtaatggtccaggcggactctggctgtgttattaactggaaaggtagagaactgaaatgcgggagtggtatttttgtaactaatgaagttcacacttggacggaacaatataagtttcaagccgactcacccaagagactgtcagctgctataggaaaggcatgggaggagggagtctgtggaatacgtagcgcaacgcgattagaaaatattatgtggaaacaaataagtaacgaattaaaccatatacttttagaaaacgatatgaagtttacagttgttgtaggcgatgctaacggtatactagcacaagggaagaaaatgataagaccccagccaatggaacataaatattcgtggaaatcatggggcaaagccaaaatcataggcgcagatattcaaaatacaacttttataatagatggaccagatacaccggagtgcccggatggtcaaagggcctggaatatatgggaagttgaggactacggttttggcattttcactacgaacatttggctaaaacttagagactcatacactcaaatgtgcgatcatcgtttaatgtccgctgctataaaggacagcaaggcggtgcatgcagatatggggtactggattgaatcagagaaaaacgagacatggaagttggcaagagcaagttttatagaagtcaagacttgtacttggcctaaaagtcataccctgtggagtaacggtgttttagaatcagaaatgatcatcccaaaaatttacggcggacccatatcacaacataactacaggcctggctattttactcaaacagctggtccatggcatctcggaaaattggaattagattttgatttatgtgaaggcaccacagtagtagtggatgaacattgcggtaatcgaggccccagcttaagaacaactaccgtaacgggaaaaataatacacgaatggtgctgtagaagttgcactctcccacctttacgatttagaggagaagatggctgctggtatggaatggaaatccgccccgtaaaagaaaaagaggagaatcttgtccgcagtatggtaagcgcaggtagtggtgaagtcgattctttctctcttggtatcttgtgtgtctccatcatgatagaagaagtaatgaggtcaagatggtcaagaaagatgttaatgacaggaactttagctgttttcctactgcttataatgggccaacttacgtggaatgatttaataagactctgtattatggtaggtgcgaatgccagcgacagaatgggaatgggcactacataccttgctttgatggcgaccttcaaaatgcgtcccatgtttgctgtaggcttattgtttaggagacttacctcgagggaagtactgttactaacaatcggattgtcgttagtagcgagtgtagaactacctaattcacttgaagagttaggcgacggactagcaatgggaatcatgatgttaaaactactaacagaatttcaaccccaccaactatggacaactttactaagtttgacattcgtaaaaactacgcttagcttggattatgcatggaagacaacggcaatggtcttaagcatagtaagtttatttccgttgtgtttatccactacgtcgcaaaagacaacttggttaccagtattactaggaagtttcggttgtaaacctttaacaatgttccttattaccgaaaataagatttggggacgtaagagctggccgctaaacgagggaataatggcgataggaatagtatcaatcctgctctcttcattacttaaaaatgatgtaccactagccggacccctaattgcgggagggatgctgatcgcatgttacgtaatctcagggtcctcagcagatctctcattagaaaaggccgccgaagtatcttgggagcaggaggctgaacattcgggcgcaagtcacaacatcctcgtggaagtgcaggatgatggaacaatgaaaattaaagatgaggaacgagatgacacacttaccattttattaaaagcaacattattagccgtgtcaggggtttaccccatgtcaataccagcaacactatttgtatggtacttctggcagaaaaagaaacagagatctggtgtgttatgggatacccccagtccaccggaagtggagagggctgtattagatgatggtatatatcgtatcctgcagagaggtttactaggtagaagccaagtaggagttggcgtcttccaagatggggtatttcatacaatgtggcatgttacacgaggtgcggttttaatgtatcagggaaaaaggctagaacccagctgggctagcgttaagaaagacttgatttcgtatggaggtggatggagatttcaaggttcatggaacacaggtgaagaagtccaagtgattgctgtagaaccaggcaaaaatccgaagaatgtacaaacaacacctggaacatttaagacaccagaaggagaggtcggagcaatagctctagactttaaaccaggaacatcaggttcaccaatagtaaaccgagaaggaaaaatcgtaggtctgtatgggaacggcgtcgtgaccacaagcggaacgtatgttagcgcgatagcccaggccaaagcatcccaggaaggaccactccctgagattgaggatgaggtattcaagaaacgcaacttgacgattatggatttgcatccaggtagcgggaagacacgaaggtacctacccgcgattgtacgagaagccataaaacgcaaattaagaactcttatcttagcacccacacgcgtagttgctagcgaaatggcagaagccttaaaaggaatgccaattcggtatcaaaccaccgctgtgaaatcagagcataccggcagagagatagtagatctcatgtgtcatgccacattcacaatgcgcctactgagccccgtgagagttccaaattataacatgatcataatggacgaagcccactttaccgacccagcatcaatagccgcaagagggtacattagcaccagagtgggcatgggagaagcagcagctattttcatgaccgccacaccgcctgggagcgtcgaggcttttccacaaagcaacgcagtaatacaagatgaagagagagacatcccagagagaagctggaactcaggatatgactggattactgatttcccgggaaagacagtttggtttgtgccaagtatcaaaagtggtaacgatattgctaattgcctaaggaaaaatggcaaacgcgtcatccagctatcacgaaaaacctttgacacagagtatcagaaaaccaaaaataacgattgggactatgtggttactaccgatatatcagaaatgggagcaaattttagagcagacagagtaatcgatccaagaagatgcctaaaacccgtgattctaaaggacggtcccgagagggtgattttagcgggccccatgccagtgaccgtggcttcggcagcccaacgtagaggaagaatcggcagaaaccagaataaagaaggagaccagtatgtctatatgggtcaaccgttaaataatgatgaagaccatgcacactggacagaagccaaaatgttactggacaacattaatacaccggaaggaatcattccagcgttatttgaaccagagcgggaaaaatcagcagctatagacggagaatacaggcttaggggtgaagcaagaaaaacatttgtagaactaatgagacgtggtgacctcccggtatggctttcttataaggtggcatcagaagggttccaatattcagaccgaagatggtgcttcgatggagagagaaataatcaagttctcgaagaaaatatggatgtagaaatatggactaaagagggagaaaggaagaaacttcgaccaaggtggctcgatgcaagaacttactccgacccacttgcactccgagagtttaaagagtttgctgctggcaggcgatcagtatctggagacctgattttggaaataggaaaacttccacaacacctgacactaagggcacagaatgcattagataacctggtcatgttacataattcggaacaaggaggtaaagcatatcgacacgcaatggaagaactacccgacacaatagaaacgttgatgctactagcgctgattgcggtactgacagggggagttacgctctttttcttaagcggaaaaggattagggaaaacgagtatcggattattgtgcgttaccgcatcttcagcacttctttggatggcttctgtagaacctcattggattgccgctagcataattttggagttctttttgatggtgttattgataccagaacctgaccgtcaaagaaccccgcaagacaaccaattggcttacgtagtaataggattactctttatgatacttacagttgcagccaatgaaatggggttattagaaacaaccaaaaaggacctaggcataggttatgtcgcagcggaaaatcatcagcatgctacgatgttggatgtagacctacgaccagctagcgcatggacgctctatgcagtcgcaacaactgtgatcacaccaatgatgcgacataccatagaaaatacaactgccaatatctctctaaccgcaatagcgaaccaagcagccatattaatgggcttagacaaaggatggccaattagtaaaatggacataggagtacctctattagcactgggatgttattcgcaggtaaacccgttaacattaactgctgccgtcttaatgctagtcgcgcattatgctattatcggccctggacttcaggcgaaagccactcgagaggctcaaaagaggaccgcagcgggaattatgaagaacccaacagtagatggaatcgtggcaattgacctagaccccgtcgtctacgacgcaaagttcgaaaagcaattaggtcaaattatgttattgatcctatgcacttcacaaatactcctaatgcgcactacgtgggcactgtgcgagagtattactctggccactggcccactgactaccttgtgggagggttcacctggtaaattttggaataccaccatagcggtaagtatggctaatattttcaggggctcttatctagccggtgcggggctagcatttagcttaatgaaaagcctaggaggaggtagaaggggaacaggagctcagggagaaacccttggtgaaaaatggaaacgtcaactaaatcagctatctaaatcagaatttaacacatataaaagaagtgggataatggaggtagatcgatctgaagccaaagaaggattgaagagaggggaaacaactaaacatgctgtaagtagagggacggcaaaactaagatggtttgtagagcgaaatctagtgaaaccggaaggtaaagtaatcgacttggggtgcggtaggggtggctggagttactattgcgccggtctcaagaaagttacggaagtaaaaggatatacaaaaggcggacccggacatgaagaaccaatccctatggcaacctatggatggaaccttgtaaaacttcatagtggaaaggatgtatttttcatgccgcccgaaaaatgcgacacactcctatgcgacataggggaatccagcccaaaccctacgattgaagaaggaaggaccttgagagtattaaaaatggtagaaccgtggctaaggggcaatcagttctgcataaaaatactcaatccgtatatgcctagtgttgtcgaaacactggagcaaatgcaaagaaagcatgggggtatgctggtgagaaaccctctatctcgtaattcaacccatgagatgtattgggtatcttgcggtacaggcaatattgtttcagctgtaaacatgactagccgtatgttactcaaccgatttaccatggcacaccgaaagcccacctatgaacgagatgtggatctaggggcaggaactagacacgtggcggtagaacctgaggaggccaatttagatatcataggacaacgaatagagaacataaagaacgaacataagtcaacatggcactacgatgaagataatccctataagacctgggcataccacggtagttacgaggttaagccatcggggagcgcaagtagtatggtaaacggggtagttaggttattgacaaaaccgtgggacgttataccgatggtaacacagattgctatgacagacacaacaccttttgggcaacaaagagtatttaaagaaaaagtagatacacgaacaccaagagccaaaagaggcactactcaaatcatggaagtcactgcaaagtggctatggggatttttaagtcgaaacaagaaaccacgaatctgtacgagagaagaatttacacggaaagttagaagtaacgcggcaattggagcagtgtttgttgacgaaaatcaatggaactcagcaaaagaagccgtagaagacgaacgattttgggatttagtccaccgagaaagagaactgcataaacaaggcaagtgtgcaacgtgcgtatataatatgatgggtaaacgtgagaagaaattaggcgaatttggtaaagcaaaaggcagcagagcaatatggtatatgtggttaggggctcggtttttggagtttgaagcactaggctttatgaacgaagatcactggtttagtagagagaatagtttatcgggtgttgaaggagaaggattacacaaattgggatacattctccgtgatatcagcaagattcccggtggaaacatgtatgctgacgataccgccggatgggataccaggataacagaggatgatcttcagaacgaagcaaagattacagatattatggaacctgagcacgcattgctagcaacgagtatatttaaattaacctatcaaaataaagtcgtaagagtacaacgaccggctaaaaacggaacagtaatggatgtcatatccaggcgtgaccaacgcggtagcggccaagtagggacttacggtttaaacacatttacaaatatggaagtccagctaatacgacaaatggagtcagagggcatatttttaccaagcgaacttgaaactccgaacttagctgagcgagtactggattggttggagaaacacggggcggaaagattaaaaagaatggcgatatcaggtgacgactgcgtcgtgaaaccgatagatgatagatttgctactgctcttacagccttaaatgatatgggaaaagttagaaaggatatccctcagtgggagccgagcaaggggtggaatgattggcaacaggtaccgttttgtagccaccatttccaccagctaataatgaaagatggccgtgaaatcgtggtgccctgtcggaatcaagatgagttggtaggacgagctcgggtttcccaaggagctggttggtcgttaagagaaaccgcatgcctgggaaaatcatatgctcaaatgtggcaactcatgtatttccacagaagagacctacgattagcagccaatgcaatttgctcagcagttcctgtggattgggtcccaactagccgaacaacatggagcatacatgcacaccatcaatggatgactaccgaagatatgttatctgtatggaatagagtgtggatagaagagaatccctggatggaggacaaaacacatgttagtagctgggaagaagtcccatatcttggaaaaagagaggaccaatggtgtggatctcttattggcttaactgcgagagccacctgggcaacaaatatacaagtagcaatcaaccaagtaagacgcctaattggaaacgaaaattatttggactacatgacttcaatgaaaagatttaagaatgaatctgatccagaaggagcgctttggtga

SEQ ID NO: 21141 - RNA, 9879 nt, synthetic construct
  misc_feature 1..9879: note = derived and/or modified CDS sequence (opt6) from DENV-1__GQ868560__SS-prME
  source 1..9879: mol_type = other RNA
agtgtcactatgctcctcatgcttcttccaacggcattagcatttcatttgaccactagagggggcgaacctcacatgattgtttctaaacaagaacgaggtaaatcattattatttaaaacaagtgcgggcgttaacatgtgcacattaattgctatggatttaggcgaactatgcgaagacacgatgacatacaaatgtccacgtatcacagaggcagagccagatgatgtcgattgttggtgtaatgcaactgatacatgggtaacctatggcacatgctcacagacgggagagcatcggagggacaaaagatcagtagcattagcgccacatgtaggactcggccttgaaactaggaccgagacctggatgtcaagtgaaggcgcatggaaacaaatacaacgagttgagacatgggcactgcgtcacccaggatttacagtaattgctttgtttctagcacacgcaattggtacatctataacacagaaaggcataatattcattttgttaatgctggttaccccttccatggcaatgagatgcgttggaattggaaatcgcgacttcgtggaaggcttgtcaggagcgacatgggttgacgtcgtgttagaacacggttcatgcgtgactaccatggctaaaaacaaaccgacactggatatagagttacttaaaactgaagttacgaaccctgcagtattgcgaaaactctgtatagaggccaaaataagcaataccaccaccgattcaagatgtcctacccaaggcgaagctaccttggtcgaggagcaagatgctaatttcgtatgtcgacgtacattcgttgatcgcggatggggaaatggatgcggactattcggtaaaggtagtttactaacatgtgctaaattcaaatgcgtaaccaaactagaaggtaaaatagtacaatatgagaatctaaaatattctgtaatcgtaactgtacacactggcgatcaacatcaagttggtaatgaaactacagaacatgggacaattgcaaccattactccccaagctcctacaagtgaaattcaactcacggattacggtgcattaacgctagactgttctccacgtacgggtctggactttaatgaaatggtattattgaccatgaaagagaaatcatggctagtacacaaacaatggttccttgatcttccactaccgtggacctctggagcgtcaacgtcgcaggaaacttggaacagacaagacttactcgtaacctttaaaaccgctcatgccaagaaacaagaagtagtagttctaggaagtcaagaaggtgctatgcatacggctttaacaggcgcgacagagatacaaacaagtgggacaacaacgatctttgcaggacaccttaagtgtagacttaagatggataaactaactttaaaaggtatgtcttacgtaatgtgtaccgggagctttaaactagaaaaagaggttgccgaaacccaacatggaacggtgttagtgcaagttaagtatgaggggacggacgccccatgtaagattcccttctctacccaagatgaaaaaggagtgactcaaaatggacgccttattactgccaatcctatcgtaacggacaaagagaaaccagtcaatatagaaactgagccgccttttggtgaatcatatatagtagtaggtgccggtgaaaaagcattaaaacttagttggtttaagaaaggtagtagtatagggaaaatgttcgaggctaccgcccgtggagctagaagaatggctattttaggtgacaccgcctgggactttggcagcatagggggagttttcaccagtgtgggaaaattagtacatcaagtatttggaacggcatatggagtactttttagtggcgtatcatggacaatgaaaataggtattggaatattattaacatggttggggctaaattcacgaagtacttcattatcaatgacctgcatagctgttggtatggttacactctacttaggcgttatggtacaggccgatagcggctgtgtaatcaattggaagggtagagaacttaaatgtggttcgggaatatttgtaacaaatgaagtccatacatggacggaacaatataaatttcaagcggacagccctaaaagactctcagcggcaataggtaaagcatgggaagaaggcgtatgtggcattcgatctgccacaagacttgaaaatatcatgtggaaacaaatctctaacgaacttaaccatattttattggaaaatgatatgaaattcacagtagttgttggcgacgcaaatgggatactcgcacagggcaaaaagatgatacgccctcagccaatggaacataagtacagttggaaatcatggggcaaagctaaaatcattggtgcagatatacagaacacaacattcataatagacgggccagatactccggagtgtcctgacggacagcgagcttggaatatatgggaagtggaggattatgggttcggaatattcactacaaatatatggttaaagttgagagattcttatacccaaatgtgtgatcaccgactaatgtcagcggcaattaaagattcaaaggcagtgcatgctgatatgggttactggatcgaatcagagaaaaatgaaacatggaaattagcccgcgcctcatttatagaagttaaaacttgcacatggccaaagagtcatacactttggtcaaacggcgtgttagaatcagagatgataattccgaagatttacgggggtccaattagtcaacataattaccgtccaggctattttacacaaacagcgggtccttggcatttagggaaactagagttggactttgacttatgcgaaggaactactgtagtcgttgacgaacactgcggcaaccgtggaccatcattaagaactacgactgtaacagggaaaataatacacgaatggtgttgtcgttcctgtacactacccccactacggtttaggggtgaggatggttgttggtatgggatggagatacgacctgttaaagaaaaagaggaaaatcttgtgagaagcatggtttcagcaggttcaggagaagtagatagtttcagtctaggtatcctctgcgtcagtataatgatagaagaagttatgcgaagtaggtggtcccgaaaaatgcttatgaccgggactctagcggttttcctactcttgatcatgggacaactaacttggaatgatctgattagactatgcataatggtgggtgcgaatgcgtcagatagaatgggaatgggtactacgtatcttgcactaatggcaacgttcaaaatgcggccaatgtttgcagtaggactactatttcgccgtctaacttcgcgtgaagtacttttactaacaataggattatcattagtagcaagcgtggaattaccgaatagcttggaagaactgggagacggcctagcaatggggattatgatgttgaagttactcactgagttccaaccgcaccaattatggacaacactcttaagcctaacttttgtaaaaactaccttgagcctagattatgcatggaaaactacggccatggtactatcaatagtttcattatttcctttatgtttatccaccacaagtcaaaagacaacatggttaccggtactactaggcagctttggatgtaaaccactaaccatgttcttaatcacagaaaacaagatatggggacgaaaatcgtggcctttgaatgaaggaataatggcaataggcattgtgagcatactcttatcaagtctactaaagaacgacgtgccgttagcaggacctttaatagctgggggtatgctaatagcatgctatgtcatttcaggcagctcagcagatttatccttagagaaagcagctgaggtatcttgggaacaagaagctgaacattcaggggcatcccataacatactcgtagaagttcaagacgacggaactatgaaaataaaagatgaagaacgagatgatactcttaccattttactaaaggcaactcttctcgcagtatcaggagtctaccctatgtcaatcccggctacattgtttgtgtggtacttctggcagaagaagaaacaaaggagtggagtactttgggatactccaagccctccagaagtggaacgggctgttctagatgacggtatatacagaatattgcaaagggggttattagggagatcccaggtaggcgtaggggtatttcaagatggagtctttcataccatgtggcatgtcacacgaggggcagttttaatgtaccaaggtaagcgtttagaaccctcatgggcctcgataaagaaagatctaataagctatggaggaggatggaggttccaaggaagttggaatactggagaagaagttcaagttatagctgtagaaccgggtaaaaaccctaaaaatgtacagactacccctggaacatttaaaacaccggaaggcgaagtgggagctatcgcgttagattttaagccagggacgagcggctcccccatagtcaatcgggaaggaaaaatcgtggggctgtatggcaatggagttgttacgacttcagggacctatgtatcagcgatagcacaggcaaaggcttctcaagaaggccctctgccagagatagaagacgaggtttttaagaaacgaaacttaacgattatggacctacatcctgggagcggtaaaaccagaaggtatttaccagctatcgtgcgagaagcgataaagcgtaagttgaggacacttatactagcacccaccagggtagtagctagcgaaatggcagaagccctgaagggaatgccgataagataccaaaccacagctgtgaaaagtgaacacacgggccgagagatagttgatctgatgtgtcatgcaacatttacgatgaggttactctcccctgttcgagtaccgaattataatatgataataatggatgaggctcattttacagatccagcatcaatagcagcacgagggtacatcagtaccagggtaggaatgggagaggccgccgcaatatttatgacggcaaccccaccaggtagtgtggaggcctttcctcaaagtaacgcggtaatacaggacgaggagagagatattcctgaacggtcatggaacagcggatacgattggataacagattttccaggaaaaacagtatggtttgtcccaagtataaaaagcggcaacgatatagctaattgtctaaggaaaaacggaaaacgagtaatacaactgtcgagaaaaacattcgatacggaataccaaaagactaaaaataacgattgggactacgtagtaaccacagatatcagcgagatgggcgctaattttagagcggaccgggttatagaccccagacgttgtctaaaaccagttatattaaaagacggaccggaaagagtaattttagcaggtcccatgccggtaactgtagctagcgcagctcaacgtcgtggacgaattggtagaaaccaaaataaggaaggagaccaatacgtatacatggggcagccacttaataatgacgaagaccacgcccactggaccgaggcaaaaatgcttcttgacaacataaatactccagagggaattattccggctctatttgaaccagaacgagaaaagagcgcggcaatagatggagagtaccgtctaaggggagaagcaaggaagacgtttgttgaactaatgcgtcgaggcgatttacctgtatggttgtcgtataaggtagcatcggaaggattccaatattcagatagacggtggtgcttcgacggagagcggaacaaccaagtattggaagagaacatggatgtagagatatggactaaagaaggcgaacgaaagaagttacgaccgcgatggctcgatgcaaggacctactcggacccattggcattaagagagttcaaagaatttgctgcaggtaggcgcagcgtatcaggggatcttatactagagataggaaaattaccgcagcaccttacccttagagctcagaacgcgttggataacttagtgatgttgcataattctgaacaaggtggtaaagcctaccgacatgcgatggaagaactcccagatacaatcgaaacattaatgctattagcccttatcgcagtgctaacagggggcgttactttatttttcttgtccggaaaagggctagggaaaacatccatagggttactctgcgtaacagcttcaagtgctctcttatggatggcttcagtagaaccccattggatagcagcgtcaatcatccttgagttctttctaatggtactactaataccggagcctgataggcagagaacaccacaagataaccagctagcatatgttgttattggcttactatttatgattctaactgtggccgctaacgaaatggggctgcttgaaacaactaagaaagatctaggaatagggtatgtggcagcggaaaatcaccaacacgcaactatgctcgacgtagatctcagaccggcaagcgcttggacattatacgcggtagcaacaacagtaataacacctatgatgcgccatacgatagaaaataccacggcgaacattagccttacagctatagcaaaccaagcagccattttgatgggactagacaaaggatggccaatcagcaaaatggatatcggcgtgcctttactagcacttggttgctattcccaagtcaaccccctgacactcacggctgctgtactaatgctagtggcccactatgcaataataggaccgggactacaagcaaaggcgacaagagaagcacagaaaagaactgccgccggaattatgaaaaatcctacggtcgatggtattgtcgcgatagatctagacccagtggtatatgatgcgaagtttgaaaaacaattaggacagataatgttattgatattgtgtactagccaaatactattaatgagaaccacttgggcgttatgcgaatccataacgttggccactggacctcttacaaccttatgggaaggttcaccaggaaagttttggaatacaaccatagctgtttctatggcaaatatctttcgtgggtcttatctcgccggtgcgggattagcattttccctaatgaagagtttaggtggtggaagaaggggcactggagcacagggagaaacattaggggagaaatggaagagacaactcaaccaattgagcaaatcagaatttaatacatataagaggtctggtattatggaagtagatcgatccgaagcaaaagaaggattaaaacgaggcgaaaccacaaaacatgcggtatctagaggaaccgcaaaacttcgatggtttgttgaaagaaatcttgttaaacctgaggggaaggtaattgatttaggttgcggaagaggaggttggtcatattattgtgcaggactaaagaaagttaccgaagtaaaaggatatacgaagggaggcccaggccatgaggaacctatacccatggctacatatgggtggaatctggtaaaactgcattcaggaaaagacgtgttctttatgccgcctgaaaagtgtgatacgctattatgtgatataggtgaatcatcaccaaatccaacaattgaggaaggaaggacactccgcgtgttaaaaatggtagaaccctggttaaggggaaaccaattttgtatcaaaatacttaacccatatatgccctctgtcgtggagacattagaacaaatgcaacgcaaacatggaggaatgctggttaggaatccacttagccgtaactctactcacgagatgtattgggttagttgtggcacaggcaatattgtaagtgctgtcaacatgactagcagaatgctattaaacaggtttacaatggctcacagaaaaccaacctatgaaagagacgtggacttaggtgcggggactagacacgtcgcagttgagcccgaagaagcaaacctcgatataatcggtcaaaggatagaaaatatcaagaatgaacataaatctacttggcattatgatgaagataatccgtataaaacgtgggcttatcacggctcctacgaagtcaaaccaagcggaagcgccagcagtatggtaaacggcgtagttcgacttttaacaaaaccatgggatgttataccaatggtcactcaaattgccatgacagatacaacaccgttcggtcagcagagagtttttaaggagaaagtagacacaaggactccccgagccaaaagaggaactactcagatcatggaagttacagcaaaatggctctgggggttcttatcgaggaataaaaagccaagaatatgcactagagaggagttcacacgcaaagtgcgtagcaatgctgctatcggagctgtgttcgtggacgaaaatcaatggaactcggctaaggaagccgtcgaagacgaacgattttgggatctggtgcatcgtgaacgtgagctacataagcaagggaaatgcgcgacttgtgtatataatatgatgggaaaaagggagaagaaactaggggaatttggaaaagcaaagggaagtagagccatttggtatatgtggctaggcgccaggttcttagaatttgaagcacttggatttatgaatgaagatcattggttctccagagaaaattccctatcaggagttgaaggtgaaggtctacacaaattaggttacatactaagagacatatcaaaaattccaggaggaaatatgtatgcggatgatactgcagggtgggacactcgaataacagaggacgatttacaaaatgaagcaaaaataacggatattatggaaccagaacatgctttgctcgctaccagtatatttaaactcacctaccagaacaaggtagtacgagttcagcggcctgctaaaaacggaacagtgatggacgtaatttcaagaagggatcagcgtgggtccgggcaggtaggaacgtacggcttgaacacgtttaccaatatggaggtccaactaatacgccagatggaaagtgaaggaatctttttaccgagtgaattagaaacacccaatttagcagaacgggtcttagattggttggaaaaacatggcgcggaacgtttaaaaagaatggctatatctggagatgactgtgttgtaaagcccatcgacgatcgttttgcaaccgcactgactgctctgaacgatatgggaaaagtccgtaaggatatacctcagtgggaaccttcaaaagggtggaatgactggcaacaggtgccattctgttctcaccactttcaccagttaataatgaaagatggtagagaaatagttgtaccttgtcgaaaccaagacgaattagtgggacgagccagagtcagtcaaggcgcagggtggtcactacgggaaactgcgtgcctcggaaaatcatacgcgcagatgtggcagcttatgtattttcatcggagagacctgaggctggccgccaatgcaatatgcagcgcggtaccagtagattgggtaccaacatctcgaaccacctggagtatccatgctcaccatcaatggatgacaacggaagatatgctttctgtatggaatcgcgtttggatagaagagaatccatggatggaggataagacacatgtatcaagctgggaggaagttccatatttaggtaaacgtgaggatcagtggtgtggtagcctaataggtctaacagcacgcgcgacttgggctactaatattcaagtagctataaatcaggtaaggcgacttatcggaaacgaaaattatatagattatatgacatcaatgaagagattcaaaaacgaatcagacccagaaggcgcattgtggtga

SEQ ID NO: 21142 - RNA, 9879 nt, synthetic construct
  misc_feature 1..9879: note = derived and/or modified CDS sequence (opt6) from DENV-1__GQ868561__SS-prME
  source 1..9879: mol_type = other RNA
tcagtaactatgcttttgatgttgttaccgacggcgcttgcattccatcttacaactcgaggtggagaaccgcacatgatcgtttctaaacaagaacgcggaaaaagtttgctatttaaaacatcagctggtgtgaacatgtgcacattaattgcaatggatctaggtgaattatgtgaagatacaatgacatataaatgccctcgaatcacagaagcagaacctgatgacgtcgattgctggtgtaacgcgacagacacatgggtgacgtatggaacatgttcacaaacaggagaacatagacgggataaaaggagtgtagcattagcccctcatgtagggttaggtctggaaacccgtacagaaacctggatgagctccgaaggagcctggaaacaaattcagagagtagaaacatgggcccttaggcaccccggatttacagtaattgcattctttttggcacacgcaattggaacgagtataactcaaaaaggcattatcttcatacttttaatgttggtaacacccagcatggctatgcgctgcgtcggtataggtaatagagactttgtagaaggtttatccggagcgacgtgggtagatgtagtgcttgagcacggctcttgcgtaaccacaatggccaaaaataaaccaacactagacattgaactcttaaaaaccgaagtgacaaacccagcggtgttgaggaaactatgtatcgaggcaaaaatcagtaatacaacaaccgattcccgctgtcctacccaaggggaagcgacgttggttgaagaacaagatgctaactttgtttgtcgtaggacgttcgtagacagaggttggggcaatggttgcggattattcggtaaagggtcacttttaacatgtgcgaaatttaaatgtgtaaccaaactcgaaggtaaaattgtacaatatgaaaacttaaaatatagtgtaattgttactgttcacaccggggaccaacatcaggtcggaaacgagacaacagaacacggaacaattgcaactataactcctcaggccccgacaagtgaaatacaattaaccgattacggagcactaactttggattgttctccacggacaggactggacttcaatgaaatggtgcttctcacgatgaaagagaaaagttggttggtacacaagcagtggtttttggatttacccttgccatggaccagcggagctagtacatcacaggagacttggaatagacaggacctgttagtaacattcaaaactgctcatgcaaagaaacaagaagtcgtagtactcggctcgcaagagggagcgatgcatactgcactaaccggagcaactgaaattcaaacgtcaggtacaactacaatattcgcaggacatcttaaatgcagacttaaaatggataaacttacgctgaaaggcatgtcttatgtcatgtgtacgggttctttcaaactggaaaaagaagtggctgaaactcaacatggcacggtcctagtacaagttaaatacgaaggaacagacgctccatgcaaaataccgtttagcactcaggatgaaaaaggtgttacgcaaaacggtcggttaattactgccaaccctatcgtaactgataaagaaaaaccggttaatattgaaacagaacccccatttggagaatcgtatatcgtcgtcggtgcaggagaaaaagcattaaaactttcttggttcaagaagggcagtagtataggcaaaatgtttgaagcaactgccagaggtgctagaagaatggctatattaggcgatacggcatgggatttcggatccataggaggtgtatttacaagtgtaggtaagttagtacaccaggtatttggtactgcatatggagtcctattttctggggtaagctggactatgaagatagggatagggattttactcacttggttgggccttaacagtagatcaacatcccttagtatgacatgcatcgcagtaggaatggttaccttatatctaggtgtaatggtacaagctgactccggttgtgtaataaattggaaaggtcgggaactcaaatgcggttcgggaatattcgtaacaaatgaagtacatacctggaccgaacagtacaagtttcaagcggattctcccaaaagattaagtgcagcaattggcaaggcttgggaagaaggcgtatgcgggatccgcagcgcaacaagattggaaaatataatgtggaaacaaatctcaaatgagttgaatcatattttattagagaatgacatgaaattcacagtagtagtgggggacgcgaacggaatcttagcacagggtaagaagatgatcagaccccaacccatggaacacaaatattcctggaaatcgtggggcaaagcgaaaattattggagccgacattcaaaacactaccttcattatagatggcccagatacgccagaatgtccagacggacaaagagcttggaacatctgggaagtagaagattacggcttcggaatcttcacaacaaatatatggctaaagttaagagactcatacacacagatgtgtgatcaccgtttgatgtccgcagcgataaaagattccaaagcagtccacgccgacatgggatattggatcgaatcagagaaaaatgagacatggaagctcgccagggcgagctttatagaagttaaaacttgtacttggccaaaatctcatacactgtggtcaaacggtgtactcgaaagcgagatgattattccaaaaatatatggaggaccaataagtcagcacaattatagaccgggatactttacacaaacagcaggtccatggcatctcggtaaattagaattagattttgatttgtgtgaagggaccaccgtagttgttgatgaacattgcggaaataggggaccgagtttaagaacaacgacggttacgggcaagatcatccatgaatggtgctgcagaagttgcacattaccaccactacgctttcgaggggaagacggttgttggtatggtatggagattaggccagtgaaagaaaaagaggaaaaccttgtaagaagcatggtgagtgcagggtccggagaagtagattcattcagcttaggtatactctgcgtctccataatgatcgaagaagtcatgcgaagtaggtggtctaggaaaatgttaatgacggggaccttagcagtattcctattattgattatgggacagctaacttggaacgacctaataagattatgtataatggtgggtgcaaatgcaagtgatagaatgggtatgggaactacctaccttgccctaatggccacattcaagatgaggccaatgttcgccgtaggactcctgtttcgccgactgacaagccgagaagtgctgctactaactataggattatccttggtggcaagtgtagaattgccaaattcgctagaggaacttggagatgggcttgcaatgggtataatgatgttgaaattgctaacagaatttcagcctcatcaactatggaccaccttgctatctttaacttttgtgaaaaccaccttatcgttagattacgcgtggaaaacgacagccatggtattgagtattgttagcctgtttcctttgtgtttgagtacgactagccagaaaacgacatggttacctgtgttgttaggctcttttggatgcaaaccgttaactatgtttttgataacagaaaataaaatatggggcaggaaatcatggcccttaaacgaaggtataatggcaattggtatagtatccattctactatcatcactgctcaaaaacgatgtccctctggctggtcctcttattgcgggaggtatgctaatagcatgttatgttattagtggttcgtcagctgacctatccttagaaaaagctgcagaagttagctgggaacaagaggccgaacattccggagcttcacacaatatactggtagaggtacaggacgacggaactatgaaaatcaaagacgaagagagagacgatactctaactattttgttgaaagcaactttacttgcagtgtcaggtgtctaccctatgtccatcccagctacgttgtttgtttggtacttctggcagaagaaaaagcaaaggagcggcgtactttgggataccccaagtcccccggaggtagaaagagcggtattagacgatggaatctatcgtatccttcaaagaggactattagggcgctcgcaagtgggtgtcggtgtatttcaagatggagtctttcatacaatgtggcatgtaacccgtggagctgtattaatgtatcaaggaaaacgtttagagccttcatgggcgagtgttaagaaagatttaataagttacggtggaggatggcggttccaaggaagctggaatacaggagaagaagtccaagtgatcgcagtagaacctggcaaaaatccaaagaatgtgcagacaacacccgggacctttaaaacacccgaaggtgaggtcggcgccattgcattagatttcaaaccaggcaccagtggaagtccaatagtgaaccgagaaggtaaaattgtagggctttatggtaatggagtagtaaccacgtcgggcacttatgtttcggcaattgctcaagcaaaggcttcccaggagggacctctcccggaaattgaagatgaagtcttcaagaaaagaaatttgacaataatggacctacacccaggatcgggtaaaacacgtaggtacctccctgcaatagtcagagaggccattaaacgaaagctacgaactctaatactagctcctactagagtggtcgcaagcgagatggcagaggcgttgaaggggatgcctattaggtatcagacaacagctgttaaatctgaacacaccgggagagaaatagtagatctaatgtgtcacgctacatttaccatgaggctactaagcccagttcgagtacctaattataatatgatcataatggacgaagcacatttcactgacccagcttcaattgccgccagaggttacataagtacaagagtgggtatgggggaagcagctgctatatttatgacggcaacgccgcccggaagcgtagaagcgttcccccaatcaaatgcggtcatccaggatgaagaaagagatatacccgaaagatcgtggaactccggatacgattggataactgatttcccgggaaaaacagtttggttcgtacctagtataaaaagtggcaatgacattgctaattgcttaaggaaaaatggcaaacgggtgattcaactaagtcgcaagacttttgacaccgaatatcagaaaactaagaataatgattgggactatgtagtaacaacagacatttcagaaatgggagccaactttagggcagatagagtaatagatccaagaaggtgccttaaaccagttatattaaaagacggtcctgagcgcgtcatccttgcaggaccgatgcctgtgacggttgctagcgccgcacaacgtagaggcaggataggaaggaatcaaaataaggagggagatcaatatgtatacatggggcaaccacttaataatgatgaagatcatgcacactggacagaggcgaaaatgctccttgataatataaatacaccagagggcataataccagctctcttcgaacccgaaagagagaaaagtgcagcgatcgacggcgaataccgtctccgtggagaggcacgtaaaactttcgtagaattaatgcgccgcggagatctgccggtttggctgtcatacaaagtggcaagtgagggatttcagtattcggataggcgatggtgttttgatggagaacgcaataaccaagttttggaagagaacatggatgtagaaatatggacaaaggagggagaaagaaagaaattaaggccacgatggctggatgcacgcacctattcagacccattagcgttacgagagtttaaagaatttgcggcggggagaaggtctgttagcggggacctaatattagagatagggaaattacctcaacacttgacgttgagggcacagaatgcgttggacaacctagtaatgctacataactcagaacaaggaggtaaagcctacagacacgctatggaagaactcccagacacaatagaaacacttatgttgttagctttgattgccgtattgaccggaggagttaccctattctttttatcaggcaagggcttaggaaagacatcaatcggactactttgtgtaactgcaagtagtgccctgctatggatggcatctgttgaaccacactggatagcagcatccataatactagagttctttttaatggtgctcctgatcccagaaccagataggcaaaggacgccccaggataaccaactggcatacgtggtgatcggacttcttttcatgattttgacagttgcagcaaatgagatgggcctgctcgaaacgactaagaaggacctgggcatagggtatgtcgccgcagagaatcaccagcatgcaacaatgctcgatgtagacttaagacccgcaagtgcatggactttgtacgctgttgcaacaacagtcattactcccatgatgagacataccattgagaataccaccgcaaacatatctctgactgccatagcgaaccaggcagctatcttaatgggactagataaggggtggccaatctcaaagatggatatcggcgtacctttattggctcttggttgctatagtcaagtaaatccattaactttaacggctgcagttctcatgctcgtggcacactatgctattatcggaccgggactacaagctaaagccactagagaagcccaaaagaggactgctgccggaatcatgaaaaatccgacagttgatggaattgtcgccatcgatctagacccagtcgtgtatgatgcaaaatttgaaaagcaattaggacagattatgttactaatattatgtacgtcacaaatactacttatgcgtactacatgggcattatgtgaatcaatcacactcgcgactggcccattaactaccttatgggaaggaagtcccggaaaattttggaacaccacaatagcagtatctatggcaaacatatttcgcggcagctatttagccggggctggactagcgtttagtctaatgaagtcattaggaggtgggagaagaggaaccggtgcacaaggagaaacacttggagaaaaatggaaaagacaattaaatcagttgagcaagagcgaatttaacacgtacaaaaggtcaggaatcatggaagttgatcggtctgaagcaaaggaaggtctaaagcgcggagaaacaacaaaacatgcagtatcccgcggaacggcgaaacttaggtggtttgttgagaggaatctagttaaacctgagggaaaagtgatagatttaggatgtggacgtggaggatggtcttattactgcgcaggactgaagaaagtcacagaggtaaagggttacactaaaggaggtcccggacatgaagaacctataccaatggcgacatatggatggaacttagtaaaactacattctggtaaagatgtattcttcatgccaccagaaaaatgtgacacgctattatgtgatataggtgaatcctcaccaagtcccacaatagaagaggggagaacattgagggtactaaagatggttgagccttggttacgaggtaaccaattctgtatcaaaattcttaacccatacatgcctagtgttgttgaaaccctagaacaaatgcagcggaagcatggaggtatgttggttcgtaacccattgtcaagaaattccactcacgaaatgtattgggtttcgtgtggaacgggaaacatcgtgtccgcagttaacatgacctcacgaatgttactcaacaggtttacaatggcccatagaaaacccacatatgaaagagatgtggatttaggtgcaggaactcgtcacgtagctgtggaaccagaagtcgcaaatttggacataataggtcaaagaatagaaaacataaagaatgaacataaaagcacatggcactatgacgaggataatccatataaaacgtgggcttaccatggaagctacgaagtcaagccaagcggatcggcgtcaagtatggtcaacggagtagttagactgctaactaaaccctgggacgttataccaatggttacacaaatagcaatgactgacacaaccccttttggacaacaacgagtattcaaagaaaaagttgatacccgaacaccaagagcaaaacggggaactacacagataatggaagtgacggcgaagtggctttggggcttcctatcaagaaacaagaaaccgcgaatatgcacacgagaagagttcactagaaaagtccgtagtaatgcagccataggagccgtctttgtcgatgaaaatcagtggaactccgctaaagaggctgtcgaagacgaacgtttctgggatctggtacacagagaacgagaacttcataagcaaggtaaatgtgccacttgcgtatacaacatgatgggaaaacgggagaagaaacttggcgaatttggtaaagctaaaggatctcgtgctatctggtacatgtggctgggagctcgattcctagagttcgaagccctgggttttatgaatgaagaccattggttttcaagggaaaacagcttatccggagttgaaggggaaggtttgcataagctaggatacatattacgggacatatcgaagataccaggtggaaacatgtatgccgacgacactgccggatgggatactagaataacagaagatgatttgcagaacgaggcaaaaattactgatatcatggaaccagaacacgcattgctcgctacttcaatctttaaactaacctatcagacaaaagtggttagagtccagcgtcctgccaaaaatggtaccgtaatggatgtcatatccagacgggaccaaagaggttcgggtcaagtcggcacttatggactgaatacgttcacaaacatggaggtacaattaattcgtcaaatggaatccgaaggcattttccttccttccgaattagagactccaaacctcgcagaaagggtactagattggcttgaaaaacacggcgcggaacgcctaaagcgaatggcaataagtggggatgattgtgtcgtaaaacccattgacgatcgatttgcgacagcactaacggccttaaatgacatgggaaaggtaaggaaagatataccacaatgggaaccaagtaaaggatggaatgattggcaacaagtccccttctgttcgcaccattttcatcagctcataatgaaagatggcagagaaattgttgtcccttgtagaaatcaggatgaattagtagggcgagcacgggtatcccaaggagcaggatggagcctacgagaaacagcatgtttagggaaatcctatgctcagatgtggcaattgatgtatttccaccgtagggacctacgtttagcagcaaacgcaatatgtagtgccgtaccggtggattgggtcccgacgtcaaggactacttggagtattcatgctcaccatcaatggatgacgacagaagatatgttgagcgtatggaatagagtatggatagaggaaaacccttggatggaagataaaactcacgtctcttcttgggaggaagttccatatttgggtaagcgggaagatcaatggtgtggctccctaattggattaactgccagagcaacttgggctacaaacattcaggtggcaatcaaccaagtgcgtcgactgattggtaatgagaattatttggactatatgaccagtatgaaacgatttaaaaatgaaagcgaccctgaaggtgcactatggtaa

SEQ ID NO: 21143 - RNA, 9879 nt, synthetic construct
  misc_feature 1..9879: note = derived and/or modified CDS sequence (opt6) from DENV-1__GU131948__SS-prME
  source 1..9879: mol_type = other RNA
tcagttactatgcttttgatgctgttacctactgctctagcgttccacttaaccactcgtggaggtgaaccacacatgattgtcagtaaacaagaaagaggaaaaagcctattattcaaaactagcgctggagtgaatatgtgtacactcatagcaatggatttaggggaactttgtgaagacactatgacgtacaaatgtccacgaatcactgaagctgaacccgacgacgtcgattgttggtgtaatgcgacagacacttgggtaacgtacgggacttgttcacaaacaggtgaacatcgaagagataaacgtagtgtagcacttgctccacatgtcggcctggggcttgaaacacgtaccgaaacatggatgtcctcagaaggggcatggaaacaaattcaaagagtggaaacatgggcgctcagacacccgggttttactgtaatagcgcttttcctggctcatgcaataggtacatcaataacccaaaaaggaatcatctttatactactcatgttagtaacgccatcgatggctatgcgatgtgtcggcattggtaatagggatttcgtggaaggattaagcggggctacatgggttgatgtggtattagaacacggaagctgcgttacaacgatggccaaaaataaacccacattagacatagaattacttaaaactgaagttaccaacccagcagtgttaaggaaactgtgcatagaagcgaaaatatcaaatacgacgacggactcacggtgtccaactcagggagaggctacacttgtggaagaacaagacgcgaattttgtttgtcgaagaacctttgtagatagaggatggggtaatggatgtggactttttggtaaaggcagtctattaacctgcgcaaaatttaaatgcgttaccaaacttgaaggaaagattgtacaatatgaaaacctcaaatactcagtcatagtaaccgtccatactggcgatcaacatcaagtcgggaacgaaacgacagagcacggaacgattgcgactatcacaccgcaagcacctacgtcagagattcaattaacagattacggtgcattgactttggattgtagccctcgtactggccttgattttaatgaaatggttctattgactatgaaagagaaaagctggctagttcataaacagtggtttttagacttaccgcttccatggaccagcggggcttcaacttcccaagaaacctggaatcggcaagatttattagtaactttcaaaactgcacatgcaaagaaacaagaagtcgttgttttaggctcacaagaaggggcaatgcacacagcacttacaggtgcaacagaaatacaaacgtcaggaacaacaactatcttcgcagggcatttaaagtgtagactgaaaatggacaagctaacactaaagggaatgtcatatgtaatgtgcacaggatcatttaaattggaaaaagaagtcgcagagacgcagcatgggactgtccttgtccaggttaaatatgagggtacggatgcaccatgcaagatacccttcagtactcaagacgaaaagggagttacgcaaaacggtagattaataacagcaaatccaatagttaccgacaaagaaaagcctgtaaacatagaaacagagccaccatttggagagagttatattgttgtaggagccggtgaaaaagcacttaaactgtcatggtttaagaagggaagttcaatagggaaaatgtttgaggcaacagcacgaggcgctagacgaatggcaattctgggagatacagcatgggattttggtagcataggcggggtctttacaagtgtaggcaaactcgtgcaccaagtattcggaacagcttatggtgttctattcagcggagtttcgtggaccatgaaaatcggaattggaatcttattaacctggttagggctaaactcaagatcaacaagtctgagtatgacttgtatagctgtgggcatggtaactctatacctaggagtaatggtccaagccgactccgggtgcgtcataaattggaaaggaagggaactcaagtgtggatcgggtatttttgtaacaaatgaagtgcatacatggacagagcagtataaatttcaagcagactcacctaaacgattatcagcagcaatcggtaaggcatgggaggagggagtctgcggaatacgatcagctacaaggttggaaaacattatgtggaagcaaatttcaaacgaacttaaccacatactcctagagaatgacatgaaattcactgtagtcgtgggggatgctaatggaatactagcgcaaggcaagaaaatgattcgtccacagccgatggaacataagtactcatggaaatcgtggggcaaagccaagattataggtgctgatattcaaaatacaacattcattatagatgggcccgacaccccagaatgcccagatggtcaacgagcgtggaatatatgggaggtggaagattatggctttggaatctttaccaccaatatctggcttaagctcagagactcatacactcaaatgtgcgaccaccggctaatgagtgctgcaatcaaagattctaaagcagtccatgcagatatgggctattggatagagagtgagaaaaacgaaacgtggaagttggctcgtgcatctttcattgaagtcaaaacatgcacatggccaaaatctcacaccctatggagcaatggagtgctcgaatctgaaatgataataccaaaaatatacggaggacccatctctcaacataattatagacctggatatttcacacaaactgcaggtccgtggcatctaggaaaactggaactagacttcgacttatgtgaaggtaccacagtagtggtcgacgaacactgcgggaatagaggtccaagtttgagaacaacaactgtgactggtaagatcatacatgagtggtgttgtcgatcctgcacattacccccacttagatttcgaggggaagacgggtgctggtatggaatggaaataagacccgtaaaagaaaaagaagagaacttagttcgatccatggtatcagctggatctggagaagtggattccttctctttaggtatactctgcgtttcaataatgatagaagaagtaatgcgatcacgatggtcgagaaaaatgttaatgactggaaccctagcagtttttctattattaattatgggacaactaacatggaacgatctcattcggctatgtattatggtaggagccaatgccagcgaccgtatgggtatgggtaccacgtacttagcattgatggcgacatttaaaatgcgtccaatgttcgctgtgggattactttttcggcgtctaacgagtcgtgaaattctacttttgacaattggacttagtttagtagcatcggttgaactaccaaactcgttagaagaactaggcgatggactggcaatgggaattatgatgttaaagctactaaccgaatttcagccccaccaactctggaccactttactctctttaaccttcgttaaaacaacactatctcttgactatgcttggaagaccaccgcgatggtcttatccatcgtatctcttttccccttatgcttaagtaccacaagtcagaaaacaacttggttacctgttttactgggatctttcggctgtaagccgctaaccatgtttttaattacagagaacaaaatttggggcaggaaatcatggcctctaaatgagggtatcatggccataggaatagtctcgattctactcagctctttattgaagaatgacgtgccgctggccggcccattgatagctggtggtatgctcatagcctgttacgttatatctgggagcagcgctgatctttctttagaaaaagcggcagaggttagctgggagcaagaagctgaacattcaggagcaagtcacaatattttggtagaagtccaagatgacggaactatgaagataaaagacgaagagagagacgataccctaacaatcctactcaaagcaacactcctggcggtgtcaggagtgtatcctatgtccataccggctactcttttcgtctggtacttttggcagaagaagaaacaacgaagcggcgttttatgggatacaccgagtcctcccgaagtagaacgcgccgtactggatgacgggatatatagaattttacaaagaggtttgttaggtagatctcaagtgggggtgggagtgttccaagatggtgtatttcacaccatgtggcatgtcacaagaggggcagtccttatgtaccagggtaaacgtctagagccttcatgggcaagcgttaaaaaggatttaatttcgtatgggggaggctggcgttttcagggtagctggaatacaggagaagaggtacaggtaatagctgtcgagccaggaaagaaccccaagaatgtacagacgacacctggaattttcaaaactcctgaaggcgaagttggagctatcgctctagactttaaacccggaacttccggatcgccaatagtaaatagggaaggaaagattgttggactttacggaaacggcgtggtgactacctcaggaacctacgtttcggcaattgctcaagcaaaggcttcacaggaaggtccattaccggagatagaagatgaagtatttaagaaaagaaatctcacaataatggatttacacccgggttcagggaaaacccggcgatatctcccagcaatcgtgcgggaagctataaaacgaaagttacgaaccttgattcttgctccaactcgggttgttgcttccgaaatggctgaagcgctaaaaggaatgccgatacgttaccagacaaccgccgttaaaagtgagcataccggccgcgaaattgtcgatttgatgtgtcacgctacttttaccatgcgattactcagccctgtgagagtacctaactataatatgattattatggatgaagcgcatttcacagacccagcatcaatagcagctagaggatacataagtacgagagtaggaatgggagaagcagcggccatttttatgacagcaactccaccgggttcggtggaagcattcccccaatcaaatgcagtaatacaggacgaagagagagacataccggaacgaagttggaactctggctatgactggattacagacttccccggaaagacagtatggttcgttccgtcaattaagtccggtaatgatattgctaattgcctccgcaagaatggtaaaagagtgatacagttaagtagaaaaacatttgacacagaataccagaaaactaaaaacaatgattgggactatgtcgttacgacagatatttctgaaatgggagcaaactttagagccgacagagtgatagaccccagaagatgtcttaaacctgtaatcctcaaagatggaccagaacgtgtaatattggctggaccgatgccagtcaccgtcgctagcgccgcacaaaggagaggacgaattggacgcaaccaaaataaagaaggagatcaatatgtttacatggggcaacctcttaataatgacgaagatcacgcacactggactgaagctaaaatgttattggacaatataaacacacctgaaggtataattcctgcattattcgaaccagagcgagaaaaatccgctgctatagacggagaatatagactccgcggtgaagcaagaaaaacatttgttgagctaatgaggaggggagacctcccagtatggctcagttataaggtggcttcagagggatttcaatatagtgatagaagatggtgttttgacggagaacggaataaccaagtcttagaagaaaacatggacgtcgaaatatggacaaaagaaggagaaaggaagaaattacgaccaagatggttggatgcaagaacatactctgacccgttagccttgagagaatttaaggagttcgcagcgggacggagaagtatttcaggggatttaattttagagatcggcaagttaccacaacaccttacactacgcgctcaaaacgcattggacaatttagtgatgttgcacaattcagaacaaggaggtaaagcatatcgacatgctatggaggaactacctgacactattgaaactctgatgctattagccttgatagcggtattaacaggtggtgtaaccctatttttcctgagtggcaaaggtttgggtaaaacgtcgattggcctactttgtgttaccgcatcaagcgcgctactttggatggcttcggttgaaccacactggatcgctgcttcgataatactcgagttctttttgatggttttactaataccagaaccagacaggcaaagaacacctcaagacaatcaattagcatatgtagtcattggcctattgttcatgatacttactgtagcagcgaatgaaatgggcctgttagaaactacaaagaaagatcttgggataggatatgtggcagccgaaaatcatcagcatgcaaccatgctcgatgtagatctacgcccagcaagtgcatggacgctatacgccgttgccaccactgttataactcccatgatgagacatacaatcgaaaacacaactgcaaacataagtctaaccgcaatagccaatcaagcagcaatattgatgggtctcgacaaaggatggccaatatcaaagatggatattggggtccccctacttgcattaggatgttatagtcaggtcaatccactaacacttacagctgccgtactaatgttggtagcacattacgcaattataggacccgggttacaggctaaggcaactcgagaagctcaaaagagaacagcggctggtataatgaaaaatccaacagtagatggtatcgtggcgatagacttggaccctgttgtatatgacgccaaatttgaaaaacaactaggacaaatcatgctcttaatcttatgcacatcacaaatattgctgatgcgaacaacttgggcattgtgcgagtccatcaccttagcgacaggaccactgaccacattatgggaaggttctccaggtaaattttggaacacaacgatcgccgttagtatggcgaatatttttagagggagctatctcgctggggccggcctggcattctcgctaatgaaatctttaggtgggggaaggagaggtactggtgcgcagggcgaaacattgggcgaaaagtggaaaagacagctcaatcaattatctaaatcagaatttaatacctacaaaagatctggtataatggaagttgatcgtagcgaggcaaaagaaggccttaaaagaggcgaaacaaccaaacacgcagtaagtaggggcacagcaaaattaaggtggtttgtagaacgaaatctggtcaaaccagaagggaaagtaatagacctgggatgcggcagaggcggctggagttactactgcgcaggcctcaagaaagtaactgaagtgaaaggctatacaaaagggggtcctggacatgaagaaccaatacccatggccacgtatggctggaaccttgttaaacttcactctgggaaggatgtgttctttatgccgccggaaaagtgtgatacactgctatgcgacatcggtgaatctagtcctaatcctacaatagaagaaggacgcacactcagagtccttaagatggtagaaccctggcttagaggaaaccaattctgtattaaaatccttaatccgtatatgccatctgtagtagaaacattagaacaaatgcagagaaaacatggtggcatgctggtcagaaatcctttatcaagaaacagtactcatgaaatgtattgggtatcatgtgggacaggaaacattgtgagtgccgtaaacatgacatcacgtatgctcttaaatagatttacgatggcgcatagaaaaccaacatatgaacgagacgtggatttaggagcaggaacaagacatgttgctgttgaaccagaagtagcaaatcttgatataattgggcaaagaatcgaaaatatcaaaaacgaacataaatcaacatggcactatgatgaagataatccatataaaacctgggcatatcacggctcttatgaagtaaaaccgtcaggatcagcttcaagcatggttaatggggtagtgagactattaaccaagccctgggacgttatcccaatggtaactcaaatagcaatgacggacacgacaccattcggacaacagcgagtattcaaagaaaaagttgatacaagaacacctcgagctaaaagaggaacaactcaaattatggaagttaccgcaaagtggctatggggatttctttcacgtaacaagaagcctcgaatatgcaccagggaagagttcacacgtaaagtaagatccaatgcagcgataggtgctgttttcgtagatgagaatcaatggaactctgcaaaggaggctgtggaagatgaaagattttgggatctagtgcaccgtgagagggagctccataaacagggcaaatgcgcaacttgtgtgtataacatgatgggaaaacgagaaaagaaacttggagaatttgggaaagccaaagggtctcgggccatatggtacatgtggctaggggcaagatttttagagttcgaagcattaggtttcatgaatgaagatcattggtttagtcgagaaaatagtttatccggcgtagaaggtgaaggattacacaaactgggttatatactcagagacatttcaaaaataccaggaggaaacatgtatgcggatgatacggcgggatgggacaccagaataacagaagatgatttgcaaaatgaagcaaaaataactgatatcatggaaccagaacatgcattattggctacgtctatttttaaattaacctatcaaaataaagtagtccgggtacaaagaccagctaaaaatggtacagttatggacgtaatatcgcgcagggatcagcgcggatcaggccaagtgggtacatatggtttaaatacattcacaaatatggaagtccagttaatacgacaaatggaaagtgaagggatattcttgccgagtgaattagagactccaaatttggcagagagagtcttagattggcttgaaaaacatggagcagaacgtctgaaacgcatggcaatatctggggatgactgtgttgtgaaaccgatagatgacagatttgcaacggccctcaccgccttaaatgatatgggcaaagtgcgaaaggacactccccaatgggagccaagcaaaggatggaatgattggcaacaagtacctttctgtagtcatcattttcatcagttaataatgaaagatgggcgagaaatagttgtaccttgtagaaatcaagacgaattggtagggcgcgcgcgagtcagtcaaggcgcaggatggtcattgcgggaaacagcttgtttaggcaaatcttatgcacaaatgtggcagcttatgtactttcacaggcgcgatcttaggttggcagcgaacgccatatgtagtgccgtgccggtggattgggttccaacttcccgaacaacatggagtatccatgcccaccaccaatggatgacgaccgaagatatgttatcagtttggaaccgagtctggattgaggagaacccatggatggaagataaaacacacgtaagctcatgggaagaagtgccctatttaggcaaaagagaggaccagtggtgtggtagcttaattggactaacggcacgcgccacgtgggctacaaacattcaggttgctattaaccaagtccgcaggctaatcggcaacgaaaattatttagactacatgactagcatgaaaaggttcaaaaacgaatctgaccctgagggagcactatggtag

SEQ ID NO: 21144 - RNA, 9879 nt, synthetic construct
  misc_feature 1..9879: note = derived and/or modified CDS sequence (opt6) from DENV-1__GQ868562__SS-prME
  source 1..9879: mol_type = other RNA
agcgtaactatgttattaatgcttctgcctacggcgcttgcgtttcatctaacaacaagaggaggggaaccccacatgatagtgtccaaacaagaaagaggaaaaagtctattatttaaaacaagtgcgggagttaacatgtgcacgctaattgcgatggatctgggagaactatgtgaagacaccatgacatataaatgcccccgaattaccgaagcagaacccgacgatgtagactgttggtgtaacgcaacagatacgtgggtaacatatggaacgtgttctcaaaccggagaacacagacgagataaaaggtctgtagctctcgcaccgcacgtaggactgggattagaaactagaactgaaacatggatgagcagcgaaggggcgtggaaacaaattcaacgagtagagacctgggccctaagacaccctggttttactgtaattgcattatttttggcacacgcaataggtacatccatcactcaaaaaggtataattttcatacttctaatgctagttactccgtctatggccatgagatgtgttggaataggaaatcgtgatttcgtggaaggtcttagtggagcaacttgggttgacgtagtattagaacacggctcatgcgtgaccaccatggcgaaaaacaaaccgactctcgatatcgaattattgaaaacagaagtaacgaacccagcagtcctgcgaaaactttgcatcgaagcaaaaatatcaaatactactactgatagcagatgtcctacacaaggagaggcaacccttgtagaggaacaagatgcaaatttcgtatgcaggaggacctttgtggaccgaggctggggcaatggctgtggcctgttcgggaaaggatccctattaacatgtgccaaattcaaatgtgtaacaaaattagaaggtaaaatagtacaacatgagaatctgaaatacagcgtaatcgtaactgtacacactggcgaccaacatcaggttggaaatgaaactacggagcatggcactatagcgacaataacacctcaggccccgacgtctgaaatccaattaacagactatggtgcactaactctagattgttctccaagaacaggattggacttcaacgaaatggtattgttgacaatgaaagaaaaatcctggttagtacataaacaatggtttttggaccttcccttaccgtggacatctggagcttcaacaagtcaagagacatggaatagacaagacttgctagtgactttcaaaacagcacatgcaaagaaacaagaagtcgttgttttgggatcacaggaaggagctatgcacacagcattaacaggggcgacagaaatccaaacatctgggactactaccatattcgccggccatttgaaatgtagattgaaaatggataaattaaccctaaaaggcatgagctacgtgatgtgtacaggtagctttaaactagaaaaagaagtggcagaaacacaacatggaacagtcctagtacaggtaaaatatgaaggaacagatgctccgtgcaaaatcccgttttcaacccaagatgaaaaaggggtaactcaaaacggacgtctcataacagccaacccaatagtaacagataaagagaaacccgttaacatagaaacagagcccccatttggggaaagctacattgtagtaggggctggtgaaaaagcacttaagttaagttggtttaagaaaggatcttctataggaaaaatgttcgaggcgaccgcacgcggcgcgagaagaatggcaatcttgggcgatacggcatgggattttggcagcattggtggcgtgttcacaagtgtaggtaaattggtacatcaagtctttggaacggcatacggagtactgttttcaggtgtatcatggacaatgaaaataggaattggaattttactaacttggctaggtctcaattcgagaagtacaagcctctcaatgacatgcatcgctgttggaatggttaccttatatttgggagtaatggtacaagctgattcgggctgtgttatcaactggaagggaagagaattaaaatgtgggtctggaattttcgtaacaaatgaggtgcatacatggacagaacagtacaaatttcaggctgattctcctaaaagattatcagcagccatcgggaaggcttgggaagagggcgtctgtggtataagatcagccacgcgactcgaaaacattatgtggaaacaaatttcgaatgaacttaatcatatactacttgaaaatgacatgaagtttacagtagtagttggagatgcgaatggcatattagcgcaggggaagaaaatgatacgcccgcagccaatggaacataaatacagttggaaatcttggggaaaggcaaaaattataggagcagacatacaaaatactacgttcataatagatgggcctgatacgcccgaatgcccagacggacagcgtgcatggaatatatgggaggttgaagactacggattcggaatatttacaaccaatatttggttaaaactgcgagacagctatacacaaatgtgtgatcaccgtcttatgtctgcagcaattaaagattcaaaagctgtacatgcagatatgggttactggatagaatctgagaaaaatgagacatggaaattagcacgagcatcatttatcgaggtcaagacatgcacttggcctaagtcacataccttatggagtaatggagtactggaaagcgaaatgataataccgaaaatctatggaggccctatctctcaacataattaccgaccgggatatttcacacaaaccgcgggaccatggcatctcggaaaattggaactggacttcgatctctgtgaaggaacaactgtggtagtagacgagcactgtggtaacagaggaccttccctacgcacaactactgtaacaggaaaaattatacatgagtggtgctgcaggtcatgtacactaccaccgctaaggtttcgaggcgaggacggctgttggtatggtatggaaatacgtcccgttaaagagaaagaagaaaacttagttagatctatggtttccgccggaagcggcgaagtagatagttttagtctgggaatcctatgtgtcagcataatgattgaagaagtcatgagaagtcgctggagccgaaagatgttgatgacaggtacattagcagttttcttactcctaatcatgggtcagttaacgtggaatgaccttattcgtctatgtatcatggtgggggcgaatgcatctgacagaatggggatgggaacaacacatttagccttaatggcaacctttaaaatgcggccaatgtttgcggtgggtttgctattcagaagattaacttcgcgggaagtgctacttctaacaataggtctttctttagtagcgagcgttgagctacccaatagcctcgaggaattaggtgatggcctggccatgggcataatgatgttaaaactcttaacggaatttcaacctcaccaactgtggacaactctattgtcactgacctttgttaaaactacgttatcactagattatgcttggaaaacaactgcaatggtactcagtattgtaagtctgtttccgctgtgtctttcaacaaccagccagaagacgacgtggttaccggtgctactaggatcgtttggttgcaaaccactcacaatgttcttaattacggagaataaaatctggggtcgtaaaagctggcctctaaacgagggaattatggctatagggatagtctcaattctactatcatccttgcttaaaaatgatgtcccccttgcagggccgctaatagccggtggaatgcttattgcatgctatgtgatcagtggatcatcagccgatctatcgctcgaaaaagcagcagaggtatcatgggaacaagaagcagagcattctggagcctcacataatatcctagtagaagtccaagacgacggaactatgaaaatcaaagacgaagaaagagatgacacacttactatattgctgaaagccaccctattagcagtaagtggtgtctacccaatgtctattcctgcgacactgtttgtctggtatttttggcagaagaagaaacaacgctctggcgttctgtgggatacaccatcacccccagaagtcgaacgagcagtcctagatgacggtatatacagaattttacagcgcggattattggggcgaagccaagtcggtgtaggagtttttcaagacggagtgttccacacaatgtggcatgtgacgcgtggagcagtgcttatgtatcaaggaaagaggcttgaacccagctgggcatcagtaaagaaagacttaatctcatatggcggcgggtggagatttcaagggagttggaacacaggagaggaagtccaagtcatagctgtcgaaccaggcaaaaatcccaaaaatgtacaaacaacacccggaacattcaagactcctgaaggagaagtcggtgcaatagcactcgacttcaaaccgggaacaagcggatcgccaatagtaaatagggaagggaagatcgttgggctctatggcaatggagtagtgaccacaagtggaacatatgtttcagccatagcacaagccaaagctagtcaagaaggtcccctgccagagatagaagatgaagtatttaagaaacgtaacctaactataatggatctgcatcccggctcgggaaagacaagaagatacttgcctgccatagtacgggaagcaatcaagcgaaaattgagaactttaatattagcccccacaagggtggtagctagcgagatggcagaggctttgaaaggcatgccaatcagataccagacaaccgctgtcaaatcggaacacaccggcagagagatcgtcgacttaatgtgccatgctacgtttacaatgcgtctattgtcacctgtaagagtaccaaattacaatatgatcatcatggatgaagctcatttcactgatccggcgtctatagccgcaagaggctatatatcaacgagagtaggcatgggagaagccgccgctatctttatgactgcaacacctccagggagtgtggaagcgtttccccaatcaaatgccgtcatacaagatgaggaacgggatatacccgaaagaagctggaactccggatacgattggataacagattttcctggcaaaaccgtatggttcgttcctagtattaaatcaggtaatgatattgccaattgcttgaggaaaaatgggaaaagggtcatccagttgtcaagaaaaacatttgatactgaataccagaaaaccaaaaataatgattgggactacgttgtcacaacggacatttcagaaatgggtgcgaattttcgggctgatagagttattgatcccagaaggtgtctaaaaccggttatattgaaggacggtccagagagagtaatattagcaggaccgatgccggtcacagttgcttccgctgcccaacgaaggggtagaattgggagaaatcaaaacaaagaaggagaccaatacgtatatatggggcaaccattaaacaacgatgaggatcatgcgcattggacagaagcaaagatgttgctagataatatcaacacgccagaaggaataatccccgcgttattcgaaccagaacgagagaaatctgcagctatcgatggagaatatcgtttaagaggggaagcgcgaaaaacattcgttgaacttatgcgcagaggagatttaccagtatggctaagttataaggtagcatcagagggttttcaatatagtgatagaaggtggtgctttgacggagaacgcaataatcaagtacttgaggagaatatggacgtggaaatatggaccaaagaaggagaaagaaagaagttacgaccgaggtggttggacgcgaggacatatagtgatcccttggctctaagagagttcaaagaatttgcagctggtagaagaagcgtaagtggcgatttaatattagaaataggaaaactacctcagcaccttacgttacgagcccagaatgcactagataatttagtaatgttgcataatagtgaacaaggaggaaaagcgtaccgacatgcaatggaggaacttccagatacgattgaaacattaatgttattggcgctaattgctgtcctgacaggaggtgcaactttgttctttctctccgggaaagggttggggaaaaccagtataggcctactctgtgtcacagcctccagtgcactcctatggatggcatcggtagagccccactggatcgcggcgtctattatattagaatttttcctcatggtattacttataccggagcccgacagacaaagaaccccacaagacaaccaattggcatatgtagtaattggactacttttcatgattctaactgttgccgcaaacgaaatgggactgttagaaacgactaagaaagatttagggataggctacgtagccgccgaaaatcatcagcatgcaaccatgcttgacgtcgacttgagaccggcgagcgcctggactctttacgctgtagcaacgacagtcatcacccctatgatgagacatacaatagaaaacacgacagcgaacataagcctgacagccatagcgaatcaagcagcaatcttaatgggactcgataaaggatggccaataagcaaaatggatataggagttcctttattggcattaggatgttattcgcaagtgaatccacttacactaacagctgctgttctcatgctagtcgcccattatgcgattataggacccggactccaagctaaagccacgagagaggcacagaaaagaacggctgcggggattatgaaaaatccgacagttgatggaatagtggctatagatctcgatcctgttgtctacgatgccaagtttgaaaaacaattaggccaaattatgttgttaatactttgtacaagtcaaatacttctaatgcgaactacgtgggcattatgtgaatcaattacactagctactggccctctcactactctttgggaaggatcaccgggaaaattttggaatacaacaattgccgttagcatggcaaatatatttagaggttcgtacttagcgggtgcaggacttgcattctccctaatgaaatccctaggcggaggcaggcgggggacaggcgcacagggagagactttaggcgaaaaatggaagagacaattaaaccaactctcgaagtctgaatttaacacatataaaagatcaggcattatggaagtggaccgaagtgaagcaaaagaaggccttaaacgaggagaaaccacaaaacatgccgtatcgcgaggaactgcaaaattgcgatggtttgtggagagaaatttggtaaagccagaaggaaaagtcattgacttaggttgtggcagagggggatggtcttattactgcgcaggtctgaagaaagtaacagaagtcaaagggtacaccaagggtggaccgggacacgaggaaccaattccaatggccacgtatggatggaacctagtcaaacttcacagtggaaaagatgtgttctttatgccaccagaaaaatgtgataccctactttgcgacatcggagaatcttcgccaaatcctaccatagaagaaggacggacgctgcgagtattaaaaatggtagaaccatggctaaaaggtaatcaattctgcataaaaatattgaatccatatatgcccagcgttgtcgaaacgctagaacaaatgcaaaggaaacatgggggtatgctcgtcagaaatcccttatcaaggaactctacacacgaaatgtattgggtgtcgtgcggaactggcaacatagtttctgcagtcaacatgacgtcccgtatgttactaaatagatttacgatggctcatcgcaagcctacttatgagagagatgttgacctcggtgccggaactaggcatgtcgccgtagagccggaagttgcaaatttggacataataggacaacgcattgaaaatatcaaaaatgaacataagtcaacatggcattatgatgaggataacccgtacaaaacgtgggcataccatggatcctacgaagtaaaaccttcagggtctgcaagctctatggtcaatggtgtagtccgtttactgacaaagccatgggatgttatacctatggtcacccaaattgcaatgacagacacaaccccgttcggacaacaaagggtcttcaaggaaaaagttgacactcgaactccccgagccaaaagaggtactacgcaaattatggaagtaacggctaaatggttgtggggatttttgagtagaaacaagaaacccagaatttgtacaagagaggaatttactaggaaggttcggagtaatgcagcaatcggggctgtatttgttgatgagaaccagtggaactcagctaaagaggccgtagaagatgaacgcttttgggatctggttcacagagaaagagaactacataagcagggcaaatgcgctacttgcgtatacaatatgatgggtaaacgagagaagaaattaggagaatttggcaaagcaaaaggaagcagagcaatatggtatatgtggttaggagcgaggttcttagaatttgaggcattggggtttatgaacgaggatcattggtttagtagggaaaactccctttccggggttgaaggagaggggctacacaaactggggtacatcctacgtgatatcagcaaaatcccagggggaaacatgtacgcagatgacacggccgggtgggatacacgtatcacagaagatgatcttcaaaatgaggcaaagataactgatataatggaacctgaacatgcactactggcaactagcatcttcaaactcacatatcagaacaaagtagtcagggtacagcgtcccgccaaaaacggaactgtgatggacgtaatatcacgaagggatcaaagaggatccggtcaagttgggacatatggattaaacacttttactaatatggaagtgcaactaataagacaaatggagtcagagggaatattccttccgagtgaattagagacacccaatttggcagaaagagtactagactggttagagaagcacggagcggagaggttaaagaggatggcaatcagcggtgatgactgtgttgtgaaaccgatagatgatcgttttgcaaccgccttaacagctctgaatgacatgggaaaagtgagaaaggatattccacaatgggaaccttctaaggggtggaacgactggcaacaggttccattttgttcacatcactttcaccaattgattatgaaagatgggcgtgaaatagtcgtaccatgtcgtaatcaagatgaattagtaggcagagctagagtatcgcagggtgccggatggagcctcagagaaacagcctgcttaggaaaaagttatgcccagatgtggcaattgatgtattttcatcggagagatcttcggctagctgcaaatgctatttgttcagccgtgcctgtagactgggttcctacgtcacggaccacttggtcaatacatgcccatcatcaatggatgacgaccgaggatatgttatctgtctggaacagagtgtggattgaggaaaatccctggatggaagataaaactcatgtaagctcgtgggaggaagtaccatatctaggtaaaagagaagatcagtggtgtggaagcctaataggattgactgccagggcaacctgggctacaaacattcaggtagcaataaatcaagtgagacgactaataggcaatgaaaattatctagattacatgaccagtatgaagcgttttaaaaacgagtcagatccagaaggagcgctatggtaa

SEQ ID NO: 21145 - RNA, 9879 nt, synthetic construct
  misc_feature 1..9879: note = derived and/or modified CDS sequence (opt6) from DENV-1__GQ868563__SS-prME
  source 1..9879: mol_type = other RNA
tctgttacgatgttacttatgcttctaccgactgcattagcatttcacttaactactcgaggtggagaaccacacatgatagttagcaaacaagaacgtggaaaatctctacttttcaagactagcgcaggagttaacatgtgcacgctcattgccatggatcttggagaactatgtgaagatactatgacttacaaatgccctcgaatcacagaagcagaacccgatgacgttgattgctggtgtaatgccaccgacacatgggtaacatatggaacttgtagtcaaacgggagaacaccgtagagataaacgatcggttgctctggcgccccatgtgggtctgggacttgaaacacgtaccgaaacatggatgtcatcagaaggcgcttggaaacaaattcaaagagttgaaacgtgggcacttcgccacccaggctttactgtcatagcattatttttagcacatgcaattggaacttcaatcactcaaaagggaataatattcatattactcatgttagtcacgccgtctatggccatgagatgtgttggtataggaaacagagactttgtagaaggactcagcggagcaacatgggttgacgtcgtactcgaacacggaagctgcgtaactactatggcaaagaataagcccacactagatattgaactcttaaaaaccgaagtaacgaaccctgctgttctgcgaaagctgtgcatagaagccaaaataagtaacacaacgacagactccagatgtcctacacaaggagaagcgactttagttgaagaacaagacgcaaactttgtctgcagacgcacattcgtagatcgaggatggggcaatgggtgtggtctttttgggaaagggagtttattaacttgcgcaaaatttaaatgtgtcactaaactagaaggcaaaattgtacaatatgaaaatttgaaatatagtgtaattgttactgtccacacaggggatcaacaccaagtaggtaatgaaacgactgaacatggaaccatagctactattactccacaagcaccgacatcagagattcagttaactgattatggggcattaacacttgactgctcaccaagaacggggcttgactttaatgaaatggttctactaacaatgaaagagaaaagttggctagtacacaagcaatggtttctcgatctaccactaccgtggacctcaggagcatctacaagtcaagagacatggaatcgccaagatcttctcgtgaccttcaaaactgcacacgctaagaaacaagaggtggtagtcttggggtctcaagagggcgcaatgcatacagcactaactggagcgactgaaatccaaacttctggaactacaaccatttttgcaggtcatctaaaatgccgactgaaaatggataaactaacattaaagggcatgtcatacgtaatgtgcacaggatcatttaagctcgagaaagaggtagcggaaacacaacatggaaccgtattagtacaagtaaaatatgagggcacagacgcaccctgtaaaatacctttcagcacacaagatgagaaaggagtaacacaaaatggccggttaataaccgcaaacccaatagtaacagataaagagaaacctgttaatatagaaacggagccaccttttggagaatcttatattgtcgtaggagctggtgaaaaagcgttaaaactttcgtggtttaagaaaggcagcagcattggcaaaatgtttgaggctacagcaagaggagcaagaagaatggcaattttaggtgacacagcatgggatttcggcagtataggaggcgtcttcacctctgttggaaaacttgtgcatcaagtcttcgggactgcatatggggtgctgttttcaggcgtctcttggaccatgaaaatcggtataggtattctgctaacgtggcttgggcttaattcaagatctacgtcattgagcatgacctgtatcgcagtgggtatggtaacattgtacttaggagttatggtacaagccgactcaggttgcgtcatcaactggaagggacgagaattaaaatgtggttctggcatttttgttaccaacgaggtacatacatggaccgaacaatataaattccaggcggactcaccaaaacgtctatccgcagccatcggaaaagcgtgggaagaaggcgtatgcgggataagaagcgcgacaagattagagaacattatgtggaaacaaatatctaatgaattaaaccacatcttattggaaaacgatatgaaattcactgtcgttgtaggagatgccaatggaatattagcacaaggcaagaaaatgatcagacctcaaccaatggaacataaatatagttggaaatcatggggcaaggccaaaataataggcgcagatatccagaatgctacatttattattgacggtccagatacacccgagtgtcccgatggccaacgtgcttggaacatctgggaagtcgaagactatggctttggtatatttacaactaatatttggttaaaacttcgagatagttatacccagatgtgtgatcatagacttatgtcagctgccataaaggacagcaaagcggtgcatgcagacatgggctactggattgaatccgagaaaaacgaaacatggaaattggctagagcttctttcatcgaagtaaaaacatgcacctggccgaagtcacacactctatggagtaacggagtcttggaatcagaaatgataatacccaagatatatggtggacccatcagtcaacataattaccgacctggatactttacccaaacagccggcccctggcacttaggaaagctagaattagactttgatctatgcgagggaactacagtagttgttgatgaacactgtgggaatcggggacccagtcttcgaactacgacagtgacgggcaagattattcatgaatggtgctgtcgctcgtgtactcttcctcccctgagattccgaggtgaagatggatgctggtatggtatggaaatcagacccgtcaaagaaaaggaggaaaatttggtacgatcaatggtatcagcaggatccggagaagtggatagtttttcactgggtatactctgtgtttctataatgatagaagaagtaatgaggtcgagatggtcccgaaaaatgctcatgacaggaaccctcgccgtctttttattgttaataatgggtcaattaacatggaatgacttaacccgattatgtatcatggtaggcgctaatgcatcagacaggatgggaatgggtacaacatatttagcacttatggcaacttttaaaatgaggcccatgtttgctgttgggctattattcagacgtctaacatcacgagaagtactcctgcttacaataggattatcattagttgcatcagtagaattacctaatagcttagaggaacttggagacggattagctatgggtataatgatgcttaaacttctcacagaatttcaaccccaccaattatggacaactctcttatctctaacttttgtaaagacaacgttatctcttgattatgcatggaagacgaccgcaatggtattgtccatagttagcctgttccctctatgtttaagtacgaccagtcagaaaactacatggttaccggtcctgctgggctccttcgggtgtaagcctttaaccatgttcttaattaccgagaataaaatctggggacggaaaagttggccactaaacgagggcattatggccattggaatcgtgtcgattctgctgtcatccctacttaaaaatgacgtccctcttgcaggacctttgatagcgggagggatgctcatcgcatgttacgtcatttcagggtctagcgccgacttatcattggagaaagctgcagaggtatcttgggaacaagaagcagaacattcaggggcttcacataacattttagtcgaagtacaagatgatggcacaatgaaaattaaagacgaagaacgtgacgacacactaacaattttattaaaagccacgttgctggcagtctctggagtttacccgatgtcaattccggcaactctatttgtgtggtacttttggcaaaagaagaaacaaaggtctggagttttatgggatactccatctcccccagaagtcgaacgagctgtcctagatgatgggatatatcgtattttacaacggggcttgcttggtagatcacaagtaggagtaggggtctttcaggacggggtattccacaccatgtggcacgtaacgaggggagctgtattaatgtaccagggaaaacggcttgaaccgtcatgggcaagcgtcaaaaaggatctaatcagttatggagggggttggcggtttcagggcctctggaacaccggagaagaagttcaagttattgcagtcgaaccaggcaaaaatcctaagaatgttcaaaccacgccgggcacctttaaaacacccgaaggagaagtcggtgcgatagcattagattttaaaccaggaacaagcggatcaccaatagttaatagagagggaaaaatagtgggtctctatggtaacggagtggtgactacgtcaggtacatatgtctcagcaatagctcaagcaaaggcatctcaggaaggacccctcccagaaatagaagacgaagttttcaagaagagaaacctgacaattatggatttgcacccagggagtggcaagactaggcgatatttaccagctattgtcagagaagctattaaacgaaaactccggaccctaatactagccccaactcgagtagtagcaagtgagatggcggaagccctaaaaggaatgccaataagataccaaacaacggcagtaaaaagcgagcatacaggtcgagaaatagtcgatttaatgtgtcatgcgactttcactatgcgattattatctccggtcagagtcccaaattataacatgatcatcatggacgaagcgcattttactgatccggcctcgattgctgccaggggctacatatccactagggttggtatgggcgaagcagcagcaatctttatgactgcaacaccaccgggaagtgttgaagcatttccgcaaagcaatgcggtaatacaggatgaagaaagagacatacctgaaagatcatggaatagtggatacgattggataacagacttcccagggaaaacagtatggtttgtgccatcaattaaaagtgggaatgacatagctaactgcttgaggaagaatggtaaacgagtaatacaactaagtcgaaaaacatttgatacggaatatcagaaaactaagaataatgactgggactatgttgttactactgatatttcggaaatgggtgctaatttcagggcggaccgagtaatcgatccccgacggtgtttaaaacccgtaatcctcaaagatggtccagaaagggtcattttggcgggcccaatgccggtaacagtggcatcagctgcacaacgaagaggacgtattggcagaaatcagaacaaggagggtgatcaatacgtgtatatgggacagcctctcaataacgatgaggatcacgctcattggacagaggctaaaatgcttctcgacaacattaacactcctgagggaataatccccgctctctttgaaccagaaagggaaaaatccgcagctatagacggagagtatcgtttgcgaggcgaagcacgaaaaacattcgtagaacttatgagaagaggagatttacctgtctggctgtcttataaagtggcatcagagggcttccaatactcggaccgaaggtggtgtttcgacggagaaagaaacaaccaagtcttagaggaaaacatggacgtagaaatctggaccaaagagggggaaagaaagaaattacgacctagatggttagatgctaggacttattcagatcccctcgccttacgtgagttcaaagaatttgcagctggaagacgaagcgttagtggggacctaatccttgagataggtaaattaccacaacacctaacgcttcgtgcgcaaaacgctttagataacttagtgatgctacacaatagcgagcagggaggtaaagcatatcgacatgcaatggaagaattacccgatacaattgaaacattaatgttattggcgttaattgctgtgttaacgggaggggtaactctgttcttcctttcgggaaaaggtctaggaaaaacttcaataggactactatgtgtaacggcaagctctgccctgttatggatggcctcagtagaacctcattggattgcagcgtccattatattggagttctttctaatggtacttctaatcccagaaccagatagacaacgaacaccacaagataatcaattagcttatgtagtaattggattactatttatgattcttactgttgccgcaaatgaaatgggactcctcgagacgactaaaaaggatttaggcatcggatacgcggccgcggaaaaccaccaacacgctacaatgttagacgtcgatcttcgacccgcaagtgcatggacgttatatgccgtggctacaacggttataaccccaatgatgaggcatacgatagaaaacacaacagcaaatattagtctcaccgcaatcgcgaatcaagctgccatattaatgggattagataaaggatggcctataagtaaaatggatataggtgtgccccttttggccttaggctgctacagtcaagtcaatccgttgactctgactgcagcagtcctaatgttggtagctcactatgccattataggaccaggattacaagcgaaagcgacgagggaagcgcagaaaagaaccgcagctgggataatgaagaaccccactgtagatggaattgttgcaattgaccttgatcccgtggtatatgacgcaaagttcgaaaaacaactcgggcagattatgctactaatactgtgtacttcacaaatacttctaatgcgcacaacatgggctctctgcgagtcgattacactagctacaggacctctaactactttatgggaaggctctccggggaaattttggaacactacaatcgcggtgtctatggcgaatatttttagaggtagttacctggcaggggcaggcctcgcttttagtttaatgaaatcgctaggagggggacgacgaggaaccggcgctcagggtgaaacattaggagaaaaatggaaacggcaactaaatcagttgtcgaagtctgagttcaacacctataaacgcagcggtataatggaagtagatcgttcagaggccaaagagggattgaaacgaggtgagactacaaagcatgcggtaagtcgaggaacagcaaaactcagatggttcgttgagagaaacctcgtcaaacccgagggaaaagtaatagatcttggctgcggaagaggaggatggtcatactattgtgctggcctaaagaaggtaactgaggtgaagggatatacgaaagggggaccaggccatgaagaaccaatccctatggccacgtatggatggaaccttgtgaaattacatagcggcaaagatgtctttttcatgccgcctgaaaaatgcgacaccctcttatgcgatattggagaatcaagcccaaatccgacgatagaagagggaagaacccttagagtattgaaaatggttgaaccatggttgcgcggaaaccaattctgtatcaaaattctcaatccatatatgccctcagtagtagaaacactagaacaaatgcaacgaaaacatggtggtatgctcgtgagaaatccccttagtagaaatagcacacacgagatgtattgggttagctgtggaacaggaaatatcgttagtgccgtgaatatgacaagcagaatgctgctcaaccgctttacaatggctcaccgaaaacctacttacgagcgtgacgttgacctcggtgcgggaacgagacatgtcgcggtagaaccggaggtgccaaatcttgacattataggacagcgcatcgagaatattaaaaacgaacataaatcaacctggcattacgatgaggataatccatacaaaacctgggcttatcacggcagttatgaggtaaaaccttcaggtagtgcttcgtctatggttaacggagtcgtacgacttctaacgaagccatgggatgtgatccctatggtaacgcaaatagcaatgactgatacaactccatttggacaacaaagggtctttaaagagaaagtcgatactagaacccctcgagcaaaaaggggtaccacccaaattatggaagtaactgcaaaatggctctggggatttttatcgagaaacaagaaacctagaatttgcaccagggaagaatttacgcgaaaggtgaggtcaaatgcggcaataggagcagtattcgtagatgaaaaccagtggaatagtgctaaagaagccgtagaagacgaacgattctgggacttagtacatagggaacgtgagctgcacaagcaagggaaatgtgccacatgcgtatataatatgatgggtaaaagagagaagaaactaggtgaatttgggaaagcgaaaggtagtcgtgccatatggtatatgtggctaggtgcgagatttctagagtttgaagcactagggtttatgaatgaagatcactggttttcgcgtgaaaactcactgtctggagtggagggtgaaggtctccacaaactgggttacattctaagagacatatcaaaaattccaggcggaaatatgtacgctgacgatacggcaggttgggatacacggattactgaagatgatctacaaaacgaagcaaaaatcaccgatataatggaaccagaacacgctctactagcaacaagtatttttaaactgacgtaccagaacaaagttgtacgtgtacaaagacccgccaagaacggtacggttatggacgttatatcccgtagagatcagagaggttcaggtcaagttggaacatacggtttaaatacttttaccaacatggaggtacaactcattcgacaaatggaatcagaaggaatatttttgcccagcgaattggaaacaccaaatttagcagaaagggtacttgattggttagaaaaacatggcgcagagcgactaaaacgaatggcaatatctggagatgactgtgtagtgaaaccaattgacgacaggttcgctacagctctaacagccctgaatgatatgggaaaagtacgtaaagacataccacaatgggagccaagcaagggatggaatgattggcaacaagtcccattttgtagccatcatttccaccaactgataatgaaagacggccgggaaatcgtcgtaccttgcagaaatcaggatgaacttgtgggaagggctagggtttcacagggagctggatggagtttgagagaaacagcctgtctcggaaaatcttacgcccagatgtggcaactcatgtatttccatcgaagagatttgagattagcagcgaatgcaatttgttcagctgtccctgtagaatgggtacctacgtctcgtaccacctggagcatccatgcccatcatcagtggatgacaaccgaagatatgctcagtgtttggaatagagtttggatagaagagaatccttggatggaagacaaaacccatgtgtcgagctgggaagaagttccatatttaggtaaacgagaggatcaatggtgtggttctcttattggacttacggccagagcgacatgggcaactaatattcaagtagcaataaatcaagtccgtagactgataggtaacgagaattatctagactatatgacatctatgaaaagatttaagaatgaatcggacccggagggtgcactttggtaa

SEQ ID NO: 21146 - RNA, 9879 nt, synthetic construct
  misc_feature 1..9879: note = derived and/or modified CDS sequence (opt6) from DENV-1__GQ868564__SS-prME
  source 1..9879: mol_type = other RNA
tctgtaactatgttactaatgctattgcctacagcactagcgttccatttaactactcggggcggagaaccccatatgatagtgtcaaaacaagaacgaggaaaagcacttttattcaaaacaagtgcaggagtgaacatgtgtacgctcatagccatggatctgggcgaactttgtgaagatacaatgacatacaaatgtccgcgaatcacagaagccgaaccagacgatgtcgattgttggtgtaacgctacagacacgtgggtaacatacgggacttgtagccaaactggtgaacatcgacgagataaacgaagcgtcgcgttagctccgcacgttggtctaggacttgaaactcgaacagaaacctggatgagctcggaaggagcgtggaaacaaatccaacgtgtggaaacgtgggcgctccgtcatcctggatttaccgtaatagcattgtttttagcgcatgctatagggacgtccatcacccaaaaagggataatatttattttacttatgttagtcactccatccatggcaatgcgttgtgttgggattggaaacagagatttcgttgaaggtctatcaggtgcaacctgggtcgatgtagtactagaacatggatcttgtgtcacaactatggccaaaaacaaacccacgcttgatattgaattattgaaaacagaagtaaccaaccctgcagtcttgcgtaaattatgcatagaagccaaaatatcaaatacaacaacagattctcgatgtcctacacagggagaagcaacgctagtagaagaacaagatgcaaattttgtttgccgacgtacatttgtagataggggctggggaaatgggtgcggattatttggaaagggtagtttattaacttgcgcaaaattcaagtgtgtcacaaagctagaaggaaaaatcgtccaatacgaaaacctaaagtactctgtaattgtaaccgtacatactggggaccagcatcaagttggaaacgaaactactgaacatggtacaatcgcaaccattaccccacaagcgccgacttcagaaattcagttgaccgattacggagcactgacattagattgctcacctcgcaccggactagacttcaatgaaatggtgctactcaccatgaaagaaaagtcttggttggtccataaacagtggtttcttgatttgccgctgccatggacatctggagcatccacatctcaagagacatggaatcgccaagacctgttagtaacatttaagaccgctcatgcgaagaaacaggaagttgtagttttgggtagccaggaaggagcaatgcacacagcgttaacaggtgcgacagagatacagacgtctggtactacaacaatattcgcaggacatttgaaatgcagactaaagatggacaagttaacacttaaaggaatgtcatacgtaatgtgtacaggatcttttaaattggagaaagaagttgcggaaacgcaacatggaaccgttttagttcaagttaagtatgaggggacagacgcaccttgcaaaattccattcagtactcaagacgaaaaaggagttactcaaaacggaagactgataactgcaaatccgatagtaactgacaaagaaaagccagtaaatatagagaccgagcccccattcggtgaatcttacatagttgtaggcgcaggagaaaaagcactgaaactgtcatggtttaagaaaggttcaagtatcggtaaaatgttcgaagccacagcaagaggtgccagacgtatggcgatacttggagacactgcatgggattttggatctataggtggggtgtttacgtcggttggcaaattagtccaccaggtttttggtacagcctatggcgttctgtttagtggagtaagctggacaatgaaaatagggataggaatattgctcacatggttgggacttaactcacgatcaacaagtttgagcatgacatgcatcgcagttggaatggttaccttatatctgggggtaatggtacaagctgatagtggctgcgtaatcaattggaaaggacgagaactaaagtgcgggagcggcatatttgtaacaaatgaggtccacacatggacagagcaatataaatttcaggcagatagcccgaagcgtttatccgcagcaataggtaaagcgtgggaagaaggggtatgtgggatcaggtcggcgacaagacttgagaatataatgtggaaacaaatatctaatgagctaaatcacatacttttagaaaacgatatgaaatttacagtagtagtaggtgacgcgaatggaatattagcacagggcaagaaaatgattaggccgcaacctatggaacacaagtactcctggaaaagctggggaaaggccaaaatcattggagctgatatccaaaatactacgttcataatcgatggtcctgatacaccagagtgccctgatggccaaagggcttggaatatatgggaagttgaagactatggttttggaattttcactactaatatatggttaaaacttagagatagctatacacaaatgtgcgaccatcgcttaatgtcagcggcaattaaagatagtaaagcagtgcatgctgacatgggatactggatagaaagcgagaaaaatgaaacttggaaactagcacgcgcttcctttatagaagtgaaaacatgtacgtggccaaagtctcacacgttgtggagtaacggggtactggaaagcgaaatgataataccaaaaatatatgggggcccaatttcgcagcacaattatagaccgggctattttactcaaacagcaggaccctggcacctgggcaaactggaactagatttcgatttgtgtgagggcacgactgttgttgttgatgaacactgtggaaatagaggtccctcattgcgtacgaccacagttacgggtaagataattcatgagtggtgctgccgcagttgcactttacctccattgcgctttagaggcgaagacggctgctggtatggaatggaaataagaccagtgaaagagcgcgaagaaaatcttgtgcgatcaatggtatcggcaggaagtggagaagtcgactctttcagtcttggtatactatgcgtgagtataatgatagaagaagtcatgaggtccagatggtcaagaaagatgctaatgactgggacgttggcagtgttcttacttctaattatgggacaattgacatggaatgatttaacacgactatgcattatggttggcgcaaacgcatccgacagaatgggaatggggactacctacctcgcgttgatggcaacattcaaaatgcgccctatgtttgctgttggacttctatttcgtagattaaccagtagggaagtcctactcttaaccataggcttgagtcttgttgcatcagtagaattaccaaatagcttagaagagttgggcgatggactagctatgggcataatgatgctaaagctgttaacagagttccaaccgcaccaactatggactactttactcagtttaaccttcgtaaaaaccacactctcgttagattacgcctggaaaacaacagcaatggttttgtctatagtcagcttgtttcccttatgcttaagtacaacttcacagaaaacaacttggttaccagtgttgctcggcagttttggatgcaaaccactcactatgtttttaatcacggaaaataaaatatggggacgtaagtcttggccattgaatgaaggaatcatggcgatcggaatagtgtccattcttttgtcctcactcctgaaaaacgatgtcccactagccggaccacttattgctggagggatgttaattgcgtgttacgtgatttcaggatcaagcgcggatttatcattagagaaagctgcggaagttagttgggaacatgaagcagagcattcgggagcttcacacaatatcttagtggaagtccaagatgatggtacaatgaagatcaaagacgaagaacgagatgacacgctaacgattttattaaaagcagcactcttagctgtatcaggagtatatccgatgtccataccggcaacactatttgtttggtacttctggcagaagaagaaacaaagatccggagttctctgggataccccaagtccgccagaagttgaaagggccgtccttgatgatgggatttacagaatactacaacggggcttactaggcagatctcaagtaggtgtcggggtgtttcaagatggggtatttcatactatgtggcatgtaactcgcggtgccgttctaatgtaccaaggcaagagactagagccctcatgggcttcggtcaaaaaggacctaatatcgtatggaggtggatggagatttcaagggagttggaacactggcgaagaagttcaggtaatagcagtcgaacccggtaagaaccccaaaaatgtgcagactacaccaggaactttcaaaacaccagaaggtgaagtcggagctatcgcattagactttaagcccggtactagcggaagcccaattgtaaatcgagagggtaaaattgtcgggctgtacgggaatggagttgtaacgacatcaggtacttatgttagcgcaatagcacaagcaaaagcatcgcaagagggtccgttgccggaaatagaggacgaagtatttaagaaaaggaacctaactatcatggatttacatcctggcagtggtaagacgagacgatatcttccagcaattgtacgtgaagccataaaaaggaaactcagaacattaatactcgcgccaacgcgagtagttgcgagcgaaatggccgaagctctaaaaggaatgcctataagataccaaacaacggctgtcaaatcagagcacacaggaagggagatcgttgatttaatgtgccatgctaccttcacaatgcgactactaagtccagtacgagtgcctaactataatatgataattatggacgaagcacattttactgatcctgcatcgattgcagcacggggctatatatcaactcgagtcggtatgggagaggcagctgcaatattcatgaccgcaacaccacctggctctgtagaagcatttccacaatctaatgctgtcatacaggacgaagaacgagatattcccgaacgaagttggaacagcggatacgattggatcacagacttcccaggcaaaacagtatggtttgtgccatctattaaatcaggaaatgatattgcgaactgtttacgcaaaaatggaaaacgagtcatacagttgtccagaaaaacattcgacacggaatatcaaaagacaaagaataatgattgggattacgtagtaacaacagatatatcagagatgggagcaaattttcgtgccgacagagtcatagaccctcgacgttgcctaaaaccggtaatactgaaggatggtccagagagggtcatcttggctggacctatgccggtcactgtagcatctgccgctcaacgtaggggtagaattgggcggaatcaaaataaggaaggagaccaatacgtttatatggggcaaccactcaataacgatgaagatcatgcacattggacagaagcaaaaatgctattagataacataaacacgcctgagggtatcatacctgcgcttttcgaacctgaaagggaaaaatctgccgctattgacggagaatatagattaagaggtgaagcaagaaaaacgttcgtagaattaatgcgtcgaggtgatctacctgtctggctcagctacaaagtggcatccgaaggatttcaatattcagacagacgctggtgctttgacggcgaaagaaataatcaagtcctagaagaaaatatggatgtggaaatctggactaaagagggagaacgaaagaaattaagaccccggtggttggacgcaagaacgtactcagatccattagcgttaagagaatttaaagaatttgctgccgggagacgatcagtatctggcgacctcatactcgaaataggaaaactaccacagcaccttacactaagagcccaaaatgctcttgataacttagttatgcttcataactctgaacaagggggaaaagcgtacagacatgcgatggaagaactcccagatactatagagacactcatgttattggcattaatcgcagtactgacaggaggtgttacactatttttcttaagtggcaaaggattaggtaaaacaagtattggacttctctgcgtaactgcttcttcggcactattatggatggccagtgttgaaccgcattggattgctgcgtctattattctggagtttttcttgatggttcttctcataccagaacctgacagacaacgaacaccgcaagataatcaactagcttacgtagtaataggattactatttatgatactcaccgtagctgctaatgaaatgggcctattagaaactaccaagaaagaccttggcattggtcatgttgctgcagaaaatcatcaacatgcgactatgctagacgtagatctgagacctgctagcgcttggactctatatgcagtagcaacaaccgtcattaccccaatgatgcgtcacaccatagaaaacacgactgcaaacatttcccttacggctatagcgaatcaagcagctatactaatgggattagataaaggatggccaatttccaagatggatataggagtaccacttttagcattaggttgctacagtcaagttaaccctctaacgctcactgcagcagtattgatgttggttgcgcattacgccatcattgggcctgggttgcaagcaaaggcaacccgcgaagcgcagaaacgtacagcagctggaattatgaagaacccaactgttgatggaattgtcgcaatcgacctcgacccagttgtgtatgacgcgaaattcgagaaacagctcgggcaaataatgttgctcattttgtgtacgtctcaaatccttcttatgagaacaacatgggcgctatgtgaatcaataacattggctactggaccactaactactctctgggaagggtcaccaggaaagttctggaacaccactatagcagtaagtatggctaatatttttagaggatcctatctagccggtgctggactagctttttcattaatgaaaagccttgggggaggaaggagaggaacgggcgctcagggagaaacactgggagaaaagtggaaaagacagttaaaccaactgtctaaatcagagttcaatacatataaaaggtcagggataatggaagtagatagaagtgaagcgaaggaaggtcttaaaagaggggaaaccacgaaacatgcagttagccgcggtacagcaaaattaagatggttcgtagagcgaaacctagtcaaaccggaaggcaaggtaatagacctaggatgtggacgtggcggttggagctattactgcgcaggattgaagaaagtaactgaggtcaaaggatatacaaaagggggccctggacacgaagaaccgataccgatggcaacatatgggtggaacctagtaaaactgcattctggaaaagatgtgttcttcatgccccctgaaaaatgtgacacgctcttgtgcgatataggtgagtcatcaccaaatccgactatagaagaaggcagaactctgagagtattaaaaatggtagaaccttggttaagaggcaaccagttctgcataaaaattctgaatccttacatgccaagcgtcgttgagacgttagaacaaatgcagagaaaacacgggggaatgttggtaaggaacccattaagcaggaactcaacgcatgaaatgtattgggtatcatgcgggacaggaaacatcgtatctgcggtaaatatgacctctcgaatgctgctcaatagattcacaatggctcaccgtaaaccaacttacgagcgagacgtcgacctaggagccggtacacgacacgtggctgtcgaaccggaagtcgccaatcttgacattataggtcagaggattgaaaacatcaaaaacgaacacaagtcaacttggcactatgatgaagacaacccttacaaaacgtgggcatatcatggctcatacgaagtcaaaccgtcgggctccgcatcttcaatggttaacggagtcgtacgattactcacaaagccatgggatgttatcccaatggttacccaaatagccatgactgacacaacaccattcgggcaacaaagagtttttaaagaaaaagttgatacccgaactccaagagctaaaaggggaacaacacagataatggaagtgacagctaaatggctttggggtttcttaagtcgtaataagaaaccaagaatttgcacacgcgaagaatttaccaggaaagtgagatcgaatgccgccatcggagctgtattcgtcgatgagaaccaatggaactcagccaaagaggcagtagaagatgaaagattttgggatctagtacacagggaaagagagctacataaacaaggaaaatgtgctacctgcgtatacaatatgatgggaaaaagagagaagaaactaggtgagtttggaaaagcaaagggcagtcgtgccatttggtacatgtggttaggtgccagatttttagagttcgaagcactaggatttatgaacgaagatcactggttctctcgagaaaattcactttctggagtggaaggagagggtttacacaaattgggatatatattgcgagatatttctaagatcccagggggtaacatgtatgcggacgacaccgccggttgggatactcgcatcacagaagacgatttacaaaatgaggcgaaaataaccgatataatggagccagagcatgctctactagcgacaagtatttttaaattaacataccagaataaagtcgttcgcgtccagaggcctgcaaagaatggaacggtgatggacgttatttcaaggcgtgatcaacgtggatctggccaggtcgggacttacggtctgaacacattcactaatatggaggtacaactcatcagacaaatggaaagtgaaggcattttcctgccttcagagcttgagacgccaaatctcgccgaaagagtacttgattggttagaaaaacacggagcagaacgccttaaaagaatggctatatcgggggatgattgtgttgtaaaacctatagatgacagatttgccacagccctcacggcacttaacgatatgggcaaagtccgaaaggacatcccccaatgggaaccctccaaagggtggaatgactggcaacaagtgcccttttgcagtcatcacttccatcaacttataatgaaagatggtagggaaatagtagtcccctgtagaaaccaggacgagttagtaggcagagccagggtatcgcaaggagcagggtggagcttaagggaaactgcatgtttgggtaagagttacgcgcaaatgtggcagttgatgtattttcaccgcagagacctaaggctagccgcaaacgcaatatgtagcgcggtccctgtagagtgggtaccaacgagtaggacgacatggagtatacatgctcaccatcaatggatgacgacagaagatatgctttcagtctggaacagagtatggatagaagagaacccttggatggaggataaaacacatgttagtagctgggaagaagtaccatatcttggaaaaagagaagatcaatggtgcggaagtttgattggtttaacagccagagccacatgggcaacaaacatacaagtagccattaaccaagtaaggagattgattggtaacgaaaattatcttgattacatgacttctatgaaacggtttaaaaacgagtctgatccagaaggtgctttatggtag

SEQ ID NO: 21147 - RNA, 9879 nt, synthetic construct
  misc_feature 1..9879: note = derived and/or modified CDS sequence (opt6) from DENV-1__GQ868565__SS-prME
  source 1..9879: mol_type = other RNA
tctgtgaccatgttattaatgttacttccaacggcgctagcttttcatctaactacaagaggtggggaacctcacatgatcgtttcgaaacaagaaagaggaaagagcttgctctttaaaacgagcgccggtgttaatatgtgcacactcatagcaatggacctgggagaactttgtgaagacactatgacatataagtgcccacgaataaccgaagcagaaccagatgatgtagattgttggtgtaatgcgacagatacctgggtaacttacggtacctgctcacaaacgggtgagcatcgccgcgataaacgaagtgtagcgcttgcaccacacgtcggattgggattggaaactcgaaccgaaacttggatgagtagtgagggggcctggaaacaaatacaacgcgttgaaacttgggctttacggcacccgggctttactgttattgcactatttttagcacatgccataggtacttcaataacccaaaaggggataatatttatactacttatgcttgttacccccagcatggccatgcgttgtgtaggtataggaaaccgggattttgtcgaaggattatctggcgcgacgtgggtggacgtcgttctggaacatggaagttgtgtcactaccatggctaaaaataaacctaccttagatattgaattgttaaaaactgaagttaccaaccctgcagtattacgaaagctctgtatagaagctaagattagtaacacaacaactgacagccgatgtccaacccagggagaagctaccctcgtcgaagaacaagacgccaattttgtatgcagacggacgtttgtcgatagaggctggggaaacggatgcgggctattcggaaaagggagtctattgacatgcgcaaagttcaagtgtgtaactaagctagaaggtaaaatcgttcaatacgaaaacctaaaatactctgttatcgtcacggtacacacaggtgaccaacatcaagtgggaaatgaaacaaccgaacatggcactattgcgacaataactccacaagctccgacatcagaaatacaattgacggattacggtgcacttacgttggattgtagccctagaacaggactagatttcaatgaaatggtcttactcacaatgaaagaaaaatcttggttagtccacaagcaatggtttctggatctaccgcttccctggacatcaggcgcgtctacaagtcaagaaacctggaacagacaagatttattagtgacttttaagacagcccacgcaaagaagcaagaagtagtagtacttggatctcaagaaggtgccatgcacacagctctaactggagcaacagaaattcaaacatcaggaacgactactatatttgccggccatttaaaatgccgcctaaaaatggataaactaacactaaagggaatgagttacgttatgtgtaccggcagttttaagttggaaaaagaagtagctgaaacgcagcatggcactgtcctcgttcaagtcaaatacgaaggaacagatgcaccctgcaagataccatttagcactcaagacgaaaagggcgtaacacagaacggccgcctaattacagccaaccctattgtaacagacaaggaaaaaccagtcaacatagaaacggaacccccgttcggcgagagctacatcgtagtgggagccggtgaaaaagcgttaaaattatcgtggtttaaaaagggtagttccatcggtaagatgtttgaggctactgcgagaggagcgcgccgaatggcgattcttggcgatacagcgtgggattttggttccattggaggagtctttacttcagtcggaaaattggtacaccaggtttttggcacggcatatggtgtattattttcgggagtttcatggacaatgaaaataggaataggaatattgttgacgtggttaggactaaatagtcgatcgacatcgttatcaatgacatgtatagccgtaggtatggtcacgctctatcttggcgttatggtacaagccgattctggctgcgtcataaactggaaaggtcgtgaattaaagtgtggcagtggtatattcgtcactaacgaagttcatacatggaccgaacaatataaattccaggcagacagtcctaagcgtttatcggctgcaataggaaaagcgtgggaagagggtgtttgtggcattcgatcagctactcgattggaaaatataatgtggaaacagatatcaaatgaactgaaccacattttacttgagaatgacatgaaattcacggtagtggtcggtgatgcaaacggtatactggcgcaaggaaagaaaatgataagaccacaaccgatggaacataaatatagttggaaaagctggggtaaagccaaaataataggtgcagatattcaaaatgcaacttttataatagacggtccagatactcccgaatgtcccgacgggcaacgagcctggaatatctgggaagtagaagactacggatttggaatttttacaaccaatatctggctaaagttaagggattcatacacccagatgtgtgatcacagacttatgtccgccgcgattaaagatagtaaagcagtacatgctgacatgggctactggatagaaagcgagaaaaatgaaacctggaaattagccagagccagttttatcgaagtaaaaacttgtacgtggccaaaatcacacacactttggtccaatggtgtattggaatcagagatgataattccgaagatatatggaggtccaatttcccaacacaattaccggcctggttacttcactcaaacagcgggaccatggcatttgggaaaattagagttggacttcgacctctgtgaaggtacaacagtcgttgttgacgaacattgtggtaatcgaggacccagtctgcggacaactaccgtgaccgggaaaataatacatgaatggtgttgccgaagttgtacactgcctcctctgagattcaggggcgaagatgggtgctggtacggaatggaaataagacctgtaaaagaaaaagaagaaaatctggtaaggtctatggtttcggcggggtccggagaagtagactcattctcactaggaatactttgcgtaagcatcatgatcgaagaggtgatgcgaagtagatggagtcgaaaaatgttaatgacaggaacattagcagtatttttgcttcttattatgggtcaattgacgtggaatgatctaactcgactatgcataatggtcggagccaatgcttcagatcggatgggaatgggaacaacttatttagctctcatggcaacttttaaaatgaggccaatgttcgctgtaggactcttatttcgtaggctaacatctagagaggtgttactattaactattggtttatcattagttgcatctgtagagctacccaacagcttagaagaattaggagatggtttggctatgggcattatgatgttgaaactcctaaccgaatttcaacctcaccaactatggaccacactattaagtctaacttttgtaaaaactaccttaagtttggattatgcctggaaaaccacagcaatggtactatctatagtatctctgtttcctctttgtctaagcaccacatctcagaaaacaacctggttaccagtacttttaggatcgttcggttgtaaacctttaacgatgtttctaataactgaaaataagatttggggtagaaaatcatggccattaaatgaaggaatcatggccatagggattgtatcgatattgttatcatctttactcaagaacgacgtccctctggcgggtcctttgattgccggaggtatgctcatcgcatgttatgttataagtggatcatcggccgatctatctctagaaaaggctgccgaggtaagttgggaacaggaagcagaacacagcggagcttcccataacatactcgtggaagttcaagatgatggaactatgaaaatcaaggacgaggagagagatgatactttaacgatattactaaaagcaactttattagcggtgtctggggtttaccccatgtcaattcctgcaacattatttgtatggtatttttggcagaaaaagaaacaaagatcaggggttttatgggatacaccaagtccaccagaagtagagagggctgtcttagacgacggtatctacagaattttgcaacgaggattattgggacgcagtcaagtaggggttggggtatttcaagatggggtatttcacactatgtggcatgtcacgagaggagcagtgctaatgtatcaaggaaaacgacttgaaccatcatgggcatccgttaaaaaggacctaatttcatatgggggtgggtggcgctttcagggactgtggaacacgggggaagaagtgcaggttatcgctgttgaaccaggtaaaaaccctaaaaatgttcaaacaacgccaggtactttcaaaacccccgaaggcgaagttggcgcgatagcacttgattttaaaccgggtacaagcgggtccccaatagtcaaccgagaaggaaaaatagtggggttatacggtaatggcgtagtaactacgtcggggacatacgtatcagcgatagctcaggcaaaagcctcacaagaaggaccattgccagaaattgaggacgaagtgtttaagaaaagaaatttgactattatggatctgcacccaggtagtggaaaaacacgtcgctacctaccagcaatagtgagagaagcaattaaaagaaaactgagaacattaattttggcgcccacgcgagttgtggcatcagaaatggcagaagcattaaaagggatgccaatcaggtatcagacaacagcggtaaaatctgaacatactggtcgcgaaatcgtcgacctaatgtgccacgctacatttacaatgaggcttttatcccctgtacgagttccgaattataatatgataatcatggatgaagctcacttcaccgatcctgcttccatagctgccagaggctatatatcgacgagggttgggatgggagaagctgcggccatttttatgaccgcaacaccacctggtagtgtagaggcttttcctcaatcaaatgcggtgatacaggacgaggaacgcgacataccggaaaggagttggaactcaggttacgattggatcacagactttcccggcaaaacggtgtggtttgtcccgagtattaaatctgggaacgacattgcaaactgccttaggaaaaatggaaaacgggtgatacagcttagcaggaaaactttcgatacggaatatcaaaagaccaaaaataatgactgggattacgtagtaactaccgacatatcagagatgggcgcgaatttccgcgcggatagagtaatcgaccctcggcgctgtttaaagcctgtcatcttgaaagatggtccagaacgagtgatattagccggtccgatgccagttacagtagctagcgcagcacagaggcgtgggcgaattgggcgcaaccaaaacaaggaaggagatcaatatgtatatatgggacaaccattaaataacgatgaggaccatgctcactggacagaagctaaaatgcttcttgacaacataaatacacctgaaggaataatacccgcgttattcgagccggaacgtgaaaagtcagcagccatagacggagagtatcgcctacgtggagaggcgagaaagacctttgtcgagctaatgagacgcggcgacctcccagtctggctttcttacaaagttgctagcgaggggtttcaatattcagatcgcagatggtgttttgatggtgagcgaaacaatcaggttctcgaggaaaacatggatgtagaaatatggacaaaagaaggggagaggaagaaacttagacccagatggttggacgcaaggacctattcagacccgttagcattacgtgaatttaaggagttcgcagctggacgccgatctgtaagcggagatttaatcctcgagatcggtaaactgccacaacatctaacacttagggctcaaaacgcactagataatctagtaatgcttcacaattctgaacagggagggaaggcttacaggcatgctatggaagaattacccgataccattgagacgcttatgttattggcgctaatcgctgttctcactggaggcgtcaccctattctttctgtcagggaaaggattaggcaaaacctcaatagggctattatgtgtaactgcgagttcagccttgctgtggatggcgagtgtcgaacctcattggatcgcagcaagcatcatccttgaatttttcctaatggtattgttaattcccgaaccagaccgtcagcgtactccacaagacaaccagctagcatatgtcgtcataggtttattatttatgattttaaccgttgctgcgaatgaaatgggattactggaaactaccaagaaagatctaggaataggttatgctgctgctgaaaaccatcagcacgctacaatgctagatgtagacttgagacctgcatcagcgtggacactatacgcagtagcgacgactgtcataacaccgatgatgcgacatactattgaaaacaccacagcgaacatctcactgacagctatcgcaaatcaagccgctatcttgatgggattggacaaaggatggccaatatcaaaaatggatatcggagtaccgttattagcactaggatgttactctcaggtcaatccattaacactgactgcagcggtactgatgttagtagcccactatgcgattattggtcctgggctacaagctaaagcgactagggaggcacaaaaacgaaccgccgccggtattatgaagaatcctactgtagatggtatagtcgcaattgacctggatccggtggtatacgatgcaaaatttgaaaaacagctaggtcaaatcatgcttttgatactttgcacaagccaaattttactaatgcgtactacttgggcactctgcgaatccattacactagctacgggacccttaacaacactatgggaagggtcacctggtaagttttggaatactactatagcagtatcaatggcaaatatttttcgaggatcatatctcgctggggcaggattagcgtttagtttaatgaaaagccttggaggtggccgaagagggacgggagcgcaaggagagactttaggagaaaaatggaagagacaactaaatcaactatccaaaagcgaatttaatacgtataaaagatccggcatcatggaagttgaccgaagtgaggccaaagaaggtttaaaacgcggagaaacaacaaaacacgcagtatcgagaggtaccgcaaaactgcgatggtttgttgaacgaaatcttgtaaagcccgaagggaaagttatagacttgggttgcggacgaggaggctggagttactattgtgccggtctcaagaaagtcaccgaggtaaaaggctacacaaaaggtggcccaggacacgaagaaccgatcccaatggcgacttacggatggaatctagttaaactccatagtggtaaagatgtattctttatgccacctgaaaaatgtgatacattgctatgtgatataggtgaaagctccccaaatccaaccatagaagaaggaagaacgcttagagtattaaaaatggtggaaccatggctaagggggaatcaattttgcataaaaatcttaaacccttatatgccaagtgttgtagaaactttagaacaaatgcaacgtaaacacggaggaatgttggtgcgtaaccctttaagtcgaaattcaacacacgaaatgtattgggtttcatgcggcacgggtaacatagtttctgccgtaaacatgactagccgaatgctactgaatcgatttactatggcacatagaaaacctacatatgagagagacgttgacctaggcgcaggtactaggcatgttgcggttgaaccagaagtcgcaaatctcgatattattggccagaggatagaaaacattaagaatgagcataaatctacatggcattacgatgaggataatccatacaaaacatgggcttatcatggaagttatgaggtaaaaccgagtggaagcgcttcgtcgatggtcaatggagtcgtaagactccttaccaaaccgtgggatgtcatacccatggtaactcagattgcgatgacagacacaacgccctttggtcagcaaagagtatttaaagagaaagtagataccagaaccccgcgtgccaaaagaggaacaactcaaatcatggaggtaacagccaagtggctttgggggttcctgtctcgaaataagaaacctagaatttgcaccagggaagagttcacccgtaaggttagatcgaacgctgctataggagcagtcttcgttgatgagaaccaatggaactccgcaaaggaggctgtagaagatgaacgattctgggatctggttcatcgggaaagagaactccataaacaggggaagtgtgcaacttgtgtttataacatgatggggaagcgagaaaagaagttaggtgagttcggaaaggccaaaggaagtcgcgccatctggtacatgtggctgggtgcaaggtttctagagttcgaggcactgggatttatgaacgaagatcattggttttcacgggagaactcgctatctggagtggagggtgaaggtttgcataaattggggtacatactcagagacataagtaaaattccaggagggaatatgtatgctgatgatacggcaggatgggatactcgaattacggaagatgatttacaaaatgaggccaagattacagatatcatggaacctgaacacgccctgttagccaccagtatttttaaactgacatatcaaaacaaagtggtaagagtgcaaagacccgctaaaaacggaactgtcatggatgtaatatcgagaagagaccaacgaggatctggtcaagttggaacctatggtctaaataccttcacaaacatggaagttcaattaattagacaaatggaaagcgaaggaatttttctcccaagcgaattagagactcctaacttggcagaacgtgttctagactggctggaaaaacatggagcggagcgtttgaaacgaatggcaatctcaggagacgactgtgtggttaagccaatagacgatagatttgccactgctttgacagcgcttaacgacatggggaaagtgcgaaaagatattccacaatgggagccatccaaagggtggaatgactggcaacaagtaccattttgttctcaccattttcaccagttaataatgaaagatggacgtgaaatagtagtaccatgtcgaaatcaggatgaattagttgggagagcaagggtatcccaaggggctggttggagtcttagggagaccgcatgccttggcaaatcgtatgcacagatgtggcaactgatgtacttccataggcgcgatttgagacttgcagcaaacgccatttgtagtgcagtacctgtcgagtgggtacccacctcacggactacctggtcaatacatgcccatcatcagtggatgacaacagaagatatgctatcagtgtggaatagagtatggattgaggaaaacccctggatggaagacaaaactcatgtgagttcatgggaggaagtaccttatctaggaaagcgagaagatcaatggtgtggaagtctgattggattaaccgctcgagctacatgggcaaccaatatacaagttgcaataaatcaagttagaagactaattggtaatgagaattatttagattatatgacatcgatgaagagatttaagaatgaatcagatccagaaggtgctttgtggtga

SEQ ID NO: 21148 - RNA, 9879 nt, synthetic construct
  misc_feature 1..9879: note = derived and/or modified CDS sequence (opt6) from DENV-1__GQ868568__SS-prME
  source 1..9879: mol_type = other RNA
tccgtaactatgctattaatgctacttcccactgcacttgcattccacttaaccactagagggggagaaccacatatgatagttagtaaacaagaacgcggtaaaagtttattatttaaaacatcagccggtgtcaatatgtgtacgttgatagcaatggatctaggtgaactttgcgaagatactatgacttacaaatgccctagaatcactgaagctgaaccagacgacgtagactgctggtgtaacgctactgatacttgggtcacatatggcacttgttcacaaacaggcgaacatcgccgtgataaacgctcagtagcgcttgcaccccatgtcggcctaggattggaaactcgaaccgagacatggatgagttcagaaggggcatggaagcaaatacaaagggtagaaacttgggctttaagacatccaggctttacagtaatagcattatttttggcgcatgtgataggaacatcaattacacaaaaaggaataatatttatattacttatgttagtaactccatcaatggcaatgcggtgtgtaggcatagggaatagagatttcgtagaaggactaagtggagcgacatgggtagatgttgtcctagaacatggatcatgtgttactacgatggccaaaaataaaccgaccttagacatagaactcctaaaaacagaagtaacgaacccggcagttttacgtaaattgtgtatagaagcaaaaatatccaatacaacaaccgattctcgatgccccacacaaggagaagcgacgctggtcgaagaacaagacgcaaattttgtttgtcgacgaacgttcgttgatagggggtggggaaatgggtgtggactttttgggaaaggtagtttattaacgtgtgctaaatttaaatgtgtaacaaaattagaagggaaaattgtccaatacgaaaatttgaaatattcggtcatagttacagtgcatacgggggaccaacatcaagtggggaacgaaaccacagaacatggaacaatagctacaattacaccacaagcgccaacatcagaaatacaactaactgactacggggctttaactctagactgcagtccaaggacaggactagattttaatgaaatggtactacttaccatgaaagaaaaatcttggctagttcataaacaatggtttctggaccttccacttccttggacatcaggtgcatctacttcgcaagagacgtggaatcgccaagatctattagttacttttaaaaccgcacatgcaaagaaacaagaagtggtagtgctgggctcccaagagggtgctatgcataccgcacttactggagcaacagaaatacaaacatcaggtactaccaccattttcgcaggtcatctcaaatgccgattaaaaatggataagttaacactcaaaggaatgagttacgtgatgtgtaccggaagtttcaaattagaaaaagaagtcgcagaaacacaacatggtactgttttggttcaggttaaatatgagggaaccgatgcaccttgtaaaataccgttttctacacaggacgaaaaaggtgtgacacaaaacggcagactaataacagcgaatcctattgtaacagataaggaaaaacccgtcaatatcgaaaccgaaccaccatttggagaaagctatatagtagttggagcaggggaaaaagcattaaaactatcttggtttaagaaagggtcatccatcggaaaaatgttcgaagctaccgcacggggtgctcgcagaatggcgatcctaggagataccgcgtgggattttggctctattggtggtgtgttcacaagtgttggaaaattagtacatcaagtattcgggactgcatacggagttcttttcagcggtgtttcatggataatgaagatagggataggcattctgcttacttggctaggattaaattcacgaagtaccagcctaagcatgacgtgtattgctgtaggtatggtcactttatacttaggagtaatggtacaagcagactctgggtgtgtgataaactggaaagggcgagaattgaaatgcggatcaggcatttttgttacaaacgaagtccacacttggactgagcaatacaagtttcaagccgatagccctaaaagactatcagccgctattggtaaagcgtgggaagaaggggtgtgcgggatacgttcagccaccaggctagaaaatatcatgtggaaacaaataagtaacgaacttaatcacattctgttggagaacgatatgaagttcacagtagtagtcggggacgcgaatggtatccttgcacaaggtaaaaagatgattaggccccaacctatggaacacaagtacagctggaagagttggggaaaagcaaagattataggagctgatacacagaacacgacgttcattatcgacggcccagatacaccagaatgcccagatggacaaagagcatggaatatatgggaggtagaggattacggatttggaatattcacgacaaacatatggctaaaattacgagatagctacacacaaatgtgtgaccacagactaatgtcagcagcgatcaaggacagcaaggccgtccatgcagatatggggtattggatcgaaagtgagaaaaatgagacatggaaactcgctagagctagctttatcgaagtaaaaacttgcacatggccaaaatcacacactttatggagtaacggagtgctagagtcggaaatgattattcctaaaatatacggaggacctatcagtcagcacaattatcgccctggatattttactcaaacggcgggaccgtggcatttaggaaaattagaactagattttgatctatgcgagggcaccactgtcgttgtcgatgaacattgtggaaacaggggccccagcttaaggactaccacggtcacgggaaagatcatacatgaatggtgttgtcgatcatgtactttgcccccactaaggtttcgcggagaagacggttgctggtacggaatggaaatacgtccagtgaaagaaaaggaagagaatttagtaagatctatggtctcggccggaagcggcgaagtagattcgttttcactaggtatactgtgtgtatcaattatgatagaagaagtcatgcggtcgcgctggtcacggaaaatgttaatgaccggtactcttgcagtattccttttacttataatgggacaactaacatggaatgatcttacacgactatgcattatggttggtgcaaatgcttccgacagaatgggtatgggaacaacgtatttggctttgatggctaccttcaaaatgcgaccaatgttcgccgtgggcttattgtttagacgacttacgagtcgagaagttcttctattaactataggattaagtctagtagcgtcagtcgagctccctaacagcctagaagaattgggagatgggttagcaatggggataatgatgttaaagctacttaccgagtttcaaccacatcaactatggactacgctcctttcattaacgtttgtaaagaccacattgtcactagattacgcctggaagacaacagctatggttcttagtatagtgtcactgtttcccttatgcttgagtaccacgtcccagaaaacgacatggttacctgtcttactcgggtcatttggttgcaagcctttaacaatgtttttgataactgaaaataaaatctggggacgaaaaagttggcctttaaatgaaggtataatggccatcggaatcgttagcatattgttatcaagtctactcaaaaacgatgtacccttggcaggtcctttaatagccggtggaatgttaatagcatgctatgttatcagtgggtcatcagcagatctatccctcgagaaagcagctgaagtatcatgggaacaagaagctgagcactcgggagcatcacacaatatcctagtcgaagttcaggatgatggtacaatgaagataaaagatgaagaaagagacgataccctaactatactgcttaaggcaacactactagctgtatcgggagtatacccaatgtccattcccgccacattatttgtatggtatttctggcagaagaagaaacaacggagtggagtattatgggatactccttctccaccagaggttgaaagagctgtactagatgatggcatataccgcatattacaacgaggcctattaggaagatcccaagtaggagtcggagtatttcaagacggtgtctttcacacaatgtggcatgtaacgagaggagcagtgctaatgtatcaaggcaaacgattagaaccctcatgggcaagcgttaagaaagatctaatatcatatggagggggctggaggttccagggctcttggaatacgggagaagaagtccaggtaatagcagtcgaaccagggaagaatccgaaaaacgttcaaactaccccgggcacttttaaaaccccggagggcgaagtaggggcaatagccctcgactttaaacccgggacaagcggatcccctatagttaatagagaaggtaaaattgtaggcctttacggaaacggagtagttacaacgagtggcacttatgtgagtgcaattgctcaagcaaaagcatcacaggagggacctctcccagaaatagaagatgaagtattcaagaaaagaaatttgacaatcatggacctacaccccgggagtggaaaaacgaggcgttatttaccagctattgtccgagaagctattaaaagaaaattaagaacccttatactcgctcctacacgggtagtagccagcgaaatggccgaagcactgaaaggaatgccaatcagataccaaacaaccgctgttaagagcgaacacactggaagggaaattgtagacttaatgtgccatgctaccttcacgatgagattgttatcgccggtgagggtaccgaattataacatgataatcatggatgaagctcacttcactgaccccgcatcaatagcagcaaggggctatatctcaacaagagtaggcatgggcgaagcagcagctatctttatgacagcaacaccaccaggatccgtagaagcatttccccagtcaaatgcagttatccaagacgaagaacgcgatatacctgaaagatcttggaactcgggttatgactggattacagattttccaggaaaaactgtatggttcgttccatcgataaagtcgggcaatgacatagcgaattgcctccgaaagaacgggaaacgagtaatacaattgagcaggaaaacattcgacacagaatatcagaaaaccaaaaacaatgactgggattatgtagtcactacagacatatctgaaatgggcgctaactttagggctgatcgagttatagaccctagaagatgtcttaaaccagtcatactcaaagatgggccggaacgagttatccttgctgggcccatgcctgttacggtagcatcagcagcccaacgtcgagggagaattgggagaaatcaaaataaggagggtgatcaatacgtgtatatgggacaaccattaaataacgatgaggatcatgcacattggacggaagcgaaaatgctactagataacataaatacgccggagggtataataccggccttattcgaaccagaaagggaaaaatctgcagccgtagacggagaatatagactcagaggggaagcgcgaaagacttttgtagaattgatgcgccgaggcgatctgcctgtatggttgtcatataaagtcgcctccgaaggatttcaatattctgatcgcagatggtgttttgatggagaacggaacaatcaggtcctggaagaaaatatggatgtagaaatttggactaaggagggagaaaggaagaaacttagaccaagatggttggacgctcgtacatatagtgaccctctagcactacgcgaatttaaggagttcgctgccggtaggcgtagtgtaagcggtgatctcatcctagagataggtaagctcccccaacatttaacactaagagcacaaaacgcactcgataatcttgtaatgctgcataacagcgagcaaggcggaaaagcatatagacatgctatggaggagttacctgatacaatcgaaacgttaatgcttctggctctaattgctgtactgactggcggcgtcacactatttttcttaagcggtaaagggttgggtaagacttctataggattactgtgcgtgacagcatcctctgcacttctctggatggcatcagtagagccacattggattgccgctagtataatattagagttcttcctgatggtactattaataccggaaccggatcggcaaaggacaccacaagataaccaattggcatatgtcgtcataggtctattgtttatgattcttactgtagcagcaaatgaaatgggcctgctagagacaactaagaaagatctaggaatcggttatgtggcagcggaaaaccatcagcacgcgactatgctcgacgtagatctcaggccggctagcgcctggacattgtacgcagtggcaaccacggtaatcacacctatgatgcgtcatacaatcgaaaacacaacagctaacatttcattaactgctatagctaaccaggcagccatactaatgggattagacaaaggatggccaatttcaaaaatggacataggagttccactactagctttaggatgctacagccaagttaacccactaacactaaccgcggcagtactaatgctagttgcacactatgctataattggaccgggtttacaagcaaaagcaacgcgagaagctcaaaagagaacggctgccgggattatgaaaaatcctacagttgacggaattgtagcaattgacttagatcccgtagtctatgacgccaaatttgaaaagcaattaggacagattatgttattaatactgtgcaccagtcaaatattactaatgaggactacctgggctttatgcgaaagcataacgcttgcaacaggtccgttaaccaccctttgggagggtagtcctggaaagttctggaatacgactatagcagtatctatggccaacatatttcggggcagttatctggccggggccggtttggcattttctctgatgaagtctctaggtggcggtcggaggggaaccggcgctcaaggagaaacccttggcgagaaatggaaaagacaattaaaccagctatccaaatcagaatttaacacttataaacgttcaggcataatggaagtagatagaagcgaggcaaaagagggcttaaagagaggagagactacgaagcatgctgtctctcgtggtactgcgaaactaagatggtttgtagaaaggaatttagtaaaaccagaaggaaaagtaatagacttgggatgtggtcgtggaggttggagctattattgtgcaggactcaagaaagttacagaagtaaaggggtataccaaaggaggcccaggtcacgaggaaccgataccgatggcaacctatggatggaatctagtaaagctacattctggcaaggacgtcttctttatgcctccagaaaaatgtgatacattactttgcgatataggagaaagctcacctaacccaactatagaggaggggagaactctgcgtgttttgaaaatggtagaaccctggcttagaggaaatcagttctgtatcaaaatattaaatccctacatgccaagtgttgttgagacgctagaacaaatgcaaagaaaacatggcggtatgctagtaaggaatcctttaagtagaaactcgactcatgaaatgtactgggtatcttgtggtaccggcaacattgtcagtgccgttaacatgacctcacgtatgcttctcaatagattcacaatggcacatagaaaacccacttacgagagagatgtagatttgggtgcaggaactagacatgtggccgtagagccggaagtagcgaatctagacattattggacagagaatagaaaacatcaaaaacgaacataaaagtacgtggcattatgatgaagataacccttataagacatgggcttatcacggttcatatgaagtgaagccatcgggctcagcgtcatcaatggttaacggtgtggtgaggcttttgaccaaaccttgggacgtgatacctatggttacccaaatcgctatgacggacaccactcccttcggacaacaacgcgtttttaaagaaaaagtagacacacgaacaccacgagcgaagaggggaacaacgcagataatggaagttactgcaaagtggttgtggggcttcctaagtagaaataaaaagccaaggatatgcacccgggaagaatttacacgtaaagtaagatcaaatgcagcaataggagccgtcttcgtcgatgagaatcaatggaatagtgctaaggaggcagtcgaagacgaaagattttgggatttagtccaccgtgaacgtgaactccacaagcaggggaaatgcgcgacatgtgtatacaatatgatgggtaaaagagagaagaaactgggggagttcggcaaagcgaaaggttcaagagctatctggtacatgtggctcggtgctagatttttagaatttgaagctcttggcttcatgaatgaagaccattggttcagtagagaaaatagtttgagtggggtggaaggagaaggacttcataaattggggtatattctaagagatataagtaaaattcctggcggaaacatgtacgcagacgataccgcgggttgggacacgaggataaccgaagatgatttacaaaacgaagcgaaaataacagacataatggaacccgaacacgcgcttttagcgacaagcattttcaaattaacatatcagaataaagtggttagagtccagaggcccgccaaaaacggaacggtgatggatgtcatctcgaggagagaccaacgaggatctggccaagtaggtacatatggactcaacactttcacgaatatggaagtgcagctaataaggcagatggaatccgagggaatctttttaccatccgaattggaaacccctaatctcgccgaacgtgtactagattggctggaaaaacatggtgcggagagattaaaaagaatggcaatcagcggtgatgactgtgtagtaaagccaattgatgacagatttgccacagccttgaccgctctcaatgatatgggaaaagtaaggaaagatatccctcaatgggagccgagcaagggatggaacgattggcaacaagtacccttttgttcacaccacttccatcaattaataatgaaggatggcagagaaatagttgttccttgccgcaatcaagatgagctagtggggagagcgcgagtttcacaaggtgccggatggagtttgagagaaacagcatgcctggggaaatcatatgcccagatgtggcaactcatgtatttccacagacgtgatctcagactcgccgcaaacgccatatgtagcgcggtaccagtagaatgggtccctacaagtcgaactacatggtcgattcatgcacatcatcaatggatgactaccgaagatatgctatcggtctggaacagggtctggattgaagaaaacccatggatggaagataaaacgcatgtttcgagctgggaagaggtcccgtatctgggaaagcgagaagaccaatggtgtggaagcctaataggcctcacagcccgtgcaacttgggctactaatattcaggtcgcaattaatcaagttagacgactcataggaaacgaaaattacctagattatatgacaagtatgaaacggtttaagaacgaatctgacccggaaggagcgctttggtaa

SEQ ID NO: 21149 - RNA, 9879 nt, synthetic construct
  misc_feature 1..9879: note = derived and/or modified CDS sequence (opt6) from DENV-1__GQ868569__SS-prME
  source 1..9879: mol_type = other RNA
tccgtaacaatgctattaatgctactaccaacagctctagcatttcatttaacaaccagagggggagaaccacatatgattgtgtctaaacaagaaagaggcaaatctttactatttaaaacttcagcaggggtgaatatgtgtactctgatagcaatggacttaggtgaactctgtgaggatactatgacttacaaatgcccaagaataaccgaagctgaaccagatgacgtcgattgctggtgcaatgcaactgatacctgggtaacatatgggacctgtagccaaactggtgaacaccgccgagataaacgtagtgtagcactagcaccacatgtgggtttaggactagaaaccaggaccgagacttggatgtcttcagaaggagcatggaaacaaattcaaagagtagaaacatgggcactacgccaccctggctttactgttatagcgttatttctagctcatgctattggtacatcaattacccaaaaagggataatatttattctactaatgctcgtgacgccaagcatggcgatgagatgtgtgggtattggcaatagagattttgtcgaagggctcagcggggcgacctgggtggacgttgtgctagagcacggttcctgcgtaactactatggccaaaaataaaccaacactagacattgagctgttgaaaactgaggtagcaaatcccgctgtgttaagaaaactttgcattgaagcgaaaatttcgaacacaacaactgacagccgttgccctacacagggggaagctactctagtcgaagaacaggatgctaattttgtttgccgtcgtacgtttgttgacagaggatggggtaacggatgtggactatttggaaaagggagcctattgacctgcgcgaaatttaagtgcgtaactaaattagaagggaaaattgttcagtacgaaaatttaaaatattcggtaattgtaaccgttcatactggcgaccaacatcaggtgggcaacgaaactacagaacatggcacgattgctacgataacaccgcaagctcccacctctgagatacaactgacggattatggcgccttaacattagactgcagtccacgaactggcctagatttcaatgaaatggtcttattgactatgaaagaaaagtcctggttagtccataagcaatggtttctggatctacccttaccttggacatcaggagcaagcacttcccaagaaacatggaaccgacaggatctcctagtaacgtttaagacggctcacgccaagaaacaagaggtagtagtattaggaagtcaggaaggagcaatgcacacagctctgactggggcaaccgaaatacagacttctggtactacaactatatttgccggacatttgaaatgtaggttgaaaatggacaaattgacattaaaaggcatgagttatgtcatgtgtactggatcattcaagctagaaaaggaggtagcagaaactcaacatggtaccgtacttgtgcaagtaaagtacgaaggaacagatgcaccttgtaaaattcctttttctacacaagatgaaaaaggagtaacacaaaatggacggcttattactgcaaatccgattgttacagataaagagaaaccagtaaatatagaaacagaaccaccgttcggagaatcgtatatagttgtaggtgcgggagagaaggctctcaaattgagctggttcaagaaaggctcgagtataggcaaaatgtttgaggctactgcgcgtggagctcggaggatggcaatacttggtgacactgcctgggattttggcagcattggaggggtctttacaagtgtgggtaagctggtacatcaagtattcggtacagcttacggagttttatttagtggagtaagttggacaatgaaaataggaatagggatccttttaacttggttaggcttaaattcccgaagtactagcctgtcaatgacatgtatagcggtgggaatggttactctatatttaggggtaatggtacaagcagacagcgggtgtgtaataaactggaaaggaagagaactaaaatgcggcagtggaattttcgtaactaacgaagtgcatacatggacagaacaatacaagtttcaagcagactcacctaagaggttatcggcagccattggaaaagcatgggaagaaggcgtgtgtggaatacgcagtgcaactagattggaaaatattatgtggaaacaaattagtaatgaattaaaccatatactcctagagaacgatatgaaatttacagtcgtagtcggtgacgcaaacggtattttagctcaaggaaagaaaatgatacgtccccaacccatggaacataaatactcttggaagtcatggggaaaggctaagattattggagctgatatacaaaacgccacttttataatagacggcccggacacgccggaatgcccagatggacaaagagcttggaacatatgggaagtagaagactatggctttgggatattcacaaccaacatctggctcaagttacgagatagttatacacaaatgtgtgaccaccgattaatgagtgcggctataaaggattcgaaagcagttcacgctgatatggggtattggatagagtcggagaagaatgaaacatggaaattagcgagggccagtttcattgaggtgaaaacatgcacctggcctaaatctcacactctatggagcaacggagttcttgaaagcgaaatgattatacctaaaatatacggcggtccaataagccagcacaattataggccaggatattttacacagactgcaggcccgtggcatttaggtaaactggaacttgactttgatttatgcgagggaacaacagtcgtagtagatgaacattgtggtaacaggggcccgtctctgagaacaaccactgttaccggtaaaattatccacgaatggtgttgccgatcatgtactttacctccattaagatttcgaggagaggacggctgttggtatggaatggaaataagacccgtgaaagaaaaagaagaaaatctagtacgatctatggttagtgccggttctggtgaagtggattcgttctccctcggtattctatgcgtatctataatgatcgaagaagttatgagatcgcgctggagccgtaagatgttgatgacaggaaccctagcagtgttcctactattaatcatgggacaattgacctggaacgatttgactcgtctctgtattatggtaggggctaatgcaagcgatagaatgggaatgggaaccacctacctagcattaatggcaacatttaaaatgagaccaatgtttgctgtaggacttctgttcaggaggttaacaagtcgtgaagtgctgttactaacaataggcctaagtttagtggccagcgttgaattgcccaatagtttggaagaactaggagatggattagcaatgggcataatgatgcttaagctgcttacagagttccaacctcatcaattatggacgacccttttatcactaacgtttgttaaaacaaccctctcccttgactacgcctggaaaacaacggcgatggtgctatcaatagtatccttgttccctctttgcctttcaacgacctctcagaaaacaacatggcttccagtactacttggaagttttggctgcaagccattaaccatgttccttataaccgaaaataaaatttggggtagaaaatcctggccactaaacgaagggattatggcaataggcatcgtatctatccttttatcatcattattaaagaatgacgttccacttgcaggacccctcatcgctggtggtatgctaatagcatgctacgttataagcggaagtagtgccgatctatcgctagaaaaggcagcagaggtcagttgggaacaagaggctgaacatagcggcgcgagtcacaacatactggtagaagtacaagatgatggcactatgaaaataaaagatgaggaacgagacgataccttaacgatattactaaaagcaacactgctggcagtatcaggtgtttatcccatgagcatccctgctactctattcgtatggtatttttggcagaaaaagaaacaaagatccggagtattatgggataccccatcaccacccgaggtagagcgcgccgtcttagatgatggaatatatcggatactacaaagagggctacttgggcgctcacaagttggcgtgggtgttttccaggatggagtatttcatactatgtggcacgtaacacggggagccgtactcatgtatcaaggaaaaagactggagcccagctgggccagtgtcaagaaagacttaatttcgtatggcggcggatggagattccagggcttatggaacatgggcgaagaagtacaagtaattgcggtagagcctggcaaaaaccctaggaatgtccaaacaactccaggtacgttcaagactccagaaggagaagtaggtgcgatcgcattggattttaaaccgggcacttcaggaagcccgatagtaaatcgggaaggtaagatcgtgggattgtatgggaatggagtcgttaccacctcaggaacatacgtatcagcaatcgcacaagcaaaagcgagtcaggaagggccgctaccagaaatagaagacgaagttttcaagaaacgaaacttaactattatggaccttcatccaggctcgggtaaaaccaggagataccttcccgctatagttcgagaggctatcaaaagaaaacttcgaacactaattttggcaccaactcgtgttgtggcgagtgaaatggcagaagcacttaaaggaatgccgattcggtatcaaacaaccgcggtaaaatcggaacacacaggcagggaaatagtagatctaatgtgccatgccacattcactatgaggctactgtctccagtccgagtgccaaactataatatgataatcatggacgaagcgcactttactgacccagcctctatagctgccagaggatacataagcacacgagttgggatgggtgaagctgcagcaatatttatgacagccactcctcctggttccgtggaggcttttccacagagtaatgctgtaatacaagatgaagagagagatatacctgaaagatcttggaactcgggatatgactggattactgactttccaggaaagacggtatggttcgtaccttcaattaagagcgggaatgatatcgctaattgcctaaggaaaaatgggaaacgagttattcaattgagtcgcaagacgttcgatacagagtatcagaaaactaaaaataacgattgggattatgtcgttaccaccgatatatcagaaatgggtgccaatttcagggcagatagggtaatcgatccaagaagatgtttaaaaccagtcatattaaaggatggaccagaacgggtaatattagcaggtcccatgccagtgacagtagcttctgcagcccaacgtcgaggacgtatcggtcgtaatcaaaataaagaaggcgatcaatacgtttacatggggcaaccacttaataatgatgaagatcatgctcactggacagaagcaaaaatgctactagataatattaataccccagaaggaataatcccagcacttttcgaaccggagcgagagaaaagcgctgctattgatggtgagtaccgcttaagaggagaagcacgaaaaacatttgtagaacttatgagaaggggtgatctaccagtgtggctaagttacaaggttgcaagtgagggatttcaatattcagacagacgttggtgttttgatggagaacgaaacaaccaggttctagaggaaaatatggatgtcgaaatatggactaaagaaggagagaggaaaaagttacgccctaggtggttagacgctaggacgtactcggatccactagctcttagagagttcaaagagtttgcggccgggaggcgatctgtaagtggggacttaatattagaaattggcaaacttccgcagcatttaaccttgagggcgcaaaatgctttggacaatctagttatgttacataattcagaacaaggtggtaaagcctatcgacatgcaatggaagaattaccggacacaatcgaaaccttaatgctactagccctgattgcagtcttaacaggaggagttacactattctttttatccggaaaagggctgggtaaaacttcaattggacttttatgtgtaacggcaagctcagcattgctatggatggcgtctgtcgaaccacattggatagcagcatcaatcatattagaatttttcctaatggtactacttataccagaacctgatagacaacgtacaccacaagacaatcaattagcatacgtggtcatcgggttattatttatgatactcaccgtggcagccaatgaaatgggattgcttgagacgaccaagaaagaccttggtattggttacgcagctgctgaaaatcatcagcatgcaacaatgcttgatgttgatcttcgacccgcttcagcatggacattatatgcagttgcaacaactgttattacccccatgatgagacacacaatcgagaacacaaccgcaaatatcagcttaaccgcgatagccaatcaagcggcaatattaatggggctagacaaaggctggccaatatcaaagatggatataggagtccccttattagcccttggatgctacagtcaggtaaatccactgacattaactgcggctgtccttatgctggtcgcacattatgccattatcgggccgggacttcaagcgaaagcaactcgagaagcgcagaagcgtacagccgctggaataatgaaaaatccgaccgtggatggtatagtagctatagatcttgatccagtggtctatgacgcgaaatttgaaaaacaactagggcaaataatgctactcatattatgcacatcccaaatcctgctaatgcgtacaacctgggcgctatgtgaatcaattacactggcaacgggaccgctgaccactttgtgggagggaagtccgggtaaattttggaatacgacgattgctgtcagcatggcgaatatatttagaggcagttacttagccggagcagggttagcatttagcctaatgaaatcgctgggaggtggaaggagaggcacgggggctcagggcgaaacgttaggagaaaaatggaaaaggcaactaaaccaactgtcaaaatccgaatttaacacatacaaacgcagcgggataatggaagttgacagatcagaagcaaaagaaggactaaaacgcggagaaactaccaaacacgcagtttcaaggggtaccgcaaaacttaggtggtttgttgagcgcaacttggtaaaaccagagggaaaagttattgatttggggtgtgggcgtggtggatggtcttactattgcgcgggattgaagaaggtaaccgaagttaaaggttatacaaaaggagggccggggcatgaagaaccaattcctatggccacatatgggtggaacttagtaaagttacattctgggaaggatgtatttttcatgccgcctgaaaaatgtgataccttgttatgcgatataggtgagagctcacccaatccaactatagaagagggtcgcacgctcagagttcttaaaatggtagaaccctggttaagagggaaccagttctgcataaagatactgaacccatatatgccttccgtagtagaaacactagaacagatgcaaaggaaacacggtggaatgttagtgaggaatccgttaagtcgaaactctactcacgagatgtactgggtttcgtgtggaaccggaaacattgtaagcgcagtgaatatgaccagtcgtatgctattgaatagattcacaatggcgcacagaaaaccgacttatgagcgcgacgtagatctgggagcgggaacaagacatgtagccgtcgagccagaagtggcgaatctagacatcatcggacagcgtatagaaaacatcaaaaatgaacataagagtacatggcactacgacgaagataatccatataagacttgggcgtatcatgggtcatatgaagtaaaaccgagtggaagtgccagctccatggtcaatggagtcgtacggttacttacgaaaccatgggacgtcatcccaatggtaacacaaattgcaatgactgacacgactcctttcggtcagcaaagagtgtttaaagaaaaagtagatacgagaacccctagggcaaaaagggggactacgcaaatcatggaagtaacagctaagtggctgtggggatttttgtcacgcaataagaaacccagaatatgtacccgtgaggagttcacaagaaaagtaaggtcaaatgctgcaataggagccgttttcgttgatgaaaatcaatggaactccgccaaagaagctgtggaggatgaaagattttgggatctagtacacagggagagagaacttcataaacaaggtaaatgcgccacttgtgtttataacatgatgggaaaaagagagaaaaagttgggggagttcggcaaagctaagggaagccgagctatatggtacatgtggcttggagcacgttttcttgaatttgaagcgttaggtttcatgaacgaagatcattggtttagtagagagaatagtctatcgggagtagaaggtgaaggcttacacaaactaggttatattctaagagatatatcaaaaataccagggggcaatatgtacgcagatgatactgctggttgggatacccggataacagaagatgatctccagaacgaggcaaaaataacagatataatggaaccagaacatgcacttctggccacgtcaattttcaaattaacgtaccaaaataaagtggtacgggttcaacgacctgcgaaaaatggaaccgtaatggatgtcataagtcgacgtgatcaaaggggaagtggtcaagtaggtacatatgggctaaatacatttaccaatatggaggtccaattaatcagacagatggaatctgagggtatatttttaccatccgaacttgaaacaccaaatcttgccgaaagggtgctagactggctggagaaacacggagcggaaagactaaaaagaatggcaatatcaggtgatgattgtgtagtgaaacccatagatgataggttcgcgacggccctaaccgccctgaatgatatgggaaaagtgcgaaaggacataccgcaatgggaaccaagtaaaggatggaacgactggcagcaagttccattttgttcgcatcactttcaccaactaataatgaaagacggtagagaaatagtagttccgtgcagaaatcaagacgagctagtcggtagggctcgtgtgagtcagggcgcgggatggagcttgagagaaactgcatgtctgggaaagtcctatgctcaaatgtggcaactaatgtacttccaccgaagggatctccgcttagcagcgaatgcgatatgttctgcagtaccagtagagtgggtacctaccagtcggacgacgtggtcaatacacgcgcatcatcaatggatgaccacagaagatatgctatccgtttggaatagagtatggatagaagaaaacccgtggatggaagacaaaactcacgtatcttcatgggaagaagtcccatacttgggcaaacgcgaggaccaatggtgtggtagtttaataggcttaacagctagggcaacatgggcaacaaacatacaagtggcaataaaccaagtcagacggctcataggaaatgagaactatttagattatatgacatctatgaagagatttaaaaacgagagcgatccagaaggagccttatggtaa

SEQ ID NO: 21150 - RNA, 9879 nt, synthetic construct
  misc_feature 1..9879: note = derived and/or modified CDS sequence (opt6) from DENV-1__GQ868570__SS-prME
  source 1..9879: mol_type = other RNA
tctgtgacaatgttattaatgcttctgccaacagcattagcatttcacctaacaaccagaggtggagaaccacatatgatagtgtcaaaacaagaaagaggaaaatcattattatttaaaacgtccgcgggagtcaatatgtgcactttaatagcaatggatttaggagaactttgtgaagataccatgacatataaatgtccacgaataaccgaagcggaaccggacgatgtggactgttggtgtaacgccaccgatacatgggtcacttacggaacctgtagtcagacaggggaacatagacgagacaaaagatcggtcgctttagccccacatgtcggtttaggattggaaacacgaacagaaacatggatgagtagtgaaggggcatggaaacaaatacaaagggtcgaaacatgggccttgcggcacccgggttttacagtaatcgcactctttctcgctcatgcgattggaactagcattacacaaaaaggtataatttttattttattgatgttagtaacgccaagcatggctatgagatgtgtagggataggtaatcgagattttgtagaaggactttcaggggcaacgtgggtagatgtagttctagaacatggaagttgcgtaacgactatggccaaaaataaaccaacgctagatatagaattacttaaaacagaagtaacaaaccctgctgtacttcgtaaactatgtatcgaagccaaaataagtaatactacaactgattccagatgtccgacacaaggtgaagcaacactggtagaagaacaagacgccaatttcgtatgcagacgaacttttgtagatcgaggctggggtaacggatgcggcttattcggaaaaggtagtttactaacttgtgctaaattcaaatgtgtaacaaaactagaaggaaagatagtccaatacgaaaacctaaagtactcggttatagtgactgttcataccggagatcaacatcaagtgggtaatgagactaccgagcatggcacaatagcaacaatcacaccacaagcacctacaagtgagatacaactaaccgactatggtgctctaacgttagactgcagtcctagaacaggacttgactttaatgaaatggtactacttaccatgaaggaaaaatcttggcttgtacataagcagtggtttttagacctgcctctaccttggacatcaggggcatcaacttctcaggaaacatggaacagacaggacctccttgtaacgtttaaaactgcgcacgctaagaaacaagaagttgttgtactagggagccaggagggcgctatgcatactgcattgactggtgctaccgaaatacagacatctggcacgacgactatctttgctggccaccttaaatgtagattaaaaatggataaattgaccctaaaaggtatgtcctacgtcatgtgcaccggttcgtttaaattagaaaaagaagtcgcagagacgcaacatggcacggtattagtacaagtaaaatacgaaggtactgatgcgccgtgtaaaataccgttttctacacaagatgagaaaggtgtcacgcaaaatggaagattgatcacagcaaacccaatagtaacagacaaagagaaacctgtaaatattgaaacagagccgccattcggggagagttatattgtcgtcggcgccggtgagaaggcccttaaactatcatggtttaagaaaggttcaagtatcggaaaaatgttcgaggctacagcacgtggggcccgccgaatggctattctgggagatactgcatgggatttcggatctattggaggggtatttacatcagtaggaaaacttgttcatcaagttttcggtactgcatatggtgtattattttctggggtaagctggactatgaaagtgggaatcgggattctgcttacttggcttggattaaattcacgaagtacctcgctaagcatgacatgtatagcagtagggatggtaactttgtatcttggggtaatggtacaagcggaccttggatgcgtcattaattggaaaggaagggagctcaaatgcggtagtggtatatttgttaccaacgaggtgcatacgtggactgagcaatacaaattccaagctgacagtccgaaacggctatctgcagcgatcggtaaagcatgggaagaaggggtatgcggcataagatcagtaacaaggttagagaacataatgtggaaacagataagtaatgaattgaaccatatcttactcgaaaacgacatgaagttcactgtggtagtgggagatgcgaacggtattctagcacaagggaagaaaatgataaggccccaacctatggaacacaaatactcatggaaatcatggggaaaagccaaaataatcggcgctgatacccaaaacacaacttttataattgacggaccagacaccccggaatgccccgacggacaaagagcttggaatatatgggaagtagaagactacggtttcggcatatttacaacaaacatatggttaaaattacgagattcatatactcagatgtgcgaccacaggttaatgtcggcggctattaaagattctaaagcagtacacgctgatatgggttattggattgaatctgagaaaaatgaaacatggaaactggcaagagctagcttcatagaggtcaaaacatgtacttggccaaaatctcatacgctatggtcgaatggagtattagaatcagaaatgatcatcccaaagatctatggtgggccgataagccaacacaactacagaccagggtactttacacaaacggcaggaccctggcatctggggaaactggaattagacttcgatctatgtgaaggcactactgtggtagttgatgagcattgtggaaataggggaccatcgttaaggactacgacggtaacaggaaagatcatacatgagtggtgttgccgatcctgcactttgccacccttgaggttccgtggagaagatggctgttggtatggtatggaaattcgtccagtaaaagaaaaagaagaaaaccttgtaagatctatggtaagcgccggttcaggtgaagtagactcgttttcactgggtatattatgtgtatcaataatgattgaagaggtaatgagatcacgatggtcccggaagatgctcatgacaggtacgttagcggtttttctattactaataatgggtcaattaacttggaacgacttaatacgactgtgcataatggttggagccaacgcatccgatagaatgggcatgggcacaacatatctcgctctgatggcaaccttcaaaatgagacctatgtttgcagttgggttgctatttagaagattgacatcacgagaagtattacttttaaccataggactctcattggtagcatcagttgaacttccaaattcattagaggaacttggcgacgggctagctatgggcatcatgatgcttaaattattgactgaatttcaaccccaccaattatggacaaccttactaagtctcacttttgtgaaaactacgctaagtctagattacgcgtggaagaccactgcaatggtactatcgattgtcagcttattcccattgtgtttaagtaccacaagtcaaaagacaacctggctcccagtactattaggcagctttgggtgcaaaccgcttacaatgtttttaataactgagaacaaaatatgggggcgtaagtcatggcctctaaacgagggaattatggcgataggcatagtgagtattctactcagttcgttattgaaaaacgacgtgccactagctggcccccttatagcaggaggaatgcttatcgcctgttacgtaattagtggcagttctgcagacctatcactcgaaaaagctgcagaagtttcttgggaacaagaggcagagcattcgggagcctcacataatatcttggttgaagtacaagatgacggtacgatgaaaatcaaagacgaagaacgagatgataccctcaccattttattgaaagctacccttctagcagtttccggcgtatatccaatgtcaataccggccacgctgtttgtttggtacttttggcagaagaagaaacaaagaagtggggtattgtgggataccccatctccaccagaggtggaacgagctgttctcgatgatggaatataccgaatcttacaacgtggtctacttgggagaagtcaggtaggagtcggagtgttccaagatggggtctttcatactatgtggcatgtcacgagaggagctgtgcttatgtaccagggtaaacgtcttgaacctagctgggccagtgtaaagaaggacctgatttcttacggtggaggctggagatttcaagggtcttggaacactggagaagaagtgcaagtaattgctgtggagccaggcaaaaatcccaaaaacgtccagactacacctggtaccttcaaaaccccagagggagaagttggagcaatcgcactagattttaagccaggtacttccggctcacccatagtaaatcgagaaggaaagatagtcggattatatggaaacggcgtggttactacgtctggaacatatgtgagtgctatcgcacaagctaaggcttcacaagaaggaccattgccagagatagaagatgaagtattcaagaaacgtaacctcacaatcatggacctacatccagggagtggcaagactagaagatatttaccagctatagttagagaagccattaaacgaaaattacgaacactaattctagctccaacaagagtagttgcctctgaaatggcagaggctctaaaaggtatgccaatacgctatcaaacaactgccgtcaaatcagaacatactgggcgagaaattgtagaccttatgtgtcacgcaacttttacgatgagacttctaagtcccgttagagtacccaactataatatgataatcatggatgaagctcattttaccgaccctgcctctatcgcagcacgcggatatatctcaacacgcgtgggtatgggtgaagcggctgcaatattcatgacagcaactcctccaggctcagtagaggcttttcctcaaagtaatgccgttatacaggatgaggagagagatatacctgaacgttcctggaactcaggttacgactggatcaccgactttccgggtaaaacagtatggtttgttcccagtataaaatctggtaacgatattgcgaattgtttaaggaaaaatggaaagagagtcatccagttatctagaaaaactttcgatacggaataccaaaagactaaaaacaatgattgggattatgtcgtgacaactgatattagtgaaatgggcgctaacttccgagccgacagagtgatagatcctcgtagatgcctaaaaccggtcatattgaaagatggccctgaacgcgttatattggctggaccaatgccagttacagtagcaagcgcggctcagagaagaggaaggatagggcgtaatcaaaataaggaaggggatcaatatgtatatatggggcaacctcttaataatgacgaagatcatgctcactggactgaggctaaaatgctactagacaacataaatacgccagaagggataataccagcattatttgaaccggaaagagagaaatctgctgcgatcgacggagaatatcgccttagaggggaggcacgcaaaacttttgtagaacttatgagacgaggagacctacccgtatggcttagttataaagtcgcctctgagggttttcagtatagtgatcgaagatggtgttttgacggcgagagaaataatcaagtacttgaagaaaacatggatgtggaaatttggactaaagaaggtgaacggaaaaagctcagacctagatggcttgacgcacgtacctattccgaccccctcgctttaagggaatttaaagaatttgcagctggccggcggtcagtgtctggagacctaatattggaaattgggaagctaccgcagcatctaacattgagagctcagaatgctttagacaatctagtaatgcttcacaatagcgaacaagggggaaaagcctatagacacgctatggaggagctcccagatactattgagactctgatgctgttagctctaatagcggtccttaccggaggggtcactttattctttttatcagggaaaggcttaggcaaaacctcaataggactgctatgtgtaacagcgagctccgcactactctggatggcatctgtggagccacattggatagcagcaagcattatattggaatttttcttaatggttttactaatccctgaaccagataaacagagaactccccaggataatcaactagcttacgtagtaattggacttctatttatgattttagcggttgcggcgaacgaaatgggtctactagaaaccaccaagaaagatcttggcattggttacgtggcaacagaaaatcatcaacacgcaacaatgcttgatgtagacttgcgaccagcaagtgcgtggacactttatgcggttgcaacaacagtaattaccccaatgatgcgtcacaccatagaaaatactactgcgaacatatccctaaccgctatagcgaatcaagctgcaatcttaatgggtctagataaaggatggccgatcagtaaaatggacatcggtgtacctttgttagctctaggatgctactcacaggttaaccctcttacacttacagcagcagtactaatgctagtggctcactacgccataattggtccaggattacaagcaaaagctacacgagaagctcaaaagagaacggccgcaggcattatgaaaaatccaaccgtagacggaatcgtcgcgatagaccttgatccagtagtatatgacgctaagtttgaaaagcaattaggacaaatcatgctgctaattttatgcacgagtcagatattattaatgagaacaacttgggcactctgcgaaagtataacgttagctacaggaccattgacgaccctttgggaaggttctccgggcaaattttggaatacaacaattgcagtatccatggcaaacattttcagaggttcctatttagccggtgcaggtctagcgttctcgctaatgaaatcgttgggtggaggacggagagggactggtgctcagggagaaacattgggtgagaagtggaaacgccagctaaatcagctatcaaaatctgaatttaatatatataaacgttcaggaattatggaagttgaccgatccgaagcgaaggaaggtttaaaaaggggagaaacgacaaagcatgcagtgagtaggggtacagcgaaactacgttggtttgtagagaggaatctagtaaaaccggaaggtaaagtaattgatctaggatgtggacgcggagggtggagctactattgcgcaggactaaagaaagtaaccgaagtaaaaggttatacaaaaggtggccctggccacgaagaaccaatcccaatggcaacatatggctggaacttagttaaactgcatagtggtaaagatgtgtttttcatgcctcctgagaaatgtgatactttgctgtgtgatatcggggaaagtagtccgaatcccaccattgaggagggaaggacactcagagtgttaaaaatggtagaaccgtggctgcgaggaaaccaattctgcataaagattctgaatccttacatgccttccgtcgtagaaactttggagcaaatgcagcgtaagcatggaggaatgttagtaagaaatccattatcgcggaatagtactcacgagatgtactgggtcagttgtggcaccggcaacattgtatccgcggttaacatgacgagccgaatgttactaaacagatttactatggcacataggaagcccacctacgaacgcgatgtggacttaggcgctggaacgcgacatgtcgcggtcgaacccgaggttgctaatctagacattattggtcagagaattgaaaatatcaaaaatgaacataaatccacttggcattacgatgaagacaacccctacaagacctgggcataccatggttcatatgaggttaaaccttccggatcagcaagttccatggttaacggagtggtccgtttgcttaccaagccatgggatgtaatacctatggttactcaaatcgcaatgactgacaccacacctttcggacagcaacgcgtctttaaggagaaagttgacaccagaacgcctagagcaaaacgagggacaacacaaataatggaagttacggctaaatggctctggggatttttaagcaggaataaaaagccaagaatctgcactagagaagaatttactagaaaagtaaggtcgaatgcagcgataggagcagtttttgtcgatgaaaaccaatggaacagtgcaaaagaagctgtagaagatgaacggttttgggatttggtacatagagaaagagaattacacaaacagggaaaatgcgcaacttgtgtttataatatgatgggcaagcgcgagaagaaattgggtgaatttgggaaagcaaaaggctcgcgggcaatctggtatatgtggctgggggcgcgatttcttgaatttgaggctttaggattcatgaacgaggaccattggttctctagggaaaattcactctcgggggtcgaaggagaaggacttcataaactcggttatattctgcgggacatatcaaaaataccaggcggtaatatgtatgctgacgatacagccggatgggatacaagaataactgaagatgatttacaaaacgaagccaagataaccgatataatggaacctgaacacgcactattagctacgtctatcttcaaactcacatatcaaaataaagttgtacgagtacagcgtcccgccaaaaatggcacagtcatggacgttatttcccgacgtgaccaacgagggagtgggcaggtaggtacatatggtctcaatactttcaccaacatggaggtacaactgataagacaaatggaatcagaaggaattttcctacctagcgaactagaaacaccgaatttggcagaaagagtcctggattggttggaaaaacatggtgctgagagattgaaaaggatggcaatatctggagacgattgtgtcgttaaaccaatcgatgaccgatttgcggcagcgctgaccgccctgaatgatatgggcaaagtaagaaaagacatcccacaatgggaaccctctaaaggatggaacgattggcaacaggtcccattttgttcccatcattttcatcaacttataatgaaagatggtagagaaattgtagtgccgtgccggaaccaggacgagctagtagggcgtgcaagagtatcacaaggcgccggctggtcattaagagaaacggcatgtttagggaaatcatatgcacagatgtggcagctaatgtattttcatcgtcgagacctacgattagccgcaaatgcaatatgcagtgctgttccagttgattgggttccaacttcaagaaccacatggtctatacatgctcaccatcaatggatgactactgaagatatgcttagcgtatggaatcgagtgtggattgaggaaaatccgtggatggaagataaaacgcatgtcagttcatgggaagaagtaccatacttgggtaaacgagaagatcaatggtgtggctctttaatcggtttaactgcaagagccacatgggccactaatatacaagttgcgataaaccaagtgaggagattgatcggtaatgaaaactacctagactatatgacatcaatgaaacgattcaaaaacgaatccgatcctgagggggcattatggtag

SEQ ID NO: 21151 - RNA, 9879 nt, synthetic construct
  misc_feature 1..9879: note = derived and/or modified CDS sequence (opt6) from DENV-1__KJ189302__SS-prME
  source 1..9879: mol_type = other RNA
tcggttacgatgttattaatgctgcttccaactgcactcgcttttcacctaactactagagggggcgaaccgcacatgatagtgtcaaaacaagaacgtggcaaatcattgctttttaaaacaagtgctggcgtaaacatgtgtaccctaattgctatggaccttggggaattatgtgaagatacaatgacttataaatgtccacggattactgaagccgaaccagatgacgtagattgctggtgtaatgcgacggacacatgggtcacttatggaacatgttctcaaacaggagagcacaggcgagataaaaggtcagtagcgttagcgccgcacgtcggactcggcttagaaacgcggacagaaacttggatgagttcagaaggagcctggaaacaaatacaaagggtcgagacatgggccttgagacatccaggttttacagtgatagcattctttcttgcccatgcaataggaacaagcattacccaaaaaggaataatattcattcttctaatgctagttactcctagtatggcaatgcggtgtgtgggtataggaaatagggactttgtggaaggactatccggagcaacatgggttgatgtagtccttgaacatggttcttgtgtaactacaatggctaaaaacaaacctacattggatattgaactcctgaaaacagaagtcacaaatcctgcggttctgaggaaactatgtattgaggcaaaaatatcaaacacaacgacagattctagatgcccgacccaaggtgaagcaacgctcgtagaggaacaagacgcaaattttgtctgccggcgaacattcgtagatagaggctggggaaacggttgcggattgttcgggaaaggatcactactgacatgtgcaaaatttaaatgcgtaacaaaacttgagggcaaaatagtacaatatgaaaatcttaaatactcggtaatagtaacagtacatacgggtgatcagcatcaggtcggaaacgagacaacagaacatggaacaatcgcaacaatcaccccacaagcgcctacaagtgagattcaactcacagattatggagccttgactttagattgtagcccaagaacaggtttagatttcaacgaaatggttttactaacaatgaaagaaaagagttggttagtacataagcaatggtttcttgatttgcctctaccatggaccagtggagctagtacaagccaagaaacatggaaccggcaagatctgcttgttacattcaagaccgctcacgcgaagaaacaagaagtcgtggtacttggatcccaagagggggccatgcataccgctctaacgggcgcaacagagatccagacttcggggaccacaactatatttgcgggacatctcaaatgtcgtctaaaaatggataaattgacattaaaaggaatgtcatacgtaatgtgtacgggttcctttaaactagaaaaggaagtagctgaaactcaacatgggactgttctagtacaggtaaagtatgaggggacggatgcaccgtgcaagataccattctcaacacaagacgaaaaaggagtaacacaaaatggtaggctaataacagcaaatccaatagtgaccgacaaagaaaaacccgtaaatatcgaaacagaaccgccctttggtgaaagctatatcgtagtaggagctggtgaaaaggctctcaaactatcttggttcaagaagggaagtagtataggaaaaatgtttgaagcgaccgcccgaggagcacgacgcatggctatacttggtgacacagcctgggattttggcagtatcggaggcgtgtttacatcagtgggcaaacttgtacatcaagtattcggtactgcatatggagttctcttcagtggagtctcttggacaatgaagatagggatcggtatactactaacttggttaggcctcaactctaggtcgactagcttaagtatgacctgcattgctgttggaatggtaacactatatctcggtgttatggtacaagctgattcgggatgtgtcattaactggaaaggtcgagagcttaaatgtggatcagggatatttgtaactaatgaagtacatacctggacagagcagtacaaattccaggctgatagtcctaaacgactgtctgcagctattggtaaagcctgggaagaaggagtatgtggtatacgaagtgctacacggctggaaaatatcatgtggaaacaaatttccaatgagctaaaccacatattattagagaacgatatgaaatttacagtagttgtaggtgacgccaacggtatccttgcacagggcaagaaaatgattagaccacagccaatggaacacaaatactcctggaaatcatgggggaaagcgaaaattataggagctgatatccaaaataccacctttattattgatggacccgataccccagaatgcccagacggacaacgggcatggaacatatgggaggtcgaagactatggctttggaatctttacaaccaatatttggctgaaattaagagattcatacactcaaatgtgcgaccacaggcttatgtcggccgccataaaggatagcaaggccgtgcacgccgacatgggttattggattgaatcagagaaaaacgagacttggaagctggcacgcgcgtctttcatagaggtcaaaacatgcacttggcctaaaagtcacaccctatggagtaacggcgtgctggaaagcgaaatgataataccaaaaatatatggtggtcctattagccaacataactatagacccggctacttcacacaaacagccgggccatggcatcttggaaagttggaactggactttgatctttgcgaaggaacaacggtcgtggtggacgaacattgtggtaacagagggccgtcccttaggactactactgttactggaaaaataattcatgaatggtgttgccgttcttgtacgcttccaccattacgatttagaggggaagacggatgttggtacggaatggagataagacctgttaaagagaaagaagagaatctcgtacggtctatggtgtctgccggatccggagaagttgatagtttctcacttggcatattatgtgtcagtataatgatagaagaagtcatgagatcaagatggtcaagaaaaatgctaatgacaggcactcttgcagtatttttgttgctaataatgggacagttaacgtggaatgatttaataaggttgtgtataatggtaggggctaacgcgtccgaccgtatggggatgggaacaacttatctcgctctcatggcaacttttaagatgagaccaatgtttgctgtgggactattgtttcgcaggctaacaagtcgggaagtcttgcttctaacaatcggactatcattagtcgcaagtgtagaactgcccaatagcttggaagaattaggagatggactagcgatggggataatgatgcttaagctactgactgaatttcaaccccaccaactatggacaactttgttatcactaacatttgtaaaaactacgctaagcctagattacgcatggaaaacaacagcaatggttctctctatagtttcgctattcccattatgtttatcaacgacaagtcagaaaacgacttggttacctgttctccttggctcattcggatgcaaaccgttgaccatgtttctcatcactgaaaataaaatatggggacgtaaatcatggcccctaaacgaaggaataatggctataggaatagtaagtatattattgtccagccttttaaagaatgacgtacctctcgcaggtccacttatcgctggcggtatgctaatagcgtgttacgtcatcagtggatcttctgctgatcttagtcttgagaaagccgctgaggtatcatgggaacaggaagcagaacatagtggtgcgtcccacaatattctagtagaagtacaagatgacggaactatgaaaataaaagatgaggaaagagatgatactttaacaatattattaaaggccacattgcttgctgtttcgggtgtatatccaatgtctataccagcgacattatttgtgtggtacttttggcaaaagaagaaacagagatcaggagtactatgggacacaccaagtccgccggaggttgaaagggcagtgttagacgacggaatttataggatcttacaaagaggattactaggacgttctcaagtaggcgtaggagtttttcaagatggcgtgtttcatacaatgtggcacgttacaaggggagcagtgttgatgtaccagggtaaacgactcgaacctagctgggcctccgtaaagaaagatttgattagctacggtggcggatggaggttccaaggctcttggaatactggagaggaagtacaggtaattgccgttgaacctggtaaaaaccccaaaaacgtacaaacaacaccaggaactttcaagactccagaaggggaagtaggcgcaatagcattagattttaaaccagggacttctggcagtcctatcgtcaatagagaaggcaaaatagtcggcctttatgggaacggggtggttactacgagtggtacttatgtttccgcgatcgctcaagcaaaggcttcacaagaaggcccactaccggaaattgaggacgaagttttcaagaaaaggaatctaacaattatggacctgcatccaggcagtggcaaaactcgcaggtacctaccagccattgtgcgcgaagcaataaaacggaaattaagaacattaatactagctcctacaagggtggtagcatctgagatggcagaagcactcaaaggaatgccgatacggtatcaaacaacagccgttaagtctgaacatacgggtagagagatagtagatctcatgtgccatgctacttttactatgagattgttatcacccgtccgggtccctaattacaatatgataataatggatgaagctcattttacagacccggcaagtatagcagcgcggggatatatatccacaagggttggaatgggtgaagcagcggctatatttatgactgctactccacccggctcagttgaggcatttccccagagtaacgctgtgatccaagacgaggaaagagatattcctgaaagatcgtggaacagtgggtacgattggattacagatttccccggtaaaacggtttggttcgtgccttctatcaaatccggaaatgatatagctaactgtcttaggaaaaacgggaagcgagttatacaactcagtcgcaaaacttttgatactgagtatcagaaaaccaaaaataatgattgggactatgtcgtaacgactgatattagtgaaatgggcgcaaatttccgggcggatagggttatagaccccagacgatgcttaaaaccagtaatactgaaagatggacccgaaagggtgattttggctggtcccatgccagttacagttgcaagtgcagcgcagcgcagaggacgaatcggacgaaaccagaacaaggaaggagaccaatatgtctatatgggccaacccctaaataatgatgaagatcacgcacactggacagaagccaagatgctattggataacatcaataccccagaaggaataataccggcattgttcgaacctgaaagagagaaaagtgcagctattgacggggaatatagattacgaggtgaagcacgaaaaacatttgtggaactaatgagacgtggagacttgccagtatggttatcctacaaagtcgcgtcggaaggattccaatacagtgaccgacgatggtgttttgacggagaaagaaacaatcaagttttagaagaaaatatggatgtagaaatatggactaaagaaggagaacgtaaaaagttacggccaagatggttggacgccaggacgtatagcgaccctttggccttgagagaatttaaagaatttgctgcgggcagacgctctgtatcaggagacttaatccttgagataggaaaattgccgcaacatttaactctacgagctcaaaatgcattagacaatctggttatgctccacaatagcgagcaaggtggaaaagcatatagacatgctatggaggagctaccagatactatcgagacattaatgttactagcattaatagctgtcttaacaggcggagtaaccttgtttttcctatcaggaaaaggcctcggcaaaacgtccattggtcttctatgtgtcacggcaagctccgctctattatggatggcatcggtcgaaccacattggatagcagcatcaataatactagagttctttttgatggtactattaataccggaaccagaccgtcagcgaacgccacaagataatcaactagcatacgttgtaataggattattattcatgatattaacagtagctgccaatgaaatgggattgttggaaacaaccaaaaaggatttgggtatcggatacgtcgcagcagaaaaccatcagcatgctacaatgttagatgtagatcttcgtcctgcaagcgcttggaccttatatgctgtcgccacaactgtaataactccgatgatgcgtcacaccatagaaaatacaaccgcaaatatctctttgacagcaatcgcaaatcaagctgcaatattgatgggattagataaaggttggccaattagcaaaatggatataggtgttccccttttggctctaggctgttattctcaagtaaatcccctaaccctaacagcggctgtactcatgttagtagcacactacgctataataggacctggtttacaggccaaagctaccagagaagctcaaaaacggactgcagcaggtataatgaaaaaccccaccgtagacggaatagtagcaatagatttggacccggtagtgtatgatgcaaaatttgaaaaacaattaggtcaaattatgttattgattttatgtacgtcccaaatacttttaatgagaacaacatgggctctatgcgagtctattacacttgctacaggcccattaactacactatgggaaggaagtcctggcaagttctggaatactactattgccgtatcgatggccaacatttttagggggagttaccttgcaggagcgggattggcattttctctaatgaaatcattaggcggaggaagacgaggaacaggagcacaaggagagacattaggcgaaaagtggaagaggcagctcaaccagctatctaagagcgagtttaacacatacaaaagaagtggaatcatggaagttgatagatcagaagctaaagagggactaaagcgaggggaaactactaaacatgcagtgagccgaggaacggcaaaattaagatggttcgtagagagaaatctagttaaaccagagggaaaggtcatagacctcggttgtggtcgaggtggatggtcgtactattgtgccgggttaaagaaggttaccgaagtgaaaggatataccaaaggtggccccggacatgaagaacctatacccatggccacatacggttggaacctggttaaactacactccggtaaagacgtattctttatgccgccagaaaaatgtgatacactattatgtgacataggagaatccagcccaagtccaacgatagaagaaggtagaacattgagagttctaaagatggtagaaccttggctaaggggaaaccaattctgtataaaaatcttgaacccgtatatgccaagcgtagtggagactctggaacagatgcagcgaaaacatggaggtatgctagtgcgtaacccactatcacgaaatagtacgcatgaaatgtactgggtttcatgtggaaccggaaacattgtatccgccgtgaacatgacaagtcgaatgctgctgaataggtttactatggcacatagaaagccaacttacgaacgagatgttgatttaggtgctggtacaagacatgtggcagttgaacccgaagttgcaaaccttgacataatcggacagcgcattgagaacattaaaaacgaacataaatcaacctggcactacgatgaagacaatccttataaaacttgggcataccacggatcatacgaagtaaaaccttcgggttcggcatcttccatggtaaatggagttgttagattattgacaaaaccttgggacgtcattcctatggttacacaaatagcgatgacagatactacacccttcggtcaacagcgggtttttaaagaaaaagttgatacaagaactccgcgcgccaaaagaggaaccacacaaatcatggaagtcactgcgaaatggttgtggggctttctgtctagaaataagaagccacggatctgtactcgtgaagagtttacccggaaggttcgctctaacgcagccatcggagctgtgtttgtggacgaaaatcaatggaacagtgcaaaagaagccgtagaagatgagaggttttgggatttagtacacagggagagagaactccacaaacaaggtaaatgtgcgacgtgtgtttacaacatgatgggaaagcgggagaagaaacttggtgagttcggaaaagcaaaaggctctcgcgcgatatggtacatgtggcttggagcacgtttcttagagttcgaggctctcggattcatgaacgaagaccattggttttcaagggaaaatagtctatcgggtgttgaaggagagggactacacaaactaggatacatcttacgagacatatcgaaaataccaggcggaaatatgtacgcagacgatactgcgggttgggacacgcggattacagaggacgatttacaaaacgaggcaaaaatcactgatatcatggaaccagaacatgcactgttggccacatcgatctttaaacttacttatcaaaacaaagttgtacgagtgcaaaggccagccaaaaacggtacagtcatggatgtaatctctagaagggaccaaagagggtctggccaagtaggaacctatgggttaaacactttcactaatatggaggtacagttgattcgtcagatggaaagtgaaggaatattccttccatcagagctagaaacccccaacttagcagaaagagtgctggattggctagaaaaacacggagcagaaaggttaaaaagaatggcaatatctggcgatgattgcgttgtaaaaccaattgacgaccgtttcgctacagcattgacagctctcaatgacatgggaaaagtccgtaaagatattccacaatgggaaccatcaaaaggctggaacgactggcagcaagttcctttttgttcacatcattttcaccaactaatcatgaaagacgggagagagattgtcgtgccctgtcgtaatcaggacgaattagtaggtcgagcccgggtatcacaaggcgcgggttggtccttgagagagacagcgtgcttaggaaaatcatacgcgcagatgtggcaattaatgtacttccatcgcagagatttgcggttagccgctaacgcgatttgttcagcggtacccgtagattgggttcctacaagtagaaccacctggtccatacatgctcatcaccaatggatgaccactgaagatatgctaagcgtatggaacagggtctggattgaagaaaacccttggatggaagacaaaacacacgtctcatcttgggaagaagtgccatatttaggtaagagagaggatcaatggtgcggttcactaataggcctaacagctcgagctacttgggccacaaacattcaagttgcaataaaccaagtcagacgattgattggaaatgaaaactatttagattacatgacttcaatgaaaaggttcaagaatgaatcagacccagagggtgcattgtggtaa

SEQ ID NO: 21152 - RNA, 9879 nt, synthetic construct
  misc_feature 1..9879: note = derived and/or modified CDS sequence (opt6) from DENV-1__KJ189303__SS-prME
  source 1..9879: mol_type = other RNA
tcagttactatgctgctgatgttacttcccacggctttggcattccacttaactaccagaggaggagaacctcacatgatagtgtctaaacaagaaagaggaaaatctttgctattcaaaacttcagccggagtcaatatgtgtacactaatagctatggatttaggagaactatgcgaagatacgatgacatacaaatgcccccgaataacagaggctgaaccagatgatgtggattgttggtgtaatgcaacagatacttgggtaacttatggaacatgtagtcaaacaggagaacatagacgagataaacgttcagtagccctagcccctcatgtaggactaggattagaaactagaactgagacttggatgtcctcagaaggagcctggaaacagattcaaagagtggagacttgggcacttcgtcatccaggctttacagtgatagcattatttttagcgcatgtaatcggaacaagtataactcaaaaaggcataatctttatattgctaatgcttgtaacgccttctatggcaatgagatgcgtaggaatcggcaatagggactttgtagaaggtttatcaggagcaacatgggtcgatgttgttctagaacacggctcatgtgtaacaaccatggccaaaaataaacctactctagatatagaacttctcaaaacagaagtcacgaatccagctgtcctaagaaaactatgtatcgaggcgaaaatttctaatacaactaccgatagccgatgtccaacgcaaggggaggcgactctagtcgaagaacaagacgcaaacttcgtctgccggaggacattcgtggatagaggctggggaaacggatgtggactcttcggaaagggatcactactcacgtgcgcaaaattcaaatgcgtcaccaaactggaggggaaaatagtacaatatgaaaatctaaaatattcagttattgtaactgtccatacgggagaccaacatcaagttggtaatgagacaacagagcacggtacaattgctactatcacaccacaagccccgacaagcgaaattcaactgactgactatggagcactaactttagactgttcgccgagaactggtttggacttcaatgaaatggtattattgacaatgaaagaaaagtcatggttagtccataaacaatggtttttagacttacctttgccatggacaagtggtgcttctacttcgcaagaaacttggaaccgtcaagatttacttgttaccttcaaaacagcgcatgcgaagaaacaagaagtagtcgtacttggaagtcaagagggtgcaatgcatactgccctgacgggtgctactgagatacaaacaagtggcacgactactatattcgctggacatttgaaatgtagattaaaaatggacaaacttacgctcaaaggcatgtcgtacgtcatgtgtaccgggtcttttaaattggaaaaggaggtggcagaaacacaacatggtacagtattggtccaagtgaaatatgaagggaccgatgcaccttgcaaaattccattctctacacaagatgaaaaaggtgtaacccaaaatggacgtttaatcacggctaatcctatagttactgacaaagaaaagccagtcaacattgagacggaacctccttttggcgaaagttatatagttgtaggtgccggagaaaaagcccttaaactgtcatggtttaaaaaggggtcctccattggaaagatgttcgaagcaacggcgaggggtgcacgacgaatggcaatacttggtgatacagcttgggatttcggatctatcgggggcgtttttacaagcgtcgggaaattggtacaccaagtattcgggacggcatatggtgttttatttagtggagtatcatggacgatgaaaataggaatcggaatcctccttacatggttgggtctaaattcgcgcagcacttctctatccatgacatgcatcgcggtagggatggtgacactatatttaggagtcatggttcaagcagactccggctgtgtcataaattggaagggacgagagctaaagtgtggttccggaatatttgtaaccaacgaagtccatacatggacggaacaatataaatttcaagcagactccccaaaaagactctccgcagctatcggaaaagcctgggaagaaggagtctgtggaatcaggtcggcgacccggttagaaaatataatgtggaaacaaatatcaaatgagttaaatcacatcttattagaaaatgatatgaaatttacggtcgtagttggagatgctaacggaatattggctcaaggcaagaaaatgatccgcccgcagcccatggaacataaatattcgtggaaatcatggggcaaagcgaaaattattggagctgacacacaaaacacgacatttatcatagatggtccagacacaccagaatgtcctgatggacaaagagcatggaatatatgggaggtagaggactatgggttcggtatttttacgaccaatatttggcttaaattacgagacagttatactcagatgtgtgatcatcgtttaatgtcagctgctatcaaagactcaaaggcagtccatgcagacatgggatattggattgaatcggagaaaaatgaaacttggaagctcgcaagagcgagttttatagaggtcaaaacttgtacgtggcccaaaagtcatactctatggtcaaacggagttcttgaatcagagatgataattcctaagatatatggcggaccaatttcgcaacataattaccggccaggatattttacacaaactgctggtccctggcatctaggcaagctggaactagacttcgacctatgtgaggggaccaccgtagtagtagacgaacactgcggcaaccgaggtccatcgctacgcactacaacggtaacaggaaagattatacacgaatggtgttgtaggagttgtactctacctccattgagattccgcggagaagatgggtgctggtatgggatggaaatccgtcccgtaaaagaaaaagaggaaaacctagtaagatcaatggtatcagctggctctggcgaagttgacagtttcagtctaggcatactttgtgtttcaattatgatcgaagaagtgatgagaagccgttggtcaaggaaaatgttaatgacaggtacattagcagtgtttctgttattaatcatgggacaactcacctggaatgatttgactcgattatgtattatggttggagcgaacgcctcagatcgtatggggatgggaacaacatatttagccctaatggctacatttaaaatgcgacccatgtttgcggtaggtctgctatttcgtcgtttaacatcacgtgaagtcctactacttacgataggactaagcctagtagcttctgtagaattaccaaacagcctagaagaactgggtgatggactcgcaatggggattatgatgttaaaattgttaactgaatttcaaccgcatcaactttggaccaccttgctatcacttacgtttgtgaaaacaacattatcgctagactatgcttggaagaccactgccatggtactatccattgtgagtctatttccactctgcctatcaaccacctctcagaaaacaacatggcttccagtattactaggtagttttggatgtaaaccgctaactatgtttctaattactgaaaataaaatatggggaagaaaatcgtggccgctcaatgagggaataatggccatcggaatagtgagcattttattatcttcacttttgaaaaatgacgtgccattagcaggacctctcattgcaggcggaatgctaattgcgtgctacgttatatctggtagtagcgccgacttaagtctagagaaagcagctgaggttagttgggaacaagaggcagaacactctggcgcaagtcataacatactcgttgaagtccaggacgatggaacaatgaaaataaaagatgaggagagagacgacacgctgaccatactgctgaaggctacactcttggctgtgtccggagtatacccaatgtctataccagctactttattcgtgtggtatttttggcagaagaagaaacagagatcaggcgtactatgggacacacccagtccacctgaagttgagcgcgccgtcttagacgacgggatttatcgaatacttcaaaggggcctgctgggtagaagtcaagtcggagttggagtattccaggatggagtatttcatactatgtggcatgttacaaggggagcggtgttaatgtatcagggtaaacgcctagaaccttcatgggcaagcgtgaagaaagatttgataagttacggaggaggatggcgatttcagggatcttggaatacgggtgaagaagtacaggtaattgctgttgagccaggaaagaatcctaaaaacgtacaaaccaccccgggaacattcaaaactcctgagggggaagtaggcgccatagctttagattttaaaccgggaacttctggtagcccaatcgtcaaccgtgaagggaaaatcgtaggattgtatggaaatggcgtagtgacaacgtcaggaacttacgtttccgcaatagcacaagccaaggcgagccaagaagggccgttgccagagatagaagatgaagtttttaagaaaaggaatcttacaataatggatctccatcctggaagcgggaaaaccagacgatacttgcctgctatagtaagggaagcaattaaaagaaagctaaggaccttaatccttgcacctacccgcgtcgtggcttccgaaatggcagaagcattaaaaggaatgccaatacgctatcaaacaacagcagtaaaaagcgaacatactggaagggaaatagttgatcttatgtgtcacgccacattcacaatgaggctactatctcccgttagagtgcccaactataacatgattatcatggatgaggcacactttactgatccggcaagtatcgcagcaaggggttacatctctacgagagtaggaatgggagaggcggcagcgatcttcatgacagctacaccacctggtagcgtggaagcgtttccccagagtaacgcggtcatacaagatgaagaacgagatataccagaacgaagctggaactctggatatgattggataacagattttccgggaaaaacggtctggtttgtaccaagtataaaaagtgggaatgatatagccaattgtctgaggaaaaatggcaaaagggtaattcagctctcgagaaagacattcgatacggaataccagaaaacgaaaaacaatgattgggactacgttgttacaacagacatatcagaaatgggagctaattttagagcagacagagtcatcgatccgcgaagatgtcttaagccagttatactaaaagatggtccggaaagagtaatcctagcaggtcctatgcccgtgactgtggctagtgcagcacaacggaggggtagaattggtcgcaaccaaaataaggaaggagatcaatacgtatacatgggtcagccgctaaataacgatgaagatcatgcacattggacagaagcaaaaatgctgctagataacattaacactccagagggaatcattcccgcattatttgaaccagagcgtgaaaaatcagcagcagtcgacggtgaatataggctccgcggggaggcaagaaaaacgtttgttgaattgatgcgaagaggtgacctcccggtttggttatcctataaggttgcatccgagggatttcagtactcggatcggaggtggtgtttcgatggtgaaagaaataatcaagttttagaggagaatatggacgtagagatctggactaaagaaggagaaaggaagaaattgcgccctaggtggttagacgctcggacatactcagacccactcgccctaagagaatttaaggaatttgcagccggacgacgttcagtgagtggcgatttaatcctagaaataggaaaattgccacagcatttgacattacgcgcacaaaatgccctcgacaacctagtaatgttacacaattcagagcaaggaggaaaagcataccgacatgcgatggaagaattgcctgacacaattgagactttgatgctattggcattaatagcagtacttactggcggtgttacactattctttctaagtgggaagggattaggtaaaaccagcataggtctattatgtgtaacagcaagctcagcattactatggatggcatccgtagaaccgcattggattgcagctagcataatattagagttcttccttatggtactacttataccggagcctgatcgacaaagaaccccacaagataaccaattagcttacgtggtgataggattgttattcatgattttaacggtagcagctaacgaaatgggtttgcttgaaactacgaagaaggatttaggcatagggtacgtcgcagcagaaaaccaccaacatgcgacaatgttggatgtagatttacgtcccgcttcagcctggacactatatgctgtggctaccaccgtcataactccaatgatgagacacactatagaaaatacaacagcaaatatatcacttactgccatagccaaccaagcagcaatcttaatgggattagacaagggatggcccatatcgaaaatggacataggagtaccattactggcactaggctgttattcgcaagtaaaccccctaactcttaccgccgcagttctaatgttggttgcacattatgcgataattggtccaggtttacaagcaaaagcaactcgagaggcgcaaaagagaacagctgctggaataatgaagaatccgactgtagatggaatcgttgcaatagatttggacccggtggtatatgacgcgaagtttgagaaacaattaggccaaataatgttattaatactatgtacaagtcaaatccttctaatgagaactacttgggctttatgcgaatctataactttagctacaggcccccttacaacgctatgggaaggaagtccgggtaaattttggaatacaacaatcgcagtctcgatggccaatatattccgaggatcatacttagctggtgcagggctagcattcagtttaatgaaaagcctaggcggtggacgacgggggaccggtgcacaaggagaaacactcggcgaaaaatggaagagacaattaaaccaactctccaaaagcgaatttaatacctacaagcggtcagggattatggaagtcgatagaagtgaagcgaaggaaggcctcaaaaggggagaaacaaccaaacatgctgtatcccgagggactgcaaaacttcggtggtttgtagagagaaatctagtaaaaccggaggggaaagttatcgatctgggatgtggacgtggtggatggtcctattattgtgcaggactaaagaaagtaacggaggtaaaaggatatacaaaaggaggacccggccatgaagaaccaattccaatggctacttatggatggaacttagtaaaactccatagtggaaaagacgttttctttatgccccctgaaaaatgcgatacgctcctgtgtgacataggagaatcgtcacctaatccaacaatagaagaaggccgaactttaagagttctgaaaatggtagaaccttggcttcgtggaaatcaattttgcattaaaatcttaaacccatatatgccgagtgttgtagaaactttggagcaaatgcaacgcaaacatggaggaatgctagttcgtaaccctttgagcagaaacagtactcatgaaatgtactgggttagttgtggtacagggaacattgtttctgccgttaacatgacatcgcgaatgctactcaacagatttacaatggcgcaccgtaagccaacatatgagcgggacgttgacttaggagctggaactcgtcatgtcgccgttgaaccagaggttgctaatttagatataatcggtcaacgcatagagaacataaagaacgaacataaatccacatggcactacgatgaagataacccatacaaaacgtgggcgtatcatggatcctacgaagttaaaccctcaggatcggcaagttcaatggtaaacggagtagtgagactcctaactaaaccatgggacgttatcccaatggtgactcaaatcgcaatgacagatacaacgccattcgggcaacaaagagtttttaaggaaaaagtcgatacgcgcacaccacgagcaaaacgcggaacgacgcaaataatggaagtgacggcaaaatggttgtgggggttcctatcgaggaataagaaaccgagaatctgtacacgggaagagtttactagaaaagtacgtagtaacgctgccataggtgctgtatttgtagatgaaaatcaatggaactcagcaaaggaggccgtagaagacgaaagattctgggatttagtacatagagaaagagaacttcacaaacaaggaaagtgtgcaacgtgtgtgtataacatgatgggtaagcgagaaaagaaactgggggagtttggcaaggctaaagggtcaagagcgatatggtatatgtggctgggtgcgcgatttttagaatttgaagctctaggattcatgaacgaggatcattggttttcacgcgaaaatagtttgagcggtgtcgaaggggaaggacttcacaaactaggctatatactcagagatatctctaaaataccaggaggaaatatgtatgcagatgataccgctggatgggatacgagaatcacagaagatgacctacaaaacgaagctaaaatcaccgatataatggaaccagagcatgcgctattagcgacaagtattttcaaattaacttaccagaacaaagtagtgagagtacaaagaccagcgaagaacggaacagtgatggacgtaatttcacgacgtgatcaaaggggtagcggtcaggtaggaacttatggcttaaatactttcactaacatggaagtacaacttataagacaaatggagtctgaaggtatatttctgccatctgaattagagactccaaacctggcggagcgtgttttggactggctagagaaacacggagcagaacgcctgaagcgaatggctatatcaggtgatgactgcgttgtcaaaccaattgacgacagattcgcaactgcactaaccgccttaaacgatatgggtaaagtacggaaggatatccctcagtgggaaccctctaaaggatggaatgactggcaacaagtaccattttgcagccatcactttcatcaattaattatgaaagatgggagagaaattgtggtaccctgtcgcaatcaagacgagttagtaggcagagcgcgagttagtcagggggcaggctggtcattgagagaaacagcctgtttaggtaaatcttatgctcaaatgtggcaacttatgtatttccacagaagagatttgagactagcagctaacgcgatatgttcagcggttccggttgaatgggtaccaacttctcgaacaacctggtctatacatgcgcatcatcagtggatgactacagaagatatgctctctgtgtggaacagagtgtggattgaagaaaacccttggatggaagacaagactcatgtaagttcatgggaggaggtgccatacttggggaaaagagaagatcaatggtgtggaagtctaataggactaaccgctcgcgcaacgtgggcgacaaacattcaagtagcaataaatcaagttagacgtttaataggaaatgaaaattatctggattatatgacatctatgaagcggttcaagaatgaatctgatcctgagggtgctttgtggtag

SEQ ID NO: 21153 - RNA, 9879 nt, synthetic construct
  misc_feature 1..9879: note = derived and/or modified CDS sequence (opt6) from DENV-1__KR028435__SS-prME
  source 1..9879: mol_type = other RNA
agcgttaccatgttattaatgcttatgccaactgctttagcatttcacttgactactagaggtggtgaaccccatatgattgtttctaaacaagagagaggaaaatcactcttatttaaaacgtcagcgggtgtaaatatgtgcactttaattgctatggatctcggtgaactgtgcgaggacactatgacatacaaatgcccgagaatcacagaggctgaacccgacgacgtcgactgctggtgcaacgctaccgacacttgggtgacgtatggtacatgcagtcaaacgggggaacaccgacgagataaacgttcagttgcgttagcaccccatgtagggctaggtctagaaacacgtacagaaacatggatgagcagcgagggtgcatggaaacaaatacaaagggtagaaacatgggcactgaggcatccgggatttacagtaatagcgttattcctagcccacgctataggaacatcaataactcaaaaaggaataattttcattctactgatgctcgtaacaccgtcaatggccatgcgttgtgttggcataggttccagagatttcgtggaagggctgagtggagcgacgtgggttgatgtagtccttgaacatggttcttgtgtgacaacaatggccaaagataaacctacacttgatatcgagcttctaaaaaccgaagttacaaatcctgccgtgttaagaaaattatgtatagaggcaaaaatatctaatacaaccaccgattcaagatgccccacccaaggagaagcaacgctggtggaagaacaagatgcgaacttcgtctgtcgacggacttttgtagatcgcggctggggtaatggttgtggactgtttggtaagggaagccttataacatgtgcaaaattcaaatgtgttactaaattagagggcaaaatcgtgcaatatgagaatcttaaatacagcgtaatagtaactgttcatacgggagatcagcaccaagttggaaatgagtctactgagcacggtaccaccgcgactattaccccgcaagctccgactacagaaatacaacttactgattatggcgcccttactctagattgttcaccccggacgggattggacttcaatgaaatggtactcctgaccatgaaggaaaaatcatggctagtgcataaacagtggttcttggatcttccgttaccttggaccagcggggcgagcacatcacaggaaacgtggaatcgccaggatctactcgtgacgtttaaaactgcacatgccaagaaacaagaagtagtagttctaggatcacaagagggtgcaatgcatacagcgctcactggtgccacagaaatacaaacaagtgggacgacgactattttcgcaggacatttaaagtgcagattaaagatggataagttgaccttaaaaggaatgtcatatgtgatatgcactggtagttttaaactcgagaaagaggtagctgaaacacagcatggaaccgtcctggtacaaattaaatatgagggaacagacgctccttgcaagatacctttttctacccaggacgaaaaaggggtaactcaaaacggacgactaattacagctaaccctatagtaacagacaaagaaaaaccagttaatattgaagctgaacctccatttggcgaatcatatatagtgattggggctggggaaaaagccctaaaactaagttggtttaagaaaggatcttccatcgggaaaatgtttgaagctacagctcgaggcgcgcgtcgtatggctatattaggtgatacagcctgggacttcggaagcattggaggagtatttacatctgtcggaaaactggtgcaccaaatatttggaacagcgtacggagtactttttagtggagtatcgtggacaatgaaaataggtataggagtacttcttacgtggttaggattaaattcccgaagtacaagcctatcaatgacgtgtatagcggtaggacttgtgacgctttacttaggagtgatggttcaggccgatagtggatgcgtcataaactggaaaggtcgagagcttaagtgcggtagtggaatatttgtaactaatgaggtacatacttggacggaacaatataaatttcaagcggattcacccaagcgactgagtgcagcaattgggaaagcatgggaggaaggagtttgcggcatcagatcagccactcgattagagaacataatgtggaagcaaatatcgaatgaattaaaccacatactgctagagaatgatatgaaatttactgtggttgtgggcgacgtagctggaatacttgcacaaggcaaaaagatgatacgaccccaaccaatggaacacaaatattcatggaaatcatggggaaaagcgaagataataggggccgatgtacaaaatacgacattcattatagatggacctaacacacctgagtgccctgatgatcaacgagcctggaatatttgggaagtagaagattacggattcggaatatttactacaaacatttggttaaagctaagagattcatacacacaggtctgcgatcatcgacttatgtcggcggctattaaagatagcaaggctgtacatgctgacatggggtattggattgagtccgagaaaaatgaaacatggaagttagctcgagcaagttttatagaagtcaaaacatgcatctggccaaaatcgcatactttgtggagtaatggcgtgctagaatcggagatgataatacctaaaatatatggaggaccaatatcgcaacataactatcgccccggatattttacacagactgccggtccatggcatctaggtaaattagaactcgactttgatctgtgtgagggaactacagtagtagtcgacgagcattgtggcaatcgcggacccagcttacgtacaactactgtaactggtaaaataatacatgagtggtgttgccggtcatgtacactaccaccgttgaggtttaggggagaggacggatgctggtatggaatggaaataaggccagtaaaggaaaaggaagagaacttagtgaaatctatggtgtccgcaggaagtggagaagttgatagctttagcctaggcttactttgtatctccataatgatagaagaggtcatgcgaagtagatggtcacgaaaaatgttaatgactggaacattagccgtatttttcttgctaatcatgggtcaactaacatggaacgatctcattagactttgtataatggtcggtgctaatgcatcagatagaatgggaatgggtacaacataccttgcactgatggcaactttcaaaatgagacctatgttcgcagtggggttactctttagaagattaacaagtagggaagttctactgctgacaataggattatcgttggttgctagtgtagaactaccgaacagtttagaagaactgggagatggcttggctatgggaatcatgatactaaaattgctcactgacttccaatcccaccagttatgggctacgctattatccttaaccttcatcaaaacaacctttagcttacattacgcgtggaagacaatggctatggttctctctattgtaagtctattccccctgtgcttaagtacaacttcgcaaaagacaacttggttgcccgtactgttaggatctttgggctgtaagccgttgacaatgtttctaattgctgaaaacaaaatttggggtcggaagagttggcctttaaatgaaggtattatggcagtaggtatcgtttctatattattgtcttctcttctcaaaaacgatgtccctctagcaggaccacttatagcgggaggaatgctcattgcctgttacgtaattagtggaagttcagctgacctcagcttagaaaaggcagccgaagtatcgtgggaagaagaagcagaacatagcggggcttcacacaatatattagtagaggttcaagatgatggcacaatgaaaatcaaagatgaagaaagagatgacactctaacgattttacttaaagccacattattagctatcagtggagtatacccattaagtataccagcaacactttttgtctggtatttttggcagaaaaagaaacaaagatctggagttctatgggacacaccaagtcctccagaggttgaacgagcagttctagacgatggaatttaccgaattatgcaaagaggactactgggacgttcccaggtaggtgttggagtattccaagaaaatgtcttccacacaatgtggcatgtaacacgaggcgctgtgttaatgtatcagggaaaaagattagaaccgtcttgggcttccgttaagaaagatctaatcagttacgggggaggatggcgcctgcaaggctcttggaatacaggagaagaagtacaggtaatagctgtagaacccggcaaaaatcccaaaaacgtacaaaccgcgccaggtacatttaaaactcctgagggggaagtaggagcaattgcactcgactttaaacctggaacttctggaagtcctatagtaaatcgagaaggaaaaatcgttggattatacggcaacggcgtcgttactacaagtggaacatacgtatctgcaatagcgcaagctaaagcgtcccaggaagggcctctgccagagatagaggacgaagtattccggaaacggaacctaaccataatggacttgcatccaggatcagggaaaacaagacggtacttaccggctattgttagagaagcaattaaaagaaaactacgaaccctcatattggcgcccactcgagtggtggcctccgaaatggccgaagcattaaaagggatgccaataagataccagacgacagccgtaaaaagtgaacacactgggaaggaaatagtagatttaatgtgccatgcaacatttacaatgagattgttaagtccggttagagtaccaaactataatatgataatcatggatgaagcccattttaccgatccatcttcaattgcagcccgcggatacatttccacacgtgttggtatgggggaagcggccgcaatatttatgacggccacacctcccggctcagttgaagcgtttccacaatctaacgcagtaattcaagatgaggaagggggcataagtgagcgaagctggaatagcggatacgaatggattactgactttccaggtaaaacagtttggttcgtacccagcattaaatctggtaacgatatagccaattgcctgaggaagaacggtaaaagagtaattcaattaagtcggaagacatttgacacagaataccagaaaacgaaaaataacgactgggactatgtggttacaacagatattagcgagatgggggcaaacttcagagcggatcgagtcatagatcctaggagatgcttaaaacccgttatactgaaagatggtcctgagcgagttatactcgcaggaccaatgcctgtaaccgtagcaagcgcggcacagcgaagaggacgtatcggcagaaaccataataaggaaggtgatcaatatatttatatgggtcaacccttaaataatgacgaggaccatgcacattggacagaagctaaaatgctactagacaatataaatactcccgagggaataattccggccctattcgaaccagaacgtgaaaaatcggctgctatagatggtgaatatagattaagaggggaagctagaaaaaccttcgtagagctaatgcgtcggggagatctaccagtgtggctgagctacaaagtagccagtgagggattccagtatagcgaccggcgttggtgtttcgatggagaaagaaataaccaagtacttgaagaaaacatggacgtagagatatggacaaaagaaggagagaggaagaaattaagaccacgatggctagatgctagaacgtattccgaccctttagccttaagagaatttaaagagttcgccgcgggaagaaggtcagtgtcaggagatttaatactcgaaataggcaaacttcctcagcatttaacccagcgtgcgcaaaacgcattagacaatctcgtaatgttacataacagcgagcaaggtggccgtgcttatcgacacgctatggaagaattacctgacacaatagagacgttaatgttgctagccttaatagccgtcctaacaggcggagttacactcttctttctctccgggcgagggttaggtaaaacaagcattggcctattatgtgtaatggcaagttcagtgttactgtggatggcctcagtagaaccccattggatagccgcgagtatcatattagaatttttcttgatggtcctgttaatccctgaaccagataggcaacgaacaccgcaagataaccagctagcatacgtcgtcataggtttattatttatgatactaaccgtggcagccaacgaaatgggcttactcgagacaactaagaaagatcttggaattggtcatgtagcagtggaaaaccaccaccatgctacaatgctggacgtagatttgcacccagcaagcgcttggacgctatacgcagtcgcgaccacgataataacacccatgatgcgtcatacaatagaaaatacaacggccaacatttctctaacagcaattgcaaatcaagcagcaatcttgatgggtttggataagggctggccaatatcaaaaatggatataggagtaccactactagcgttaggttgctatagccaggtaaatccattaacattgacagctgctgtacttatgctagtagcacattatgccattataggaccaggacttcaagcaaaagcaacacgcgaagcgcagaaacgtacagcagcaggtatcatgaaaaacccgacagtggatggaatagtagctatagacctagacccagtagtgtacgatgcaaaattcgaaaaacaacttggacagataatgttactgattttatgtacttctcaaatattgttaatgagaaccacctgggccctatgtgaatcgattaccttagctacgggcccacttacgaccttgtgggagggctcaccaggaaagttttggaacactacaatagcagtatctatggccaatatattcagagggtcttatcttgctggagccggattggcattcagcttaatgaaatcgctaggtggcggtcgaagaggcacaggagcgcaaggtgaaacactaggcgaaaagtggaagcgccagcttaaccagctaagcaaaagtgaatttaacacgtataaacgatccggaataatggaggtcgatcggtccgaagcgaaagaagggttaaaacgaggcgaaactactaaacatgctgtctctaggggtactgcaaagctacggtggtttgtcgaaagaaatctagtgaaaccagaagggaaagttatagacctgggatgcggacgaggaggttggtcatactattgtgccgggcttaagaaagtaacagaagtaaaaggatatacaaaaggagggcccggtcacgaagaaccgataccaatggcaacatacggatggaatctggttaaactttattccggtaaagacgtattcttcatacctccagaaaaatgcgatacccttctatgcgatattggtgaatctagtccaaatccaacaatcgaggaaggacggacactaagagtactaaaaatggtagagccttggctaaggggtaaccagttctgcataaaaattttaaacccatatatgccaagtgtggtagaaacgctggaacagatgcaaagaaagcatgggggtatgctagtaaggaatcctttaagcaggaactcaacccatgaaatgtattgggtatcatgcggtacaggaaatatagtttcagcagtaaatatgacctctcgtatgctgttaaataggtttacgatggctcacagaaaaccaacttatgagcgagatgtagatttaggagcaggaacaagacatgtagcagttgaacctgaggtggccaatctagacataatcggacaacgaatcgagaatattaaacatgaacataaatcgacatggcattatgatgaagataacccgtacaaaacctgggcctaccatggttcatacgaagtaaaaccaagtggatctgcaagtagcatggttaatggcgtggttaaattactgacaaaaccttgggacgtgattccaatggtaacacaaatagcgatgacagatacaacaccttttggtcaacaaagggtttttaaagaaaaagttgatacaaggacacctaaagccaaaaggggtaccgcacagattatggaggttacagctagatggttgtgggggttcttgtctagaaataagaaaccacgtatctgtacacgagaagaatttactagaaaagttcgttcgaatgctgcaataggcgctgtgtttatagacgaaaatcaatggaatagcgcgaaggaagccgtcgaagacgaaaggttctgggacctcgtacatagggaaagggagttacataagcaaggtaaatgtgcgacatgtgtttacaatatgatgggaaaaagggagaagaaactgggagagttcggtaaagcgaaggggtcaagagctatctggtacatgtggctaggtgctagatttttagaatttgaagcattaggattcatgaatgaagatcattggttttcaagagaaaatagcctaagcggagtagaaggcgagggcttgcacaagttgggttatatcttgagagacatatcaaagattcctggcgggaacatgtatgcagacgacacagcaggttgggacacaagaattactgaagacgatctacaaaatgaagcaaaaattacagatattatggaacctgaacatgcgctgctagcgaaagctatattcaaactaacatatcagaataaagtagttagggtccaaagaccagcaaagaacggaacagtgatggacgtgatatccaggagagatcaacgcggttcgggacaagtgggtacatatggacttaatacattcacaaatatggaagcccaacttatcagacagatggaatcggaagggatattctcacctagcgaactagagacaccaaatttagccgaaagagttttagactggttggaaaagtatggggtggaaaggctaaaacgtatggctatatcaggcgacgattgtgtagttaaaccaatagatgatcggtttgccactgcactaacggcgcttaatgacatgggaaaagtgcgaaaggatataccacaatgggaaccatcgaaaggatggaacgattggcaacaagtcccattttgcagtcaccattttcatcaacttataatgaaagacggtcgcgaaatagtagtcccgtgcaggaatcaagatgagcttgttgggcgggcaagagtcagtcaaggggcaggatggtctctccgcgaaaccgcgtgtttgggtaaatcatacgcgcaaatgtggcaattgatgtattttcataggcgagatttaagattagctgcaaatgcgatatgctctgcagtaccagtagattgggtgccaacttctagaactacttggtctatacacgcacatcatcaatggatgactacggaggatatgctttcagtatggaatagagtctggattgaagagaacccatggatggaagataagacgcatatatcgtcatgggaagatgttccctacctaggtaagcgagaagatcagtggtgtggtagtcttattggattaacggcaagagcaacatgggcgacaaatatacaagtggcaattaatcaagtgcggagattaataggcaacgaaaattatctagattacatgacgtcgatgaagaggtttaaaaatgaaagtgaccccgagggagcactatggtaa

SEQ ID NO: 21154 - RNA, 9879 nt, synthetic construct
  misc_feature 1..9879: note = derived and/or modified CDS sequence (opt6) from DENV-1__JQ922548__SS-prME
  source 1..9879: mol_type = other RNA
tccgtaactatgttattaatgctattacctactgcacttgcattccatctgactactagaggtggagaaccgcacatgattgtaagcaaacaagaaagaggaaaatcattgctatttaaaacgtcggctggagtgaatatgtgtacattaatagctatggacttgggggaactatgtgaagacacaatgacctacaaatgcccccgaattacagaagctgaacctgatgacgtcgattgttggtgcaatgcaactgacacctgggtcacatacggaacgtgctcacaaacaggagaacatagacgcgataaaaggagtgtggccctagccccacatgtagggcttgggctcgaaacacggaccgagacatggatgtctagtgaaggagcgtggcgccaaatacaaaaagtagagacatgggcgcttagacaccccggattcacggttatagcattattcttagcacatactatagggacttctatcactcaaaaaggcatcatctttatcctattaatgttggtgacgccctcaatggcaatgcgttgcgtaggtattggtaatagagattttgtagaaggattaagcggggcaacatgggtcgatgttgtactggaacatggaagctgcgtcactacgatggcaaggaacaaacccacattagacatcgaactattgaaaaccgaagtaacaaatcctgctgtattaagaaaactatgcatagaagcaaaaatttccaataccacaacggattcccggtgccccactcaaggagaagcaacgttagtagaggaacaagatgcaaactttgtgtgtagacgcacattcgtagataggggctggggaaatggatgtggactgttcggtaaaggatcgcttttaacttgtgcaaaatttaaatgcgtgactaaactagaaggaaaaatagtccaatacgaaaatctgaaatacagtgtgatagtaacagtgcacacaggtgatcaacatcaagtcgggaacgagacaacggagcatggaacgattgcgacaattactccacaagctcccatgtccgaaatacaactaacagattatggtgcattaacattggattgtagcccacgaactgggcttgattttaatgaaatggtcttgttaactatgaaagaaaagagttggttagtccacaaacaatggttcctcgacctaccacttccatggacttcaggtgcatcaacatctcaagaaacgtggaatcgacaagatctcctagttacgttcaaaacagcacaagctaagaaacaagaggtcgtggtcttaggtagtcaagaaggagcaatgcatacagctctcacaggtgcgacagaaatacaaactagcggaacgaccaccatgtttgcaggacatttgaaatgtcgcttaaaaatggataaattaacattaaagggagcttcgtacgttatgtgtaccggaccgtttaaacttgaaaaagaagttgcagaaacacagcatggtaccgtattagttcaagtgaaatacgaaggaacagacgccccttgcaaaattccattctccacccaagatgaaaaaggcgtgactcaaaatggaagactaatcactgctaacccaattgtcacagataaagagaagccagttaacatagaaaccgaacctcctttcggcgaaagctacatcgtaataggcgccggcgaaaaagcgttaaaactatcttggtttaagaaaggatcctcaataggcaaaatgtttgaagctacggcccgaggagcacgccgtatggcaatattaggcgatacagcgtgggactttggaagtattggaggtgcattcacgtccgttggtaagttagtccatcaagtatttgggaccgcctatggcgttctttttagcggagtaagttggacgatgaaaattggtataggaatactattaacatggctgggactaaactcaaggtccacgtcattaagtatgacttgcatcgctgttggaatggtaactctatatctaggagtaatggtgcaagcagacagtgggtgtgtaataaattggaaaggtagagaactaaaatgtggcagtggaatttttgtaaccaatgaagtacacacatggacggaacaatacaagtttcaagcagattcaccaaaaaggctaagtgcagcaattggtaaggcctgggaggagggagtatgcggcataaggtccgcgacacgattggagaacataatgtggaaacaaataagcaatgaacttaatcatattctcttagagaatgacatgaagtttactgtagtggtaggagatgcgaatggaatattgactcagggcaagaaaatgataagaccccaacctatggagcataagtacagttggaaatcttgggggaaggccaagatcatcggtgctgacgcgcaaaatactacctttataattgacggacctgatacgccagaatgtccggatgaccaacgggcgtggaatatttgggaagtcgaagactatgggttcggcatcttcacgacaaatatctggcttaaactgagggattcatacacgcaaatgtgcgatcataggttaatgagcgccgcaataaaagactctaaagcggtacatgctgacatgggatattggatagaatctgagaaaaatgaaacatggaaacttactcgtgcgtcatttattgaagtaaaaacttgtacatggccaagatctcatacactttggagtaatggagtattagagagcgaaatgattattcctaaaatctatggagggcctatttctcaacataattatcgccctggctattttacccaaactgctggtccatggcatttagggaaattagagcttgactttaatctctgtgaaggtacaactgtagtggttgacgagcactgtggtaacggcggagcatcattgggaactacgacagtgacaggaaaaataatacatgaatggtgctgtaggagctgtacgctcccacccttgcgattccttggcgaagacggatgttggtatggaatggagataagacccgttaaggagaaagaagagaatttattccgtagtatggttagtgctggatcgggtgaagtagatagttttagcttgggcttactatgcgtatccataatgatcgaggaagtgatgcgtagtagatggtctcggaaaatgttaatgactggaacattagctgtgttctttttgttaattatggggcagcttacgtggaacgatttaattcgtttatgtattatggtcggtgcaaatgcctccgacagaatcggcatgggaactacgtacctcgcactaatggctactttcaaaatgagacccatgtttgcagtgggactcttgtttagacgcctcacatcaagggaagttttattactaacgataggactatcacttgtagcatcagtcgaattaccaaattcacttgaggaattaggagacggtttagcaatgggtattatgatgttgaaattattaacagattttcaaagtcaccaactttggactacactactatccttaacttttattaaaacaactttatctcttgattatgcatggaagaccatagcgatggtattatctatcgtatcactctttccattatgcctaagtacaacaagtcagaaaacgacgtggttgccagtgttgctcggatcatttgggtctaaacctctaacgatgttcttaataactgaaaacaaaatctggggaaggaaaagctggcccctcaacgaaggaataatggcagtaggtatagtgtcaatcttgttatctagcctaccgaagaacgacgtacctctcgcagggccactgatagccggcggaatgcttatagcatgttatgtaatttcgggttctagtgcagatctgagtttggaacgcgcagcagaagtatcctgggaagaagaagcagaacactctggcgctagccataatatcctggtcgaagtacaagacgatggtaacatgaaaatcaaggatgaggaaagagacgattcgttaacaatacttcttaaggctacgctgttagcagtatctggcgtttatccaatgtctatccctgccacattatttgtatggtacttttggcagaagaagaaacaacgcagcggagtattgtgggatacccctagtccgccagaagtcgtcagagcagtactcgacgatggaatttacaggattctacaaagaggcctattagggagatctcaagtaggcgtgggtgtgtttcaggacggcgtttttcacacaatgtggcacgtaacacgaggagctgttttaatgtaccagggcaaacgtttagaaccctcttgggcaagtgttaagaaagatctgatttcctacggaggtgggtggagatttcaagggtcatggaataccggcgaggaagttcaagttatcgcggtggagccaggtaaaaatccaaagaatgttcagaccacacctggaacgttcaaaaccccagaaggcgaggttggagcaatagctcttgattttaaaccaggaacatctggaagtcctatagtaaatcgtgagggaaagattgtgggactttacggaaatggcgttgtaactacatccggtacatacgtatctgctatagcacaagcaaaggcctcgcaggaaggaccgctgccagagattgaggatgaagtatttaagaaaagaaatcttactataatggacttacatcctggtagtggaaaaacgcgtcgttatttaccagcaattgtcagagaggcaataaagcggaaactaagaaccttgattttagcaccgactcgggttgtagcgtccgagatggcagaagcgctcaaaggaatgcccatacgctatcaaacgacagcagtgaaatcggaacatacagggagagagatcgtagacttaatgtgtcacgccaactttaccatgagactcttgagccctgtacgagtaccgaattataacatgataataatggatgaagcacatttcactgacccggcctcaattgctgctagaggttatatctccacaagggtaggaatgggcgaagcagctgccatctttatgacggccactccaccaggatcggtagaagcatttccacaatcgaatgccgtaatccaagacgaggaaagagacataccagaaagaagttggaacagtgggtatgattggataacagactttccaggaaaaacagtttggtttgttccgtccataaaatcaggtaatgacatcgctaattgcctaagaaagaacggcaagagggtcatacaattatcgaggaaaacatttgacacagaataccagaaaacgaaaaataacgactgggattatgtagtcactaccgatatatcagaaatgggtgcaaactcacgaacagatcgagtgatagatccacgacggtgtcttaaacccgtgatactcaaggacggacctgagcgggtaatacttgcaggaccgatgcccgttacggcagctagtgcagcacaacgaaggggaagaataggacgaaaccaaaataaagaaggcgatcagtacatatatatgggccagccattgaataatgatgaggaccatgctcattggacagaagctaaaatgttgctagataacataaacacaccagagggaatcatccctgcgctattcgaaccggaacgtgagaagtcggctgcaatagatggagaatacagactgaggggagaggcgcgcaaaaccttcgttgaactaatgagaagaggtgatttaccagtttggctaagctataaagtagcttctgaaggattccaatactcagatagacgttggtgttttgatggagaacgcaacaaccaggtacttgaagaaaacatggacgttgaaatttggacaaaggaaggagagagaaagaaattgagaccacgttggttagacgcaaggacgtatagtgatcccctagctttaagggaatttaaagagtttgctgcaggaagacgcagcgtttctggcgatctaatattggaaattggaaaactaccacagcacttaacacttagagctcaaaatgcactagacaacctagtcatgcttcacaattcagaacaaggaggcaaagcatataggcatgccatggaagaattacccgacacaatcgaaactctaatgcttttggctctgatagcggtcttaacagggggcgtaaccttattctttttatcaggaaaaggtctcggaaaaacaagcataggcctattatgcgtaatggcgagcagcgtactattatggatggcctcagtagaaccgcactggatagccgctagcataatattagagttctttcttaaagagctcctaatcccagatgcggatggacaacgaacaccgcaggacaatcaattagcttatgtagttattggattattgtttatgattttaacagtagcagcgaatgagatgggtttactagaaacaaccaaaaagaatttagggataggacacgtcgtcgctgaaaatcaccaccatgctaccatgctggatattgacttgcatcctgcttctgcatggaccctctacgccgtcgctaccacgataattacaccgatgatgcgacacacgatagaaaacacaacagcgaacatttcattaaccgctatagcgaatcaggccgcgatcttaatgggtctcgacaaaggtcgccctatttcgaaaatggacataggcgtgccgttgttagcactgggctgttatagtcaagtaaatcccctgacactaacagccgcagtattgatgttagtagcacattatgctataatagggccaggtcttcaggccaaagccacgagagaagcacagaaaagaacggcagccggactcatgaaaaatccaacggtagacggaatagccgccatagatctagaccctgttgtctacgacgcaaagtttgaaaagcaattaggccaaataatgttgctgatattatgtacttcgcagattctcctcatgcgaacgacatgggcgctttgtgaatccataacgcttgccactggaccactaacaaccctgtgggaaggatcaccaggaaaattctggaatactactatagcagtgtctatggcgaacatattcagaggtagctatcttgcaggagcaggacttgcttttagtcttatgaagtccctcgggggtggccgacgaggaacaggagcacaaggcgaaacacttggcgaaaaatggaaaagacaactaaatcaattaagcaaatcagaatttaacacttacaagcgtagcgggattatggaagtggaccgtagtgaagccaaagaaggattaaaaagaggcgagaccactaaacatgcagtaagcagggggactgcaaagttacgttggtttgtagaacggaatcttgtgaaaccagagggtaaagtcatagaccttggctgtggaagaggagggtggagttattattgtgccggcctcaagaaagtaacggaagtaaaagggtacactaaaggcggtcccggacatgaggaaccaattccaatggcgacttacggttggaatttagttaaacttcatagtggtaaagatgtatttttcacaccacccgaaaaatgcgacacattgctatgtgacattggcgaatcttctccaaacccaacgatcgaagaaggaagaaccctgagggtactcaaaatggtcgaaccatggctgaggggaaaccaattttgtatcaagattttaaacccctacatgccgagcgttgtcgagaccttggagcaaatgcaaagaaaacatggcggcatgctggtgcgtaatcctcttagcagaaatagcacgcacgaaatgtactgggtgagctgtgcaacaggcaatattgtaagtgcggtgaatatgacaagtcgtatgttactgaaccgatttacgatggcccatagaaagccgacttatgaaagggacgtagatttaggagcaggcactaggcacgtcgcagtcgagccagaaatagcaaacttagacataatcggtcaaagaattgaaaatatcaaaaatgagcataaatcaacatggcactacgatgaagataatccttataaaacttgggcataccacggtacgtatgaagttaaaccaagtggaagtgcctcaagtatggtgaatggagtagtaagacttctcacaaaaccttgggatgtcatacctatggtaactcaaatagcaatgaccgatacaacgccattcgggcaacaaagagtattcaaagaaaaagtggatacacgtactccaaggcctaaacgaggaacagcacaaatcatggaagttacagcaagatggctatggggatttctatctagaaataagaaaccgcgaatatgcacacgggaagagttcaccagaaaagtgcgttcaaatgcagcaataggggctgtatttgttgacgagaatcaatggaactctgctaaagaagctgttgaagatgaacgattttgggatttagtgcacagagaacgtgaactgcataagcaggggaaatgcgctacgtgtgtttacaatatgatgggtaaacgagagaagaaactgggagagtttggcaaggctaaaggtagccgggcaatatggtatatgtggctaggagcccgattcctagaatttgaagcgttaggcttcatgaacgaggatcattggttttccagagaaaactctctttcaggggtcgaaggtgaaggtttacataagctcggatatatattaagggatatcagtaaaattcccggtggaaatatgtatgcagatgacaccgcagggtgggacacaaggataacagaagacgatctgcagaatgaagccaaaattaccgacattatggaacccgaacatgcattgctggcgacttccatctttaaattgacttaccagaacaaagtggtacgcgtacaacgacctgcaaaatctgggacagttatggacgttattagcagacgggatcaaagaggtagtggacaagtcgggacatatggactaaatacatttaccaatatggaagtgcaattaatacgtcagatggagagtgagggtatattttcacccagtgagctggaaaatagtaatctcgcagaacgagcgctcgattggctagaaaaacacggcgtagaacgactgaaaaggatggccataagtggggatgactgcgttgttaaacctacagacgatcgctttgcgactgcgttaacggctttaaatgacatgggtaaagttagaaaggacataccccaatgcgagccaagtaaggggtggaatgattggcaacaagttccgttttgttcacatcacttccaccagttaattatgaaggatggaagagaaattgtagtgccgtgcaggaatcaagacgagttagtaggtagagcaagggtttctcaaggagcaggatggtctttacgtgaaacggcatgcctcgggaagagttacgctcaaatgtggcaactaatgtatttccatagaagggatcttcgattagcagccaacgcaatctgtagtgcagtccctgttaattgggtaccaacaagtagaactacatggtctatacacgctcaccatcaatggatgacgaccgaagatatgcttagtgtctggaacagggtatggatcgaagaaaatccatggatggaagacaaaacccatgtctcatcttgggccgatgtaccgtacttaggcaagagagaagaccagtggtgcggatccctaattgggttagccgcaagggcaacttgggctactaatatccaagttgcactgaaccaggtcagacgacttatagggaacgaaaattatcttgattatatgacaagtatgaagcgttttaagaatgagtctgatcctgaaggagctctctggtaa

SEQ ID NO: 21155 - RNA, 9879 nt, synthetic construct
  misc_feature 1..9879: note = derived and/or modified CDS sequence (opt6) from DENV-1__JQ922544__SS-prME
  source 1..9879: mol_type = other RNA
agcgttaccatgctattaatgttactacctactgcattagcatttcatttaaccacccgaggtggtgaaccacacatgatagtgtctaaacaggaacgaggtaaaagtcttttattcaaaacctctgctggagtaaatatgtgcactttgatagcaatggatttaggcgaattgtgcgaagacacaatgacatacaaatgtcccagaatcactgaagcagaaccagatgatgtggattgctggtgtaatgccactgatacatgggtaacctacggaacatgctctcaaacaggggaacataggagagacaaaaggagtgttgcactagcgccacacgttggactaggattagaaacgcgtactgaaacttggatgtcatgcgaaggagcctggaaacaaatacaaaaagtcgaaatatgggcattgagacaccccggttttaccgttatagcactcttcttagcgcacgcaattggtacatcaataacacagaaaggaatcatttttatcctattaatgttagttacgccatcaatggctatgcgctgtgtaggaataggtaatcgtgaatttgtagagggacttagcggtgcaacatgggttgatgttgttttggaacatggatcatgccttcacactatggcacaaaataaacctacacttgatatagaactgttaaaaactgaagttacgaacccagcggtactcaggaaactatgtattgaagcaaaaatctcaaacacgacaactgattctcggtgtcctacacaaggagaagcaacactcgtggaagaacaagatgcgaattttgtctgcagaagaacgtttgtcgacagagggtggggaaatggatgtggactattcggaaaaggttcactcctaacctgcgcgaagtttaaatgcgtgacaaaattagaaggtaaaatcgtacagtatgaaaatctaaaatattcagttatcgtgacggttcatactggtgaccagcatcaagttgggaatgaaacaacaacacatggaaccatcgcaacaataacgccacaagcaccaaccagtgaaatacaattgactgactacggagctttaacattagactgtagtccgagaaccggtctagatttcaatgaaatggtactgctgactatgaaggaaaaatcctggctagttcataaacaatggtttttagacctaccattgccgtggacatccggagccagcaccagccaagaaacctggaataggcaagatttattagtaactttcaaaactgcacatgccaagaaacaagaggtagtcgttttgggcagtcaagaaggcgcaatgcatactgcacttacaggtgcgacagagattcaaacatcgggtacaacaacaatttttgctggtcatctaaagtgcaggcttaaaatggataaactaacacttaagggtatgagttacgttatgtgcactggttctttcaagctcgagaaagaagttgcggagacccagcatggcacagttttagtccaagtgaaatatgaaggaacagatgcaccatgcaaaattccttttagtacccaagatgaaaaaggagtaactcaaaatggacgccttatcactgcgaacccaatagtaactgataaggaaaaaccagtaaacatagaagctgaaccaccttttggggaaagttatatagtagtaggggctggagaaaaagcactcaaactaagttggttcaagaaaggatcttccataggtaagatgtttgaagcaacggcaagaggcgccagaagaatggcaatcctaggcgatactgcgtgggactttggctctataggtggtgtttttacatcagttggtaagttagtacaccaagtatttggaacagcgtacggtgtacttttcagcggggttagttggataatgaagataggcattgggattttactaacatggctcggacttaattctagatctacctctttatcaatgacgtgtattgcggtgggaatggttactctatatttaggagtcatggttcaagcagactcaggttgcgttattaattggaagggaagagaattaaaatgcggatcaggaatattcgttaccaacgaagtccatacttggactgaacaatacaaatttcaagcagacagtcctaagagactatccgcagcaatagggaaagcctgggaagaaggtgtgtgcggaataaggtcagcaactcggctggaaaatattatgtggaaacaaatatctaatgagctaaaccacatactcctagaaaacgacatgaaatttaccgtcgtagttggtgacgctaacggcattctagctcaaggcaagaaaatgatcagaccccaaccaatggaacacaaatatagttggaaatcgtggggcaaggcgaaaataataggtgcggatattcagaataccacctttattatagatggaccggacacccccgagtgtccagatgatcaacgagcatggaatatctgggaagtcgaagattatggttttggaatctttaccacaaatatatggctaaaattacgagatagttacacacaaatgtgtgaccaccgactgatgtccgcggcgattaaagattccaaagcagtccacgcagatatgggctactggatagaatcagagaaaaatgaaacttggaaacttgcccgagcatcctttatagaagtgaaaacctgcatctggccaaaaagccatactttgtggagtaacggagtactggaatcggaaatgattataccaaaaatctatggaggtccaatatcgcaacataattataggccgggctattttacccaaactgcaggaccatggcatcttggcaaactggaattggacttcgacttatgcgaaggtacaaccgtagtcgttgaagaacattgtggaaatagaggaccttctctaagaacgacaacagtaacaggtaaaattattcacgaatggtgttgcaggtcgtgtacgcttccacccttacggtttaaaggagaagacgggtgttggtatggaatggaaataagaccagtaaaggaaaaggaagagaacctagtgagatcaatggtcagcgcaggatcaggagaagtagattcattttcgttaggacttttatgtgtttcaataatgatagaagaagtcatgagatcacgctggagtcgaaaaatgttaatgacaggaactcttgcagtgttcctattattaataatgggacaactgacttggaatgatttgatacgactatgtataatggtcggagctaacgcaagtgaccgaatgggaatgggtactacatacctcgcgttaatggcaacctttaaaatgcgacccatgttcgcagtgggattactttttaggagattgactagcagggaagttctattacttacgatcggattatcgctagtagcttcagtagagctgccaaactctctagaagaacttggtgacgggttggcaatggggataatgatgctaaaactacttaccgatttccaatctcatcaactctggactaccttattgtcgctaacctttattaaaacaacactaagcctggattatgcgtggaaaacaatggcaatggtactatcaatagtcagcctgttccccttatgtctatcaaccacaagtcagaagactacttggttaccagtcttgctaggtagttttggttgtaaaccacttacaatgttcctcataacagaaaacaaaatatggggccgaaaaagctggcctttgaacgaagggataatggcagttggcatagttagtatactattgtctagccttttgaaaaacgatgttcctctagcaggaccactaatagcgggcggaatgcttatcagctttttcgttatatctgggtcctctgctgacttatcgttagaaaaggcagcggaagtatcatgggaagaagaagcagaacattccggtacaagccacaacatattggtagaggtacaagacgatggaactatgaaaattaaggacgaagaacgtgatgacacgcttaccattctattgaaggcaactttacttgcagttagtggggtttacccaatgtcaataccggcgacattgtttgtctggtatttctggcagaaaaagaaacaacgaagtggagtattatgggatacgccaagtcccccagaggttgagagagcggtccttgatgacgggatatacagaatactacaaaggggacttcttgggaggtcgcaagtgggagtaggagtattccaagatggagtcttccataccatgtggcatgtaacgaggggagcagtattgatgtatcaaggaaaaaggttggagccctcttgggcaagtgtaaagaaagatttgatttcgtatggtggtggctggaggtttcagggatcctggaataccggtgaagaagtgcaagttatagcggtagaacctggtaaaaaccccaaaaacgttcaaactactcctggtacatttaaaaccccagaaggtgaagtgggcgcaattgctcttgatttcaagccagggacgagcggaagtccgattgttaatcgcgagggtaaaattgtaggattatacggaaatggcgtcgttacgacatccggaacttatgttagtgcgattgctcaagctaaagcaagccaggaaggccctctgcctgagattgaagatgaagtattccgaaaaagaaatcttacgataatggaccttcacccagggtcgggaaaaacacgtaggtacttgccagccatcgtgcgagaagcgatcaaaagaaaattacgcactttaatattagcacccactagggtagtagcaagtgaaatggctgaagcactcaagggcatgccaattaggtatcaaacgacagcagtaaaatccgagcatacaggtcgagaaattgtggatttaatgtgccatgcgacctttaccatgagacttttaagtcctgtaagggtcccaaattataatatgataataatggacgaagcacactttacagatccagcctcaatagccgctaggggatacatatcaacaagagtaggaatgggtgaagcagcagcgatatttatgactgcgaccccaccaggttctgtggaggcatttccacagtccaatgcagtaatacaagacgaagaaagagatataccagaacgttcatggaatagcggatatgactggataacggactttcctggtaaaacagtatggtttgttccatctataaagtccggaaacgatatagcaaattgccttagaaagaatggaaaaagagtaattcaattgtcgcgaaaaacatttgatactgagtatcaaaagacaaagaataacgattgggattatgtagtaacgactgacatatccgaaatgggagcaaatttccgagcagacagggttattgaccctagaagatgcctaaaacccgtaattttaaaagatggaccagaaagagttattttggcggggcccatgcctgtgactgttgcgagcgcagcacaaagaagaggcaggataggaaggaaccaaaacaaggagggagatcaatatgtaaatatggggcaaccactcaacaacgatgaagatcacgcacattggaccgaggcaaaaatgctactcgacaatattaacacaccagagggaattattcccgcgctattcgaacctgaaagaaagaaatctgccgcagtcgacggcgaataccggctcagaggtgaggcacgtaagacttttgttgaattaatgaggcgaggcgacttgcccgtatggctatcctacaaggttgcctcagaaggttttcagtactcggaccggaggtggtgcttcgatggagagcgaaataatcaagtactagaagagaatatggacgtggagatttggacaaaggaaagagagcgaaagaaacttcgacctagatggctagacgcacgaacttattcggaccccttagccctcagagagttcaaagaatttgcggcaggaaggcgatccgtaagcggagatttgatcttagaaattggtaaattaccacaacacttaactttgagagcacaaaatgctctcgataatttagttatgttgcataactcagaacaaggcggcaaagcctaccgacacgccatggaagaacttccagatactatcgaaacactaatgcttttggcactgattgcggtcctcacaggcggtgtcacattatttttcctctcaggtaaaggattaggcaagactagcataggactactatgtgtcatggcaagtagcgctttactctggatggcatcggtagagccacattggattgcggctagcattattttagagttctttctcatggtactcttgattcccgaacctgaccgacaacgtaccccacaagataatcaactagcgtatgttgttataggactgctctttatgattttaactgtcgcagcaaacgagatgggtctattagagacaacaaagaaagatcttggaatcggacacgttgccgcagaaaatcatcaccatgcaacgatgttagatgtggatttgagacctgcatccgcttggaccctatacgcggtcgccactacgattattaccccaatgatgagacacacaatagagaatacgacagcgaatatatcactgaccgcaatcgcaaatcaagcagcaatactaatggggttggacaaaggatggccaataagtcttatggatataggtgttccgttactagcattaggatgttacagccaagtaaatcctttaacactcacggctgcagtgctaatgctggtagcgcattatgccataataggtccaggtcttcaggccaaagccacacgagaagcacaaaaacgcacagccgctggaataatgaaaaatcctacagtagacggaatagtcgcaattgatttggacccagtagtatacgatgcaaaatttgaaaaacaactagggcagatcatgctactaattctatgcacttcccaaattcttttgatgagaaccacgtgggcactctgcgaatcaataacgctagcgaccgggccacttacaacgttatgggagggctccccaggaaagttttggaatacaacaattgcggttagcatggctaacatcttcagaggcagttatttagccggggctggtttagcattctctttaatgaaatcattaggaggtggaaggagaggaacgggcgcgcaaggcgagacgttaggagaaaaatggaagagacaattaaatcaattatcaaaatcggagttcaatatatataaaagaagcggaataatggaagtggaccgatccgaagcgaaagagggtttgaaacgtggcgagacgacgaaacatgctgtatctagaggaacggcgaaactaaggtggttcgttgagagaaatttagtaaaacctgaaggcaaagttatagacctcggttgtggtcgcggaggatggagctattactgcgccggactcaagaaagtaacagaagtaaagggctacacgaaaggaggaccggggcacgaggaaccaattccaatggcaacgtatggctggaacttggttaaactccacagtggaaaagatgtattctttactcctcctgaaaaatgtgacacactcctctgtgatataggcgaaagctccccgaaccccactatagaagaaggacgcacacttagagttctcaaaatggtggagccatggttacggggcaaccaattctgcattaaaatcttaaacccgtatatgcccagtgtggtcgaaactcttgagcaaatgcagcgtaagcatggaggtatgttggtaagaaacccactatctcgaaattctacccatgaaatgtattgggtcagctgtggaactggtaacatcgtctcagctgtcaatatgaccagccgaatgttgttaaatagatttacaatggctcaccgtaaacctacgtatgaaagagacgtagatctaggagctggtactcgccatgtcgcagtagaacctgaagtggcaaacttggatatcattgggcaacgaatcgagaacatcaaaaacgaacacaaatctacatggcattatgacgaggacaacccatataaaacgtgggcatatcacggatcttatgaagtaaagccctcaggttcagctagtagtatggtaaacggagttgttcggctactaaccaaaccttgggacgtgataccaatggtgacccaaatcgcaatgaccgatacgactccttttggacaacaacgtgtatttaaggagaaggtggacacaagaaccccacgcgctaaaaggggaacagcacaaatcatggaagtaactgcgaaatggttgtggggtttccttagccgaaataagaaacctcgaatatgcacacgcgaagagtttactcggaaggttagatccaacgcggcaatgggagctgtatttgttgatgaaaatcaatggaactccgcgaaagaagcagtggaagacgaaagattttgggacttagttcacagagaacgcgagttacacaaacaaggaaaatgcgcaacatgtgtatataatatgatgggtaaaagagaaaagaaactcggagaatttggcaaggccaaaggctcacgggctatatggtatatgtggctaggcgctcgtttcctggaatttgaagccttagggttcatgaatgaagaccactggttttctagggaaaactcccttagtggcgtggagggagaaggattgcataaattaggctatatcctccgagacataagtaaaatacctggtggaaacatgtatgcggacgatacggcgggatgggacactcgaatcaccgaagacgatttacaaaatgaggcaaagataacggatattatggaacctgagcatgcgttgcttgcaaccagtatattcaaattaacatatcaaaataaagtcgttagagtacaacgacctgcaaaatcaggaacagtcatggatgtaatatcacgaagggatcaaagaggatcaggccaggtcggcacatacggattaaacacttttactaatatggaagtacaactaataagacaaatggaatcagaagggatattcttgccaagtgaactagaaactcctaatctagctgagagagttctggactggctagaaaaacacggggcagaaagattaaaaagaatggccatatcaggcgatgattgcgtggtcaaacccatcgatgacaggttcgctacagctttgaccgcactaaacgacatgggtaaagtgcgaaaagatattcctcagtgggaaccgagtaagggatggaatgactggcaacaagttcccttctgttcacaccacttccaccagttgataatgaaagatggaagggagattgtggtaccttgtagaaaccaagataaactcgttggcagggcacgagtatctcaaggagcgggatggtcattaagagagacagcctgtctggggaagtcatatgcccaaatgtggcaattaatgtatttccataggcgtgatctcagactagcagctaacgccatttgttcagctgtcccagttgactgggttccaactagcagaactacctggagtatacatgcccaccatcaatggatgacaaccgaagatatgttatcagtgtggaacaaagtatggatcgaagagaatccctggatggaagataaaacacatgtttcatcatgggaagatgtaccgtatctaggaaaacgagaagaccaatggtgtggcagtttaattgggctgactgcaagagcgacctgggcaacaaacatacaagttgcaataaaccaagtccggagattaataggtaatgagaattacctagactacatgacgtcaatgaagcgattcaaaaacgaatctgatcccgaaggagccttgtggtaa

SEQ ID NO: 21156 - RNA, 9879 nt, synthetic construct
  misc_feature 1..9879: note = derived and/or modified CDS sequence (opt6) from DENV-1__JQ922546__SS-prME
  source 1..9879: mol_type = other RNA
agtgttgcaatgttattgatgcttctaccgacagctttggcgttccacctaacgacgcgcggcggcgaaccgcacatgatagttagtaaacaggaacgggggaaatccctactatttaaaacaagtgctggggtgaatatgtgcacgttaatagctatggacctaggcgaattatgcgaagacacaatgacatacaaatggccccgaattacagaagctgaacctgatgacgtggattgctggtgtaatgccacggatacgtgggttacgtatggcacatgttcacagactggggaacatagacgagataaacgaagtgtggcattggctccacatgtcggtttggggttagaaacaagaacagaaacgtggatgagttcagaaggcgcctggaaacaaatacaaaaagtagaaacgtgggccttaagacaccctgggtttacagtgattgctttatttttagcgcacgctattgggacatcaataactcaaaaaggcataatattcattctattgatgctagtaactcccagtatggcaatgcgttgtgtgggaatcggcaaccgtgattttgtcgaaggactctccggagctacgtgggtagatgtagtcttagaacatggttcgtgcgttactaccatggccaaaaataaacctactctcgatattgaacttctaaaaacggaagtaaccaatcctgctgtacttcgaaaactgtgcatagaagcaaaaatttcaaacactacgactgacagtaggtgtccaacccaaggcgaggcaaccttagttgaggaacaagatgccaatttcgtatgtcgaaggacctttgtagataggggatgggggaacggttgtggcctcttcggaaaagggagcctactaacatgcgcaaaattcaaatgtgtaacaaaactagaaggaaaaattgtacaatatgaaaatttgaaatactcagtcattgtcacggttcatacaggagaccaacaccaagtaggtaatgagaccacagaacatggaactatagccattataacaccgcaggccccaacctcagagatacaacttacggactatggtgcattaacacttgactgttcacccaggaccggtctagatttcaacgagatggtactattaacgatgaaagagaaaagttggttggtccataaacaatggtttcttgacctcccattgccgtggacaagcggcgcaagcacgagccaagagacatggaataggcaagacctcttagttacattcaaaacagctcatgctaagaaacaagaagtagttgtattgggctcgcaggaaggtgcaatgcatactgctctcacaggagcaacagaaatacaaacatcagggactacgacaatctttgccggacatctaaaatgtcgactaaaaatggacaaactgacgcttaaaggtatgagttacgtaatgtgcaccggatcatttaaattagagaaagaagtggctgaaacccagcatggaactgtgttagtacaagttaaatatgaagggacggatgcaccatgtaaaatacctttctctatacaggacgagaaaggcgtaacacaaaacggccggttaataactgcaaatccaatagtaacagacaaagaaaaacctgtgaatatagagacagaacctccatttggagaatcttatattgttgttggtgccggagaaaaagcgctaaaactgagctggtttaagaaaggttcatctataggaaaaatgtttgaggcaacagcccgaggtgcccgcagaatggcaatattaggtgatacagcatgggatttcggaagtattgggggagtgttcacttcggtaggaaagctagtacatcaagtcttcgggactgcatacggcgtgctcttttcaggtgtatcatggacgatgaaaatcggaatcggaatccttttgacatggttagggcttaactcgagatccacaagccttagtatgacttgtatagcagtcggcatggtaactttatatctaggtgtgatggtacaagcggatagcggatgtgtaatcaattggaaaggcagagagctaaagtgtggtagtggcattttcgtgacaaatgaggtccatacatggacagagcaatacaaatttcaagcagattcaccaaaacggctgagtgccgcgattggaaaggcttgggaagagggcgtgtgtggtatcagatctgcaacgaggttagaaaatgtaatgtggaaacaaatttctaacgaactcaatcacatactattagaaaacgatatgaaatttaccgtagtagttggtgatgttaacggcattctggcacaaggtaaaaagatgattagaccgcaacctatggaacataaatatagctggaaaagttggggaaaggccaagataataggagccgatatccaaaacaccacgttcattattgatggtccggatacaccagaatgtcccgatgatcaaagagcatggaatatatgggaagtggaagactacgggttcggaattttcaccacaaacatttggttaaagttgagggactcgtatacgcaagtatgcgaccatagattaatgagtgctgcaattaaggactcgaaagcagtacatgccgatatgggatactggatagagtcggagaaaaatgaaacatggaagttggcgagagcgtcctttatcgaagtaaaaacgtgcacatggccaaagtcacatactctctggtctaatggagtattggagagcgaaatgattataccgaaaatctacggtgggcccatctcacaacataactacaggcctggatattttacccaaacagccggaccatggcatttaggaaaactggaattggatttcgatctgtgcgagggtacaacagtagtagtagacgagcattgcggaaatcgagggccaagtctgagaacaacaacggtcactgggaagataatacacgagtggtgctgtaggtcatgtacactaccacctttaaggtttaaaggagaagacggctgctggtacggaatggagattcgcccggtgaaagaaaaggaggaaaacctagtcaggagtatggtatctgcaggttcgggtgaagtcgatagcttctcccttgggctgttgtgtgtatcaatcatgattgaagaagtaatgcgatctaggtggagtcgaaaaatgctaatgacagggaccctagcagtattctttttgctaattatgggacaactaacatggaatgatttatttaggctctgtataatggttggagcaaatgcaagtgatcgaatgggcatggggaccacatacctagcacttatggcaacttttaaaatgaggcctatgtttgccgtagggttattattccggcgcctaacatccagagaagtgctactattaacaattggactaagtctggttgcctcagtagagctaccaaattcactagaagagttgggagatgggttagcaatgggcataatgatgcttaagctactaactgattttcagtcccatcagctgtggacaacgctactgtccttaactttcatcaaaacgacattatccctcgactacgcatggaaaaccatggccatggtgttatcgatagtttctttaagtcccctctgcttgtcaacaactagccagaaaactacgtggttaccagtacttctaggttccttcggttgcaaaccactcacgatgtttcttataacagaaaataaaatttggggtagaaaaagctggccgcttaatgagggcatcatggccgtcggcatcgtgtccatattgctatcaagcctattgaaaaacgatgtaccacttgctggaccactgattgcaggagggatgcttattgcctgttacgtaatatcggggtcatccgcagacctatcactcgaaaaagcagcagaggtctcatgggaggaagaagccgaacattctggtgcatcgcataatatcctagtggaagtacaagacgatggcacaatgaaaattaaagatgaagaaagggatgacacacttaccattctattgaaagcatcactactcgctgtgagcggcgtgtatcccatgagcatacctgctactcttttcgtgtggtacttttggcaaaagaagaaacaacggagtggggtactatgggacacccctagtccacccgaagtagaaagggcagtcttagatgacgggatatatagaatactgcaaagaggactcttaggaagaagccaggtaggggtaggcatattccaagacggtgtatttcatacaatgtggcatgtgacacgtggagcagtacttatgtatcaaggaaaaagactcgaaccgagctgggcttcagttaagaaagacctgatatcatatgggggaggatggagattccaaggcagttggaatacgggtgaggaagtacaggtaatcgcagtcgaaccgggcaaaaaccctaagaatgttcaaactaccccaggaatttttaaaacacctgaaggagaagttggagccataacattagactttaaaccaggcacatcaggttccccaatagttaaccgtgaggggaaaatagtaggattgtacgggaatggtgtggtaactacatcgggtacatatgtctcagcaatcgcccaggcgaaggcgagtcaagaaggaccactacctgaaatagaagatgaggtatttagaaagagaaatcttacaattatggaccttcatcctggatcggggaaaactagaagatacctccctgcaatagtaagagaggcaatgaaaagaaaactgagaacactaatattagccccaacccgtgtggtagcatcagaaatggcagaagcactaaagggtatgccaatcaggtaccaaactacagctgtgaaaagcgagcacacaggtagagaaatagtagacttaatgtgtcacgcaacatttactatgagattattgtccccagtacgcgttccgaactataacatgataatcatggacgaagcgcacttcacagaccctgccagcatagctgctagaggatatatatcaacccgggtaggtatgggcgaagctgcagctatttttatgaccgcaacacccccaggttcagtagaagcatttccacaatcgaatgctgtaattcaagacgaagaacgtgatatcccagagagaagttggaactcaggctatgattggattacagatttcccaggcaaaacagtatggttcgtcccatcaattaaatcagggaatgatatagccaactgtctccgtaaaaacggaaaaagagtgatccagctaagtagaaaaacattcgatactgagtatcagaaaaccaaaaataatgactgggattatgtagtcaccacagacatatccgaaatgggtgccaactttagagcagatagagttatcgatcccagaagatgtctaaaacctgtgatattaaaagagggaccggaaagggtaattctggcaggcccaatgcccgtgacggtcgctagcgccgcacagaggaggggaagaataggacgaaaccaaaacaaagaaggggatcagtacgtttacatgggtcaacctctaaacaatgatgaggatcatgcacattggacggaggctaaaatgttgttggatcatatcaacacaccagaagggattattcctgcactcttcgaaccagaaagagagaaaagtgctgctatagatggtgaatatagattgcgtggcgaggcaaggaagacatttgtggagcttatgagaaggggcgatctaccagtatggttgtcatacaaagtggcatcggaaggatttcagtatacagatcgtcgatggtgtttcgatggagaaagaaacaatcaggtattagaagaaaatatggacgtcgaaatttggatggaagaaggagaaaagaagaaaatacgccccaggtggttggagatagaaaaatatagcgatccgttagcacttcgggaatttaaggagttctccgcgaagaggaaaagcgtacttggtgatttaaaattggagatcggtaagctgcctcagcacctcaccataaaagcgaggaacgcactcgacaacctggtaatgcttcataattctgaacaaggagggaaagcctacaggcatgccatggaagaattgcccgataccattgaaactttaatgcggttaggtctaatagccgttatgactggaggtgtaacactattctttctctctggtaaagggctgggcaaaacgtcaaacggactcctctgtgttatggcatcgagtgtccttctctggatggctagcgttgaaccccattggatcgctgcaagcataatcctagagttcttcctgatggtacttctcataccagagcctgacaggcaacgaacacctcaagataatcagttagcttatgtagtaataggacttctttttatgattctcaccgttgcggcgaatgaaatgggattattggaaacgaccaagaaagatcttggtataggacatgtagtggcagaaaatcatcaccacgcgaccatgttagatgtagatttacatccagcatcagcatggactttatatgctgttgccactactataattacgccgatgatgcgacataccatagaaaacacaaccgccaatataagtcttactgcaatagctaatcaggcagctatattaatgggattggacaaagggtggcctatttcgaaaatggatataggtgttcccctactcgccttaggatgttatagtcaagtcaatcccttaacattgacggcagctgtgttgatgttagtagcacactacgctataatcggtcccgggttgcaagcaaaagctaccagagaagcccaaaagagaacagcacctcaaataatgaaaaaccaaatagtggatggcattgtagcggttgaccttgacccagtggtgtatgacgcaaaattcgaaaaacaattaggacagataatgctattaatactatgtacaagtcaaattctactaatgaggacaacttgggcgttatgtgaatctataacgctggccacaggtccacttactaccttatgggaaggcagccccggaaaattctggaacactactatagctgtctctatggcaaatatctttaggggaagttacctagcaggcgcaggattagcattttctctaatgaaatcactaggtggtggaagaaggggaacgggtgcccaaggcgaaacgctgggagaaaagtggaaaaggcagctgaatcaattatcaaaatcagaatttaatacctacaaaagatctggaattatggaggttgatagaagtgaggccaaagagggcttgaaacgaggcgaaactacaaaacatgctgttagtcggggtacagcaaaactacgatggttcgttgagagaaacctagttaaaccagaagggaaggttatcgatctaggttgcggcaggggtggatggagttactattgcgcgggactgaaaaaggtcaccgaagtgaaaggttatactaaaggcggaccaggacacgaggagccgataccaatggctacttatggttggaacttagtaaaattgcatagtggaaaagatgtcttctttacaccaccagaaaaatgcgatacgttactatgtgatataggtgaatcgtcacctaatccaactatagaagagggtagaactttacgtgttttaaaaatggtggaaccatggctacgtggcaatcagttttgtataaaaatattgaacccgtacatgccatctgtcgtagagactctcgaacaaatgcaaagaaaacatgggggaatgctggtaagaaacccattgagccgcaattccacccatgaaatgtattgggtaagttgtggaactggaaatatagtttcagccgtcaatatgacatcccggatgctactcaaccgatttaccatggctcatagaaaaccgacatacgagagagacgtagacctaggtgctggtactagacatgtagctgttgagccagaagtggcaaatctggacatcataggccaacgtattgagaatatcaaaaatgaacacaaaagcacatggcactatgatgaggataacccatacaaaacgtgggcataccatggatcctatgaagttaagccttctggtagcgcttcaagtatggtaaatggagtagtcagactgcttactaagccctgggacgtcataccaaccgtaacacaaatagcaatgaccgacactacaccttttggtcagcaaagggtatttaaggaaaaggtagacaccaggacacctaaggcaaagagaggtacagcccaaatcatggaggtaactgcaaactggctatggggcttcctgtcaagaaataaaaagccacgcatatgcacgagagaagaatttacaagaaaagtaaggtcaaacgcagctataggtgcagtatttgtggatgaaaatcaatggaactcggcgaaggaagccgttgaagatgaaagattttgggacctagttcacagggaaagggaactccacaaacaagggaagtgtgccacgtgtgtatataatatgatggggaagagagagaagaaattaggcgaatttggcaaagcaaagggttcacgagctatctggtatatgtggcttggagcgcgctttctagaatttgaagcgcttgggtttatgaacgaagatcactggtttagtcgagaaaatagcctaagtggagtcgagggagagggattacacaagttaggatacatcttaagagatatatccaaaatacctggagggaacatgtatgccgatgatactgcaggctgggacacacgtataaccgaagatgacctccagaatgaggcaaaaataacagacattatggaaccagaacatgccttattagctacaagtatcttcaaattaacataccaaaataaagtggtaagagttcaacgacctgccaaatctggtacagtcatggatgtaatcagtagacgcgaccagagaggaagtggacaagtagggacttacggactcaatacctttactaatatggaagtccaattaatacgacaaatggagtctgaaggtatcttcttaccatcagaattggaaacacctaacttagccgagagagtattaaattggctagaaaaacatggagtggaacgattaaagaggatggccattagtggagatgattgcgtggtaaaacctacggatgaccgatttgccaccgcacttactgctctaaatgacatgggaaaggttagaaaagacactccacagtgggagcctagcaaaggatggaacgactggcaacaagtaccgttctgctcacatcatttccatcaattaattatgaaggacggtcgcgaaatagtcgtaccatgtagaaatcaagacgaattggttggcagagctagagtatcgcatggggcaggctggtcactccgagaaacagcctgtttggggaagtcatatgcacaaatgtggcaacttatgtacttccatagaagggatttacgacttgcagccaacgcaatatgtagtgcagtccctgttgattgggtcccgacttccagaaccacgtggtccattcacgctcaccatcaatggatgactactgaagacatgctaagtgtatggaaccgagtatggatagaagaaaatccatggatggaggacaaaactcacgtaagttcctgggaagacgtaccttacctaggaaagagagaagaccagtggtgtgggtcaataatagggttgactgctagagccacatgggctacaaatattcaggttgccataaatcaggtaagacgactgattggtaatgaaaattatctagactatatgacttctatgaagagatttaagaatgaaagtgatccagaaggagcgctatggtaa

SEQ ID NO: 21157 - RNA, 9879 nt, synthetic construct
  misc_feature 1..9879: note = derived and/or modified CDS sequence (opt6) from DENV-1__JQ922545__SS-prME
  source 1..9879: mol_type = other RNA
tccgtaactatgctgctaatgttacttcccactgctttagcctttcatctaaccacgcgtggcggcgaaccacatatgatagttagtaaacaagaacgggggaaatccttactattcaaaacttcggccggggtcaatatgtgtaccctcattgcaatggatcttggtgagttatgtgaagacactatgacctataaatgcccacgaataacagaagcagaaccggatgatgttgattgttggtgcaatgcaactgatacttgggtcacttatggtacatgcagccaaactggcgaacatagaagagataaaagatccgttgctctagcaccacatgtcggtttggggctagaaactagaaccgagacctggatgtcttctgaaggagcatggcgccagatacaaaaagtggagacatgggctctaagacatccaggatttactgtaatagctttgtttttagctcacaccattggtacatctataacacaaaaaggtataatttttatcctattaatgactggagctcccataatggctatgcgctgtgtaggaataggaaatcgagactttgtagaaggtctgtctggcgcaccctgggttgatgtcgtcctcgaacatggcagttgtctcagtaatatggcgaaaaataaaccaactttagatatagacttctttaaaacggaggtaacgaatccagccgttttgcgaaaactttgtatagaagccaaaatatccaatacgactactgacagtaggtgtccaacccaaggtgaggcaacactggttgaagaacaagatgctaattttgtatgcagacggacatttgtagataggggatgggggaatggatgcggattgttcggcaaaggctctctgttaacgtgtgcaaaatttaaatgtgtgacaaaactagagggtaaaatagtacaatatgagaatctcaaatactctgttatagtgacggtacatacgggcgaccaacaccaagtgggaaatgaaacaacagaacacggcaccattgcgaccattaccccgcaagcaccgactagcgaaattcaattgaccgactacggtgctttaacgttagactgttcacctcgaaccggcttagactttaatgaaatggtacttctaacaatgaaagaaaaatcttggctagtacacaaacagtggtttttagatctaccattaccttggaccagtggagcatctacaagccaagaaacgtggaacagacaagatctgctagttactttcaaaactgcacatgcgaagaaacaagaggtcgttgttcttggctcccaagaaggagcaatgcacaccgctctaactggggctaccgagattcaaatgagtggtactaccacaatattcgcaggccatctaaaatgccgtttaaaaatggataaactaacactaaaaggggtgagctatgtgatgtgcacaggctcctttaaactagagaaagaagttgccgaaactcaacacggaacagtattagtgcaggtaaagtacgaaggtacagacgctccttgtaaaatacctttctcaacacaggatgaaaaaggagttacgcagaatggtaggctaattacagctaatcctatagttacagataaagaaaaacccgtaaatattgaaacagagccaccatttggagaaagctatatagtaattggagccggcgaaaaagcattaaagctaagttggtttaagaaggggagctcgatagggaaaatgtttgaagcgactgcaagaggagcacgaagaatggcaattttaggcgacacagcatgggactttggaagcatcggaggcgtattcacaagtgtcggaaagttagtccatcaggtgtttggaacagcatatggtgtgttattttcaggggtgagctggacgatgaaaataggaattggaatattattaacgtggttaggtctaaactccaggtcaacttcattgagtatgacatgtattgcagttggaatggtcactctatatctgggtgtaatggtacaagctgattcgggttgtgtaattaattggaaggggcgggaactaaaatgcggaagcggtatttttgtgaccaacgaagttcatacgtggactgaacaatacaagtttcaagccgactcccccaaacgcttatccgcggcaattggaaaagcatgggaagagggcgtatgcggaattagaagcgcgacctgcctagaaaatataatgtggaaacaaatatccaatgaactaaaccatatcctacttgagaacgacatgaagttcactgttgtagttggggatgcaaacggtatactgacacaaggtaaaaagatgataagacctcaacctatggaacataaatattcttggaagagttggggcaaagccaaaataataggagcagatattcagaacacaacttttataatcgacgggcccgacaccccagagtgtccagatgaccagagggcgtggaacatctgggaagtagaagactatggattcggtattttcacaaccaatatatggcttaaactacgagattcatatacacaaatgtgtgatcatcgcctaatgtctgccgcaataaaagacagcaaagctgtacacgcagatatgggctactggatcgaatcggagaaaaacgaaacgtggaaactcgcgagggcctcattcattgaagttaagacttgcatatggccgagatcacatactctttggagcaatggagtattagagtcggagatgataattcctaaaatctatggtggtcccataagtcaacacaattaccgaccaggttacttcacacaaactgcaggaccatggcatcttggtaagttagaactagatttcgatctctgtgaaggaacaacagttgtagttgatgaacattgtggaaatcgaggaccaagcctgagaactaccacggtaacgggcaagataatacacgaatggtgctgtaggtcttgtacgttaccaccattaagatttaagggagaagacggatgttggtatggaatggaaattagaccagttaaagaaaaggaggaaaacttggtcagaagtatggtatcagctggatccggagaagtagactccttctctttgggcttattatgcgtttcaataatgattgaggaagttatgaggtcaaggtggtcgcgcaaaatgttgatgacaggtacattagcggtgttctttttattaatcatggggcaattaacttggaacgaccttatcagactctgtataatggttggagcaaatgtttccgatcgcatgggaatgggaacaacataccttgcgttgatggctacctttaaaatgcgtccaatgttcgctgttgggttattgttccgtagattgactagccgggaagtattattactcacaataggcctaagtcttgttgcctcagtggaacttcctaattctttagaagaactgggagacgggttagccatggggataatgatgctaaaacttttaactgattttcaaagtcatcagctctggacgacattattatcattaacatttatcaagacgacactgtcactggattatgcatggaagacaatcgcgatggttttatcaatagttagcctttttcccctatgtttaagtacgaccagccagaaaaccacttggctacccgtgttactcggctcctttgggtgtaaaccattaactatgtttttaattactgaaaataagatatggggacgaaaaagttggccactaaacgagggaataatggcagtagggatcgtttccatattactaagttcattactcaaaaacgatgtgccattagctggaccgctgatagctgggggaatgttgattgcttgctacgtaatctcaggatcatcggcagacctatcacttgaaaaggctgccgaagtctcgtgggaagaagaggcccaacattcaggagccagccataacattttggtcgaggtgcaagacgatggcaccatgaaaatcaaagatgaagaacgggacgacacattaacaatactactaaaagccacactactagctgtaagtggagtatacccaatgtcaatacccgcgacactctttgtatggtacttttggcaaaagaagaaacaaagaagtggagtcctttgggacactccgtcgccacctgaagtggaacgagccgttcttgatgatgggatttaccggattctgcaaaggggcttactagggagatcacaggtgggagtaggagtatttcaagatggtgtcttccatactatgtggcatgtgacaagaggagcagtattaatgtaccaaggaaaacgtctagagccttcttgggccagtgtgaagaaagacctaatctcatacggtggtgggtggaggtttcaaggttcatggaacacaggagaagaagttcaggtcatagcagtcgaaccggggaaaaaccctaaaaacgttcaaacgacgcctggaacttttaagacaccagaaggggaagttggagccattgcattagatttcaaaccaggtacctcgggttctccaatagtcaatcgggagggaaaaattgtgggcctatatggtaatggagttgtcaccacgagtgggacctatgtgtcagctatcgcacaagcgaaggcaagtcaggagggcccattgcctgagatcgaggacgaggtttttaagaaacgaaatttgactataatggatctgcatcctggaagtgggaaaacccgaagatacttacccgcaattgttagagaagcaatcaaaaggaaattacggacgttaattttggcacccacgagggtagtagcgagtgagatggctgaggctctaaaagggatgccaattcgttaccaaacgacggcggtaaagtccgagcacacagggagagaaatagtcgacttgatgtgtcacgccacatttacgatgaggttgctcagcccggtgagagtaccgaattacaatatgataattatggatgaagcacactttactgatcctgcttcaatagctgcaaggggatacataagtacgagggtcggaatgggagaggctgcagcgattttcatgactgcgacacctcccggttccgtagaagcgtttccacagagtaacgcagttatacaagacgaggaacgtgatataccagaaagatcgtggaactctggttacgattggattacagattttcctggaaaaactgtatggtttgtaccaagcattaaatctggaagtgacatagcaacagttctcgaacgatcacgagaacccgtaatacaactatcgcgaaagacatttgatacagagtatcaaaagacaaagaataacgactgggattatgtagttacaactgatatttcagaaatgggagcaaatttcagggctgatagagtcatcgatcctagacggtgcttgaaaccagttatacccaaagatggtccagaacgtgttatattggctggccccatgcccgtaactgttgcatcggccgcacaaaggagaggaagaataggaaggaaccagaataaagaaggcgatcaatacatttacatggggcagccgttgaacaacgacgaagaccacgctcattggactgaagctaagatgttgctggataatataaataccccagaaggaataatacctgcgttattcgagccggaaagagagaaaagtgcagctattgacggagaatacaggttgcgaggagaggcccggaagacctttgtagagttaatgagaagaggggacctcccagtctggcttagctataaggtagcatctgaaggatttcagtattcagatagaaggtggtgctttgatggtgagcgaaataaccaagtgttggaagagaatatggatgtcgaaatctggacaaaagaaggcgaaaggaagaaacttagaccaagatggttagacgctcgtacgtacagtgacccgttagcactacgtgaatttaaagagtttgcagcaggaaggaggtcggtaagcggagatctgatcttagagattgaaaaactacctcaacacttaacactgagggcccaaaatgcattagacaatttagtaatgctgcataactcagaacaaggtggaaaggcatatagacacgcaatggaagagttgcccgatactatcgaaacgctaatgttgcttgcattaattgcagtattaaccggcggagttacgctattctttctgagtggaaaaggtttgggtaaaacatcaataggccttttatgcgtgatggcaagctctgtacttctgtggatggcatccgtggaaccccactggatagcagcatcaatcatcttggaatttatattaatggtattactcattccagagcctgatagacagcgtacaccacaagataaccaactcgcttatgttgtaattggtttattattcatgatactaacggtagcagcaaacgaaatgggattgttagagacaacaaagaaagatcttggcataggtcatgttgtagcagagaaccatcatcatgcaacgatgttggatatagaccttcatcctgcttcagcttggaccctatacgcagtagcaactactataattactcctatgatgagacacaccattgaaaatacgactgcaaatatcagcctgaccgcaattgcaaatcaggcagccattctcatggggcttgataaaggatggcccatctcaaaaatggatataggcgtaccactactagcccttggatgttactctcaagtaaaccccctaacactaacggccgccgtacttatgttggtagcacattatgcaatcatcggtcctggcttacaggctaaagccactcgagaagcgcaaaagcgcaccgccgctggaattatgaagaatccaacggtcgatggaatcgtagcaattgacttagatccagtagtttatgacgcaaaattcgaaaaacaattaggtcaaatcatgcttctaattctatgcacaagtcaaatcctgttgatgaggactacttgggcactatgcgaaagcattactcttgctacgggtcctttgacgacactatgggaaggaagcccgggaaaattttggaatacgacaatagcagtatcaatggctaacatatttagaggtagttatctagcgggtgcaggcctagccttcagtttgatgaaatccttaggtggtggtcgacgtggaacaggagcacagggtgaaacactaggcgaaaaatggaaaagacaattaaatcaattatctaagtcagaatttaatacgtataaaaggtccgggattatggaagttgacaggtctgaggccaaggaaggactgaagcggggagaaacaactaagcacgctgtctctaggggaactgctaaactacgatggttcgtcgaaagaaatctagttaaacctgaagggaaagtaatcgacttaggctgtggaagaggtggctggtcatattattgcgctggattaaagaaagtcaccgaagtcaaagggtatacaaagggaggtccgggtcacgaagaacctatcccaatggccacttatgggtggaatttagtaaaactacattccggaaaagatgtattctttacgccacccgagaaatgtgatactcttctgtgcgatataggtgaaagttcaccaaatccaacaattgaagaagggcgaactctgagagtattaaaaatggtagaaccctggttaaggggaaatcaattttgtatcaagattttaaatccatatatgcctagtgttgtagagactttagaacaaatgcaacggaaacacggaggtatgctagttagaaacccgttaagtcgaaatagtacccacgagatgtattgggtgagttgtggaactggaaacatagtaagtgcagtaaacatgacaagtcgaatgttacttaatagatttacaatggcacataggaagccaacatacgagagagacgtggacttaggagcaggaacaagacacgtagccgtagaaccagaaatagccaacctagacataattggacaacggattgaaaatataaagatcggtcacaaaagcacatggcattacgacgaagataatccctacaagacatgggcttaccacggttcttatgaagtcaaaccatcgggttcagctagtagcatggtcaatggtgtagttaggttgctaactaaaccatgggacgttattcccatggtcacacaaatagctatgacagatacaacgccttttgggcagcagagagtcttcaaagagaaagtagacacaagaacgcctagaccaaaaaggggaacagcacaaataatggaagtaacagccaaatggatgtgggggtttctattcaggaacagaccccctcgaatatgtactcgcgatgaatttgcgcggaaagtcagatcatcaacagcaaatggtgcagtctttgtagatgaaaatcaatggaactcagctaaagaggcagttgaggatgaaagattttgggatctagtacaccgtgaaagagaattacataagcaaggcaagtgcgctacttgtgtatataacatgatgggtaaaagggagaagaaattaggagaatttggcaaggccaagggatcacgtgccatatggtacatgtggctcggagcaagatttctagaatttgaagcgttaggtttcatgaatgaagaccactggttcagccgcgagaactcgctgagcggggttgaaggtgaaggtttgcataaactaggatatatactacgagatatatcaaaaatccctggaggtaacatgtatgcggatgacacagcaggttgggacacaagaattacagaagatgatagttctaatgaagcaaaaatcatagagctcatgagaccggaacatgcattattagctacttcaatatttaaattaacattccaaatttcagtcgttagagtccaaaggccagcaaaaagcggaacagttatggagtgcatatcccgccgtgatcaaaagaggagcggccaggtaggcacatacggattgaatacttttacaaacatggaagtccaattaatccgacagatggaatctgaaggaattttctccccgtccgaaatggagaactcaaatcttgccgaacgggtactagactggttggaaaagcatggggtagaaagactgaaaagaatggcaatatcaggagatgactgcgtagttaagccaactgatgatcgattcgctacagcattgaccgcacttaatgacatgggtaaagtcaggaaagacattccacaatgggaaccatctaagggctggaacgattggcaacaagtaccattttgcagtcaccactttcatcaattaataatgaaggatggacgcgaaatagtagttccgtgtaggaaccaagatgagctagttggccgggcacgggtgtctcagggggctggttggtcacttagagagacagcatgcttggggaaaagttacgcacagatgtggcaattgatgtattttcatcgaagagatcttcgattagcagctaatgccatatgttctgcggttcctgtagattgggtacctacatcacgaacgacatggagtatacatgcgcaccatcaatggatgaccacagaagatatgctatctgtttggaatcgagtttggatagaagaaaatccctggatggaggacaaaactcacgtttcaagttgggaagatgtaccgtatttaggaaaacgtgaggatcaatggtgcgggtccctcattggcttaaccgcaagagccacatgggcgacaaacattcaagtcgcgatcaatcaagtacgacgtttaatcggaaacgaaaactatttagattatatgacatcaatgaaacgctttaaaaatgaaagcgaccccgagggtgctctatggtag

SEQ ID NO: 21158 - RNA, 9879 nt, synthetic construct
  misc_feature 1..9879: note = derived and/or modified CDS sequence (opt6) from DENV-1__GU131887__SS-prME
  source 1..9879: mol_type = other RNA
tctgttaccatgcttctgatgctaatgcctactgcgttggcgttccacctcactacacgaggaggggaaccccacatgattgtttcgaaacaagaacgaggtaaaagtctattgttcaaaacttccgccggcgtaaacatgtgcacccttattgctatggacctcggagaactatgtgaagacaccatgacatacaaatgtcctagaataacagaggctgaacctgacgacgtagactgttggtgtaacgccaccgatacatgggtaacatacgggacatgcagccaaactggagaacatcgtagggataaaagatcggtagcactggcacctcatgtcggattgggcctagaaacaagaacggagacctggatgtcaagtgagggagcatggaaacaaatacaaagagtagaaacttgggcactacgtcaccccggtttcacagttatagcactgtttctggcacatgccataggaacaagtataacccaaaaaggaataatatttatattgttgatgcttgttacaccctcgatggctatgaggtgcgtaggcatcggaagtcgggatttcgtggaaggattatctggtgctacctgggtagacgtcgttcttgaacacggatcatgtgttactaccatggcaaaagataaacctaccctagatatagagttactaaaaacggaggtaactaatccggccatactaagaaaattatgcatagaagcgaaaatatccaacacaactacagactcacgttgcccgacccaaggagaggcaactctagtagaagaacaagatgccaactttgtatgcaggaggacatttgtagatagagggtggggtaacggttgtggactcttcggtaaaggatcattaatcacttgtgctaaatttaaatgcgtaacgaaattggaaggaaaaattgtacaatatgagaacctaaaatactctgtaatagtaaccgtacacacgggggatcaacaccaagtgggaaatgaatccacagaacacggaaccacagcaacaatcactccacaagccccaactacggaaattcaattaacagattacggagcattgaccttagattgttcaccaagaacaggactagattttaatgagatggtcctacttactatgaaagagaaatcatggctggtacacaaacaatggtttcttgatttgcctcttccatggacatctggagcttcaaccagtcaagaaacatggaatagacaagatctattagtcacgtttaaaaccgcacatgcgaagaaacaagaggttgtggtcctaggatcacaggagggagcgatgcatactgcactaacgggggccactgagatccagacgtcaggcaccactacaatctttgcgggacatcttaaatgtcgcttgaaaatggacaaactgacacttaagggaatgtcgtatgtcatgtgtacgggttcattcaaactggaaaaagaagtagctgaaacgcagcatggcacggtcttagtgcaaattcgatatgaaggaacggacgctccgtgtaaaattccgttttctacccaagatgaaagaggagttacacaaaatggtcgattgataacagccaacccaattgttaccgataaagagaaacccgtaaatattgaggcagaacctccgtttggggaaagttatatagtaatcggcgccggagaaaaagcgttaaaactttcctggttcaaaaagggctcctcaatcggaaagatgttcgaagccactgcacgaggagccaggcggatggcaatattaggcgacacggcatgggactttggcagtattgggggtgtttttacaagtgtaggcaaacttgtgcatcaaattttcggtacagcatacggagtactattttctggtgtgagctggactatgaaaatcggcataggtgtactattaacgtggcttggccttaacagtagatcaactagctttagtatgacttgcatagcggtcggcttagttactctatatttaggagtcatggttcaggcagattcgggatgcgtaataaattggaagggaagagaattgaaatgtgggtcaggtatatttgttactaacgaagtacacacatggactgagcagtataaattccaagccgatagtcccaaaagactatccgcagcaatagggaaagcctgggaggaaggagtgtgcggtatcagaagtgcgacaagattagagaacataatgtggaagcaaataagcaatgagctgaatcatatactattagaaaatgatatgaaattcacggttgttgtaggtgacgtcgcaggtattttagcgcaaggaaagaagatgattcgaccacaacctatggaatacaaatatagttggagatcatggggtaaagctaaaatcataggagccgacgtacaaaatacgacatttataatagatgggcctaatacgcccgaatgtcctgacgatcaacgagcatggaacatttgggaagttgaagattatggtttcggcatttttacaacgaacatttggttaaaactcagagacagctatacgcaagtatgtgatcacaggttaatgtcagcggcaataaaagacagcaaagctgttcatgctgacatgggttattggatagaatccgagaaaaatgaaacctggaaattagcgcgtgctagctttatagaagtcaaaacctgcatctggccgaaatcacacacgttgtggagtaacggggtattagaaagtgaaatgataatccctaagatttatggaggccctatcagccagcataactacaggccaggatacttcactcaaacggccggaccctggcacttaggcaaactagagttagatttcgatctgtgtgaaggaactacagtggtagttgatgaacattgcggaaacagaggacccagtttacgaaccacaacagtaacaggtaaaatcattcatgaatggtgttgtcgttcatgtacgctccctccgctgaggtttagaggtgaggacggatgttggtatgggatggagataagaccagtcaaagaaaaggaagaaaatctagtaaaatcgatggtatccgcaggcagcggggaagtagacagtttttcactagggctgctttgtatttccataatgattgaggaagttatgcgttcaaggtggtcacgaaagatgcttatgactggtacactggcggtctttttgttattaataatgggacaattaacttggaacgatttaattcggctctgcataatggtaggcgctaacgcctcagacagaatgggcatgggaacaacatacctagcccttatggccacattcaaaatgcgtcctatgtttgcagtgggtctattattccgcaggctaacaagccgtgaagtacttctattgacaatcggcttgagtttagttgcttcagtagaattgccaaattcgttggaggagttgggcgacggtttggcaatgggtataatgatactgaaactattaacagactttcagagtcaccagctttgggcgactctcctatcgctaacatttatcaagactacattttctcttcactacgcctggaaaacaatggccatggtcttaagtattgtttcactattccccctatgcttaagtacgacatcccaaaagacgacttggttacctgttttgttgggttccctcggatgcaaaccacttacgatgtttcttattgcagaaaataagatatggggaagaagaagctggcccctaaacgagggaataatggcagtaggaatcgtatcgatattactatcaagtcttttgaaaaatgatgtcccactagccggaccgcttattgcgggtggtatgttgattgcatgctacgttataagcgggtcatcagcggacctatcattggaaaaggcggcagaggtttcatgggaggaagaagcagagcacagcggtgcgtcacacaatatattggtagaagtacaagacgatggtacaatgaagattaaggatgaagaaagagatgataccctgacaattttattaaaggcaaccctactagctgtatcaggtgtatatccactatcaataccggccacattgttcgtgtggtacttttggcagaagaagaaacaaaggtccggagttttatgggacacacctagtcctcccgaagtcgaaagggcagttctcgatgacggaatatatagaatcatgcagcgggggctattaggtaggtctcaagtgggcgtaggagtgtttcaggaaaacgtgtttcacactatgtggcatgtaacacgaggtgcagtcctaatgtaccaaggtaaacgattagagccttcttgggcgtcggtcaagaaagatctcatctcctacggagggggatggagattgcaagggtcatggaatacaggggaggaagtccaggtgatcgccgttgaacctggcaaaaacccgaaaaatgtgcagacagcacccggaacctttaaaacgcccgaaggtgaggttggtgcgatagctctagactttaaaccaggaacatctgggtcccctattgtaaaccgcgaaggtaaaatagtcgggctatacggaaatggcgtagttaccacatctggtacatacgtatcagcgatagctcaagccaaagcaagccaagagggacccctgccagaaatagaagatgaagtatttaggaaacgaaatttaacaataatggatctacatccaggctcgggaaaaacccgccgttacttacccgcaattgttagagaagccataaaaagaaaacttcggaccctcatactggctccaacccgagtcgtagcaagtgaaatggcagaagccctcaaagggatgcctatacgctatcaaacgactgctgtaaaatcagaacatacgggcaaggaaatcgttgatttaatgtgccatgctacctttacaatgcgcttattgagtccagtaagagtcccgaattataatatgataataatggatgaggcgcactttacggatccatccagtatcgcagcgagagggtatatatctacaagagtgggcatgggagaggccgcagcaatattcatgacggcaacacctcctggatctgtcgaagcatttccacagagtaatgccgtaatccaggatgaagaaagggatataccagaacgttcttggaatagcggatatgaatggataacggattttcccggaaagaccgtatggttcgtaccctccataaaatctggaaatgatattgcaaactgcttgcgtaaaaatggtaaaagagttatacaactctcaaggaagacatttgacactgaatatcagaagacgaaaaataatgattgggattatgtggtaactacagatatatcagaaatgggcgcaaacttcagagcggacagagtaatagacccaaggcgttgtctgaaacccgtgatactaaaggatggtccagaaagagtaatattagcaggtccaatgcccgtaacagtagcatcagcagcacaacgtcgaggaagaataggtcggaatcacaacaaagaaggagatcaatatatttatatgggccaaccattaaataatgacgaggaccatgcacactggacggaagcaaagatgttactagacaacatcaacacaccggaaggcataatcccggcattgtttgagccggaacgtgaaaaatctgctgcaattgatggtgagtatcgactaagaggagaagcacggaagacgtttgtagaacttatgaggagaggagatctaccagtttggctttcatacaaagtagcaagcgaagggtttcaatatagtgaccgtcgttggtgctttgatggtgaaagaaataatcaggtattggaagaaaatatggatgtagaaatttggacaaaagagggtgaaagaaagaaactgcgacctcgatggctagacgctcgaacatactcagaccctctagcattacgagagtttaaggagtttgccgccggcagaagatcggtatcaggagatttaatactcgaaattggaaaactacctcaacatttaacacaaagggcccaaaacgcactagataacctcgttatgctacataattcagaacaaggtggacgagcatatcgtcacgcaatggaagaacttccagacacaatagagacgttaatgctacttgcactaatagctgccttaacaggtggtgtaacactatttttcctatctggtaggggtttagggaaaacgagtatagggcttctttgtgtaatggcatcgagtgtgctgctatggatggcaagcgttgaaccacactggatagcagctagcataattttagagttctttttaatggtactcttaattccagaaccagacaggcaaaggactcctcaagataaccaattagcgtatgtcgttatcggtttattgtttatgatattaacggtagccgcaaatgaaatggggttacttgaaacaacgaagaaagacttaggaattggacatgtagcggtaggcaatcatcaccatgctgcaatgttagacgttgatttacaccctgcgtcagcatggactttatatgctgtcgccacgacaataataacaccaatgatgcgtcacacgatcgaaaacacgacggcgaacattagtctgacggcaattgctaatcaggcggcaatacttatgggtctcgataaaggatggcctatatcaaagatggatatcggagtgccactgctagccttaggttgctactcacaagtcaacccattaacactgacggcagctgtgctcatgcttgtggctcattatgctatcatagggccgggtctacaagcaaaagcaactcgagaggctcagaaaaggactgcagctggaataatgaaaaatccaacagttgacggcatagtagcaattgacctagatccagtggtatatgatgctaagttcgaaaaacagctaggtcaaataatgttgttgattctatgtacgtctcaaattctgttaatgcgtacaacttgggcgttatgcgaatcaataactttagctacaggacctttgacaacgctctgggaaggaagtccgggcaaattttggaatactaccattgccgtcagcatggcaaacattttccgaggatcgtacctggcaggagcgggattagctttctcgttaatgaaatccctaggcggtggacggcgaggtacaggagcgcaaggtgaaactctaggtgaaaagtggaaaaggcaactaaaccaactatccaaatcagagtttaacacctacaaacgatcgggcataatggaagtagacagatcagaggccaaagaaggactgaaaaggggagaaataacaaaacacgcagtatctcgaggtactgcgaaactacgctggtttgtcgaacgaaatcttgttaagccagaaggtaaagtaatagatttaggctgtggcagaggcgggtggagttactactgtgccggtttaaagaaagtaaccgaagtcaaaggttacactaaaggtggaccgggacatgaagaacctatcccaatggccacttacggctggaatctagtaaaattacattcaggtaaagatgtcttctttgttccacccgaaaaatgcgatacccttttatgcgatataggggaaagttctccaaaccctaccatcgaagaaggacgcacattgagagtgttgaaaatggtagagccgtggttaaggggcaaccagttctgtattaaaattcttaatccctatatgccaagtgttgtcgaaacactggaacaaatgcagagaaaacatggtggtatgttagtaagaaaccctctaagtagaaatagcactcatgaaatgtactgggtttcgtgtggcacagggaacatcgtatcagccgttaacatgacaagtagaatgttattaaataggttcacaatggcccatcgtaaacctacttatgaaagagatgtagatttgggagcaggtacacgtcatgtagcagttgaacctgaggtagcaaatctggacataatcgggcagagaatcgaaaatataaaacatgaacataaatcaacttggcattatgacgaagataacccctataagacatgggcctaccatgggtcatacgaagtcaaaccttccggaagcgcgagtagtatggtaaatggcgtagtaaaactactaacaaagccatgggatgtaattccaatggtaacccagattgccatgacagatactactccgttcggacagcaaagagtttttaaagagaaagtagacacaagaacaccaaaagctaaaagaggcacagctcagataatggaagttacagccaaatggttatggggatttctatccaggaacaagaaaccaagaatttgcaccagagaggaatttactagaaaggtgcgctccaacgcagcaataggagctgtatttgtcgatgagaatcaatggaactctgcaaaggaggcagttgaagacgaaagattctgggacttagtccatcgcgagagagaactccataaacaaggtaaatgcgctacctgtgtatacaacatgatgggtaaaagagagaagaaattgggcgagtttggcaaagctaagggaagcagagctatttggtacatgtggctcggagcaagatttctagaatttgaagcactaggatttatgaacgaagatcattggttcagcagagaaaactcattaagcggagttgagggcgagggcttacataaattaggttatattttaagagatattagtaaaataccagggggtaacatgtacgctgatgatactgcaggatgggacactcgaataaccgaagatgatttacaaaatgaggcccgaataacagatataatggaacccgagcacgccttattggccaagagcattttcaaattaacatatcaaaataaggttgtgagagtacaacgtccagcgaagaatgggacagtaatggatgttataagtcgtcgagaccagagaggaagcgggcaagtaggtacatacggactgaatacatttactaatatggaagcgcaactaatacggcaaatggaatccgaaggtatattttcgccgtcagaattagagacacctaatctagcagaacgagttttagattggctagaaaaatacggcgtagaaagactaaaacgtatggctataagtggtgatgattgcgtagtaaaaccgatcgacgatagattcgcaaccgccttgacggcgctaaacgacatgggaaaagttaggaaagacatcccccagtgggagccttcgaaggggtggaacgactggcagcaagtacctttctgtagtcatcacttccatcagctaataatgaaggacggtagagaaatagtagtgccgtgcagaaatcaagacgagcttgtaggtagggccagagtatcacagggagcaggatggagtctccgagagacagcatgtttaggaaaaagctatgctcaaatgtggcagttaatgtactttcatcgcagagatcttagactagctgccaatgcgatatgtagcgcagttcctgtagactggatccccacaagtcggactacatggtcgatccatgcgcatcaccagtggatgactacagaagatatgctatccgtttggaaccgagtctggatcgaagaaaatccttggatggaagataaaactcacatctctagctggggagacgtaccatacttaggcaaacgcgaggatcaatggtgcggatcactgattggtttgacagcgagagcaacttgggcaacaaatatacaggtagcaatcaaccaagttagaagactaatcggaaatgagaattacctagattacatgacgtctatgaaaagatttaaaaatgaatcagacccagagggtgcactatggtaa

SEQ ID NO: 21159 - RNA, 9879 nt, synthetic construct
  misc_feature 1..9879: note = derived and/or modified CDS sequence (opt6) from DENV-1__GU131888__SS-prME
  source 1..9879: mol_type = other RNA
tcggtaacaatgctcttaatgctaatgccaactgcgcttgcattccatttgactacgaggggaggagaaccacacatgattgttagtaaacaagaaagaggaaaaagcctgttattcaaaacaagcgcaggggtaaacatgtgcacattaatagcaatggacctcggtgaattatgcgaagacactatgacatacaaatgtccacgaataacggaagcggaaccagatgatgttgattgctggtgcaatgcaacagatacatgggtaacatacggaacgtgtagtcaaacaggagaacacaggcgagataaacgcagtgtggcattagcgccgcatgtcgggcttggacttgaaacccgaaccgaaacatggatgtcttcagaatcggcatggaaacaaattcaaagagtagaaacctgggctttacgacatcctggattcacggttattgcactgttcctggcacacgctattgggaccagcataacccaaaaaggaattatttttatattattgatgttggtgacaccaagtatggccatgcgttgtgtaggaataggttcaagagattttgtagaaggattatcgggggctacttgggttgatgtcgtgctcgaacatggatcctgcgtgacgacaatggcgaaagataaaccaacactagatatagaattattgaaaacggaagtaacaaatccagctatactaagaaaactgtgcatagaagcaaaaataagtaacacaacaaccgattcaagatgccctactcagggcgaagcaactctagtggaagaacaagacgcaaacttcgtgtgtagaaggacttttgtagatagaggatggggaaacggttgcggactttttggtaaagggtcactaatcacgtgtgcgaaattcaagtgtgtgactaaacttgaaggaaaaatagttcaatacgaaaatttaaaatattccgttatagtcactgtccatacaggtgaccaacaccaagtaggtaacgaaagcacagaacacggaacaacggccacgataacacctcaagcccctacaacagaaatacaactaacagactacggggcattaacattagattgttcaccaagaaccgggttagatttcaacgaaatggtattattaaccatgaaagagaaaagctggctcgttcacaagcaatggtttctggatctaccactaccatggacctcaggagcgtcaacaagtcaagaaacttggaataggcaagatttactcgtcacttttaaaaccgcacatgccaagaaacaagaagttgtagtattgggatcacaagaaggtgcaatgcacacagcattaactggcgcaacagaaatacaaacatcgggcacaactacgatatttgccggccatttaaaatgccgattaaaaatggataaacttacactaaaagggatgtcatatgtgatgtgtacaggcagctttaaattagaaaaggaagtggcagaaacccagcatgggacagttctggttcagattaagtatgagggcactgatgcgccatgtaaaattcctttcttaacgcaggacgaaaaaggggtcacacaaaatgggcgtctaataaccgcgaaccctatagtaactgataaggagaagccagttaacattgaggcagaacctccatttggggaaagctatatagttataggggctggcgaaaaggctttaaaattatcttggttcaaaaagggatcttctataggcaagatgtttgaggcaaccgcacgaggagctcgtagaatggctatattgggggatacgggttgggactttgggtctataggaggagtatttacttccgtaggaaaattagtccatcaaatctttggtaccgcatatggtgtattgttctcgggtgtatcatggactatgaaaatcggaataggagtacttttgacttggttaggactaaattctcggtccacctcgctctctatgacatgtatcgcagtgggattagttactctatatctaggggttatggtacaagccgacagcggatgtgtaataaactggaaagggagggagcttaaatgtggttctgggatatttgtgacaaatgaagttcatacttggaccgagcaatacaagttccaggcggattcacctaaaagattgtctgctgcaattggtaaagcgtgggaagaaggagtatgtgggatcaggtctgccactagacttgagaacataatgtggaaacagatcagcaacgagctaaaccacattctactggaaaatgacatgaaattcacagtggtggtaggagatgttgcgggcattctagcacagggtaagaaaatgatcagacctcagcccatggaatataaatatagctggaagtcgtggggtaaggcaaaaataatcggagcagacgttcagaacaccaccttcataatcgatggtccgaatacgccagaatgcccggacgaccaaagagcatggaacatatgggaggtcgaggactacggatttgggattttcactacaaatatttggttaaaactcagagatagctacacacaagtatgtgatcacagacttatgagtgcagccataaaggactcaaaagcggtacacgcagacatgggctactggattgaatcagagaaaaacgaaacatggaaattagcaagagcatcatttattgaagtaaagacttgtatatggcctaaatcacacaccctgtggtcaaacggcgttttggaaagcgaaatgataataccgaaaatttacggaggtcctataagtcaacataattatcgcccaggatatttcacacaaacagcggggccctggcatctcggtaaattagaactagatttcgacctatgtgaagggactactgtggtagtggatgaacattgtggtaaccgtggtccctccttgcgaacgactacagtaactggaaagataatacacgaatggtgctgcagatcttgcacattacccccgcttcggtttcgtggagaggacggatgctggtatggaatggaaatccgaccggtaaaagagaaagaagaaaatctagttaaatcaatggtatcagctggttctggagaagtagatagtttttcgctgggattactttgtatatccattatgatcgaagaggtcatgaggagtaggtggagtcgaaaaatgctcatgacaggtacactagctgtcttcttgcttttaatcatggggcaattgacatggaatgatttaatacgtctatgtattatggttggagcaaacgcgagtgatcgaatggggatgggtactacatatcttgcattaatggctacatttaaaatgaggccaatgtttgcagtaggactattatttagacgactgacatcccgcgaggtactattattgacaattggcctcagcctggtggcaagtgtcgaattacctaacagtctagaggaactaggagacgggctcgcaatgggaatcatgatcctcaagttactgacggattttcaatcacatcaattgtgggcaaccttattaagcctcacttttatcaaaactacattctcattgcattacgcatggaaaaccatggctatggtgttaagtatagttagtttattcccgttatgcctgtccacaacgagtcagaaaacaacttggttgccggttttattaggtagtcttggctgtaaacccttgactatgttccttatagctgaaaataagatctggggcagaagatcttggccactaaatgagggaattatggcagtaggaatcgtaagtattctattaagcagcctgttaaagaacgatgtacctttggctggacctttaatagcaggaggtatgttaatcgcatgctacgtcatctccggatcatctgcagatttatccctagaaaaagcagcagaagttagttgggaggaggaggctgaacactcaggggcttcacataacatcttagtggaagtccaagatgatggtccaatgaaaataaaagatgaggaacgtgatgacacactaaccattttattgaaagcaacgttgttagcagtatctggagtttaccccctcagtataccggcgactcttttcgtatggtatttttggcagaagaagaaacagagaagtggggtcttatgggatactccatcaccgcctgaagtagagagggcggttttagatgatggcatatatcgtataatgcagcgaggactcctaggcaggtcacaagtgggtgtaggtgtgtttcaagaaaatgtctttcatactatgtggcacgtgactcgaggtgcagtcttaatgtatcaaggtaaacggctagaaccatcctgggccagcgttaagaaagatctaatcagctacggaggtggttggaggctgcagggaagttggaatacaggagaagaagtacaagtaatagctgtagaaccagggaaaaatcccaaaaacgtacaaactgcacctggaaccttcaaaacaccagaaggagaagtgggcgccatagcactagactttaaaccaggtacatcaggatcacctattgtaaaccgtgaaggtaaaattgtaggcctttacggaaatggagtagtcacaacgtctggaacctatgtcagcgcaatagcacaagctaaagcgagtcaagaaggaccgttaccagaaatagaagacgaggtcttcagaaaaagaaaccttacgatcatggatttacacccaggctcgggtaaaactcgccgatatctacctgccattgtacgggaagcaattaaaagaaaacttcgaacactgattttagcaccaacacgggtggttgcctctgaaatggcagaggctttaaagggaatgccaattcgctaccagacaacggctgttaaaagcgaacacactggtaaagaaatagtcgatctcatgtgtcatgcaacattcacaatgagattgctttcaccagtaagggtgcctaactacaatatgattattatggatgaagcacactttaccgacccttctagcatagctgctcgaggttatatatcaacaagggtcggtatgggagaggcagcagcaatattcatgaccgctactcccccaggatcggtcgaggcttttccgcaaagcaatgcgcttatccaagatgaagaaagagacattccagaaaggtcttggaactctggatacgaatggataactgacttccccggaaaaaccgtatggttcgtaccttccatcaaatcaggtaacgatattgcaaactgtttaaggaaaaatggtaagagagtcatccagctaagtcggaaaacatttgacaccgaataccaaaagaccaaaaataacgactgggattatgtcgttactactgatatctcggaaatgggagcgaacttcagagctgaccgggtaattgatccacgtagatgtcttaaacccgtgatattaaaggacggaccagaacgagtcatactggcaggtcccatgcctgtgacggtagcaagcgcggcacaacgaagaggacggattggaagaaaccacaacaaagagggagaccaatatatttacatgggtcagccattgaataacgatgaagaccacgctcattggacggaagcaaaaatgttacttgacaatattaataccccagaaggtataataccagcactcttcgaaccagaaagagaaaagtcagcagcaatagatggcgaatatagactgagaggagaagccagaaaaacattcgttgaactcatgcgacgtggggacctcccagtttggttaagttacaaagtagcgtctgaaggtttccaatactctgatcgaagatggtgttttgacggggaacgcaataaccaagttctagaggaaaacatggatgtagaaatatggaccaaagagggcgaacgaaagaaactccgaccccgttggttagacgcccgtacatatagtgatccgttggcactgagagagtttaaagagttcgcagcaggcagacggagtgtatcgggagacttaattctggaaatcggaaaattacctcaacatctaactcaaagggcacagaatgccttagataacctcgtcatgttacacaactcggaacagggtggacgagcttaccgacatgccatggaagaactgccagacactatcgaaacactcatgttattggcgttaatagctgtcctcactggaggggtcacactattctttctctccggccggggattaggaaagacgagtattggcctgctatgcgtaatggcatcttcagtgttgctatggatggcatcagtcgaaccacactggatcgcagcctctataatccttgaatttttccttatggtattacttattccagaacctgacagacagcgaacaccacaagacaaccagcttgcatatgtagtgatagggctcctatttatgatcttaacggtcgcagcgaatgagatgggactgttggagacgactaagaaagacctagggataggacatgtagcagtaggaaatcaccaccatgcagcaatgttagatgtcgaccttcacccggcgagtgcttggacactctatgccgttgccacaactattataacacctatgatgagacacacgattgaaaacacaactgctaatatatccctaacagcaatagccaatcaggcagctatcttaatgggacttgacaaaggttggccgatatcaaaaatggatataggagtacccttgctagcgctaggttgctattcacaagtcaacccactaaccctgacagcagcggtgctgatgctggtggcccattacgcaatcataggacccgggcttcaagcgaaagctaccagggaagctcagaaaagaacggcggctggtataatgaagaacccaacggtagatgggatagttgcaatcgacttagacccagtagtatatgatgccaagtttgaaaaacagcttggacaaattatgcttcttatactgtgcacaagccagattttattgatgagaacaacatgggcgctctgtgaaagtataactttggcaactgggccattaacgactctctgggaaggaagtccgggaaaattctggaacacaacgatagccgttagtatggcaaatatatttcgtggatcttatttggctggagccggacttgctttttctttaatgaaatccctcgggggtggaagaagagggactggggcccaaggggaaactcttggtgaaaaatggaaacgccagcttaaccaactttccaagtccgaatttaatacttataaacgatctggaattatggaagtagatagatccgaggcgaaggaaggtctaaagagaggcgagacaaccaagcacgctgtaagcaggggtacagcaaaattgagatggtttgtagaacggaacttagttaaaccggaagggaaagtaattgatctagggtgcggccggggagggtggagttactattgcgcgggactaaagaaagttacagaagttaaagggtatacgaaaggagggcccggacatgaagaaccaattccgatggctacatatggatggaatctcgtgaaattacacagcggtaaagatgtgttctttatccctccagaaaaatgcgatacattattatgtgacataggggagagcagcccgaatccaacgattgaggaaggaagaactctaagagttttgaagatggtcgaaccatggttaagaggtaatcaattctgcatcaaaatactaaacccgtatatgccctcagtagtagagacattagagcagatgcagaggaaacatggcggcatgttagttaggaatcccctatcgcggaatagcacacatgagatgtactgggtgtcctgtggcactggaaacattgtatccgcggttaatatgacgagcagaatgcttctaaacagattcacgatggcgcatcgtaaaccaacatacgaacgggatgtagacttaggagccgggactcgccatgtcgctgtggaaccggaagtagcgaatttagacataatcggccaaaggattgaaaatattaaacacgaacacaagagcacatggcattacgatgaagataacccatataagacatgggcataccacggatcatacgaggtaaaaccttcaggatccgcatcttcaatggtgaatggggtagtgaaattattaacaaaaccctgggatgttatcccaatggtaacacagatagcgatgacggacaccacaccatttggtcaacaacgggtgtttaaggagaaagtggacacgagaacgcctaaagcaaagagaggaactgcgcaaattatggaagttactgcgaaatggctgtgggggtttttgtcaagaaacaagaaacccagaatatgtacgagggaagaatttactcgcaaagtccggagcaatgcggccattggtgcagtcttcgtagacgaaaatcaatggaactctgctaaggaagcagtagaagatgagcgcttctgggatctagtacatagggagcgagaattacataagcaaggcaagtgtgcaacctgtgtatacaatatgatgggcaaacgagagaagaaattaggagagttcggcaaagcaaaaggatcaagagcaatatggtatatgtggttaggggcacggtttttagagttcgaagctcttggatttatgaacgaagatcattggttttcacgagaaaattcactaagcggggtggaaggcgaagggctacataaacttggatatatattaagagacatcagtaaaattcctggtggtaatatgtacgcggatgatactgcaggatgggacacgcgtataactgaagacgatctacaaaacgaagctaggataactgacattatggaaccagaacatgctttattagcaaaaagtattttcaaattaacctaccagaacaaagtggtcagagtacaaaggccagccaaaaatggaacggttatggatgtcatatcacgacgagaccagcgaggcagtggccaggtaggtacatatggtcttaacacgttcacaaatatggaagctcagttgataagacaaatggaatctgagggaatcttttcaccatcagaacttgaaactcctaacctagcagaaagggtcttagactggttagagaaatacggagtcgaaagattgaaaagaatggcaatctctggcgacgactgtgtggttaaacccatagacgatagatttgcaacagcgctgaccgcgttaaacgatatgggaaaagtcagaaaagacatacctcaatgggaaccttccaaaggatggaacgattggcaacaagtgccgttttgtagtcatcattttcatcaattaataatgaaggatggaagagaaatagtagttccctgtagaaaccaagacgagctagtagggcgcgccagagtttcacaaggagctggctggtcattacgagagaccgcttgtttaggaaaatcttacgcacaaatgtggcaactcatgtattttcatagaagggatttacgactcgcagctaacgcaatatgcagtgctgtacctgtagactggattccaacttctagaactacttggagtatacacgcgcatcatcagtggatgacgaccgaagatatgttatcagtctggaatcgagtatggattgaggaaaatccctggatggaggataaaacacatattagttcatggggagacgtaccgtatttagggaaaagagaagaccagtggtgtggctcgttaatagggttaaccgctagagcaacatgggccacgaacatccaagttgctattaaccaagtcagaagattgattggtaatgaaaactatttggactacatgacaagtatgaaacggttcaagaacgagtcagatcccgagggagccctatggtaa

SEQ ID NO: 21160 - RNA, 9879 nt, synthetic construct
  misc_feature 1..9879: note = derived and/or modified CDS sequence (opt6) from DENV-1__GU131892__SS-prME
  source 1..9879: mol_type = other RNA
agcgtaaccatgttgttaatgcttatgccgactgcgctagcattccacttaaccactcggggaggagaaccgcacatgatagtgtcgaaacaagaacggggtaaatcgctactgttcaaaacatcggctggcgtcaatatgtgcaccttaatagcaatggatctgggggaattatgtgaagatacaatgacttataaatgtccgagaataactgaagcagaacctgatgatgtagactgttggtgtaacgctacggacacgtgggtaacctatgggacatgttctcaaactggtgaacatagaagggacaaaaggagcgttgctcttgcgccgcatgttgggctaggattggaaacgagaactgaaacttggatgtctagcgaaggcgcatggaaacaaattcaaagggtggaaacttgggctcttagacacccaggatttacagtaattgcattatttttggcacatgcaataggaaccagcatcactcaaaaaggaataatatttattctgttaatgctagtcacaccatccatggcaatgagatgtgtgggaattggatccagagatttcgttgaaggactttctggggcaacatgggtagacgtggtgcttgaacatggcagctgtgtaacgaccatggcaaaagataaaccaactttggacatagaattattgaaaaccgaagtaactaatccagcaatactgcgaaaactgtgcattgaagcaaaaatatccaatactacgacagactcacgttgtccaacccaaggagaagcaactttagttgaggaacaagatgctaactttgtatgtagacgaacctttgttgatcgaggctggggtaacggttgcggcctattcggcaaaggttcgcttataacatgtgccaaattcaaatgcgttactaaactggaaggcaaaattgtgcaatacgagaatttgaaatacagtgtaattgtaacagttcatacaggggatcaacaccaagtagggaatgaatcaactgagcatggtacaactgcgactattacccctcaagcaccgacaacggagatacaactaaccgactatggagcgttaactctagactgctcaccgagaaccggtcttgattttaatgaaatggtactactcacaatgaaagaaaaatcgtggctcgtacacaaacaatggtttttggacttgccactgccatggacgtccggagcaagtacgagtcaagaaacttggaacagacaagaccttctcgttacatttaaaactgcacacgccaagaaacaagaggttgtcgtcttgggttcccaagaaggagctatgcatacagcgttgacaggtgctacggaaatacaaactagcggaaccacaacaatattcgcgggtcacctcaaatgcagacttaaaatggataaactgacattaaaaggaatgtcatatgtaatgtgcacgggatcttttaaattggaaaaagaagtcgcagaaacacaacacggcaccgtattagtccaaataaaatatgaggggactgacgcgccttgtaaaataccattcagtacgcaggatgaaaaaggtgtaacacagaatggacgtttaattacagcaaatccaatagtaactgataaagaaaaacctgtaaacattgaggctgaaccgccatttggcgaaagttatatcgtaattggtgcaggagaaaaagccctgaaactatcgtggtttaagaaaggttcctccataggaaagatgttcgaagctactgctcgtggagcacgacgtatggccattctaggagacacggcgtgggactttgggagtataggcggcgttttcacatcggtggggaagttagtacaccagatattcggcacagcttatggagtactcttcagcggtgttagctggaccatgaaaatcggtataggtgttcttttaacatggttagggctaaattccagatccacctccctatcaatgacctgtatagcagtaggcttagtaactttgtatttaggagtcatggttcaagccgattccggatgcgttattaattggaaaggaagagagcttaaatgtggaagtggaattttcgtaactaatgaggttcacacctggactgaacaatataaatttcaggcagatagccccaagcgattatcagccgcaattggtaaagcctgggaggagggtgtctgtggaattaggtctgccaccaggctcgaaaatatcatgtggaaacaaatatctaatgaattaaatcacatcctattagaaaatgacatgaagtttacagttgtcgtcggcgacgtagcaggaatcctagtgcaaggcaagaagatgatacgaccacagcccatggaatataaatattcttggaaatcatggggaaaagcgaaaataataggagcagacgtacagaacacaactttcattattgacggtccaaacactcctgagtgtccagacgaccaaagagcttggaacatatgggaagtagaagactacggtttcggaatatttacaactaacatctggttaaaattaagagactcctacactcaagtatgtgatcacaggttgatgtccgcggcgataaaggattcaaaagcagtacatgcagacatgggctattggatcgaatcagagaaaaacgaaacctggaaactcgcaagagccagctttattgaagtcaaaacctgcatctggcctaaaagccatacattgtggtccaacggagtacttgaatccgagatgataatcccaaaaatttatggtggcccaatatcacaacataactatagacctggatacttcactcagacagctggaccatggcacctcggaaaactagaactagacttcgatttgtgtgaagggaccacagtagtagtagatgagcactgtggcaacagaggcccatctctcagaacaacaactgtaactggaaaaatcatacatgaatggtgctgtcgttcttgcactctacctccactgaggtttcgcggagaggatggttgttggtatggtatggaaataagacccgtgaaggagaaggaagaaaacctagtcaaatctatggttagtgcagggagtggagaagtagattcgttctctctaggcctcctatgtatttccattatgatagaagaagtaatgaggtcaagatggtctcgaaaaatgttaatgaccggaacactggccgtcttcttactattgataatgggacagttaacttggaatgacttaatacgtctatgtataatggtaggagcaaatgcttcagaccgcatgggaatgggaacgacgtatctggctcttatggcaacatttaaaatgcgacccatgtttgcagtgggattgttatttcgccgactgacaagcagagaagtactactgttgacaataggactctcactcgttgctagtgttgaattaccaaattcattggaagaactaggagatggacttgcaatgggtataatgatacttaaattgcttacagattttcaaagtcatcaactatgggcgacactcttgagccttacttttataaagacgacattctcacttcactatgcatggaaaacaatggccatggtattaagtattgtatcactatttccactctgcctcagtacaacaagtcagaaaacaacctggctaccagttctgttaggatcactgggctgcaagcccctaactatgtttctaatagcagaaaacaagatatggggaagacgatcatggccacttaatgaaggtatcatggcagttggcatagtctcaattctcttgtctagcctgctaaagaacgacgtaccattagcagggccattaatcgctgggggaatgcttatcgcttgttatgtgatttctggctccagcgctgatctcagtttagaaaaagccgcagaagtatcctgggaagaggaggcagaacacagcggtgctagtcataatattttagtagaggtccaggatgatggtacgatgaaaataaaggatgaagaacgggatgatacattaactattctattaaaagcaacattgttagccgtttctggagtttatcccttatccataccggcgacattattcgtatggtacttttggcagaagaagaaacaaagaagtggagtattatgggacacaccatcaccaccagaagtagaacgggcggttctagatgatgggatttataggataatgcagcgaggattactaggaagaagtcaagtcggggttggagtctttcaagaaaatgtatttcatactatgtggcatgtgacacgaggagccgtattgatgtatcagggtaaacgtctagaaccgagttgggcgagcgttaagaaagatttaatatcgtatggtgggggatggagattacaaggttcttggaacactggtgaagaagtccaagttatcgccgtagaaccagggaaaaatcccaaaaatgtacagacagctccaggtacattcaaaaccccagaaggagaagtcggagccatcgcgctggacttcaagccaggaaccagtggatctcctatcgttaatcgagaaggaaaaattgtcgggctctatggaaatggagttgttacaaccagtggaacatacgtcagcgcgatagcgcaggcaaaagcaagccaggaaggaccgctaccagaaatcgaagacgaggtgtttcgcaaaagaaacttaaccataatggacctccacccgggtagcggaaagacaagacgctacttacctgcaattgtccgcgaagctattaagcggaagctacgcactctaatcctagcaccaacccgcgttgtagcatctgaaatggctgaagcactcaagggtatgccaattcgttatcaaacaactgcagtaaaaagtgaacatactgggaaagaaatagtggatttgatgtgtcatgcaacatttacaatgaggctactgagtccagtccgagtaccaaattacaatatgattataatggacgaagcgcattttacggatccttcgtctatagcagcgaggggatatatatctacgcgagtaggaatgggagaagcggcagcaatatttatgaccgcaactcctcccggttcagtagaagcatttccccaatctaatgcagtaatccaggacgaagaaagggatatccccgagagaagttggaatagtggatatgaatggataacagatttccccggaaaaacagtatggttcgtcccttcaattaagagtggaaacgacatagcaaattgcttaagaaagaacggcaaacgagtaatccaactttccagaaaaacgttcgatacggaatatcagaaaaccaaaaataacgactgggactacgtggtaacgacagatatatctgaaatgggtgcaaattttagggctgacagagttatagacccccgccgatgcctaaaaccagtgattctgaaagacggtccagagagagtaatactggcgggtccgatgccagttacggtagctagtgcggcgcaacgaagagggcggattggccggaatcacaataaggaaggtgaccaatacatatatatgggccaacctttaaataatgacgaggaccatgcacactggacagaagcgaaaatgttactcgacaacattaatacacctgaaggaataatacctgctctatttgagcctgaaagggaaaagagcgccgctattgatggtgaatataggctccggggagaagcaagaaagacattcgtcgaactaatgcgaagaggtgatcttccagtttggctgtcgtataaagtagcaagtgaagggtttcaatactcagatcgaaggtggtgtttcgatggagagcggaataaccaagtacttgaagaaaatatggacgtagaaatttggaccaaagaaggagaaaggaagaaattaaggccacggtggttagatgcaagaacttactcggatcctcttgcattaagagaatttaaagaatttgcagccggacgcagatctgtatctggcgatctaatcctagaaattggcaaattaccgcaacatcttacgcagagagcacaaaacgcgctcgataatctagtaatgctacacaattcggaacaaggaggcagagcgtatagacacgcaatggaggaattaccagacacaatagaaacgctaatgttgttagcacttattgccgttctaacaggaggagtaacattatttttccttagtggacgaggtcttggaaaaacatctattggcttattgtgcgttatggctagctccgtcttactatggatggcatcagttgagccacactggatagccgcaagtataatcctagagttcttcttgatggtactattgatacccgaacctgaccgccaaaggacaccacaagacaatcaactagcatatgtagttattggcctactatttatgatactaacagtcgcagctaatgaaatgggattacttgaaacaactaagaaagatttaggaatcgggcatgtggcagtaggcaaccatcatcacgctgcgatgctcgatgttgacctacatcctgcctcagcttggacgttatatgcagtagcaactactataattactccaatgatgcgacatacaattgaaaatacgacagcaaatattagtcttacagcgatagctaatcaagctgcaatattaatgggcctagataaaggttggcctatctctaagatggatattggagttcctctactagcattaggatgctacagtcaggtgaatccgctaacacttacggccgctgtactaatgttagttgcacattacgctattattgggccaggacttcaggcgaaagctactagagaagctcagaaaagaacagcagctggaattatgaagaaccctaccgtagacggtattgtcgcaatagatctggaccctgtagtgtatgacgcgaaatttgaaaaacaactaggtcaaatcatgttattgatcttatgcacatcacagatacttttgatgcgaactacttgggctctttgtgaatccatcacattagcgacgggaccactgacaacgttatgggaaggatcgccgggaaaattctggaacacaactattgcagtctctatggctaatatattccggggatcatatctcgctggagctggactcgcgttcagtttaatgaaaagtctagggggcggcaggcgtgggacgggtgcgcaaggcgagactttaggcgaaaagtggaagcgccagttaaatcagttgagtaaatctgaatttaatacctacaaaagaagtggaataatggaagtggaccgtagtgaggctaaagagggcctaaaaagaggtgaaacaactaaacatgcagtatcacgagggacagcgaaacttaggtggttcgtagagcgtaatcttgtgaaacccgagggtaaagtaattgacttaggatgcggcagaggaggttggtcttactattgcgcgggactgaagaaagtaactgaagtaaaaggttacacaaagggcggtccaggtcatgaggagccgattccaatggcgacatatggctggaatctcgtgaaacttcatagcggtaaagatgtgttctttatcccacctgaaaaatgcgatactcttctgtgtgatattggagagtctagtccaaacccaaccatagaagaaggaagaacattgcgtgttttaaaaatggtagaaccatggctacgagggaatcagttttgtataaagatcttgaatccgtatatgccgagcgtggtggaaacgctggaacagatgcaacgtaaacatggcggtatgttagtacggaaccctctgagcaggaactcaacgcatgagatgtattgggtcagctgtgggactggaaacattgtcagtgcggtaaacatgacatctaggatgctgttaaaccgctttacgatggcgcaccgcaaacctacgtatgaaagagatgtagacttaggtgcgggaacacgccacgtagcagtagaacctgaagttgctaatttggatattatcggtcaaagaatagaaaatattaagcatgaacataaatcaacatggcactacgatgaggacaacccatacaagacttgggcatatcacgggagttatgaggtaaaaccgagtggcagtgcctcgtccatggtgaatggtgttgtcaagctcctgacgaaaccatgggacgtaatcccgatggtaacacagatagcaatgactgatacgacgcctttcggccaacaacgagtattcaaggaaaaagtagacactcgcactccaaaggctaaacgtggcaccgcgcaaattatggaggtaacagcaaagtggctatggggctttttgtctagaaacaagaaacctagaatatgtacaagggaggaatttacgcgaaaagtacggtccaacgctgccattggagcggtgttcgtagatgaaaatcagtggaactcagcaaaagaagccgttgaagacgaaaggttttgggatctcgtccatcgagagagggaattacacaagcaaggaaaatgcgcaacttgtgtttacaatatgatgggtaaaagagagaagaaactcggtgagtttggaaaagcaaagggatcaagagcaatttggtatatgtggctaggagcgcgattcttagagttcgaagcactaggatttatgaatgaagatcattggttttctcgtgaaaacagtctttcaggtgtggaaggggaaggtcttcataaactaggatatattctcagagacattagtaaaatacctggaggtaatatgtacgctgatgatacggctggctgggatacgcgtataactgaagacgacttacagaatgaggcacggataacagatataatggaaccagaacatgcactattagcaaaatcaatatttaaactgacataccaaaacaaagtcgtaagagtacaacggccagcgaagaacggcacagtcatggatgtaatatcacggcgtgaccaaagaggctcaggccaagttggaacttacggattgaatacgttcactaacatggaggctcagttgatcagacaaatggaaagtgaaggaatattctccccctctgaactagaaacccccaacctggcagaacgggttttagactggttagaaaaatatggcgttgagagattaaagcgcatggcaatcagcggcgacgattgtgtcgtgaaacctatagacgacaggtttgccacagctctaactgcactaaatgatatgggaaaagtacgtaaagatatacctcaatgggaaccatcgaaagggtggaatgactggcaacaagtcccgttctgttctcatcattttcatcaacttataatgaaagacggtcgtgagatagtggtgccatgcagaaatcaagatgagctagtagggagggcgagggtttcacaaggagctggctggagtttaagagaaactgcttgtttaggaaaaagctacgcgcaaatgtggcaattgatgtatttccacagaagagacttaaggctggctgcaaacgcaatttgttcggcagtaccagtcgattggattccaacatcgaggacgacctggagcatacacgctcaccatcaatggatgacaacggaagacatgttgtccgtatggaatagagtttggattgaagaaaatccatggatggaagataaaacgcacataagttcatggggagacgttccatacttgggtaaacgcgaagaccaatggtgcggaagtcttatcggattaactgcgcgcgccacttgggccaccaatatacaggtcgctataaatcaagtaagacggctaatcggcaatgaaaactatttagactacatgacatctatgaagcgatttaaaaacgaatctgaccctgagggagccttatggtaa

SEQ ID NO: 21161 - RNA, 9879 nt, synthetic construct
  misc_feature 1..9879: note = derived and/or modified CDS sequence (opt6) from DENV-1__GU131893__SS-prME
  source 1..9879: mol_type = other RNA
tccgtcactatgctacttatgcttatgccgaccgctttggcgtttcacctaacaacaaggggtggagaaccacatatgatagtgtctaaacaagaacgtggaaaatccctactatttaaaacgagtgcaggcgtaaatatgtgcacattgattgcaatggacttaggcgagttatgtgaagataccatgacttacaaatgtccgaggataaccgaagcggagccggatgatgttgactgctggtgcaatgcaactgatacttgggtaacttacggcacgtgcagccaaacaggggagcatcgacgggataaacggagcgtggcattggccccgcacgttggtctaggacttgaaacacgcacggagacctggatgagtagtgagggcgcatggaaacaaattcaacgcgtagaaacatgggcacttaggcatccaggatttacagtgattgcgttattccttgcccatgcaataggcacatccattactcagaaaggcattatcttcatactgttgatgctagtcacgccttcaatggctatgagatgcgttggaatcggaagtcgtgactttgtagaaggattatcgggtgccacgtgggtagacgtagtcctcgagcacggaagttgtgttacgacaatggcaaaagataaacctaccttggatattgaacttctcaaaaccgaggtaaccaacccggccatcttgagaaaactttgtatcgaggcgaaaatatccaatactaccacagacagtagatgtccaacacaaggcgaggcaactctagtagaggaacaagatgcaaatttcgtgtgccgccgcacttttgtcgacagaggttggggcaatggatgtggtctctttggtaaaggatctttaatgacgtgcgcgaaatttaaatgtgtcacaaaattagaagggaaaatagtacaatacgaaaatctcaaatattccgtcatagtgactgtgcataccggcgaccagcatcaagtggggaacgaatcaactgagcatggcacaacagcaacaatcactccacaagctcctactaccgaaattcaactgacagattacggcgcactgacactagattgtagtcccagaacaggactagactttaatgagatggttttactgacaatgaaagaaaaatcttggttagtacataaacaatggttccttgatcttcccttaccttggacaagtggcgcaagtaccagtcaagaaacttggaaccgccaggacttattagtgacttttaaaaccgcacatgcaaagaaacaagaagtagtggtattgggaagtcaggagggtgcaatgcatacggcattgacaggtgcgacagaaatacagacctctggaacaacaactatattcgcagggcatttaaaatgtcgactcaaaatggacaaactaacattaaagggtatgtcatatgtaatgtgtactggatcatttaagttagagaaagaagtagctgaaactcaacacgggacggtccttgtacagataaaatatgaaggtacagatgctccctgcaaaatacctttctctactcaggacgaaaaaggagcaacgcaaaacggtcgcctaatcactgctaatcctatcgtaaccgataaggaaaaacccgtgaatattgaagctgaaccaccctttggagaatcttatattgtaataggcgctggagaaaaagctctaaaattgtcatggtttaagaaaggaagcagcataggaaaaatgtttgaagctacggcaagaggagcgaggcgaatggcaattttgggcgatacggcttgggatttcggatcaattggaggagtatttacatctgtgggaaagctagttcatcaaatattcggtacagcatatggagtattatttagcggagtatcttggaccatgaaaattggtcttggtgtccttttaacgtggctaggactaaattcacgatctacttccctaagtatgacatgcatagcagttggactcgtaacgttatacttgggagtaatggtccaagcagacagtggttgtgttattaattggaaaggtagagaacttaagtgcggtagcggtatcttcgtaactaatgaagtacatacatggacagaacaatataaatttcaagctgatagtccaaaacgtctttcagcagcaatcggtaaagcatgggaggagggagtatgcggtattagatcagcaacaagattagaaaatattatgtggaagcaaatatccaacgaattaaaccatattctattagaaaacgatatgaaatttacggtagtagtaggtgacgtggcagggatactagcacagggaaagaaaatgataagaccacaaccaatggagtataaatacagttggaaaagttggggaaaagcaaaaatcatcggggctgatgttcaaaataccacattcattatcgatggtccaaatacacccgagtgcccagatgaccaacgggcatggaatatatgggaagtcgaagattatggttttggaatatttaccacaaatatatggttgaaactcagagacagtcacacccaggtctgcgatcaccgtttgatgtctgcggctataaaagatagcaaagccgtccatgctgacatgggttattggattgagtccgagaagaacgaaacttggaagctagctagggcgagttttatcgaggtaaaaacctgtatatggcccaaatcccatactttgtggtctaacggggtattggaaagcgaaatgatcatacctaaaatttatggtggtcctatttcgcaacataattacagaccaggttacttcacacaaacagccggaccttggcatcttggtaaactagaattggacttcgatctgtgtgaaggaactacggtagtagtagatgagcattgtggcaatagaggccccagcttgcggacaacaactgttacaggaaagattatccatgaatggtgctgcagaagttgcactctaccgcctttacgtttccgaggagaagatggctgctggtacgggatggagataagaccagttaaagagaaagaggagaatctggttaaaagcatggtatcagcaggctccggtgaagttgatagtttttcattaggtctgttgtgcatatcaataatgatagaagaggttatgcgctctcggtggagtagaaagatgctcatgacaggtacattggccgtctttctccttttaattatgggtcaacttacatggaatgatttaataagactttgcattatggtcggcgcaaacgcttctgacagaatgggcatgggcacaacctatcttgcattaatggcgacatttaaaatgaggccaatgtttgctgtaggattgttatttagacggttgaccagtcgggaagtcctacttcttacaataggtctgagtttggtggcaagtgtcgaattgcctaacagtttagaggaactaggtgatggattagcaatgggaatcatgatcctaaaacttctaacagatttccagagtcatcagctttgggccacgcttctaagcctcacattcattaaaacaacattctcattacattatgcctggaagactatggcaatggtcttgagtattgtcagcctatttccactatgcttaagtactacaagtcagaaaaccacctggctaccggtcttgctaggttctctagggtgcaagcctttgaccatgttccttatagcggaaaataaaatatggggcagacgatcatggcccctcaatgaagggatcatggctgtgggaatagttagtatactattatctagcttacttaaaaatgatgttccattagctggcccattaatcgctggtgggatgttaatagcgtgttatgtgatcagcggtagctctgctgaccttagccttgaaaaagctgcagaggtatcttgggaggaagaagcagaacactcaggagcctcgcataatattctcgtagaggtacaagatgacggaactatgaaaattaaagatgaagagagagatgacactctaacgatattactaaaggcaacactccttgctgtttcaggagtttatcctctatctataccagccacgttatttgtatggtatttttggcagaagaagaaacaacgtagtggagtcctatgggatactccaagccctccagaagtagaaagggcagtattagacgatggcatataccgtattatgcagcgaggtttattaggccgatcacaggtgggagtaggtgttttccaggagaatgttttccacacaatgtggcatgtcacacggggcgctgtgttaatgtatcaaggtaaaaggttagaaccgtcatgggcgagtgttaagaaagatttgatcagttacggaggaggctggagattacaagggtcgtggaatacaggtgaagaggtacaagtcatagctgtagaacctggtaagaacccaaagaatgttcaaactgcccccggcacattcaaaacaccagaaggagaagtgggtgctattgcgttggattttaagccaggcacaagtggcagccctatagtcaaccgagaaggaaaaattgtaggattatacggtaatggggtagtaacgacttctggaacctacgttagtgcaattgcacaggcgaaagcaagccaagaaggcccgttaccagagatagaagacgaggtatttaggaagcgaaatttaactataatggatttacatccaggttctggtaaaacgcgtaggtatttgcctgccatagtaagagaagcaatcaaacgaaaattaagaacactaattttagcccccacaagggttgtagcatccgaaatggcggaggcattgaagggaatgcctatcagatatcaaacaacagccgtgaaaagtgagcacaccggtaaggaaatcgtagacttaatgtgtcatgccacctttacgatgagattgttatctcctgtcagagtgccaaattacaacatgataattatggatgaagcacattttacggacccgtctagtatagcagccaggggctatataagcacacgggtaggcatgggtgaagcagccgctatatttatgactgcgacccctccgggaagtgtagaggcttttcctcaaagtaatgccgttatacaagacgaggaaagggatatacctgaaagaagctggaatagtggatacgaatggataaccgacttccccggcaaaactgtttggttcgtgccatctataaagagtggaaatgatatagctaactgccttcgtaaaaatggaaagcgagtcattcaactctcacggaaaacatttgatacggaataccagaaaactaaaaacaacgattgggattatgtcgtcacaacggatatatcagaaatgggtgcaaattttcgggcggatagagttatagatccgcgtagatgcttaaagcctgtaatactaaaagacggaccggaacgagttatactagcagggccaatgccagtcacagtagctagcgcggcacaacggcgcggacgaattggtcgatcacacaataaggaaggagatcaatatatttatatgggtcaacctctgaacaacgatgaagaccacgcccattggaccgaagccaagatgttattggataacattaatacgccagaagggatcattcccgcattatttgaacccgagcgagagaaaagtgctgcgatagatggagaatacagactaagaggcgaagcgcgaaaaaccttcgtggaactaatgagaagaggagatttgcctgtgtggttatcgtacaaagttgcctcggagggatttcaatactcggatagaaggtggtgctttgacggagaaagaaacaatcaggtactagaagagaatatggatgtagaaatttggactaaagagggagaaagaaagaaattgcgaccccgatggctagatgctagaacttactcagatccattagcgttgagagaatttaaagagtttgctgccggacgacgaagcgtttctggagatttaatattagaaatcggcaagctaccccaacacctaacacagagagctcaaaacgctctagataaccttgttatgcttcacaattctgaacaaggaggacgtgcttatagacatgctatggaagaactaccagatactatcgaaaccttaatgttattagccttaatcgcggtgttgacgggaggagttacacttttcttcctatcaggaagaggattaggaaaaacatcaatcggattgttatgcgttatggcgtcttccgtattgttatggatggcatcagtagaaccacattggattgcagcttcgatcatactagagtttttcctcatggtactgctaattccagagcctgatcgccagcgaacgccacaagataatcaattagcttacgttgtaattggtttactgtttatgatcctaactgtagctgctaatgaaatgggattattagaaaccacgaagaaggacttaggtataggtcatgttgcagtagggaaccaccatcacgccgctatgttggatgtggatcttcatccagcctcggcctggacattatatgccgtcgcaactacgataataacacctatgatgaggcatacaattgagaatacaactgcgaacattagccttacagctattgcaaatcaagccgccattctaatgggtttagataaaggttggcccatctccaagatggacattggggtcccactcctcgctttagggtgttattcacaagtaaatcctctaactttgactgccgcagtcttgatgctagttgcgcactacgctataatcggtcctggattgcaagcaaaagctacgcgagaagcgcaaaaacgtaccgccgccggtatcatgaaaaacccaaccgttgatggtatcgtagcaattgacttagacccagtagtatacgatgcaaaatttgaaaaacaattaggacaaattatgttacttattctttgtacttcccagattctattaatgcgcacaacttgggcgttatgcgaaagcattacattagcgaccggacctcttacaacgctttgggagggatctccaggaaaattctggaatacaacaatagcagtttctatggcaaatatctttagagggagttacctggcgggagcgggattggcattttcgctaatgaagtcattaggtggaggacgaagaggtacaggagcacaaggggaaaccttaggagagaaatggaaaagacaactaaatcaattatcgaaatctgaatttaatacctacaaaagatcaggcataatggaagtagatcgatctgaagcaaaggaaggcctcaaaagaggcgaaacaacaaaacacgcagtgagcagaggaactgccaaattgcgatggtttgtcgagcgcaatttagtcaaaccagaaggaaaagttatagacctcgggtgtggcagaggcgggtggtcttactattgtgcaggcctcaagaaagtaaccgaggtaaagggctacacaaaagggggccccggacatgaggaaccaataccaatggcaacatatggctggaaccttgtaaagctccactcgggtaaggatgtgtttttcattccacctgaaaaatgtgatacattactctgtgatataggggagtcaagtcccaatccgacgatcgaagagggaaggacattgagagtactaaaaatggtagaaccttggcttagaggaaaccaattctgtataaaaatcttaaatccatacatgccatccgtggttgaaaccctggaacaaatgcaacgaaagcacggagggatgctagtacgcaatcccttatccagaaatagcacccacgaaatgtattgggtttcttgtggaactggtaacatagtgagtgcggtgaatatgacatcaagaatgttgctgaatcgtttcacaatggcccacagaaaaccaacatatgaacgggatgttgatttaggcgcggggacgcgtcatgtagcggtagaaccagaagtcgccaatcttgacattataggtcaacgaatagagaatataaaacatgaacataaatcaacatggcactatgatgaagacaatccgtacaaaacttgggcataccatggatcttacgaagttaaaccaagcggttcagcctcctcgatggtaaacggagtagtcaaactcctaacaaagccatgggacgtaatccctatggttacacaaatcgctatgactgatacaactccgtttggacaacaacgtgtctttaaagaaaaagtcgatacaaggactccgaaagcaaaacgtggaactgcacagataatggaagtgaccgcaaaatggctatggggttttctgagtcgaaacaagaaacctagaatatgtacgagagaggaatttacaagaaaggtacgttcaaatgctgcaataggagctgtcttcgtggatgaaaaccagtggaactctgccaaagaagcagtcgaggatgaacgattctgggatttagtccatagagaaagggaattacataagcaaggaaagtgtgctacgtgtgtgtacaacatgatgggaaaaagagagaagaaactaggagaatttggcaaagcaaagggaagcagagcaatatggtatatgtggttaggcgcacgattccttgagtttgaggctctaggattcatgaacgaagaccattggttttcaagagaaaacagcctgagtggggtagagggagaaggcttacacaaattaggctacatattaagagacatttccaagataccaggaggaaatatgtacgcggatgatacagcaggctgggacaccagaattacagaggacgatcttcagaacgaagcgaggatcactgatataatggaaccagaacacgcacttctagcgaaatcaatattcaaactcacctatcaaaataaggttgtccgggttcaaagacccgcgaaaaacggcactgtcatggatgtcataagtcgacgggatcaaagaggatcaggccaagtaggaacatacgggcttaacacatttactaatatggaagctcaactaatacgacaaatggaaagtgaaggaattttctctccctcagaactcgaaacccctaatctcgcagaaagagtacttgtatggctagaaaaatatggtgttgaacgtttaaaaagaatggcgataagcggtgatgattgcgtagtcaagccaatagacgacagatttgctactgcccttactgctctaaacgatatgggaaaggtacgaaaagatatacctcagtgggaaccaagtaaaggctggaacgattggcaacaggtacccttttgctcacatcacttccaccagctgattatgaaagatggtcgagagatagtagtaccatgccgaaaccaagatgaactcgtaggccgtgcaagggtctcacaaggagcaggatggagtttgcgtgagacagcatgtctagggaaaagctatgcccagatgtggcaacttatgtattttcatagacgagatctgaggttagcagctaatgctatctgttctgcagttcccgtagattggataccaacttccaggactacgtggagtattcacgcgcatcaccaatggatgacgacagaagatatgctttccgtttggaatagagtgtggatcgaagagaatccgtggatggaagataaaacgcatataagttcctggggagacgtaccgtacttaggaaaaagagaagaccagtggtgcggaagtttaatcggattaaccgctagagctacctgggcgacaaatattcaagtggccatcaaccaagtccgacgattgatcggcaatgaaaattatctcgattatatgacatcaatgaagcggtttaaaaatgagagtgatccggaaggagcgttgtggtaa

SEQ ID NO: 21162 - RNA, 9879 nt, synthetic construct
  misc_feature 1..9879: note = derived and/or modified CDS sequence (opt6) from DENV-1__GU131894__SS-prME
  source 1..9879: mol_type = other RNA
agcgtaactatgttgttaatgctaatgcccacagctttggcttttcatttgactacccgcggaggagagccacacatgatagtgagtaaacaggaaagaggtaagtctttactatttaaaacgtcagctggagtcaatatgtgcacactaatagctatggatttaggagaactctgcgaggatactatgacatataagtgtcccagaattacggaggcagagccggatgatgtggattgttggtgtaatgccaccgatacgtgggttacctatggtacatgttctcaaacaggtgaacatagaagagacaagagatccgttgcactagccccacatgtaggactcggtctagaaacaagaacagagacatggatgtcgtcagagggtgcgtggaaacaaattcaacgtgttgaaacatgggctctccgacatcctggtttcaccgttattgcacttttcctagcacacgcgatagggacgtcaatcacccaaaaaggtataatatttatactactaatgcttgtcacaccatctatggctatgagatgcgtgggaatagggagccgagactttgtagaaggcttgagtggagccacatgggttgacgtggtattagaacatggaagctgtgtaaccacgatggcgaaagataaacctacactggatatagagctcttgaaaactgaagtcaccaatccagccattcttcgaaagctatgtatcgaagcaaaaataagcaacaccacaacagacagcagatgtccaacacagggcgaagcaaccctagtagaggaacaagatgccaattttgtatgcagacggacatttgtagatcgcgggtggggaaatggatgcggtttgtttgggaaaggtagtctaattacatgtgcgaagtttaagtgcgttacaaagttagaaggtaaaatagtacaatatgaaaatctgaaatattcagttatagtaactgtacatactggggatcaacaccaagtaggtaacgaaagcacagagcatggcacaacagcaacaataacccctcaagcaccaacaactgagatacaattgaccgactatggagcacttactcttgattgcagcccaagaacaggtttagattttaacgagatggtcttattaaccatgaaagagaagtcatggttagtccataaacaatggtttttggatctaccactcccttggacctctggtgcatccacgagtcaggaaacttggaatagacaagacttattagtaacgttcaaaacagcacatgctaaaaaacaggaagtagtggtactcggttctcaagaaggagcaatgcacaccgctctaactggcgctactgagatacaaacatctggtacgaccaccatatttgctggtcaccttaaatgtaggctaaaaatggataaactaacgctaaaaggcatgtcttatgtaatgtgtactggatcattcaaactagaaaaagaagtcgccgaaacacagcacggcacagtgttagtccaaataaagtatgagggaacagatgcgccttgcaaaatacctttttctactcaagatgaaaagggagttacgcaaaacggacgattaataacagcaaacccaatagttaccgacaaagaaaaaccagtaaatattgaagctgaacccccattcggcgaaagctatattgtaataggagcaggtgaaaaagcattaaaattatcttggtttaaaaaagggagtagcatcggtaaaatgttcgaagctaccgccaggggggcacgaaggatggctatcttaggggataccgcatgggacttcggcagcattggtggtgtttttacctcagtcgggaaattggtgcatcaaatattcgggactgcctatggggtcttgtttagcggtgtaagttggacgatgaaaataggcattggtgtattactgacgtggttagggttaaattctcgttcaacgtccctgagtatgacttgtatagcagtgggtttggtaactttatacctgggagtaatggtacaagctgatagcggctgtgtaatcaactggaaaggtagggaactcaaatgtgggagcgggatctttgtaactaacgaggttcacacatggacggaacaatataagttccaagcggactcccccaaacgcttgagtgctgctatagggaaagcttgggaagaaggagtttgcggaatcagatctgcaacccgactagaaaatataatgtggaaacaaataagtaatgaattgaaccacatactgctcgaaaatgatatgaagttcactgttgtagtgggagacgtggctggaatactagctcaaggaaaaaaaatgatccgtccccaacctatggagtataaatactcgtggaaaagttggggaaaggcaaagataataggtgcggatgtacaaaacactacctttattattgatggccccaatacaccggagtgtccagatgaccaaagagcatggaatatatgggaagtggaagattacggtttcggaatatttaccaccaatatatggttaaaattaagagactcatatacccaagtctgtgatcacagactaatgtccgcagcaattaaagattcaaaagccgtacatgcggatatgggatattggatcgaaagcgagaaaaatgaaacttggaagctagcaagagcatcttttattgaagttaaaacttgcatctggccgaaatcacacactttatggtcaaacggtgtacttgaatcagagatgataattcccaaaatttatgggggacctataagtcaacataattaccgaccagggtactttacacagacagcaggcccatggcacttaggtaaactcgaattagatttcgatctttgcgagggtactacagtcgttgtggacgaacactgtggtaaccgaggtccaagcttgcggactacaacagtcactggaaaaataattcatgaatggtgctgtagatcgtgtacattaccacctttacgttttaggggagaagacggatgctggtacggaatggaaattaggcctgtaaaggaaaaggaagaaaacctggtaaaatccatggttagtgccggaagtggtgaagtagatagcttttcattaggactcttgtgcatatcaataatgatcgaagaggtcatgaggagtcggtggtcccgtaagatgctaatgactggcacattagcagtttttttattactcattatgggccaattaacatggaacgaccttataagattatgtataatggtcggagctaatgccagtgaccgtatggggatgggtacgacatacctagcattgatggcaacttttaaaatgagacctatgttcgctgtgggactactattcagaagactaacaagccgtgaagttttacttttaacgataggactgtcattggttgcaagtgttgaattacccaattcattagaagaactcggagacggtttggcaatgggcattatgatcctgaagcttcttactgacttccaatcccaccaattatgggccacgttgttgtccctcacattcataaagacaacgttctctctccactatgcctggaaaactatggcaatggtcttaagtatagtgtcgctattccccctatgcctttctaccacgtcacaaaaaacaacttggttacctgtgctattgggttcattaggatgcaaacccttaacaatgttcctcatagcggaaaacaagatatggggaagaaggagctggcccctcaacgaaggaattatggctgtggggatcgtctcaatacttctttcttccttgttgaagaatgatgtacccctagccggccctctgatagctggcggaatgttaatagcttgctacgtcatcagtggcagtagtgcagaccttagcctagaaaaagctgctgaagtatcatgggaagaggaagccgaacactcgggtgcaagtcacaatattcttgtggaagtacaggatgatggaactatgaagatcaaggatgaagagagagatgatacacttactatattattaaaagctacgttactggcagtatccggggtttacccccttagtataccagctacactctttgtttggtacttctggcaaaaaaaaaaacaaagatctggcgtcctttgggatactcctagtccgccggaagttgagcgggcggtattagacgatggaatatatagaattatgcaaagaggtcttttgggacggtcgcaagtaggggtaggcgtatttcaagaaaatgtttttcacacaatgtggcatgtaactcgaggtgcggtgttaatgtatcagggaaaaagacttgaaccttcttgggcttcggtgaaaaaagatctaatatcctacggcggaggatggcgattacaaggttcatggaataccggtgaggaagttcaagtcatcgctgttgaacccggaaaaaacccaaaaaatgtccaaactgctcccggcactttcaaaactccagaaggggaagtcggcgcgattgcactggactttaagcctggaacatcgggctctccaattgtaaacagagaaggaaagatagttggcctgtatggtaacggtgtcgttacgacctccggtacatatgtatcggcgattgcacaagcgaaagccagccaagaagggcctctaccagagatagaagacgaagtttttagaaaaaggaatctaaccattatggatttacatcccggttcggggaaaacaagaagatatctcccagcaatagtacgagaagcaattaaacgaaaattaaggaccctaattctagccccaacaagagtagtggcatctgagatggccgaggcgttaaaaggcatgcctattagatatcagactaccgcagtgaaaagtgaacatactggtaaggaaatagtagatttaatgtgtcacgctacattcacaatgcgccttttaagcccagtgcgggtccccaattataatatgattattatggatgaagcgcactttacagaccctagctcaatcgctgcccgtggatacatatctacaagagtaggtatgggcgaagcggcagcaatattcatgacagcaacgcccccaggaagtgtagaggcgttcccccaaagtaatgcagttatccaggacgaggaaagagatataccagaaagatcatggaatagtggatatgaatggataacagattttcctggcaaaacggtatggtttgttccatcgataaaatcgggaaatgatatagcaaattgtttaagaaagaatggaaaacgagttattcaacttagtcgtaaaacattcgatacagaataccaaaaaacaaaaaacaatgattgggactacgtggtaacaactgatatctctgaaatgggtgcaaatttccgtgcagatagggtaatcgaccctcgaagatgcttaaagcctgtgatactcaaggatggaccagagagagtgatattggctggtccaatgccagtcactgttgcatcggctgcacagagacgcggccgcataggcaggaatcataataaggaaggagatcaatacatttatatggggcaaccacttaataatgacgaagatcacgcccactggacggaggcaaaaatgttactagacaacattaatacgcctgaaggaattatcccagcgctatttgaaccagagagggaaaaaagcgcagccattgatggggaatatagactgcggggtgaggctagaaaaacgttcgtagaattaatgagaaggggcgatttaccagtttggctctcctacaaagtagcatcagagggatttcaatattcggatagacggtggtgctttgacggggagcgtaataatcaagtattagaggagaacatggacgtagaaatatggacgaaagagggcgaacgtaagaaactgcgtcctcgctggttagatgcccgaacctatagcgaccccctggcactgcgtgagttcaaagaattcgccgccggaagacgatcagtttctggagatcttattttagaaataggaaagttaccacaacatttaacacaacgagcacaaaacgcgctagataacttggtaatgttacacaactccgaacaaggaggtagagcgtaccgtcatgcgatggaggaactgcctgatacgattgagacgttaatgctcttagcccttatcgctgtactaaccggaggggtcactttattctttctgtctgggagaggtttagggaagacttccattggtttactatgcgtgatggcgtcgtcggtactgttatggatggcttctgttgaaccccattggattgcagccagcatcatattggagttctttttgatggttttactcattccagaacctgatagacaaagaaccccacaagataaccaattggcttacgtagttattggtctgctattcatgatactaaccgttgcagcgaatgaaatgggactgttggagacgactaaaaaagacttaggtataggtcatgtagcagtcgggaatcaccatcacgctgcgatgctcgatgtagatctccatccagcatcggcatggacactgtacgctgtggcaactactatcataacccccatgatgcggcatacaattgaaaacaccaccgctaatatatctctaaccgcaatagctaaccaggccgcgatattaatgggattggataaaggatggcccatctctaaaatggatattggtgtgcctttattagcattaggctgttatagccaagtgaatccattaacattaacggcagccgtgttgatgctggtagctcactatgcaataattggtccaggtttgcaagcaaaggcaacccgtgaagcacagaaaagaactgcagctggaatcatgaaaaacccaacagtcgacgggatagtggcgatagatctagacccagtcgtgtatgacgcgaaatttgaaaaacaactcggtcaaattatgctactaatcctgtgtacatcacaaatattgcttatgcgcacaacgtgggcactatgcgaatcaataacgctcgcaactggacctcttacgacgctctgggaaggaagtcctgggaagttttggaacacaactatagccgtatcgatggcgaacatctttcgaggatcttaccttgccggcgccggtctagctttttccctcatgaaatctcttggtggaggacgtcgcggaactggggcgcaaggagaaactcttggggagaaatggaaacgacaactcaatcagctatcgaaatcggaatttaacacctacaaaaggagtggcataatggaagtggacaggtccgaagcgaaagaagggctaaaacgaggtgaaactaccaaacacgcagtatcaagagggacagccaaactaagatggttcgtcgaacgtaacttagttaaacccgaagggaaagtaatagaccttggctgtggaagaggagggtggagctactactgcgccggactgaaaaaagttacagaagttaaaggttacactaagggtgggcctgggcatgaagaacctattcccatggcgacctatggatggaaccttgttaaactgcactctggtaaagatgtattttttataccacccgaaaaatgtgataccctattgtgtgatataggtgaaagtagtccaaatccaactatcgaagaaggtagaaccctcagagtcctgaagatggtagaaccatggcttcgtggcaatcagttctgtataaaaatcttaaatccatatatgcccagtgtagttgaaaccttagaacaaatgcagaggaaacatggaggaatgttagtcaggaatccattaagccgaaattcaacacacgagatgtattgggtatcgtgtggaacagggaatatagtttctgcagtgaatatgacatccagaatgttacttaatcgatttacaatggcacatcgtaagccaacttatgaacgagacgtggatctaggtgcaggcacaagacatgtagcagttgaaccagaagtagcgaatcttgatataatcggacaaaggatagaaaacataaaacatgagcacaagagcacatggcactacgatgaagataacccttataaaacatgggcctaccacggcagctatgaagtgaaacctagtggaagcgcaagttcaatggtaaatggagtcgtcaagttacttacaaaaccgtgggacgtaatccctatggtgacacaaatcgccatgacggacactacaccatttggacagcaaagggtttttaaagaaaaagttgatacacgaacaccgaaagccaaacgcggaacagcccaaatcatggaagtaacagcaaaatggttatggggatttttgtctagaaacaaaaagccaagaatttgcacaagagaagaattcacgagaaaagtccggtccaatgccgccatcggagcagtattcgtggacgagaaccaatggaattcggccaaagaggcagttgaggacgaacgcttctgggatctagttcataaagagagagaattacataaacaaggaaaatgcgctacgtgcgtttataacatgatgggcaaacgggagaaaaaactcggagaatttgggaaagccaaaggttcgcgcgctatatggtatatgtggctgggcgcccgattcttagagttcgaggcactaggctttatgaatgaagatcattggtttagtcgcgaaaactcgctatcaggagtagaaggcgaaggcctacataaattaggttatatcctaagagatatatcaaaaattcctggaggtaacatgtatgcagatgacacggcaggctgggatactcgtattacagaggatgacctacaaaacgaagcacgtattacagatataatggaacctgaacatgctttgcttgccaagagtattttcaaactcacatatcaaaataaagtagttcgagtacagaggcccgcaaaaaatggcacagtgatggatgttattagtaggcgtgatcaaagaggatcaggtcaggtaggaacatatggcttaaacacctttacaaatatggaagcacagcttataagacaaatggaaagcgagggaatattctcgccatctgaactggaaactccaaatctagcagagagagttcttgattggttagaaaaatacggtgtcgaaaggcttaagaggatggcaattagtggtgacgattgcgttgtaaaaccgatcgatgacaggtttgccacagcattgacggctttaaatgatatgggtaaggttcggaaagacattcctcaatgggaaccttccaaaggctggaacgattggcaacaagtaccattttgctctcatcactttcatcagctcataatgaaggatggccgagagatagtagtcccatgtagaaatcaagatgaactcgttggcagggctagggtatcgcaaggagctgggtggtcactgcgcgaaacggcgtgccttgggaaatcatatgcccaaatgtggcaattaatgtactttcaccgaagggacctaaggctggccgccaatgcaatttgctctgcagtacctgtcgattggacacctacaagtagaacgacatggtccatacatgcgcatcatcaatggatgacaacggaagatatgctcagtgtatggaacagagtgtggattgaagagaacccttggatggaggataaaacgcacatatcaagttggggcgacgtcccttacttgggcaagcgagaagatcaatggtgtgggtcattaataggtctaacagctagggccacatgggcgacaaacattcaagttgcaattaatcaggtaagaaggcttataggaaatgaaaattatttggattatatgacatcaatgaaacgtttcaaaaatgaaagcgatccagagggagccctatggtaa

SEQ ID NO: 21163 - RNA, 9879 nt, synthetic construct
  misc_feature 1..9879: note = derived and/or modified CDS sequence (opt6) from DENV-1__GU131895__SS-prME
  source 1..9879: mol_type = other RNA
tcagttacaatgttgttaatgcttatgcccaccgcgttagcattccatttaactacgcgagggggagaaccgcatatgattgtatcaaaacaagaaaggggtaaatcactgctattcaaaacctcagcaggggtgaacatgtgtacgttaattgcaatggatttaggtgaactttgtgaagatacaatgacatataaatgccctaggattacagaagcagaacccgatgacgtagactgttggtgcaatgcaacggacacttgggttacgtacgggacgtgttcccagacgggagaacatcgacgtgacaaaaggagtgtggcactagcgccgcatgtagggctaggactagaaacgagaacggaaacctggatgtctagcgaaggggcttggaaacaaatacaacgagtggaaacatgggctttgagacacccaggttttactgttatagcacttttcttagcacacgctatcggaacctcaataacgcaaaaaggcataatattcatacttttaatgctagtgaccccatcaatggcgatgaggtgtgttggtataggttcacgggatttcgtcgaaggtttaagtggagcaacgtgggtagatgttgttttagaacatggctcctgtgtgacgacaatggctaaagacaaaccaaccctagatattgaacttctaaaaacagaagtcacaaatccagccatactacgtaaactatgcatagaagcgaaaatctctaacacaactaccgactcaagatgtcctacccaaggtgaagcgacgctagttgaagaacaagacgctaattttgtatgtagaaggacgttcgttgatcgtggttggggtaatgggtgcggtctgtttggaaaaggctcattaatcacgtgcgcaaaatttaaatgtgtaacaaaactagaaggaaaaatagttcaatatgaaaatctaaaatatagtgttatcgttacagtacacacgggggaccaacaccaagtaggaaatgaaagtactgaacatggtactacagctactataaccccacaagcaccaacaaccgaaatccaactgacagattacggagcactaacgctggactgttcacccagaacaggtctagatttcaatgaaatggtattacttaccatgaaagaaaaatcttggttagttcacaaacaatggtttttggatttgcccttaccgtggactagcggagccagcacttcacaggaaacctggaacaggcaagatctattagtaacctttaaaacggcgcatgctaagaaacaagaagtagtagtacttggatcacaggaaggtgcaatgcacacggccttaacaggagccacggaaatccaaacaagtggaacaaccacaattttcgctggtcatctaaaatgtaggttaaaaatggataaactagcactaaaaggaatgagctatgtcatgtgcactggttctttcaaattggaaaaagaagtagcggaaacacaacatggtacagtcctagtacaaataaaatatgaaggtacagatgctccatgcaaaattccattttcaacccaagatgaaaaaggggtaacacaaaacgggcgattgatcaccgctaaccctattgttaccgataaagaaaaacctgttaacatagaagcagaaccaccttttggtgaaagctacatagtcatcggagcaggggaaaaagcattaaaacttagttggttcaagaaaggttcatctattgggaaaatgtttgaagcaacagcccgaggtgcccgaagaatggcaatactaggagacaccgcttgggattttggatctataggaggggtattcaccagtgtcggtaagctagtccatcagatttttggtacagcttatggggttctgttctcgggtgtttcttggacaatgaaaattggtattggagtccttctgacgtggcttggcttaaacagtcgttcgaccagtttgagcatgacttgtatcgcagttgggctggtaacattatatctaggtgttatggttcaagccgacagtggatgcgtgatcaactggaagggtcgcgagttaaagtgtggctcaggcatttttgttaccaatgaagtacatacctggacggaacaatataagtttcaagccgattcaccgaaacgcctaagtgcagcgatcgggaaggcttgggaggaaggcgtgtgcggtatcaggtcagcaacccgacttgaaaatataatgtggaaacaaataagtaatgaactcaaccacatattattggagaatgacatgaaattcacagttgtcgtaggtgacgtagcgggaatattagcccaaggcaagaaaatgattcgaccgcaacccatggaatacaagtatagttggaaatcatggggaaaagctaaaataatcggcgcagatgttcagaacacaacctttataattgatggaccaaatacgccagaatgtcctgatgatcaacgagcatggaacatatgggaagtagaggactatggattcgggatattcacgacgaacatatggctcaaattaagggattcgtatacacaggtgtgcgaccaccgattgatgagcgcagcaattaaagatagtaaagcagtacacgcagacatgggttactggattgaatctgagaaaaatgagacgtggaaactcgcacgagcgtctttcatagaagtgaaaacatgcatatggccgaaatctcacaccttatggtcaaatggcgttctagagtctgaaatgatcatccccaaaatttatggtggtcccatcagtcaacacaattaccgtccaggctatttcacacaaaccgctggcccatggcacttgggcaaactagaactagattttgatctatgcgaggggacaaccgtcgttgtcgacgaacattgtggtaataggggaccctcgctaagaacaactactgtaacaggaaagataatacatgaatggtgctgcagaagctgcacattacccccgttacggtttagaggagaagatggatgttggtatggaatggaaatacgacccgttaaagagaaagaagaaaatctagtaaagagcatggtttccgcgggaagtggagaagttgatagtttttcactaggcttactatgtataagtataatgatagaagaagtaatgagatctagatggagtcgaaaaatgctaatgactggaacgcttgcagtgttcttactcttaataatgggtcagctcacatggaatgacttaataaggttgtgcatcatggtaggggcaaacgcatctgatagaatggggatggggacaacatatctggctctaatggcgacattcaaaatgaggccaatgtttgcagtaggtcttttatttaggcgcttaacctctagagaggtattgctattaacaatcggcctttctttagtggcctccgtagaattgccaaactccctcgaagaattaggtgacgggttagcaatgggcattatgatcttaaaattattaactgattttcagagtcatcaattgtgggctaccctactatctcttacatttataaagacaacctttagtttacattatgcatggaagaccatggccatggtcctttcgattgtatctctatttcctctttgtttatccacgacatcccagaagactacttggttgccagtcctattagggagtctgggttgtaagcctttgaccatgtttttaatagcagaaaataaaatatggggtagacgtagttggccactgaatgaaggaatcatggcagtaggtatagtcagcattttactgtcctccctactcaaaaatgatgttccattagcgggccccttaatcgccggtggtatgctaatcgcatgttacgttatcagtggctctagcgcggacttatcacttgagaaagcagcggaagtttcgtgggaagaagaagcagaacatagtggtgcaagccacaatatacttgtagaggtacaagatgatggtactatgaagataaaagacgaagaacgagatgatacattaacaatattactaaaggcaacactcttagcagtcagtggtgtctatccactgtcaatcccagccacactgtttgtatggtatttctggcagaagaagaaacaaagaagcggagtgctctgggacacaccgtcacccccagaagtagaaagagctgttttagatgatggaatatacagaataatgcagagagggcttcttggccgatcacaagtaggcgtcggtgtctttcaggaaaacgtgttccacactatgtggcatgtgacaagaggtgcagtgttaatgtatcaaggaaaacggttggaacctagttgggcttcagtcaagaaagatttaataagttatggaggaggatggagactgcaaggttcatggaataccggggaagaagtacaagtgattgccgttgaaccgggcaagaaccccaaaaatgtacaaaccgctcctggaacattcaaaacaccagaaggtgaagtgggagccatagctctagattttaagcccggcacatcaggaagtcccattgtaaatcgggagggcaaaatagtcggtttatatggtaacggtgtagtaacaacaagcgggacttatgtatcggcgattgcacaggcaaaggcatcacaagaaggtccactaccagagatagaagatgaagtctttagaaaaagaaacctcaccataatggatttacacccaggaagcggaaaaactagacggtatctaccagcaatagtgcgagaggcaataaagcgaaaacttagaactctcattttggcacccacacgagtcgtcgcatcagaaatggcggaggcactgaaaggaatgcctatacgatatcaaactacagcggtaaagtcagaacacacaggaaaagaaatagttgacctcatgtgccatgcaaccttcactatgaggctattgtcgccagttcgcgtaccaaattataacatgatcataatggacgaagctcatttcaccgaccctagctcgatagccgcacggggatatatttcaacaagagtgggaatgggagaagcggcagcaatatttatgacagcgacaccgccaggttcagtagaggctttcccccagtctaatgcagtaatacaagacgaagaaagagatataccagagcgatcatggaactcggggtatgaatggataacggactttccaggaaaaactgtatggttcgtacctagtataaaaagtggtaatgacattgcaaattgcttgaggaaaaatggcaaaagagtgattcaattatcacgcaaaactttcgatacagaatatcaaaagactaagaataatgattgggattacgtagtcacaaccgacatttccgaaatgggggcaaattttagagcggacagagttatcgatccaagaagatgtcttaagcctgtaattctaaaggacggcccagaaagagtaattctcgctggtcctatgccggtaacagttgcctctgcggcacaacgaagaggtagaatcggaaggaatcacaacaaagaaggagaccaatacatatatatgggacaacctttaaacaatgatgaagatcacgcgcactggacggaggcaaagatgttactagacaatataaacaccccagaaggtatcattccagcgcttttcgaaccagaacgggaaaaatcggcggcaatagacggagagtatagacttaggggcgaagcacggaaaacatttgttgagttaatgcgaagaggagatttgccagtgtggttatcatataaagtcgcgagcgaaggtttccaatacagtgaccgaaggtggtgcttcgacggggaaaggaataaccaagtccttgaagagaatatggatgttgagatatggactaaagaaggtgaaaggaagaaactacgtcctaggtggctggatgcaagaacttattcggatccacttgccttgagagagttcaaggagttcgcggccggtagacgaagtgtgtctggagacttaatactagaaataggcaaactaccacaacatctaacacaaagagcacaaaacgccttggacaatctggtcatgctccacaattcagaacaaggcgggagagcgtatagacacgcaatggaggaattaccagatacaatagagacattaatgttattagcactgatagcagttctaacaggaggtgtgactttgtttttcctttcgggtcgaggactcggaaagactagcatcggactgctgtgtgtcatggcatcgagtgtactgttgtggatggcaagcgtagagccacattggatcgccgcttcaattattctcgagttctttctcatggttcttttgataccagaacctgatcggcaaagaactccgcaagacaaccagttagcatatgttgtaatagggttgttatttatgattctaaccgttgcagctaatgaaatgggattactagaaacaactaagaaagatctaggaattggacacgttgccgtgggtaatcaccatcatgctgctatgcttgacgtggatctacatccagcttcagcgtggacactttatgcagttgccacaactataataaccccaatgatgagacatactatagaaaatacgacggcaaacataagcctcacagcaatcgctaatcaggccgcaatattgatgggacttgacaaagggtggcccatttctaaaatggacatcggcgttcccttactagcgttaggctgctactcacaggttaacccactaacgctgacagcagctgttttaatgctagtagcacattacgcgataatcggcccagggctacaagcaaaagctacaagagaagcacagaaaagaactgcagccggcattatgaaaaatcctaccgtagatggaatcgttgccatcgatttggacccagttgtatatgacgctaaattcgaaaaacaattaggacaaattatgctattaatattatgtacctcgcaaattcttctgatgagaactacctgggcactatgtgagtccatcacactagcaactggacctttaacgacgctatgggaagggtcaccaggtaaattttggaatacaacaatcgctgtgtccatggccaatatatttcgtggatcatatttagccggagcgggtctcgcgtttagtctgatgaaatcactaggcggaggaaggcgggggaccggggcacaaggtgaaacattgggggaaaaatggaagagacaacttaaccagttaagtaaatcggagttcaatacttacaaacgatccggtattatggaggtcgatcggtctgaagccaaagaaggactaaagagaggggaaacaacaaaacatgcagtcagtagaggtacagctaaattaagatggttcgttgaaaggaatttagttaagccagaaggtaaagtaatcgatttaggatgtggtaggggaggatggagctactattgtgcgggtttgaagaaagttacagaggtaaaaggttatacgaaaggaggaccgggtcatgaggaaccaataccaatggctacgtacgggtggaatctcgtcaaactccattcgggaaaggacgtctttttcattccacctgaaaagtgtgacacattactttgtgatataggggagtcaagtccaaatcccactattgaagaagggcgaacactaagagttcttaaaatggtagagccttggttaagaggaaatcaattttgcataaagattcttaatccctatatgcctagcgtagtagaaactttagaacaaatgcaacgaaaacatggaggaatgttagtaagaaatcccctaagtagaaattcaacgcatgaaatgtattgggtaagctgcggtacaggtaatatagtgtcagcagtgaatatgacttcgaggatgcttctcaaccggtttacgatggctcacagaaaaccaacctatgaaagagatgtagacctcggcgccggaacacgtcatgtcgcagtcgagcccgaagttgcaaatttagacattatagggcaacgcattgaaaacattaaacatgagcacaagtcgacatggcattacgatgaagacaacccctacaagacctgggcttatcacggctcttacgaagtgaaacctagtggatcggcgagttctatggttaacggagtagtgaaacttctaaccaaaccatgggacgttatacccatggttactcaaattgcaatgaccgatacaactccctttgggcagcaacgcgtctttaaggaaaaagtggacactaggacccctaaagcaaagagaggaaccgcgcaaattatggaagtaactgcgaaatggttatgggggtttctatcaagaaacaagaaaccacgaatctgcaccagggaggagttcacaagaaaagtgagatccaacgcagctattggggctgtatttgttgacgagaatcaatggaatagcgctaaagaagctgtagaagacgaacgattctgggatttggttcacaaagaaagggagttacataaacaagggaagtgtgcaacctgcgtctataacatgatgggaaagagagagaagaaattaggagagtttggtaaagcaaaagggtcaagagcaatatggtacatgtggttaggtgcccgattcttagagttcgaagcgttaggatttatgaacgaggatcattggttttctagagaaaatagcctcagcggagttgagggggaaggattacataaacttggatacatacttagagatatatcgaagattccgggaggcaacatgtatgcggacgacacagcgggatgggacacacgaattacagaggacgatctgcaaaacgaagctcgtataactgatattatggaacccgagcatgcactattggccaaatctatttttaaacttacttatcaaaacaaagtagtcagggttcagagaccagccaaaaacggcactgtaatggacgtgataagccgaagagatcaacgaggatccggtcaggtaggcacatacggtttaaatacatttaccaacatggaagcacaactaataagacagatggaaagtgaaggcatttttagtccgtccgagctagagactcctaatctggctgaaagggtgttagattggctagagaaatatggcgtcgagagactaaagaggatggccatttcaggcgatgattgtgtagttaagcccatagacgacagattcgcaacggctctaacagctcttaacgatatgggtaaagtccggaaagatattccacagtgggaacctagtaaaggatggaacgactggcagcaagtcccattttgcagtcatcactttcatcagctaattatgaaagatggcagagaaatcgtagtaccatgtcgtaaccaagatgaactggtgggtagagctagggtcagtcaaggagcgggatggtctttgcgagaaacggcttgcctgggtaaatcatacgcacagatgtggcaacttatgtattttcacagacgcgaccttagattagcggcaaacgccatctgttcagccgtgcccgtagattggattccaacgagtcgaaccacgtggagtatacatgcccatcatcaatggatgacaacggaggatatgctaagtgtctggaaccgagtgtggatcgaagagaatccgtggatggaggataaaacacacattagttcatggggtgatgtgccttatctaggaaaaagagaggatcagtggtgtggatcactgattggactgactgcacgggcaacatgggcgactaacatccaggttgctatcaatcaagttagacgattaataggcaacgaaaattatctcgattatatgaccagcatgaaaagatttaaaaatgaatcggatccagagggagcattgtggtga

SEQ ID NO: 21164 - RNA, 9879 nt, synthetic construct
  misc_feature 1..9879: note = derived and/or modified CDS sequence (opt6) from DENV-1__GQ868632__SS-prME
  source 1..9879: mol_type = other RNA
tcagttacaatgcttctcatgctcatgccaacagctctagccttccacctgactacacgcggaggggaaccacatatgattgtctcaaaacaagaacggggaaaaagtctactatttaaaacatctgcgggagttaatatgtgtacgctaatagctatggacttgggagaactttgcgaagacacaatgacgtataaatgcccccgtattacagaagctgaaccggatgatgtagactgctggtgtaatgcaacagatacttgggtaacatacggcacatgctctcaaacgggggaacatcgaagagataaacgttcggtcgccctggcgccacatgttggactaggccttgaaacacgtaccgaaacctggatgtctagtgaaggagcatggaaacaaatccagcgcgttgaaacatgggcacttcgccatccgggattcactgtaatagcactatttctggctcacgcaatcggcacctcgatcactcaaaaaggaataatatttattttattaatgttagttacaccctcaatggcaatgagatgtgttggaatcggaagcagagactttgtcgaaggtctatcaggggcaacgtgggtagatgtggtcttagaacacggatcctgtgtcactaccatggcgaaagacaaaccaactcttgatattgaactactaaaaactgaagtcaccaatccagcaatacttagaaaactttgtatagaagccaaaattagtaacacgaccacagattctaggtgccccacccaaggggaagccaccctagtagaagaacaggatgcaaattttgtatgtaggagaacgtttgtagatcgaggttgggggaatggatgcgggctatttggaaaaggttccttgataacatgtgcaaagtttaaatgtgtaacgaaattagaaggtaagattgtacaatatgaaaatctaaaatactcagtgattgtcacagttcacactggtgaccagcaccaagtaggtaatgaaagcacagagcacggtacaactgcaactataacccctcaggctccaacaaccgagattcagctaacagattatggagctttaactctcgattgctctccccgcactggattggattttaatgaaatggtattattgaccatgaaagaaaaatcgtggctagtacacaagcaatggtttcttgacctacccctgccttggacatctggagctagtacgtcacaagaaacttggaatagacaggatcttctggtcacattcaagacagcacatgcgaagaaacaagaggttgtggtattaggttctcaggagggggcaatgcacacagcactaacgggagcaactgaaattcagacttctggaactaccacaatatttgcaggtcatctcaaatgccgactgaaaatggataagctaacgcttaaaggtgtttcatatgtaatgtgtactggaagttttaaattagaaaaagaagtggctgaaacgcagcatggaacagttttagtacaaataaaatatgaaggtaccgatgcaccttgtaaaataccattttcgactcaggacgagaaaggtgtaactcaaaacggacgactaataaccgcaaatcccatagttactgataaggaaaaaccggtgaatattgaagctgagccaccatttggagaaagttacatagtaataggtgcaggggagaaagcactaaaattaagctggttcaagaaaggttcttcaatcggaaaaatgttcgaagcaacggctagaggcgctagaagaatggccatactaggtgataccgcgtgggattttggttccattggtggggtattcactagcgtaggcaaattagttcatcagatattcggtaccgcgtacggcgtactattctcaggggttagctggacaatgaaaatagggattggtgtgttacttacatggcttgggctaaacagtaggtctacgtcactgtcaatgacatgtatcgctgttggattggtaacattgtacttgggcgttatggtccaagctgatagtggctgcgtgattaattggaagggacgagaactaaaatgtggatcaggaatcttcgtaacaaacgaagtccatacatggaccgaacagtacaaattccaggcagactcaccaaagaggttgtcagcagcaatcggtaaagcatgggaagagggggtgtgtggaattagatctgcaactagactggaaaatataatgtggaaacagatatcaaacgaattgaaccacattttattagaaaatgacatgaaatttacggtagtagttggtgatgtcgccggcattctagcccagggcaagaaaatgatcagaccacagccaatggaatataaatactcatggaaaagctggggtaaagcaaaaattattggagcagacgtacagaataccacctttataatagacggtccgaatacacctgaatgtccggatgaacagagggcttggaatatatgggaagttgaagactacggcttcggaatttttaccacgaatatatggctaaaattgagagattcatacacacaggtatgtgaccaccgtttgatgagtgcagcaattaaggatagtaaagcagttcacgcggacatgggttattggatagaaagcgaaaagaatgaaacatggaagttggctagagcatcatttatagaagttaaaacttgtatctggccaaaatctcacacattgtggtctaacggtgtactagagagcgaaatgataatacccaagatttatggaggacccatatctcaacacaattatcgaccagggtatttcacccaaacagctggtccatggcatttaggtaaattagagttagattttgatctatgtgaaggaacgacagtggttgtggatgaacattgtggaaaccgcggtccatctttgcgaacaaccacggtgacgggtaaaataatacatgaatggtgttgtagaagttgcacattaccaccactacgtttcagaggggaggatggttgctggtatggtatggaaattagaccagttaaggagagagaagaaaatctagttaagagcatggtctccgcaggctccggagaagtggattctttttcattggggctactgtgtataagcatcatgattgaagaagtaatgagaagtcggtggtcacgaaaaatgttaatgacaggtacactggctgtatttttgctactaataatgggtcagttaacctggaacgacttaatcagattgtgtataatggtaggagcaaatgcatcagatcgcatgggaatgggtaccacctatctagcattgatggcaactttcaaaatgagaccaatgttcgcagtaggactgctttttagaagactcacaagcagagaagtgttactcctaactattggattatcattagtagctagcgtagaattaccaaatagtcttgaagagttaggggacggcctcgctatgggtatcatgatactgaaactcctgacagatttccaatcccatcaactctgggccaccctgctgtcactaactttcattaagactacatttagccttcattatgcctggaaaaccatggctatggtccttagcattgtaagtctctttccgctgtgtttatctactacttcccagaaaacgacctggctaccagttttgctaggcagtttaggctgcaaaccgttaactatgtttctaattgcggaaaacaaaatatggggccgcagatcctggccactcaacgaaggaataatggcagttggtatagtatccatcttattaagctcgtttctcaagaatgacgtgccactagcaggaccattgatagcgggaggaatgctgatagcttgttatgtcatatcaggttcctcagcggatctctctttagaaaaagcagcagaagtatcatgggaagaagaagccgaacattcaggtgctagccataacatcctagtggaagtccaagatgatggaacgatgaaaattaaagacgaggagagagatgatacactaactattttattaaaagccactttactagctgtaagtggggtatatcccttatcaatcccagcaacattattcgtctggtatttctggcagaagaagaaacaaaggtctggcgtgctatgggataccccctcccctcctgaagtagaaagagccgtacttgacgatggaatttatcgaattatgcaaagaggactactcggccggagtcaagttggcgttggcgtatttcaggagaacgttttccacactatgtggcatgtgaccagaggtgcagtactaatgtaccaaggtaagcgcctagagccttcttgggcatctgtaaagaaagacctgatttcatatggcggtggttggcgattgcagggatcttggaacaccggagaggaagtacaagttatagcggtagaaccaggcaaaaatccgaaaaacgtacagaccgcaccgggaacatttaaaacgccggaaggagaagtaggtgcgattgcattagactttaaacctggaacgtcaggatcacctatcgttaatagagaaggaaaaatcgtaggactctacggtaacggcgtagtaacaacatctgggacctacgttagtgcaattgctcaagcaaaagcctcccaggaggggccgttaccagaaatagaagacgaagtattcagaaaacgcaacctaacaatcatggacctacaccctggcagcggcaaaaccaggagatacttaccagcaatagtacgagaagcgataaaaagaaaactaagaacattaattttagcacccacacgcgttgtcgcctcggaaatggcagaggcacttaaaggtatgccaatccgctaccaaacgacagcggtaaaaagtgagcacactgggaaagaaatagtggaccttatgtgtcatgcgacattcacaatgagactcctaagccctgttcgagtgccaaactataatatgattataatggacgaagcacattttacagaccctagttcaatcgctgcacgaggatacatctccacaagggtaggtatgggtgaagcagccgctatattcatgaccgcgacaccaccagggtctgtagaggctttcccccagtccaatgccgttatccaagatgaggaacgagacatcccagaacgttcgtggaactcaggttacgagtggatcacagattttccaggaaagactgtctggtttgtcccatcaataaaaagtggaaacgatatagccaactgtcttaggaaaaatggtaaaagagtcatacaactgtcgcgcaaaacatttgatacagaataccagaaaaccaaaaataacgactgggattatgtcgtgaccacggacatcagtgagatgggcgccaattttagggctgatcgtgtcattgacccaagaaggtgcttaaagccagtcatcttaaaagacggtcctgaaagagttatcttagcagggccgatgcctgttacagtagcatcagcggcccaacgtagaggcagaatcggtcgtaaccataataaggaaggcgaccagtatatttatatgggtcagcctctgaataacgatgaagaccacgcgcactggactgaagctaaaatgctattagataacataaatacacccgaagggatcatacctgctctatttgaacccgaacgggagaaaagtgcagcgatagacggagaataccgtttacgtggtgaagccagaaaaactttcgtagaactcatgcgacgcggagacctacccgtgtggttatcatataaagtggcgagcgaaggatttcaatattccgaccgaaggtggtgctttgacggggaaagaaataatcaagtactagaggaaaacatggatgttgaaatttggaccaaggagggagaacgcaagaaactacgcccacgatggttagatgcaaggacctatagtgatccgttagcgttaagagagtttaaagaatttgctgcgggacgaaggtcagtctcgggtgatctaatcctggaaataggaaaactgcctcagcatcttactcagagggcacagaacgctctagacaacttggtgatgttacacaacagtgagcagggagggagggcttataggcatgccatggaagaattaccggacacaatagagacactcatgttactcgcattaattgcagttctcacgggaggcgtcaccttatttttcttatctggccgagggctgggcaaaacaagcattgggcttctttgcgtaatggctagttcagtgttattatggatggcttcagttgagccgcattggattgcggctagcattatattggagttctttctaatggttctactaatccctgaacctgatagacagagaacaccacaagataaccaattagcatacgttgttataggcctcctctttatgattctaactgtcgcggctaatgaaatggggttgttggaaacgaccaagaaagatctaggaataggacatgtagctgtagggaatcatcatcatgcagcaatgttggatgtagacttgcacccggcatctgcatggacgctatatgccgtcgccaccaccataataactcctatgatgcggcatacgatagaaaatacaaccgctaatatatccctaactgcgatagcaaaccaagcagccattctaatggggttggacaaaggatggccaataagcaagatggacataggcgttcccctcttggcactgggctgttattcacaggtgaacccattaacacttacagcagctgtccttatgctggtagcccattacgcaataataggacctggcctacaagcaaaagcaactagggaagcacaaaagagaaccgcggcaggcattatgaagaatcctactgtagacgggatcgtagccatagacctagatcctgtggtttatgacgcaaaatttgaaaaacaactaggccagataatgttactaattctgtgcacatctcaaatactactaatgaggactacatgggctctttgtgaaagtataacattagcaacaggaccgctcacgacattgtgggaaggatcaccgggtaagttctggaacacaaccatcgcagtttctatggccaatatatttaggggttcatatctagctggggctgggcttgctttttcacttatgaaatcactcggcggtggccgtagaggaactggagctcaaggtgagactttgggcgaaaaatggaaaaggcaattgaatcaattgtccaaaagtgaatttaacacttataaaaggtctggaattatggaggtagaccgttctgaggcaaaagaaggtttaaaacggggagaaacgaccaaacatgcagtctcaagaggaaccgcaaaactacgatggttcgtcgaaaggaatcttgtcaaacctgaaggaaaagtgatagacttgggatgtggaagaggtgggtggagttattattgtgcaggattaaagaaagttactgaagtcaagggttatacgaaagggggaccaggccatgaagaaccaatcccgatggcaacgtatggctggaatttggtaaaattacatagtggaaaagatgtgttctttattcccccggaaaaatgtgatacacttttgtgcgatatcggagaaagttcgccaaatccaactatagaagaaggtagaacattgcgggtactaaaaatggtagaaccttggctgcgaggtaatcagttttgtattaaaattttgaacccttatatgccaagcgtggtagagacgttggaacaaatgcaaagaaaacacggaggcatgttagtaaggaatccactctcaagaaattctactcatgaaatgtattgggtgtcatgcggaaccggcaacatcgtatcagctgtaaatatgacatctcgaatgctgctaaacagattcacaatggcacatcgtaagcctacatatgaaagagatgtagatttgggtgctggcactcgacatgtagctgtagaaccagaagttgcaaacctagatatcattggccaaaggatcgaaaacataaagcatgaacataaatctacttggcattatgacgaagataacccttacaaaacgtgggcatatcacggcagctacgaagtgaagcctagcggaagtgcttctagcatggtaaacggtgtcgttaaattactgacgaaaccatgggacgtaatccccatggtaacacaaattgcaatgactgatactacaccctttgggcaacaaagagtatttaaagaaaaggtagatacaagaacccccaaggccaagagagggaccgcacaaatcatggaggttacagcaaaatggttatggggttttcttagtcgaaataagaaaccgaggatttgcactcgcgaggaatttactagaaaagtaaggagtaatgctgcaatcggtgcagtttttgtcgatgagaatcaatggaactccgccaaagaggctgtagaagatgaacgcttctgggacctagtacacaaagaaagagagttacacaaacagggaaaatgtgcaacatgtgtatacaatatgatgggaaaaagagagaagaaattaggtgaatttgggaaagcaaaaggctccagagcaatatggtacatgtggttaggagcaagatttttggagttcgaagcattaggctttatgaacgaagatcattggtttagtagggaaaattcactgagtggtgtagaaggcgaagggcttcataaattgggatatatcctgcgagatatatctaaaattcccggtggaaatatgtatgcagatgacaccgcaggatgggatacacgaataactgaggacgacctacaaaatgaagcaaggataacagatataatggagcctgaacatgcgttacttgcgaaatcaatatttaaacttacttaccagaataaggtcgttagggtccaaagacctgctaaaaacggcacagtgatggacgttataagcaggagggatcagagaggatcgggtcaagtggggacttatgggttaaatacgtttacgaatatggaagctcaattaatacgtcaaatggaatctgaaggaatattttccccatcagaactagagacaccgaatttagcagaaagagtccttgattggctcgagaagtacggagtggaacgcttaaaacgtatggcgataagcggagacgattgcgttgtaaaaccaattgacgaccgattcgcaacggcgctcaccgcattgaatgacatgggtaaagtacgaaaggacatcccgcaatgggaaccctcaaagggttggaacgattggcaacaagtacccttctgtagtcaccattttcatcaactaataatgaaagacggtagagagattgtagttccttgtcggaatcaagatgagctagtcggccgagcgcgggtttcgcagggggccggatggagtttaagggaaacagcttgtttaggtaaatcctacgcgcaaatgtggcagctaatgtacttccatcggcgagacttgaggctggctgccaacgcaatttgtagtgcagtaccggttgattggattcctacgtccaggactacatggtctatacatgcacaccatcaatggatgacaacagaagatatgttgtcagtatggaaccgcgtctggatcgaggaaaatccatggatggaagataaaacacatataagttcttggggcgacgtaccttatctcggaaagagggaagaccaatggtgcggttcacttataggtctgactgcacgtgcaacatgggctaccaatattcaagtagcaattaatcaagtcaggcgcctcataggaaacgaaaactacttggattatatgaccagtatgaagaggttcaaaaatgaatcggaccctgaaggcgctctttggtaa

SEQ ID NO: 21165 - RNA, 9879 nt, synthetic construct
  misc_feature 1..9879: note = derived and/or modified CDS sequence (opt6) from DENV-1__GQ868633__SS-prME
  source 1..9879: mol_type = other RNA
tcagtcactatgctactaatgctaatgcctactgccctagcattccacctgacgacaagaggaggggaaccacatatgatcgtatcgaaacaagaacgagggaaatcattactattcaaaacaagtgcgggagtgaatatgtgcacattaattgcaatggacttaggggaactatgtgaagacactatgacatacaaatgcccacgtattactgaagcggaaccggatgatgtcgattgttggtgcaacgcgacagacacttgggtgacttatggtacttgttctcaaaccggtgaacatcgaagagataaacgaagcgttgctctcgcaccccatgtgggcttgggcctggaaacacgtactgaaacttggatgagctctgaaggagcatggaaacaaattcaaagagttgaaacgtgggcactgagacatccaggattcacagtcatagctttatttcttgcacatgcgatagggaccagtattacgcaaaaaggaataattttcattctgcttatgcttgttacaccatcaatggctatgagatgcgtcggcatcggctctagagacttcgtggaaggacttagcggtgctacatgggtggatgtagtactagaacatggaagttgtgtgaccacgatggcaaaagataaacccacgctcgatatcgagttactaaaaacagaagttactaacccagcaatcttgaggaaattatgcattgaagctaagattagcaatacgacaacagatagtcgctgcccaacccaaggtgaggctacgctagtagaagaacaagacgcaaattttgtatgtagacgtacgttcgtagatcgaggatggggaaacggatgtgggttatttggcaaaggctcattaataacgtgcgcgaagttcaaatgtgtgacaaagctcgagggaaagatagtacaatatgagaacttaaaatacagtgtgatagtaactgtacacaccggagatcaacatcaagtgggaaatgaatcgacggagcatggaacaactgctaccattactccacaagcacccacaacagaaatccaattaaccgattatggggcgctgacactagattgctcgccaagaacaggtttggatttcaacgaaatggtgctcttgacgatgaaagaaaaatcgtggctagttcacaaacaatggtttttagatcttccgctcccgtggacctcaggtgcctcaacgagtcaagaaacatggaataggcaagacttactggttaccttcaaaacagctcatgctaagaaacaagaagtcgtagtactaggtagccaagaaggagcgatgcacacagcattaacaggcgcaacagaaatacaaacaagtgggaccaccacgatatttgctggtcatttaaaatgcagattaaaaatggataaactcacacttaagggcatgagttatgtaatgtgcaccggttcgttcaagttagagaaagaagtcgccgaaacgcaacacggtacagtgttagttcaaattaaatacgaaggaacagatgctccatgcaagattcctttttccacccaagacgaaaaaggggtaacgcaaaatggaagattaataacggcaaatcctatagtaacagacaaagaaaaacctgtaaacatcgaagcggaacctccatttggggaaagctatatagtaattggcgcaggcgaaaaagctcttaagttatcgtggtttaagaaaggaagtagtataggtaagatgtttgaagcgacagccagaggagcgagaaggatggctatcttaggtgacacagcgtgggacttcggatcaataggaggtgtctttacaagtgttggtaagctagtacatcaaatatttggaacagcttatggagtgttgtttagcggcgtatcatggaccatgaaaataggaataggagtattgctcacatggctcggccttaattctagaagcacaagtctaagtatgacttgtatagcagtcggacttgtaacactctatttaggagttatggtacaggcagattcaggatgtgtaatcaattggaaaggccgcgagttaaaatgtggaagtggaattttcgtaacaaatgaggtacatacctggactgagcaatacaaatttcaagcagattctccgaagcgcttgtccgcagcgatcggaaaagcgtgggaagaaggtgtttgtggaatcagaagtgcaactagactcgagaacattatgtggaaacaaatttcaaacgaattaaatcatatcctactggaaaacgatatgaaattcacagttgtagtaggcgacgtagccggcattctagcacaaggtaaaaagatgattagaccacagccaatggaatataaatacagctggaagagttggggtaaggctaaaataataggagctgatgtacaaaacacaacatttattatagatggaccaaacacgcccgagtgccccgatgatcaacgagcttggaatatttgggaagttgaagattatggctttggtattttcactaccaacatctggttgaaactacgtgacagttatactcaagtttgcgatcataggctcatgtcagcagcgatcaaggatagtaaggcggttcatgccgatatgggttattggatcgagtcagaaaagaatgagacttggaaattagctagggcatcattcatagaggttaaaacttgcatatggcctaaaagtcacacattgtggtccaatggcgtgttagaatccgaaatgattattccaaaaatatatggcggaccgatatcacaacacaactatcggccgggatactttacgcagactgcgggaccttggcacttgggtaagctggaacttgatttcgatctatgtgaaggaacaactgtagtagttgatgaacattgtggaaaccgtggcccttctctcagaacgacaacagtaacagggaagataatacatgaatggtgttgcagaagttgcactctaccaccattacgcttcaggggagaggatggatgttggtatggaatggaaataaggcccgtaaaagagaaagaagaaaatttggtaaagagcatggttagtgcaggttcaggagaagtcgatagcttcagtctagggcttctatgcattagcataatgatagaggaagtaatgaggagtaggtggagtagaaaaatgcttatgactggaacgctagcagtattccttttattaattatgggacaactaacatggaatgatctaataagattatgtatcatggttggtgccaacgcaagcgacagaatgggtatgggcacgacatatctcgccttaatggcaacatttaagatgagaccgatgtttgcggtgggactactctttcgacgactaacatcccgagaagttttactccttacaatcggacttagtctagtagctagcgtagagttgccaaattcattggaggagctaggagatggattggctatggggattatgatcctgaaattacttacagattttcagagccaccaattgtgggcaactctgctgagtttaacgttcattaaaacaaccttctcgctacattatgcatggaaaacgatggcgatggtgctatccattgtatcactatttcccctatgcttgagcactacgtcgcagaaaaccacctggttgccggtcttgctaggcagtctaggatgtaagccgctaaccatgtttttgatcgccgagaataaaatatggggccggagaagctggccactgaatgaaggtattatggctgtgggaatagtctcaatactattgagctcccttcttaaaaatgatgtccctttagccggtccactgattgccggaggcatgctaatcgcatgctacgtaatatcagggtcaagtgctgatctcagtttggaaaaagcggcagaagtttcgtgggaagaggaagcggaacactctggcgctagtcataacattctcgtggaggtgcaggacgatggaaccatgaagataaaagacgaagaaagagacgacactcttacaatcctattgaaggccacactactcgcagtaagcggagtctaccctttaagtataccagcaacactattcgtatggtacttttggcagaagaagaaacaaagaagcggagtgttatgggatacaccaagtccacccgaagttgaacgagcggtattagatgatggtatttaccgaataatgcaacgaggactgctggggcggagccaagtcggagtaggcgtattccaagaaaacgtatttcacacaatgtggcatgtcacacgaggtgcagtacttatgtaccaaggtaagcgattagagcctagctgggcatcagttaagaaagatctaataagttacggcggaggttggaggttgcaaggaagttggaataccggtgaagaagtacaagtcattgccgtcgaaccaggtaaaaatcccaaaaacgtgcaaacagcgccggggactttcaaaacaccggagggggaggtaggagcaatcgcattagacttcaaaccgggtacctcgggatcaccaattgtcaatcgggagggaaagatagtcggactctatgggaacggcgttgttacaacgtcaggaacatatgtctctgctatagcacaagcaaaggcaagtcaagagggccctctgccggaaatagaagacgaagtattcagaaagcgaaatttaacaataatggatcttcatcccggtagtggaaagaccagacgctacctgccagctatagtacgtgaagcaatcaaacgtaaacttcgaactttgattctagctccaacccgcgtggtggcctctgagatggcagaggctttgaaaggaatgccaatcagatatcaaacaaccgcggtaaaatcagaacacacaggtaaagaaattgttgacttaatgtgccacgccacatttaccatgaggttattatcgccggttagagtaccaaactataacatgataataatggacgaagcccactttacagatccgtctagcatagcagcaagaggttacataagcacacgcgtgggaatgggagaagctgcagctatatttatgacagccactccaccaggtagtgtcgaggcctttcctcagtcaaatgcggtaattcaagatgaggaacgagatatcccggaacgatcttggaactctggttatgaatggattacagactttccagggaaaaccgtctggtttgtgccctctataaaatccggtaatgatatagctaattgcttgcggaaaaatggtaaaagagtaatacaattaagtcgaaagacattcgacacagagtatcagaaaaccaagaataatgattgggattacgtagtaactacggatataagcgagatgggagctaattttagagcagatcgcgtcattgatccacgtcgatgcttaaagcccgttattttgaaagatgggcccgaacgagttattctagcaggcccaatgcccgtaacagtcgcttcagcagcacagcggcgcggacgaataggaagaaatcacaataaagaaggagatcagtatatatatatggggcagcctttaaacaatgacgaggaccacgctcattggacagaagccaagatgctgctggataatattaacacaccagaaggtataattcctgcactatttgaaccggaaagagaaaagagcgcagcaattgatggagagtaccgtttgaggggtgaggcgagaaaaacgttcgtagaactaatgagacgaggtgacctcccagtctggttgagttataaagtcgcatcagaagggtttcaatactcagatagacgctggtgctttgacggcgaacgaaacaaccaagtccttgaagagaacatggatgtagaaatatggacaaaagaaggtgaacgaaagaaacttagaccacgatggttagatgcacgaacctacagtgatccactcgcattaagagaatttaaagagtttgcagctggtagacgtagtgttagcggagacttaatattggaaattggtaaactacctcaacatcttacacaacgagcacaaaatgctctcgataatctagtaatgttacataatagtgaacaaggagggagggcttacaggcacgcaatggaagagttacctgatactatagagacactgatgttgttggcccttatagctgtattaaccggtggagtaacattatttttcctaagtggccgaggtcttggcaaaacatctataggtctactgtgcgtaatggcgtcatctgtcctgttatggatggcatcagtagaaccacactggatcgcagcgagtataatcttagaatttttcctaatggtgctactaatacccgaacccgacaggcagagaacacctcaagacaaccaacttgcatatgtcgtaataggcctcctctttatgattcttacggtagcagctaatgaaatgggcttgttagaaacaactaagaaagatctaggaatcggacatgtagctgttggcaaccatcaccatgccgcgatgttagacgttgatttacacccagcaagtgcgtggaccttatacgcagtagcaaccacaattataacgccaatgatgcgccatacaattgaaaatacaaccgcaaacatttcactaactgcaatagctaaccaagcagccatacttatggggttagataaaggttggccaataagcaaaatggacataggagttccacttttggctttaggatgctactcacaagtaaaccctctaactttaaccgcggcagtcctaatgctggtagcacactacgctattatcgggccaggattacaagcgaaggccactagagaagcacagaaaagaaccgcggccggtataatgaagaatcccacggtagatggaatagtagcaattgacttagacccagtagtgtatgatgctaaatttgaaaaacagctaggacaaatcatgcttttaattttatgcacgtcgcagatattattaatgcgcacaacctgggcgttatgtgagtctatcacgctagcgacagggccactaaccacattatgggaaggatcccctggaaaattttggaacacgacaattgccgtctctatggcaaacatttttagaggctcttatctggcaggggctggattagcttttagtcttatgaagtccttaggtggtggaagacgaggtactggagcgcaaggagagacgttaggagaaaagtggaagaggcaattgaatcaattaagtaaatctgaatttaatacatataaacgtagtggaatcatggaagtggatagaagcgaagcaaaagagggacttaagagaggcgaagcaacaaagcacgcagtttctagggggcctgccaaattaagatggtttgtggaaagaaatttagttaacccagagggaaaagttatcgatttaggttgtggaagaggtggatggtcgtattactgcgcaggtctaaagaaagtaactgaagttaaaggttacactaagggaggcccaggtcatgaagaaccaatccctatggctacatatggatggaatttagttaagttgcactcaggtaaagatgtattctttataccaccagaaaagtgcgacacattactgtgcgacataggagaatcctcccctaatccaacgattgaagagggaagaacactgagggttttaaaaatggtagaaccgtggcttagagggaatcagttttgcataaaaatactgaacccctatatgccaagcgtagttgaaactctagaacaaatgcaacgtaaacatggcggtatgttggtgagaaaccccctgtcacgcaattccacccatgaaatgtattgggtctcatgcggaacaggaaacattgtcagtgcggtaaacatgacgtcgcgtatgttactaaaccgatttacgatggcacatcgtaaacctacctatgagcgggatgtcgacctaggtgcggggacccgacatgtagcggtagaacctgaagttgcgaatctagatatcatcggccaacgaatagaaaacattaaacatgagcataaatcgacatggcattatgatgaggacaacccatacaaaacgtgggcatatcacggaagttacgaagttaaaccctctgggtcggcgtcttccatggtgaacggtgttgtcaaactgctgactaaaccgtgggatgtgattccaatggttacacagatagccatgaccgatacaacaccgttcggtcaacaaagagtgttcaaggagaaagtagatacaagaacaccaaaggccaaacgaggtacagctcaaataatggaagttaccgcaaaatggctatgggggtttctatcaaggaataaaaagccgcggatatgcacacgtgaagagtttacacgaaaagtacggagcaacgctgctataggtgcggttttcgtagatgaaaaccaatggaactccgcaaaagaagcagttgaagatgaaaggttctgggacctagtgcataaagaacgagaacttcacaagcaaggaaaatgcgccacgtgtgtctacaatatgatgggtaaacgagagaagaaactcggagagttcggaaaagcgaaaggatcaagagcgatctggtacatgtggctaggtgcaagattccttgaatttgaagcgctcgggtttatgaatgaagaccattgggtgtcacgagaaaactcactttctggagtagagggagagggattacataagctaggatatattctaagagatatcagtaaaattccaggtggcaatatgtacgcggatgataccgcaggctgggatacccgaataacagaagacgatttacaaaatgaagcgaggataaccgacattatggaacctgaacacgcccttctggccaaaagcatatttaaactaacctatcaaaacaaagtagttagagtacaaagaccagcgaaaaatggcactgtgatggatgtaattagccgaagagatcaacggggcagtggtcaagtaggaacctacggtctaaacacctttactaacatggaggcgcaactaataagacagatggaatcagaaggcatttttagtccatcagaactagaaacaccaaatctggcagaaagagtattagattggcttgaaaaatacggtgtggagagacttaaaagaatggcaattagtggagacgactgcgtagtaaaacctattgatgataggtttgctacagccctcaccgctttaaatgatatgggtaaagtccgtaaagacattccacaatgggaaccttctaaagggtggaacgactggcaacaagttccattctggagtcatcatttccatcaacttataatgaaggacggaagggaaatagttgtaccctgcagaaatcaagatgaattagtaggccgtgcacgggtatctcaaggagcagggtggtcattaagagagaccgcttgcctaggcaagtcgtatgctcaaatgtggcaactcatgtacttccatcgaagagacctgagattagccgcaaacgctatttgtagcgctgtaccagtagattggataccaacaagtcggactacatggtcaatccacgcacaccatcaatggatgaccaccgaagatatgctcagcgtctggaacagagtatggatcgaagaaaatccatggatggaagataagactcacatctcttcgtggggtgacgtcccgtatctaggaaagagagaagatcaatggtgcggtagcttaatcgggctgactgctcgagctacttgggcaacaaatatacaagtagcaattaatcaagtccggcgccttataggaaacgagaattaccttgattatatgacttcgatgaaacgcttcaaaaacgaatcggacccagaaggtgccctatggtag

SEQ ID NO: 21166 - RNA, 9879 nt, synthetic construct
  misc_feature 1..9879: note = derived and/or modified CDS sequence (opt6) from DENV-1__GU131919__SS-prME
  source 1..9879: mol_type = other RNA
tcagtcactatgttactaatgcttatgcctacagcacttgctttccatctaacaactaggggaggggaaccgcatatgatagtctcgaaacaagaaaggggaaagagcttactctttaaaacatcagcaggagtcaatatgtgtacgctaatcgcaatggacttaggagaattatgcgaagacaccatgacctataaatgcccaaggatcacggaggctgaacccgatgacgtcgattgttggtgcaatgcaacagatacttgggtcacatacggtacttgttcacaaaccggtgagcatcgtcgagataaacgatcagtggccttagccccacatgtcggattgggactagaaacaaggacagaaacgtggatgagttctgagggagcctggaaacaaatacaaagggtagaaacgtgggcgcttagacatccaggatttacagtgatagcgctatttctggcacacgctataggcacgtccatcacgcaaaaagggataatatttatacttctaatgctagtaactccatcaatggcaatgagatgcgtaggcataggtagtcgggattttgtagagggattaagcggggcaacctgggtcgatgtagtacttgagcacggaagttgtgtaaccacaatggcaaaagataaaccaacactggatatagaactcttaaaaacagaagtaaccaatccagccatacttcgcaaattatgcattgaagcaaaaatcagcaacacaacgaccgatagtcgatgcccaacgcaaggagaggctacactggttgaagaacaagatgcgaactttgtatgccgacgtacattcgtagacagagggtggggaaatggatgtggactatttggcaaaggttccttaatcacatgtgctaaattcaaatgtgtcacgaaattagaaggcaaaattgtccagtacgaaaacctaaaatatagtgttatagtcacagtacatacaggagatcagcaccaagtagggaacgaatcgacagaacatggaacgacggcgactataacaccacaggcacctacgacggagattcagctaacagattacggagccctgacactcgattgcagtcctaggacaggtctagatttcaacgagatggtgttacttacaatgaaagaaaaatcttggctcgtacataaacaatggttcttagatttgccgctaccttggacttcaggagcatctacgagccaagagacatggaatcgccaggatctattagttactttcaaaacagcgcacgcgaagaaacaggaagtcgtcgttttaggaagtcaagagggagctatgcatacagctctgacaggggcaaccgagattcaaacgtcgggcacaacaactatattcgcaggacaccttaaatgcaggctcaaaatggacaagctaactttaaaggggatgtcgtatgtcatgtgtacaggatcattcaaactagaaaaagaggtagccgaaacacaacatggaactgtgctagttcagataaaatacgaaggtacagacgcaccatgtaaaatcccattcctaacacaggatgaaaaaggagtgactcagaatgggagacttatcacagcaaatcctatagtcaccgacaaagaaaagcctgttaatattgaagcagaacctccctttggggagagttatatagtcattggagccggtgaaaaagccttgaagctgtcatggttcaagaaaggtagtagcatcggcaaaatgtttgaggctacagcaagaggggcgagaaggatggccatattgggggacaccgcatgggatttcggaagtatagggggcgtctttacgagtgtcggaaagctgatccaccaaatatttggaactgcatacggcgtgttattcagtggggtatcatggaccatgaaaattgggattggtgtcttattaacttggttaggacttaactctcgatcaacgagcctgtcaatgacatgtatagctgtaggcctagttacactatacctaggggtaatggtgcaagcagactctggatgcgtaattaattggaaagggagagagctaaagtgtggatcagggatatttgtaaccaacgaagttcacacatggactgagcagtataaattccaagctgactctccgaaacgactatctgcagcaattggaaaggcatgggaagaaggtgtatgtggaataaggagtgcaactaggttggagaatataatgtggaagcaaatatctaacgaactaaatcacattctcttagaaaatgacatgaaattcacggtagtggtaggggatgttgcaggcatcctcgctcaaggcaagaaaatgattagacctcaacctatggaatataagtattcatggaagtcctgggggaaagctaaaataataggtgcagatgtacaaaacacaactttcattattgatgggcccaatacaccagagtgcccagatgaccaacgtgcatggaatatttgggaagtggaagattatgggtttggaatatttacaacgaacatctggttgaagctacgtgacagctatacccaggtctgcgatcatcgattaatgtccgcagcaataaaagattctaaagcggttcacgccgatatggggtattggattgaatcagagaaaaatgaaacttggaagttagctcgagccagcttcatagaagtgaaaacgtgcatatggcccaagagccacacgctttggagtaacggtgtattagaaagtgaaatgatcatacctaaaatatacgggggtccaataagtcaacataactaccgaccaggttattttacccaaacggccggtccatggcacttggggaagttagaactagacttcgatttgtgcgaaggaacaacggtcgtagtagatgaacattgtggaaataggggaccttcactacggaccactactgtcactggtaaaataatacacgaatggtgttgcaggagctgcacattgcccccactacgctttcgtggcgaggacggatgctggtatgggatggaaattagaccagtcaaggagaaagaggaaaacctagtgaagagtatggtttcggctgggtctggggaagtggactccttctcactaggattattatgtatctcaataatgattgaagaggttatgagaagtaggtggtcaagaaaaatgcttatgacaggaacactagcagtgttccttttactcattatgggtcaactaacgtggaatgacctcatccgtctctgtatcatggttggggcgaacgcctgcgatcgtatgggaatgggaacaacatacctcgcgttaatggccacttttaaaatgcgaccaatgttcgcagttgggttattgttccgacgcttaacctccagagaagtattactcttaactatcggattgtcattagtggcatcagtagagttaccaaattccttggaagaattaggggatggtcttgcgatgggaataatgattctaaaacttttgacagacttccagtcatatcagctctgggccacattgctctctctgacatttataaaaacaacattctctttgcattacgcctggaagactatggcaatggtcctatctatagttagtttattcccgttatgtctctcaactacaagccaaaagaccacatggcttccagtattattaggatcactaggatgcaagccattaactatgttcttaatcgcagaaaataaaatatgggggagacgctcatggccattaaacgaaggaataatggccgtgggcatcgtatccatattattatcatcactactcaaaaatgatgttcccctagctggacccttaatcgctggcggtatgctaatcgcatgttatgtgatcagtggtagttctgctgaccttagcttagaaaaggccgctgaagtaagctgggaagaggaagcggaacactctggtgcgtcgcacaacatattggttgaggtacaagatgacggtactatgaaaataaaagatgaagaacgtgatgatacactgacgatattactaaaagcaactttgctggctgtaagtggtgtataccctttgtcaatccccgcaacactgttcgtgtggtatttctggcagaagaagaaacaacggagcggggtattatgggatactccaagtccccctgaagtggaaagagccgtactggatgatgggatatacagaataatgcagcgcggactgctgggtcgaagtcaagtaggtgttggagtatttcaggaaaatgttttccacacaatgtggcatgtgactcgaggtgcagtcctaatgtaccaaggaaaaagactagaaccttcgtgggctagcgtcaagaaagatctgatttcttatggaggaggatggcgcctacaagggtcatggaatacaggggaagaagtgcaagtcatagcggtcgaaccaggcaaaaaccccaaaaacgtccaaacagcaccgggcactttcaaaactcctgaaggtgaagtcggtgcaatagcactcgatttcaaacccggaacatcagggtcaccgatagtgaatagagaaggaaaaattgttggattatacgggaacggggtagtcactacatcgggaacatatgtatccgctatagcacaagctaaagccagtcaggagggtccattaccagaaatagaagatgaagttttcagaaagagaaacttgactatcatggacttacacccagggtcaggcaaaactcgacgatatctcccagcaattgttagagaagcaattaaaagaaagttaagaacgttaatacttgctcctacccgagttgtagcatctgaaatggctgaggctttgaagggcatgcccatccgttaccagacgactgcggtcaagtcagaacacacaggtaaggagatagtagatctaatgtgtcatgcaacatttacaatgagactattgagtcccgttagggtgcctaattataatatgataatcatggacgaagctcactttacggatccttcaagcattgctgctagaggttacatttctactcgagtgggaatgggcgaagccgctgcaatctttatgacagccactccaccaggcagcgtggaagcgttcccccaaagcaatgcagttattcaagatgaagaaagggacatacctgaacgaagttggaactccggctacgagtggataactgatttcccaggaaaaactgtttggttcgtcccgtcgatcaaatccgggaatgacatagcaaactgcttgcggaaaaacggtaaacgcgtgatacagctaagcagaaagacgttcgatacagaatatcagaagaccaaaaacaatgattgggactatgttgttacaacagacatatcagaaatgggtgccaattttagggctgacagagtgatagatccaagaaggtgtctaaaaccggtaatactaaaagacggtcctgaaagagtcattcttgcaggccccatgcctgtcactgttgcgtcagcagctcaaaggcgcggtagaattggaaggaaccacaacaaagaaggagatcaatatatatatatgggacaaccactcaacaatgacgaggatcacgctcactggactgaagcaaaaatgttgctagataacatcaacacaccagagggcattataccggcgttattcgagccagaacgtgaaaaatcagcggcaatagatggagaatatagattgcgaggagaagcacgtaaaacctttgtagagctaatgagacgcggagatctcccggtctggttaagttataaggtcgcgtctgagggcttccagtacagcgataggaggtggtgcttcgatggggaaagaaataatcaagtgctagaggagaacatggacgttgaaatatggactaaggagggcgagaggaagaaactaagaccacgatggttagatgcgagaacatatagcgatcctctagcattaagagaatttaaagaatttgcagcagggagaagatcagtttctggggatcttatattggagattgggaaactcccacaacaccttacgcaaagggctcaaaacgccctcgataacctagtaatgctacacaattctgagcaaggcgggagagcataccgccacgcaatggaagaactaccggacaccatagaaacattgatgttactcgccctaatcgcagttcttacgggaggagtaaccctattctttttgtcaggtcgaggtttgggaaaaacgagcatcgggttactttgtgtcatggcttcatcagttctattatggatggctagtgtagaaccacattggatagcagcatcaattattttagaatttttcctaatggtattattaatccctgaacctgatagacagagaacaccgcaagacaaccaactagcttatgtagtgataggcctactgtttatgatcttaacagtagcggctaatgagatggggcttctagagaccactaagaaagacctcggtatcggtcacgtcgcagtgggaaatcatcatcatgcagcaatgctagatgtcgacttgcatccggcatcagcgtggacattatatgcagtggctaccacgatcataacacctatgatgcgacatacaattgaaaacacgacagcaaacataagtttaacggcaatagcaaatcaagccgcaatattgatgggcctagacaaaggctggcctatttccaaaatggatataggagtacccttgctcgctctaggctgttattctcaagttaaccccttaactcttacagcggcagtcttaatgttagtagctcactatgcaattataggacctgggttgcaagcaaaggcaacacgcgaagcccaaaaacgaactgctgcaggaatcatgaaaaacccaaccgtagacgggattgtggctatcgatttagatcctgtcgtttatgacgcaaagttcgaaaaacaactggggcaaataatgttactgatactgtgtacgtcgcaaatcctcttgatgagaacgacgtgggctttgtgcgaaagtattacactggcgaccggacctttaacaactttatgggaagggtcgccgggcaaattttggaacacaacaattgctgtcagtatggcaaacatatttcggggctcctacctagccggcgctggtctagcgttcagcctaatgaaatccttgggcggtggccgaagaggtaccggagcacaaggagaaacactaggggaaaaatggaagagacaattaaaccaattatcaaagagcgagtttaatacctataagaggagtgggattatggaagtggacagatcagaggctaaagaaggacttaaaagaggggaaacgacaaagcatgctgtaagcagaggtaccgcgaaattgcgatggttcgtcgaaagaaacctcgtaaagccagaaggcaaagtaatagaccttggatgcggtagagggggttggtcctattactgcgctggtttgaagaaagtaactgaagtaaaaggttatacgaaaggagggccggggcacgaagaaccaatccctatggcgacatatggctggaacttggttaaactacatagcggaaaagatgtgttctttatacctcctgagaaatgcgacacactcttatgcgatataggagagtcatcaccaaatccaaccatcgaggaggggaggacactaagagtattaaaaatggtcgaaccatggctaagaggaaaccaattttgtataaagatacttaacccgtacatgccctcggtcgttgaaactttagaacaaatgcaacgaaaacatggcggaatgttagtaagaaacccgttgtcaagaaattcaacacatgaaatgtattgggtttcatgtgggacaggtaatatagtatccgccgtcaacatgacatcgagaatgcttttgaatcgctttacaatggcccatcgtaaaccaacatatgaaagagacgtagacttgggcgcaggaactagacacgtcgccgtggaacctgaagtggctaatttagatataataggtcaaagaatcgaaaatataaagcatgaacacaagagtacctggcactatgatgaagacaacccatacaaaacatgggcctaccacggttcttatgaagtaaaacccagcggatctgcgagttcgatggtcaatggggtagttaaattgctaacgaagccatgggatgtaattccgatggtaactcaaattgcaatgacggatacaaccccctttgggcaacaacgagtattcaaagaaaaagtcgacacacgaacgcctaaagcgaaaaggggtaccgcgcaaataatggaagtaacagcgaagtggttatggggatttctaagtagaaataagaaacccaggatttgtacgagggaagaatttacacgaaaagtaagaagtaatgctgccattggagcagtctttgtcgatgagaaccaatggaactcagcaaaagaagcagtagaagatgaaagattctgggatttggtgcatcgcgaacgtgagttgcataaacagggcaaatgcgcaacatgtgtatataatatgatggggaagagagagaagaaactaggggaatttgggaaagcaaaaggatcaagagctatatggtatatgtggctcggggcaagatttttggaatttgaggctttaggcttcatgaacgaagaccattggttttcaagagaaaactcactttcaggtgtggagggggagggactgcacaaattagggtatatactgagagatataagtaaaattccaggagggaatatgtatgcggatgacacagcgggatgggacacgagaattacagaggacgacttacaaaatgaagctcgcattacagatattatggagccagaacatgcgttattagcgaaatccatctttaaacttacatatcaaaataaagtagtacgtgtccagaggccagcaaagaatgggactgtgatggatgtaataagcagacgtgatcaaaggggtagtggacaagtaggtacatatggactaaacacattcacaaacatggaagcacaacttataagacaaatggaatcagaaggaatattctccccaagtgaacttgagaccccaaaccttgcggaaagggtactagattggttggaaaaatatggagtcgaaagattaaaaagaatggcaatatccggtgacgattgtgtcgtaaaaccaatcgacgatagattcgctaccgcattaacagccctaaacgacatgggcaaagtacgaaaagatattccacagtgggagccgagcaaaggttggaacgactggcaacaagttccattttgcagtcatcatttccaccaattaataatgaaagatggcagagaaattgtggtaccttgtcgaaaccaagatgagcttgtaggacgggcacgcgtatctcaaggagcaggctggagcttaagagaaacagcttgtctaggcaaatcatatgctcaaatgtggcagctaatgtattttcatcgaagagatcttagactagcggcaaatgcgatatgctcagcagtgccagttgattggattccaacttcaagaactacgtggtcgattcatgcccatcatcagtggatgacgacagaagacatgctgtcagtttggaatcgagtctggattgaggaaaatccatggatggaagacaaaacacatatctctagctggggcgatgtaccgtatctaggtaagagagaggatcaatggtgtggatctcttatcggactaactgcgagagcgacctgggcgaccaacattcaagtcgcaatcaatcaagttaggcggttaataggaaacgagaattaccttgattacatgaccagtatgaaaagatttaaaaatgaaagtgatcccgagggtgctctctggtga

SEQ ID NO: 21167 - RNA, 9879 nt, synthetic construct
  misc_feature 1..9879: note = derived and/or modified CDS sequence (opt6) from DENV-1__GU131920__SS-prME
  source 1..9879: mol_type = other RNA
tcagtgactatgttactaatgctaatgcccacagcgttagcgttccatctaaccacgagagggggtgaacctcatatgattgtaagtaaacaagaaaggggaaaaagtctgttattcaaaacctccgccggtgtaaatatgtgcacattaatcgctatggacctaggggaactgtgtgaggatacgatgacctataaatgtcccaggataacagaagcagagccagacgatgtagactgttggtgtaatgctacagatacgtgggtcacatatgggacgtgtagtcaaacgggagagcaccgccgcgataaacggtctgttgcactggcgccgcatgttggacttggattagagacccgcacagaaacatggatgtcatccgaaggcgcatggaagcagattcaacgtgtagaaacctgggcattacggcacccaggattcacagtaatagcactattcctagcacatgccataggtacctcaattactcaaaaaggaataatatttatactgttaatgttagttacaccatccatggcaatgcgatgcgttgggattggatcccgcgatttcgtggaaggcctatccggtgcaacatgggtagatgtagtcctagagcatgggtcttgcgtcacaacgatggcaaaagacaaacccacgctcgatattgaactattgaaaactgaagtaacgaaccctgcaatcctgaggaaattgtgcattgaggcaaaaatatctaacactaccaccgacagccgttgtcccacccagggagaagctacattagtagaagaacaagacgcaaattttgtttgtaggcgaacatttgttgaccgcgggtggggtaatggatgtggcctattcgggaaaggctcccttattacatgcgcaaaatttaaatgtgtgaccaaactagaaggcaaaatcgtacaatatgaaaatctaaaatattcggtgatagttacggttcatacgggagaccaacatcaggtaggtaacgaatcaaccgaacatggaactacagcaaccatcacaccgcaagcaccaacaacagaaatacaacttacagattatggtgcactaactctggactgctcaccaagaacaggtctagacttcaatgagatggtattattaacgatgaaagaaaagtcttggttagtacataaacaatggtttctagatctgcctttgccatggacttccggcgctagtacatcacaagaaacatggaacagacaggatcttttggtaacatttaaaacagctcatgccaaaaagcaagaagtagtcgttctaggaagtcaagaaggtgccatgcatactgccttaacaggtgccacagaaatccagacatcaggaactacaaccatttttgccggccacctgaaatgtaggctaaaaatggacaaacttacactaaaggggatgtcctatgtaatgtgtacaggatcatttaaattagaaaaagaggtagctgaaacacagcatggaacagtgcttgtccaaattaaatatgaagggaccgacgctccctgtaaaattccgttctcgacgcaagatgaaaagggagtaacgcaaaacggaaggctcataacggcaaatcctatagttacggatagagagaaaccagttaatatcgaagcggaaccacccttcggcgaatcatatatagttataggagcgggtgaaaaagcacttaaacttagctggtttaaaaagggaagtagtatcggaaaaatgtttgaagccacagctcgcggagcacgcagaatggcaatactcggtgacactgcctgggatttcggaagtattggaggtgtatttacatcagtcggtaagctagtacatcaaatctttggtacagcatacggcgtcttattttcaggggtatcgtggacaatgaaaatcggtataggagtgttattaacatggttaggccttaatagtagatccacatccctgagcatgacatgtatagcagttggattagtaacgttataccttggagttatggtgcaagccgattcagggtgcgtgataaattggaaaggacgagagttaaaatgtggcagtggtattttcgtaacaaacgaagtacacacatggacggagcaatataagtttcaagcagattccccgaagagactctcagcagccattggcaaagcatgggaagaaggcgtatgtggcatacgatcggcaacaagactagaaaacataatgtggaaacagatctctaacgaactaaatcatattttgttggagaatgatatgaagtttactgttgtggtaggcgatgtagcagggattttagctcaagggaagaaaatgataagacctcaacccatggaatataaatattcctggaagagttggggaaaagcgaaaataataggagccgacgtccagaatacaacatttataattgatggtccgaacacccctgaatgcccagatgaccagagagcatggaacatatgggaagttgaagactacggattcgggatattcactacaaacatatggctcaaactaagagacagttacactcaagtttgtgatcataggttaatgtcagcggctattaaagattctaaagcggtccacgcggatatgggttattggattgaatctgagaagaacgaaacatggaaattagcaagagcgagtttcatagaggtgaaaacatgcatttggccgaaaagccatacactatggagcaatggtgtattagaatcagaaatgatcattcctaaaatatatggtggtccaattagccaacataactatagaccaggatactttacacaaacagcagggccctggcacctaggaaagttagaattagattttgatttatgcgaaggtacgactgttgttgtcgatgaacattgtgggaataggggcccatcacttagaaccaccacagtcacgggcaaaataatacacgaatggtgctgtcgatcatgcacattaccaccgcttagatttcgaggcgaagatgggtgctggtatggaatggagatcagaccggtcaaagaaaaagaagagaatcttgtaaagtcaatggtgtcggctggttctggggaagttgatagtttcagtctgggtctattatgtataagtataatgattgaagaagtaatgcgaagccgatggagcaggaaaatgttgatgacaggaacactagctgtattcctactgcttataatgggtcaattgacgtggaacgaccttatacgtttgtgtattatggtaggagcaaatgctagtgacagaatgggcatgggaacaacatatctagcgctaatggctaccttcaagatgcgtccaatgtttgctgtcgggttattgtttcgacgattgacatcaagagaagtactactgttgactattggcttaagtttggtcgccagcgtcgagctgcccaattcactagaagaattaggagatggactagccatgggaattatgatattaaaattactaacggacttccaaagtcatcagctttgggcaacgttacttagtttaacattcattaaaacaactttctcgcttcactatgcatggaaaacaatggctatggtgctcagtatagtcagtctctttccactatgcttaagtacaaccagtcagaaaacgacatggctccctgttttgttaggcagcctgggctgtaaaccccttactatgttccttattgcagagaataaaatttggggaaggagatcttggccattaaacgaaggaatcatggcagtgggaattgtgtcgatcttattatcatcgttgctcaaaaatgatgttccgttggctggacccttaatagctggtgggatgttgattgcctgctatgttataagcggcagcagcgcggatttgtcgttagaaaaagcagcagaagttagttgggaagaagaagcggagcactcaggggcatcacataatattctagtagaagttcaagacgatggtacgatgaaaataaaagatgaggaaagggatgatactttaacgatactgttaaaagcgacacttctagcagtgtctggagtttatccacttagcatccccgcaacccttttcgtctggtatttctggcaaaagaagaaacaacgcagcggggtcctatgggacacgccatcaccaccagaagtcgaacgagcagtactagatgatggcatttatagaataatgcaaaggggattgttaggaagatcacaagtaggagtaggagtctttcaagagaatgttttccacacaatgtggcacgtgacacgaggagccgtattaatgtatcaaggtaagagattagaaccatcctgggcatcagtcaagaaagatctaataagttacgggggtggatggagattacagggcagttggaatacgggtgaagaagtccaggtcatagccgtcgaacctggcaaaaatccaaagaatgttcaaacagcaccaggcacattcaaaacaccagaaggtgaagttggggcaatcgcactcgacttcaaacccggaacttccggaagccctatagtaaaccgagaggggaaaattgtgggtttgtacggtaatggagtagtaactacgtcaggaacatatgtcagcgcaatagcacaggcaaaagcatctcaagagggtcccttaccagaaatcgaggacgaagtctttcgaaaaagaaaccttacaattatggatcttcatccggggtcaggcaagacaaggagatatctgcctgctattgtaagagaggcaatcaaaaggcgattaagaaccttaattctggcacccactagagttgtggccagtgaaatggctgaggctttaaagggtatgccaatccgctaccaaactacagcagtgaaaagtgaacatactggtaaggaaatagtagacttaatgtgccatgcaacgttcacaatgcgtctattatcccctgttagagtgccgaactacaatatgataataatggacgaagcccatttcacagacccttcaagtatagccgctagaggatacattagcacaagagttggaatgggagaagctgcggccatttttatgacggcgactccacccggtagcgtagaggcatttccacagtcaaacgctgtcatacaggacgaggagcgcgatattcccgaaagatcatggaactcgggatatgaatggataaccgatttcccaggaaagaccgtttggtttgttccgagtataaaatcagggaacgacatagcaaactgtctaaggaaaaatggcaaacgggtgattcaattatccagaaaaacgtttgatacagagtatcagaaaaccaaaaataatgattgggactatgtagtaactactgatataagcgaaatgggtgccaactttagagctgatagagttatagacccaagacgctgtttgaaaccagtaattttgaaagatgggcccgaacgggtcatattagcaggtccaatgcccgtaactgtagcctcagctgctcaacgacgcggaagaataggcagaaaccataataaggaaggagatcagtatatttacatgggacagcctcttaataatgatgaagatcatgcacattggactgaagcaaaaatgctccttgacaacatcaatacaccggagggtattattcctgccctctttgagccggagagagaaaaatcagcagcaatcgacggcgaatataggttacgtggcgaagcgcgtaaaactttcgtagagttaatgagaagaggagatttaccagtgtggctaagttacaaggtggcgtcagaaggatttcaatactcggatagaaggtggtgctttgacggagaaagaaataatcaagtcctagaagaaaatatggatgtagaaatttggacaaaagaaggtgagcgtaagaagttaagacccagatggctcgacgcacgaacatactccgatccacttgcacttagggagtttaaagaatttgcggcgggacgacgttccgtatcaggtgatctgatactagaaattggaaaactacctcaacaccttactcaacgagcacaaaacgcgttagataatttggtgatgttgcataacagtgaacaaggcggtcgtgcgtatagacatgcgatggaggaattacctgatacaatagaaacgctgatgttactagcactaatagctgttttgacagggggtgtcactttattctttctgtcaggtagagggttgggaaagacatcaataggactcttatgcgtgatggcctcgagtgtcttgctctggatggcaagcgtcgaaccacattggattgccgcaagtattatattagagttctttctaatggttcttcttataccagaacctgatagacaaaggacaccgcaagacaaccagttagcgtatgtagttataggacttctttttatgatcctcactgtagcagcaaatgaaatgggcttattagaaacaactaagaaagatttaggaatcgggcatgtagcggtcggaaatcaccaccacgccgctatgctagacgtagacctacatccggcatcggcatggacgctttatgctgtcgcaaccacaataataacacctatgatgaggcacactattgaaaatacgacagcgaacatctcactgactgctatagcaaaccaggcggccatattaatgggactcgacaaaggctggccaatatcaaaaatggatataggcgttcctcttcttgcgctaggttgttatagtcaagtaaacccccttactttgacagctgctgttttaatgttagtcgcccactatgccataattgggccaggccttcaggctaaagcaaccagagaggctcaaaaacggactgccgcagggataatgaaaaatccaaccgtagatggcattgtagcgatagatttggatccagtcgtatatgatgccaagtttgaaaagcaactaggacaaataatgttattaatactgtgcacaagtcaaatcctattaatgagaactacttgggcactatgcgaaagtataacattagccactggacctttaacaacattgtgggaaggatcaccaggtaaattctggaatacgactatagctgtaagtatggcaaacatatttcggggttcttatttagctggagcagggttggccttttcactcatgaagtccttaggaggtgggagaagaggtacgggtgcccaaggagaaaccttaggggagaaatggaaacgacagctgaatcaactatccaaatcagaatttaacacctataagcgctccggtattatggaggtcgatagatcggaagccaaagaaggactcaaacgaggcgagaccacaaagcacgccgtctcgagaggaactgcaaaactcagatggttcgtcgagcgaaacctggtgaaaccagaaggaaaagttattgatcttggatgcggaaggggtggatggtcatactactgtgcagggctcaaaaaggtaacagaggttaaagggtacaccaaaggcggacccggtcacgaggaacctattcccatggcaacgtatggttggaacctagtgaaactgcactcaggcaaggacgtattcttcatcccgcctgaaaagtgcgatacgttactatgtgatattggagaatcaagtccgaatcctacaattgaagaaggtcgtacgttacgagtactaaagatggttgaaccctggttgagaggaaatcaattttgtattaaaatcctgaatccatacatgcccagtgttgtagaaacattagaacagatgcaacggaaacatggagggatgctggtacgtaacccactcagccgtaactcaacacatgaaatgtattgggtaagctgtgggacaggtaatatagtctccgctgttaacatgacatcacgaatgctgttaaataggtttacgatggcccataggaaacctacttacgaaagagacgttgatctaggagccgggacgagacatgtagctgtggaacccgaagtagctaacctcgatatcataggccagcggatagaaaacattaaacatgagcataaatcaacatggcattatgacgaagataatccatacaagacatgggcatatcacggcagttacgaggttaagccaagcggcagcgcatcttcaatggtaaatggagtggtaaaactactcacaaaaccttgggacgtgattccaatggttacacaaatagctatgacagacactacaccatttggtcaacaacgcgtatttaaagagaaagtagacaccagaactcctaaagcaaagagaggaaccgcccaaataatggaagttacagctaaatggctctgggggtttctatcacgaaataaaaagccacgtatatgtacgcgagaagaatttacaagaaaagtgcgatcaaatgcagcaattggagctgtctttgtggacgaaaaccaatggaacagtgcaaaagaagccgttgaggatgagagattttgggatctagtgcataaagaaagagaattacacaaacaaggaaaatgtgctacatgtgtgtacaatatgatgggtaaaagagagaagaaattaggtgaatttggaaaagcaaaaggatcgagagcaatatggtatatgtggttaggcgcaagatttttggaatttgaagccttaggcttcatgaatgaagatcactggttcagtcgcgaaaacagcctaagcggagtagaaggagaaggacttcacaaacttggatacattctaagggacataagcaaaataccaggtggaaatatgtacgcagacgacactgctggatgggatacgcgaattacagaagatgacttacagaatgaagcacgcatcacagatataatggaaccagaacatgcgttactggcgaagagtatattcaaactaacgtaccagaataaagtcgtgagggtgcagcggccagccaaaaatggtactgttatggatgtaataagtcggagagatcagcgtggttcgggacaagtcgggacatacggattaaatacgtttactaatatggaagctcagcttatacgccaaatggaaagcgagggtatcttcagtccttcggaattagaaacgcccaacctagctgagcgcgttctggactggctggaaaaatatggagttgaaaggttaaaaaggatggcgatttccggagacgactgtgtggtcaaacctattgatgaccggttcgccacagcattaacagcactaaatgacatggggaaagttaggaaagacataccgcaatgggagcccagtaaaggatggaacgattggcaacaagtaccattctgttcacaccactttcatcagttaataatgaaagacgggagagaaattgttgtaccttgcaggaatcaagatgaattggtggggagagcaagagtgtcccaaggagctggctggagcttgcgcgaaacggcttgcttaggcaaaagttacgcgcaaatgtggcaattgatgtattttcatcgcagagacctgaggctcgccgctaacgcaatttgtagtgcagtaccagtagattggattccaacttcacggacaacctggtcaatacatgcacatcaccaatggatgactacggaagatatgctgagtgtctggaatagggtgtggatagaagagaatccgtggatggaagataaaacacacatcagttcgtggggagatgtaccctatttgggtaagagggaggaccaatggtgtggcagcttgattggactaacggcaagagcaacctgggctacaaacatacaagtcgcgatcaaccaggttagacggctaatagggaatgaaaattacttagactatatgacaagtatgaaaaggttcaaaaacgagtccgatccggagggtgcactttggtga

SEQ ID NO: 21168 - RNA, 9879 nt, synthetic construct
  misc_feature 1..9879: note = derived and/or modified CDS sequence (opt6) from DENV-1__GU131921__SS-prME
  source 1..9879: mol_type = other RNA
tcggtaacgatgctattaatgttaatgccgactgctttagcgtttcatcttactactagaggtggggaacctcacatgattgtatctaaacaggaaagaggtaaatctcttctatttaaaacatctgctggtgtaaatatgtgtaccttaattgcaatggacctaggggaactctgtgaagatacgatgacttataaatgtcctagaataacggaagcagaaccggacgatgtagattgttggtgtaacgcaacagacacttgggttacctacgggacgtgttcacaaacaggggaacaccgacgggacaaaagatccgtggcactggcaccacacgtaggacttggtttagaaactcgaacagaaacatggatgtctagtgaaggcgcatggaaacaaatacaaagagttgaaacatgggcactccgtcatcccggtttcactgttatggcactatttctagcacatgctatagggacgtcaatcactcaaaaaggcatcatatttatattgcttatgttagtaacacccagcatggcgatgaggtgcgtgggtatcggatctcgcgatttcgtagaagggttaagtggtgcaacatgggtagatgtcgtcctagagcacggatcatgtgtaactacaatggcaaaagacaaaccaacattagacatagaactgctaaaaactgaagttactaacccggcaatactacgtaaattatgtatagaagctaaaatttcaaataccacaacagactcacgttgcccgactcaaggagaagcgaccttagtagaggaacaggacgctaactttgtgtgccgtcgaacctttgttgaccgaggctggggtaatggctgtggattatttggaaaaggatcattaattacttgcgcaaaatttaaatgtgttacaaaattagaaggaaaaattgttcaatatgaaaatttgaaatattctgtaatagtaaccgttcacacaggtgatcaacaccaagtgggaaatgaaagtacagaacatggaacgacagcaacaataacaccgcaggcacctatgactgaaattcagttaactgactacggagcgttaacactagactgctcacctagaacaggtttagattttaatgagatggtactgcttacgatgaaagaaaaatcatggttggtacacaaacaatggtttctggatctcccattaccgtggacatcaggagcgtctaccagccaagaaacatggaataggcaagacttacttgttacgttcaaaacagcgcatgccaagaaacaagaagtggtggtattgggtagccaagagggggcaatgcacacagcacttacaggggcaactgaaattcaaacatcagggactaccaccatctttgccggtcatttgaaatgccgcttaaaaatggataaattgactctaaaaggcatgagctatgtcatgtgcactgggagcttcaaattggagaaagaggtagcagaaacacaacatggcaccgtattagtacaaattaaatatgaaggcacagatgccccctgcaaaatacctttttcaacacaagatgaaaaaggagtcacacaaaatgggcgtcttattacggccaacccaattgttacagataaagaaaaacccgtgaatattgaagcggagccaccgtttggcgaaagttacatcgtgataggagctggcgaaaaagcattaaaattaagctggtttaaaaagggttcttccattggcaagatgttcgaggctacagcaaggggcgctcgaagaatggcaattctcggtgataccgcctgggactttggaagtatcggaggtgtatttacttcagtaggaaaactggtccatcaaatttttggagccgcatacggggttctgttcagtggcgtcagttggacgatgaaaattggaataggagtattgttaacttggctaggcctgaatagtcgctctacaagtttatctatgacatgtattgctgtcggcttagtaacattgtatttgggcgttatggttcaagccgactctggttgcgtaataaactggaaaggtagagaactaaaatgtggctccggcatattcgttactaatgaagtccatacatggacagaacagtataaatttcaggctgattctccaaaaagattaagcgccgcgataggcaaagcatgggaagagggtgtatgtggtataagatcggcgaccagattagaaaacataatgtggaaacaaataagtaatgaattgaaccacatacttttagaaaatgatatgaaatttacagtggtagtaggagacgtcgcgggcatcctcgcccaaggtaagaaaatgataagaccacaaccaatggaatataagtactcctggaaaagttggggtaaagctaaaataataggggctgatgtacaaaatacgacatttattatcgatggacccaatactcccgaatgtcctgatgatcaaagagcgtggaacatatgggaggtagaagattatggattcggcatatttacaactaatatctggctaaaactgagggactcctatacccaggtatgcgaccataggcttatgtcagcggcaatcaaagattctaaagccgtacacgcggatatgggatactggatagaatcagagaaaaatgagacatggaaacttgcaagagcttcgttcatagaagtcaagacttgcatttggccaaagtcacatacactatggagcaacggagtcctagaatccgaaatgataatacccaaaatatatggcggaccgattagccaacataattatcggcccggttattttacacaaacggcaggaccctggcatttgggaaaattagaactcgactttgatttatgcgaagggactacagtggttgtagacgaacattgcggtaacagagggcctagcttaagaaccacaacggttactggaaaaataatacatgagtggtgttgcaggagctgtacacttccaccgctacgattcagaggtgaagacggttgctggtacggcatggaaatacgaccggtaaaggaaaaggaagagaacttggtcaaatctatggtaagtgcagggagtggagaagtcgattccttttccttgggactgttatgtatcagtataatgattgaagaggtgatgcggtcacgatggtcaaggaagatgttgatgacaggaacattagctgtgttcttactattgattatgggacaactaacatggaatgatttaataagactatgtattatggtaggagcaaatgctagcgacagaatgggtatgggtactacatatttagcactgatggcaacatttaagatgagaccgatgtttgcggtagggcttctctttcgccggctgacaagccgagaagtactcttacttacaatcggtttgagcttagttgctagcgttgaactaccgaacagtttagaagagttgggtgatggtctggcaatgggcataatgatcttaaaattattaacagattttcagagccatcaactttgggctacactactttctttaactttcataaaaacaacatttagtcttcactatgcttggaaaacaatggccatggtcctttcaatcgtctcactattcccactttgtctctctaccacaagtcagaaaactacatggcttcctgtattgctaggaagcctgggttgtaaaccgttaacaatgtttttgatcgcagaaaacaaaatttggggacggagatcatggccattaaacgaagggataatggcagtcggcatcgtttcaatcctgctaagcagtctattaaagaacgacgttccgctagctggaccacttatagcaggaggcatgttaatagcttgttacgtaattagcgggagtagtgcggacctaagtttggaaaaagcagccgaagtcagttgggaagaggaagccgaacactccggtgccagtcataacatcctagttgaagtgcaggatgacggaacgatgaaaattaaagacgaagaacgggatgacacattaacaatacttcttaaagcaacgctactcgcagtttcaggagtctatccgttaagtatccccgcaaccctctttgtctggtacttctggcagaagaagaaacaaagatcaggagtactgtgggacactccatctcctcctgaggttgaaaaggcagtattggacgatggcatatatagaataatgcagcgagggttgctaggtcggtctcaagttggagtcggggtatttcaggagaatgtctttcacaccatgtggcatgtcactagaggcgcagtactgatgtatcagggaaaaagactcgaaccttcttgggcatcagtcaagaaagacctaattagttacggaggagggtggcgccttcaaggtagttggaacaccggggaagaagtacaagtaatcgcagtagagcctggcaaaaacccgaaaaacgtacaaacagcgccaggaactttcaaaactccagagggagaggttggagctattgccttagattttaagcctggaacgtccggtagccccatagtaaacagggaaggcaaaattgtaggattatatgggaacggagtggtaacgacaagtggaacttacgtatcagcaattgcacaggccaaagcatcgcaagaaggaccgttaccagaaatagaagacgaggtcttccgtaagaggaacctaacaataatggatctacatcccgggagcggaaaaacgaggaggtacctaccagcaatagttagagaagcaataaagcgaaagttacgtaccttaatattagcgcctacaagagtcgtagcaagcgaaatggccgaagcattaaaaggaatgcccatcaggtaccaaacaacagccgtgaaatctgaacatacagggaaagaaatagttgacctaatgtgtcatgcaacgtttacgatgagattactatcacctgttagagttcctaactataacatgatcattatggatgaagcgcactttacggacccttcatcgattgctgcacgcggatatatttctacacgagtgggtatgggtgaggcagctgctatctttatgacagccacaccgcccggatcagtggaagcgtttcctcaaagtaatgcagtaattcaagatgaggagagagacatccctgaacgatcctggaacagtgggtatgaatggattacggattttccgggaaaaacagtttggtttgtcccgagcatcaagtctggaaatgatatagctaactgtcttaggaaaaatgggaaacgcgtcatacaactcagtagaaaaacatttgataccgaatatcaaaagaccaagaacaatgattgggattatgttgttactacggatatcagtgaaatgggagctaattttcgtgcagatcgggttatagatcccagaagatgcctaaaaccagtaatactaaaagacgggccagaacgagtaattttagctgggcccatgccagtaactgtcgcatcggccgcacaacgtagaggtcggataggaagaaatcataacaaagaaggcgaccaatatatttatatgggacaacctttaaacaacgatgaagaccatgcacactggaccgaagcaaaaatgttattggataacataaatacgccagaaggtattattcctgcccttttcgaaccagaaagagagaaaagtgccgcaatagacggtgaataccgcttgcgtggtgaagcacggaaaaccttcgtggagctaatgagacgaggcgatctacctgtatggctaagctataaggtagctagcgaaggttttcagtattccgacaggcggtggtgtttcgacggtgaacgaaacaaccaagtccttgaagagaacatggatgtcgaaatctggaccaaagaaggcgaacgaaagaaacttcgaccccggtggctcgatgctcgaacatactcagatccattggctttgcgggagttcaaggagttcgcagcaggtaggagaagcgtttcaggtgaccttatactggaaattgggaagctgccacaacacttaacacagagggctcagaatgcccttgacaatttagtaatgttgcataatagcgaacaagggggtagagcttacagacatgctatggaagaattaccagacacgattgaaacactgatgttgcttgcgttaattgcggtcttgacaggaggagtaacgttattcttcttgtcaggtcgcgggcttggaaaaacaagtataggcctgttatgtgtaatggcatcttccgtactattatggatggcgtcggttgaaccacattggattgcggcttctatcattctcgaatttttcttaatggtcttactaataccagaaccagatagacaaaggacccctcaggataaccaactcgcatatgttgtcataggtctactatttatgatactaacagttgctgccaatgaaatggggctattagaaactaccaagaaagatctcggaatagggcacgtggctgttggaaatcaccatcatgctgcgatgttagacgttgatctacatcctgcatctgcctggactttgtacgcagtagcaactacaataatcacgcccatgatgcgacacacaatagaaaatacaactgctaatatttcgctgactgcaatagctaaccaggcagcgatcttaatgggtctagataagggatggccaatctctaaaatggatattggggtgccattgttggcattaggctgctatagccaagttaatccacttacactgacggcagcggttttaatgttggtagctcattatgccataataggtccagggttgcaggctaaagcaacacgtgaagcacagaaacgaacagcagcgggaataatgaaaaatcctactgttgatggcattgtggctattgacctcgacccagtagtatatgatgcaaaattcgaaaaacaactaggtcagattatgctacttatcttatgcacaagtcaaatacttttaatgagaacgacttgggctctatgcgaaagtataacattagcaactggtcccttaacaacactatgggagggttcaccgggaaaattttggaatactacaatagctgtgagtatggcgaatatatttagaggttcttacttagctggagcgggtctagcgttttcgttaatgaaaagtttaggaggagggcgaagaggaacgggagcgcagggcgaaacgcttggagaaaagtggaaacgacaactaaaccaactttctaaatctgagttcaatacatataaacgctccggaattatggaagtagatagatctgaagctaaagaaggattaaaaagaggtgaaactacgaaacatgcagtatcaagaggtactgcaaaacttagatggttcgtggaaagaaatctcgttaaacctgaaggaaaagtaattgacctaggatgcggacggggcggatggtcgtactattgcgcaggactaaagaaagtaacagaagtaaaaggctataccaaagggggtccaggccacgaagaacccataccaatggctacttatggttggaatcttgtcaaacttcattcgggaaaagacgtgttctttattccacctgagaaatgcgatactcttctttgtgacataggcgaatcctcaccaaatcctaccatagaggagggaagaacattaagagtactaaagatggtggagccttggcttcgcggtaatcaattctgcataaagatattaaatccctacatgcctagtgtcgtagaaactcttgagcaaatgcaacgtaagcacggtggaatgctcgtgaggaacccgttaagcaggaatagcactcatgagatgtattgggtaagctgtggaactgggaacatagtgagcgcggttaatatgacgagtagaatgttattgaataggtttaccatggcccatagaaaacccacatacgaaagagatgtggatttaggagcagggactaggcacgtggcggtcgaacctgaggtagctaacttggatataatcggacagcgtatagagaacataaaacatgaacataagtcaacgtggcactatgacgaggataatccttataaaacatgggcatatcatgggtcttacgaggtaaaaccgtcaggttcagcatcgtccatggtcaatggcgttgtaaagctattaactaagccctgggatgtaatccctatggtaactcaaatcgcaatgaccgacactactccatttggccaacaaagagtttttaaagagaaagtagatacaagaacacctaaagcgaagagaggtacagcgcaaataatggaagttaccgccaagtggctttggggattcttatcaagaaataagaaaccaagaatctgcactagagaagagttcactcgaaaagtacggagtaatgcagcgattggggcagtgttcgttgatgaaaaccaatggaactccgctaaagaagccgtagaggatgaaagattttgggacttagtacaccgagaacgcgaattgcataagcaaggtaaatgtgccacctgtgtctataacatgatgggcaagagagagaagaaactaggcgaatttggaaaagcaaaaggttcacgtgcaatttggtacatgtggttaggggcaaggttcttagaatttgaagcgctgggatttatgaacgaagaccattggttctcaagagaaaattccttaagcggagtagaaggggaaggattacacaagctcggttatatactaagagatatttcaaaaattccagggggcaacatgtatgcagatgataccgcaggttgggacacaagaataactgaagacgatttacaaaatgaggctagaattacagatattatggagccagagcatgccttactagccaaaagcatttttaaattgacttatcagaataaggtagtgcgggtccaacgcccggccaaaaacggaacagtaatggacgtcatctcccgtagagatcaaaggggttcaggacaggtgggtacatatggactcaacacgttcactaatatggaggcacaactgattcgtcaaatggagagcgagggaatcttctcgccatctgaactagagacccccaacttagcagagcgtgtactagattggttggaaaaatatggggtagaaagattgaaacggatggctatatctggtgatgattgtgtcgtaaagcctatcgacgacagatttgccacagccttaaccgctttaaacgacatgggtaaagtccgaaaagacattcctcaatgggaaccttcaaaaggttggaatgactggcaacaagttccgttttgcagtcatcattttcatcaattgataatgaaagatggaagagaaatagtagtcccatgtcgaaatcaagatgaactcgtgggtcgggcgagagtgtcacaaggtgctgggtggagtttacgagaaactgcgtgtctagggaagtcatacgcacaaatgtggcaactaatgtattttcaccggagagacttaagattagccgcaaatgctatctgcagtgcagttcccgtagattggattcccacatcaagaacgacttggagtatccatgcgcatcatcaatggatgacgacggaagacatgttgtctgtctggaaccgcgtatggatagaagagaatccatggatggaagataagacccatataagtagttggggagacgtgccctatcttggtaaacgagaggaccaatggtgtgggagtttaataggtctaaccgcaagagctacgtgggcaaccaatatacaagtagcaattaaccaagtaaggcgactaataggtaacgaaaattacctagactatatgacgtctatgaaaaggttcaaaaatgaaagcgacccggaaggtgctctttggtaa

SEQ ID NO: 21169 - RNA, 9879 nt, synthetic construct
  misc_feature 1..9879: note = derived and/or modified CDS sequence (opt6) from DENV-1__GQ868635__SS-prME
  source 1..9879: mol_type = other RNA
tcagtcaccatgcttctgatgctgatgccgaccgcattggcttttcacctaacaacaagaggaggagaaccacatatgatcgtgagcaaacaagaacgcggaaaatctctattgtttaaaacttcggccggtgtaaacatgtgtactttaatagcaatggacttaggcgaattatgtgaggataccatgacgtataaatgtccaagaattacagaggctgaaccagacgacgtagattgttggtgtaatgctacggatacttgggtgacatacgggacatgtagtcaaacgggtgagcacaggcgagataaacgatccgttgctttggctccccacgtaggattaggactagaaaccagaacggaaacatggatgtcatctgaaggggcatggaaacaaatccaaagagtagaaacatgggctttgcgacacccgggatttactgtcatggctttattcctagctcacgctatcggaactagcataacgcaaaaaggaatcatatttatactattaatgcttgtgacaccgtcgatggctatgcgctgtgtaggtataggatcaagagacttcgtagagggtttatccggggcaacctgggtagacgtcgttctagagcacggatcatgtgtgacaacaatggctaaagacaaaccaacactggacatagaactattgaaaaccgaagtaacgaatcccgccattttaagaaaactttgtatagaagcaaaaatatcaaatacaaccaccgactcaaggtgtccaacgcaaggggaggcaacgttagttgaggagcaagatgctaatttcgtatgtagaaggacatttgtagacagaggatggggaaatggctgtgggttattcgggaaaggatcactcataacatgcgcaaaattcaaatgcgtaactaaactcgaggggaaaatagtccaatatgaaaatctaaaatactctgtaatcgtcactgttcatacgggagaccaacatcaagtaggaaatgagtctactgagcacggaacaactgctaccataactccgcaggcgcctacaaccgaaattcaattaacggattatggtgcactcacacttgattgtagcccacggactggcctggacttcaacgaaatggtattgctcacaatgaaagagaaaagttggttagttcacaaacaatggtttttggatttaccattaccatggacatctggcgcatcgacttcacaagaaacttggaaccgccaagatcttttagtgacattcaaaacagcgcatgctaagaaacaagaggtagtggtactaggctcgcaggaaggtgctatgcatacggcgcttaccggagcaaccgaaatacaaacgtccggcaccacaaccatctttgctggccatttaaaatgcaggttgaaaatggataaattgactttaaaaggaatgagttacgtaatgtgtacaggctcattcaaattagaaaaagaagttgcagaaacacaacatggtacagtgctagtgcaaattaaatatgaaggtactgatgcaccgtgcaaaattccgtttagcacacaagacgaaaagggtgtaacgcaaaatggacggctcatcaccgcaaacccaattgtcactgacaaagagaaaccagtgaatatagaagcagagccgccatttggggagagctatattgtgataggggccggagaaaaagctctaaaattatcatggtttaagaaaggctcgtcaattggaaagatgtttgaagctaccgctcgtggagccagacgaatggctatcttaggcgacaccgcgtgggattttggaagcataggtggtgtatttacttcggtaggaaaacttgtacatcaaatctttggagcggcatacggcgtgctgttcagtggagttagttggactatgaaaatagggattggagtacttctaacgtggttaggtctcaatagcaggtccacatcgctaagtatgacttgtatagctgtaggcctagttacactttatttaggtgtgatggtacaagctgactcaggatgtgtaattaattggaaaggtcgagagctgaaatgcggcagtggaatttttgtcactaatgaagtacatacatggaccgaacaatataagtttcaagctgattctccgaaacggttgagtgctgcgataggtaaagcctgggaagagggtgtttgtggcatcagatcagcaacacgtttggaaaacattatgtggaaacaaattagtaatgaattaaatcacattctattagaaaatgatatgaaattcacagtcgtagttggagatgtcgcaggcatcttagcacaagggaagaaaatgatacggcctcagccaatggaatataaatattcatggaaatcatgggggaaggcaaagatcattggtgcggatgtacaaaacaccactttcatcatagatggtccgaatactcccgaatgtcccgatgaccaacgagcatggaacatatgggaagtagaggattacggctttggtatatttacgacaaacatttggctaaaacttagagatagttacactcaggtttgtgatcacagactcatgagcgcagccatcaaagattcgaaagctgtacatgcagatatggggtattggatcgagagcgagaaaaacgaaacctggaaattagcaagggcaagttttatcgaagtcaagacctgcatttggccgaaatcacacacgctttggagtaacggggtcctagaaagcgaaatgataataccaaaaatatatggtggcccgatctctcagcacaactacaggccaggatatttcacgcaaaccgcaggaccgtggcatttaggaaaattagaattggacttcgatttatgtgaaggcacaacggtcgtagttgacgaacattgtggaaatagaggcccatccttaaggacaactacagttacagggaaaataatacatgaatggtgttgcagaagttgtacattaccaccactgcgatttcgtggcgaagacggttgttggtatggtatggaaatccgtcctgtaaaagagaaagaggaaaatttagtcaagagcatggtgtcagccggcagtggagaagttgattcgttcagcctaggcttattatgcataagcatcatgatagaagaagtcatgagatcccgatggtcacgaaaaatgctcatgacgggcacgctcgcggtattcctattactcatcatgggacagctaacgtggaatgacttgatccgtttgtgcataatggtaggcgcaaacgcatcagacagaatgggaatgggaactacttatctcgctttaatggctacgttcaaaatgagaccaatgtttgcagtgggattattatttcgtaggctaacatcgagagaggttttactattaacaataggactgagtctcgtggcaagcgtcgaactaccaaattcgctagaagagttaggagacggtcttgcgatggggataatgatactcaaactattaacagatttccaatctcatcagttatgggccacattattatcactaacatttatcaaaactacattttcactacattatgcatggaagacgatggctatggtcttgagcatagtatccctatttcctttatgtctgagcacaacgtcacagaaaactacttggctaccagttctactaggtagcctaggctgtaaaccgttaacaatgtttctaatagcggaaaacaagatttggggaaggaggagctggcctcttaatgaaggaataatggctgtagggattgtctcaattttactcagttcactattgaaaaacgacgttcccctagccggacccctaatagcgggtggcatgttaattgcctgctatgtaatctcaggatccagcgcagacttatctttagaaaaagcggcggaagtcagctgggaagaagaagcagaacattcaggagcttctcataacattcttgttgaggtacaagatgatggtaccatgaagataaaagacgaagaacgagatgacacgctcacaatactcttgaaggctacattattagcggtaagcggagtataccctttaagtatcccagccacactattcgtctggtacttctggcagaagaagaaacaacgcagcggtgttctgtgggatacgccatcgccacctgaagttgaaaaagcagtattagatgacggtatataccgaataatgcaaagaggcttgttgggtagaagccaagtaggagtaggagtatttcaagaaaatgtatttcacacaatgtggcatgttactaggggtgcagtgttaatgtatcaaggtaaaagattagagccatcatgggcatcggtcaagaaagatttaatctcttatggtggtggatggagactacaaggatcatggaatacaggggaagaagtacaagtaatagcagtagaaccaggcaaaaatccaaagaacgttcaaacagcgcccggtacctttaagaccccggaaggcgaggtaggcgccatagccctagattttaaaccgggtacgagcggctcaccaatagtaaaccgcgaaggaaaaatcgtcggtttatacggaaatggagttgttactacctcgggtacatacgtttccgctatagcgcaggctaaggcttcgcaagaagggccgctaccagaaatagaagacgaggtatttcgaaaaagaaacttaacaataatggatttgcatccaggcagtggaaaaactagaagatatctcccagcaatagttagagaagcgatcaaacgaaaattgagaaccttaatccttgcgccaacaagagtggtagcaagtgagatggccgaagcattgaaaggaatgccaataagatatcaaactaccgccgtaaaatctgaacatacaggtaaagagatagtagaccttatgtgtcacgcaaccttcacgatgagacttctaagtcccgtccgggtcccgaattataatatgataataatggatgaagctcattttacagatccatcatcaattgcagccagaggttatataagtactagggtgggtatgggcgaagccgccgctatatttatgactgctacaccccctggaagcgtagaagcgttcccacagagcaatgctgtaatacaagacgaagaacgagacatccccgaaagatcctggaatagcggatatgagtggatcactgacttcccgggaaagactgtatggtttgttccatctataaaatcgggcaatgatatagctaactgtttacggaaaaatggtaaacgtgttatacaacttagtagaaagaccttcgatacagaatatcagaaaaccaaaaataatgactgggactatgtagtaaccacggacataagtgaaatgggcgcaaactttcgtgcagatcgagttattgatccccgtcgttgtcttaagccggtaatattaaaggatggtcctgaaagagtcattttggcaggaccaatgccagtaacggttgcatcagccgctcaaagacggggacgtattggacgaaaccataataaagagggtgaccagtatatatatatgggacaaccactaaacaacgacgaggaccatgcccactggacagaagcaaaaatgttactggacaatatcaatacccctgagggaattatcccggccttattcgagcccgaaagagaaaagtcagcagcaatcgatggagaataccgactaagaggagaagcccggaaaacttttgtagaattaatgaggagaggagatctaccagtatggctatcatataaagttgcatccgaaggatttcaatattctgatcgacgatggtgttttgatggggaaagaaataatcaagtcttagaggaaaatatggacgtagaaatatggacaaaagagggtgaacgtaagaaactccgtcccagatggctagatgcacggacgtattcagatccacttgcgcttcgggagttcaaagagttcgctgccggccggagatccgtctctggggatttaatactagaaatcgggaaattacctcaacatctaacgcaacgtgcacagaatgctttagataatctagttatgttacacaacagtgaacaaggaggacgggcctaccgacacgccatggaggagttgccagatacaatagaaactctcatgttattagcgttgattgctgttttaacaggcggagtaacgctgttcttcctttcaggaagaggcctagggaaaacaagtattggtttgttgtgtgtcatggcatcgtcagtactactttggatggcaagtgtggagccacactggatagcagcttcaataattctagaatttttcttaatggtcctactgataccagaaccagaccgccaaaggacaccgcaagacaatcaactagcatacgtagtcatagggttattgtttatgattttaacggtagcggctaacgaaatgggtttattggaaactaccaagaaagatctaggaatcggacatgtcgccgtaggtaatcaccatcatgcagcaatgcttgatgtcgatctacatcctgcatccgcatggacactttatgctgttgctaccactataataacaccgatgatgagacacacaatagagaataccaccgctaacataagtttgacggccatagcgaaccaagctgccattctaatgggacttgacaagggatggcccatttcaaagatggatataggcgtaccgctactggcactgggttgctatagtcaggtcaaccctctgacattaacagctgcagtgttaatgttggttgcgcattatgccattataggaccaggcctgcaggcaaaggcaaccagagaagcccagaaacgtacagccgcagggataatgaaaaatcccacagtcgatggaatagtagctatagacctagatccggtcgtctacgacgctaaatttgaaaaacaattaggccaaataatgttattaatcttatgcacgagccaaatccttctgatgaggacaacatgggccttatgtgaatctataactctcgctaccggcccacttaccacattatgggaggggtcaccgggaaaattttggaatacgacgatagcggtctcaatggccaacatttttagaggctcgtaccttgcgggtgcaggtttagcattctccttaatgaaaagtctcggaggtggaagaaggggaaccggagcgcagggagagaccctaggagaaaagtggaaaagacaattaaatcagttaagcaaaagcgaatttaatacgtataaaagatcgggaatcatggaagtggatcggagcgaggccaaagaaggcttgaaacgcggggaaacgacaaaacacgcggtgtccagaggtacagcgaagctaagatggttcgttgaacgtaatctagtaaagccagaaggaaaagttatcgacctgggatgtggcagaggaggatggtcttactattgcgcaggacttaaaaaggtaacggaagttaaaggatatacaaaaggcggaccagggcatgaagaacccataccaatggcaacgtatggatggaaccttgtaaaacttcactcaggaaaagacgtattctttataccgccagaaaaatgtgacacactgctgtgtgacataggggaatcttcccccaatccgacaatcgaagaagggaggacactacgggtccttaaaatggtcgagccttggttacggggaaatcagttttgcataaaaatactcaatccgtacatgccatcagtagtagaaacactagaacagatgcagcggaaacatggagggatgctagttaggaatcctctatcaaggaactctacacacgaaatgtactgggtaagctgcggaacaggaaacatagtaagtgctgtaaatatgacaagtaggatgctgttgaaccgattcactatggcacatagaaaaccaacttatgaaagagacgttgatctaggagcgggtacacgacatgtggccgttgaacctgaagtcgcgaatctcgatataataggacaaagaattgaaaatataaaacatgaacataaatctacctggcattacgacgaggacaacccatataaaacctgggcttaccacggttcatacgaagtcaaaccatccggttctgcatcttcaatggtgaatggagtcgtgaaattactaaccaaaccatgggatgttatacctatggtaacacaaatcgcgatgacagatacaacgccattcggtcaacaaagagtatttaaagaaaaagtagatacacgaacacctaaagctaagcgaggaacagcacagataatggaagtcaccgcaaaatggttgtggggattcctgagtcggaataagaagccgcgtatttgtacccgtgaagaatttacaaggaaagtaagatctaatgcagcaataggcgcagtatttgtcgatgaaaatcaatggaatagtgcaaaagaagctgttgaagatgaacgcttttgggacttggttcatcgagaacgtgaactacataaacagggtaagtgtgcaacttgtgtatacaacatgatgggcaaacgcgagaagaaattaggcgaatttggaaaagcaaaaggatctcgtgctatctggtacatgtggctaggagctaggtttttagagttcgaagcactgggattcatgaacgaagatcattggttttccagggaaaacagtttaagtggagtagaaggggaaggtttacacaaacttgggtatatattgcgagacatatctaagatacctggaggtaatatgtacgcagacgataccgccgggtgggatactcggataactgaagatgatttacaaaatgaagcgcggataaccgatataatggaaccagaacacgccttactagcgaagtccatctttaaattgacctatcaaaataaggtagtgagagtacaacgtccagcgaaaaacggaacagtgatggacgtaatatcccggagagatcagagagggagcggacaagtcggaacttatggtttaaatacatttacaaatatggaagcgcagctaatccgtcagatggagagtgaaggtatattttcaccgagtgagttagagacgcccaacttggcagaacgcgttcttgactggctagagaaatatggtgttgaaagactgaaacgtatggccataagtggtgatgattgtgtcgttaaacctatagacgacagatttgcaaccgcattgactgctttaaacgatatgggaaaagtccgaaaggacataccccaatgggaaccttccaaagggtggaatgactggcaacaggtgcccttttgttcacatcattttcatcaactcattatgaaagatgggagagaaatagtagttccgtgtaggaatcaagatgaattggtaggccgagcgagggtgagtcagggagctggttggtctctccgagagacagcatgtctcggcaaatcatatgcacaaatgtggcaattaatgtactttcacagaagagatctaaggctagcagctaatgccatatgcagtgcagtccctgtggattggataccaacaagtagaactacctggagtatacatgctcatcatcaatggatgacgacggaagatatgttaagcgtatggaatcgagtctggatagaggagaacccgtggatggaagataaaactcatatatcaagttggggtgacgtaccataccttggtaagcgagaagaccaatggtgtggaagcctaataggattgacagcgcgagcaacatgggccacaaacattcaggttgctataaatcaagttcgaagactaataggaaatgagaattatctagactacatgacctcgatgaaacgctttaaaaacgaaagtgacccggaaggagcattgtggtaa

SEQ ID NO: 21170 - RNA, 9879 nt, synthetic construct
  misc_feature 1..9879: note = derived and/or modified CDS sequence (opt6) from DENV-1__GQ868636__SS-prME
  source 1..9879: mol_type = other RNA
tcggtaacaatgcttctaatgttaatgcctactgcattggcatttcacctaaccacgcgtggaggggaaccacatatgatcgtaacaaaacaagaacggggaaaaagcctgttgttcaaaacatcagccggtgtaaatatgtgtaccttgatagccatggatttaggagaactttgtgaagatacaatgacctataaatgtccaagaattactgaagctgaaccagacgacgtcgattgctggtgcaatgcgaccgatacatgggtcacctatggaacttgctcgcaaacaggagagcaccgaagagataaacgctctgtagctttggcaccacatgtgggactaggtctcgagacgagaactgaaacttggatgtcttcagaaggggcatggaaacaaatacaaagagtagagacttgggcattgagacatcccggatttactgtgatagccttattcctggcacacgcaataggaaccagtataacccaaaaaggaatcatatttatcttgttaatgttagtaacaccatctatggctatgaggtgtgtaggaattggatcaagagattttgtcgaggggctatcaggtgccacttgggtggacgttgttctagaacatggatcttgtgttacaaccatggccaaagacaaacccacgcttgatattgaactcctcaaaacagaagttacaaaccctgctgttctcagaaaactatgcatagaggcgaaaatctcaaataccacaacagactcacgatgccccacacaaggagaagctacattaatggaggaacaagacgcaaattttgtatgtagaaggacgttcgttgatcgcggatggggcaacggctgtggattgtttggtaaaggctcgttaataacatgcgcaaaatttaagtgcgtaacaaaattagaagggaaaatcgtgcaatatgaaaatttaaaatactcagttattgtaacggtccataccggagatcaacatcaagtaggtaatgaaagcactgaacatggaactactgctactataactccgcaagctccgacgtcggaaattcagctaaccgactatggcgccctcactctagattgttcccccaggacggggctcgactttaatgaaatggttcttctaaccatgaaagaaaagtcgtggttagtccataaacaatggttcctagacttgccattaccttggacaagtggagcctcaacttcgcaagagacatggaacagacaagatcttcttgtaacattcaaaacagctcacgctaagaaacaagaagttgttgtcctgggcagccaagaaggggcaatgcatacagcgctcacaggggccactgaaatacaaacgagtgggaccacgactatatttgcaggacatctaaaatgtcgcttaaaaatggataagctaaccttaaaagggatgtcttacgtaatgtgtaccgggtccttcaaacttgaaaaggaagtcgcagaaacacaacatggaacagtcctcgttcaaataaaatatgaaggaacggatgccccttgcaaaattccattcagtacacaagacgagaagggtgtcactcaaaacggacgcctgatcactgcaaatcctatagttaccgacaaagaaaaacccgttaatatagaggcagaaccaccctttggggaatcgtacatcgtcattggtgccggggaaaaagctctaaaactaagttggttcaaaaagggatctagtataggaaaaatgtttgaagcgacagcaagaggagcacgacgaatggcaattctcggtgatacggcatgggattttgggtctataggtggagtattcacatcagtgggtaaattagtacatcagatatttggtaccgcctatggagttttgttctctggtgtcagttggaccatgaaaataggtataggtgtattactaacgtggttaggccttaacagcaggagtacctcattaagtatgacttgtattgctgtagggctggtgactctatatttaggcgtaatggtgcaagctgactcaggatgcgtcataaattggaagggccgtgaacttaaatgtggaagtggaatattcgttacaaatgaagtacatacttggacagaacaatacaaattccaagccgacagtccaaaaaggttgagtgctgcaataggtaaggcttgggaagaaggagtgtgcggaatacgaagtgcaacacgtctagaaaatattatgtggaaacaaatatcaaatgagcttaatcacatactactcgagaacgacatgaaatttacagtagtagtaggagatgtagtagggatccttgctcaaggcaagaaaatgataaggccccaaccgatggaacataagtacagttggaaatcatggggaaaagctaagataataggtgcagacgtacaaaatacaacctttatcattgatggcccaaacacgcccgaatgtcccgatgaccagagagcgtggaatatctgggaagtagaggattacggattcggtatattcactacaaatatatggttaaaattgagggattcatacacacaagtctgcgaccatcggcttatgtcagcagcaataaaggatagtaaagctgttcacgctgatatgggatattggatcgagtctgagaaaaatgaaacgtggaagttagctcgcgccagcttcatcgaagtaaaaacttgtatatggcctaaatctcacacgctctggtcaaacggggtattggaaagtgaaatgataatacccaaaatatacggcggcccaatttcgcaacataactatcggccaggctacttcacgcaaacagcgggtccttggcatctaggaaaacttgaactagactttgatttatgtgagggaactacagtagtcgtggatgagcattgtggtaacaggggtccttctcttcggacgaccaccgttacaggaaaaattatccatgaatggtgctgtcgcagctgtacactacccccacttaggtttaaaggggaagatggatgttggtacggaatggaaattagacccgttaaagaaaaagaggaaaatctagtaaaaagtatggtctccgctgggctaggcgaggtagattccttttcgttagggctcctatgtatatcgataatgatagaagaagtgatgagatccagatggtcacgtaaaatgttaatggccggaacactggctgtatttctacttttaataatggggcaactaacctggaatgatcttatcaggctttgcattatggtaggagcaaacgccagtgatcggatgggaatggggactacttacctagccctaatggcgacctttaagatgaggccaatgttcgcagttggactcctctttagaagacttacgtcccgagaggtcctccttcttactataggactaagtctagttgcgtcagtagaattacctaatagtttagaagaactcggggatggactagcgatggggataatgatactaaaattgctaaccgatttccaatcgcatcaattatgggctactctactatctttaacattcattaaaacaacattatccttacatcatgcatggaaaactatggcaatggtattatctattgtatcactatttccattatgtctttcaacaacgtcccagaaaacaacttggctgccggtacttctagggagtcttggatgtaaacctcttacaatgtttttaatcgcagaaaacaaaatttgggggagaaaatcttggccattgaacgaaggaattatggcagtaggtgtagtgtctattttactatcaagtttgcttaaaaatgatgtacctttagctggacccctaatagcaggcggcatgttgattgcctgttacgtgatctccggttcctccgctgatttgtcgttggaaaaggcagcagaggtcagctgggaagaagaagcagagcatagcggagccagccataatatcttggtcgaagttcaagatgatggcaccatgaaaatcaaagatgaagaaagagacgacacattaacaattttgctaaaagcaactttattggctataagtggcgtttacccattatcaattccagcaaccttatttgtctggtacttttggcaaaagaagaaacaaagatctggcgtactatgggatactccatcgccgccagaagtagaaagagcagttctagacgacggaatttacaggattatgcaacgaggtctgttaggccgatcgcaagtaggggtgggagtttttcaagagaatgtcttccacacgatgtggcatgtcacaaggggtgccgtattaatgtatcaaggaaaacgtctggaaccctcttgggcgtcagtcaagaaagatctgatttcgtatggcggaggatggaggctacaaggtagctggaatacaggtgaagaggtccaagtgatagctgtggagcctggcaaaaatcccaaaaacgtacaaacagcaccaggaacattcaaaacgcctgagggagaagtaggtgctattgccttggatttcaaaccaggaacgtccggtagtcccatagtcaatagagaaggaaaaatagtcggactctatggtaacggcgtcgtaaccacgtccggaacttatgtctcagcgatagcacaagcgaaagcctctcaagaagggccgctaccagaaatagaagatgaagtatttaggaaaagaaatctaacaataatggatttacatcctgggtccggtaagacacggaggtacttacctgcgatagttcgtgaggcgataaaacgcaaacttcgaacactaattcttgcacctacaagagtagtcgcgagcgaaatggccgaggcactcaaaggcatgccaattagataccaaacgacagcggtaaagagcgaacatactggaaaagagattgtagaccttatgtgtcacgcgacattcaccatgagattactctcccccgttagggtaccaaactataatatgattatcatggacgaggcacacttcactgacccctctagcatagcagcacgaggctatatatctacgagagtgggaatgggagaggcagctgctattttcatgacagcaacacctccaggaagcgttgaagccttccctcaaagcaatgcagttatccaagatgaagaaagagacattcctgaacgatcatggaacagcggatatgagtggataaccgacttccctggtaaaactgtatggtttgtccccagcataaaatcaggaaatgatatcgccaattgtcttaggaaaaatggtaaacgagttatacaactgagcagaaaaacgtttgatacggaataccagaaaaccaaaaataatgattgggattacgtagtaactacagacatttcagaaatgggagcgaactttagagcggatcgggttatagatccaagacgatgtttaaagccagtgatacttaaagatggtccggagcgagtgatcttagcaggaccaatgccagttacagtggccagtgcggcacagagacgcggacggatcgggagaaatcataataaagagggtgatcagtacatctacatgggtcaacccttaaataatgatgaggatcacgcccattggacagaggcaaaaatgttattggacaacatcaacacaccagaaggtattattcctgccctatttgaaccggaaagagaaaaatcagcagcaatcgacggagaatacagactgcgaggagaggctagaaaaactttcgtagagcttatgaggcgaggagatttaccggtatggctatcttataaagtagcgtcagagggtttccaatactctgacagaaggtggtgcttcgacggagagaggaataaccaggtattagaagagaacatggacgtagaaatatggacaaaggaaggtgaacggaaaaagttaagaccccgttggctagatgctaggacatacagcgatccactcgccctacgagagtttaaggagtttgccgcagggcgaagaagtgtgtcaggagacttaatattagaaatagggaaacttccacaacatctaacgcaaagagcacagaatgcattggacaatttagtaatgttacacaattcagaacaagggggtagggcttacagacatgcgatggaagaactacctgatacaatagaaacgctaatgcttctggctctaatagcggtattgaccggaggcgtaaccctgttctttttatcaggaaggggcttaggaaaaacaagcataggattgctttgtgtaatggcaagtagcgtcctgctatggatggcgtcagtggagccacattggatagcggcaagcattatactcgaatttttcctaatggtgctactcatcccagaaccagaccgacaacgtacaccacaagataaccaactcgcatatgttgtaatcggtctattattcatgattttaaccgtagcagcgaacgaaatgggacttcttgaaacaacaaagaaagacttggggataggacatgttgcggtagaaaatcaccaccatgcgactatgcttgatgtggatttgcatccggcatcagcttggacattgtatgccgttgctacaacaatcataacccctatgatgagacatacaattgagaatacgacagcaaatataagtttgactgcaatagctaatcaagctgcgatacttatgggattggataaaggttggccaatatccaagatggatataggagtaccacttttagccttgggatgttattcgcaagtgaaccccctcacactgacggcagccgtcctaatgttagtagcacactacgcgataatagggccaggattacaggctaaagcaactcgtgaagcccagaaaagaacggcagctgggataatgaaaaatccaactgtcgatggaatagtggcgattgatctggaccctgtagtatatgatgcaaagtttgaaaaacaacttggacagataatgttgctaatactatgcacaagtcaaatattactaatgcgcactacttgggctctatgcgagtcaataacattagcaacaggacctttaacaacactatgggaaggatcaccaggaaagttttggaatacaacgattgctgtctcaatggctaatatcttccgaggctcttacctcgctggggccggattagctttttcacttatgaaaagcctgggaggaggtcgccgggggaccggagcccagggggagacattaggggagaagtggaaacgtcaactaaaccaattatctaagtcagagtttaacatatataaaaggagtggtattatggaagtagataggagtgaagctaaagaaggattgaaaaggggcgaaacgacacgccacgccgtttcgcgaggcacggcgaaactaagatggtttgttgaacggaacctcgttaaaccggagggtaaagttattgacttgggatgcggccgagggggctggtcctactattgtgccggtcttaagaaagtcaccgaagtaaaaggatataccaaaggaggacctgggcacgaggagccaattcccatggctacctatgggtggaacctagttaagctccattctgggaaggacgtattctttacacctccagaacgttgcgatactcttctatgtgatataggagaaagcagcccaaatccaactatagaagagggacgaacactaagagtactaaaaatggtcgagccatggcttagagggaaccaattctgtattaaaattcttaatccctatatgccatcggttgtcgaaactctagagcaaatgcaacgaaaacacggaggcatgcttgtacgcaaccccttgagccgtaacagcacccatgagatgtactgggtgtcatgcgggactgggaatatagttagcgcagtaaacatgacttcacgcatgttgctgaataggtttactatggcacatagaaaaccaacatatgagagagacgtcgatctaggggcagggacgcgacatgttgctgtagaacccgaagtcgctaacttagacataatcggacaaagaatagaaaacatcaaacatgagcataaaagcacatggcattatgatgaagataacccgtataaaacttgggcttatcatggctcttatgaagttaaacctagcggttcagcatccagtatggtaaatggagtcgtaaaactactaaccaaaccatgggatgtaatacccatggtcacccagattgccatgacagatacgactcccttcggacaacaaagagtgtttaaggaaaaagtagatactaggactcctaaagctaaacgagggaccgctcagatcatggaagtcactgcacggtggctatggggctttttaagcaggaataagaaacccaggatctgtactagagaagagtttacacgcaaagtacgaagtaatgcagcaatcggagcagtgttcgttgatgagaatcagtggaactctgctaaggaggctgttgaagatgagcgattttgggacctagtacaaaaagagagagaactacataaacaaggtaagtgcgctacatgtgtttacaatatgatgggtaaaagagagaagaaattgggtgaatttggtaaggctaaaggtagtagagcgatatggtatatgtggttaggagcacgatttcttgaatttgaagcattaggatttatgaatgaagatcattggttctcaagagaaaattcgttgagcggtgtcgaaggagagggacttcataagttgggatatatacttagagatatctcaaaaataccaggtggaaatatgtacgcagatgatactgcagggtgggacaccagaataactgaagacgacctccagaatgaagctaaaataacagatataatggagcccgaacatgctttactagcaacctcaatattcaaacttacataccaaaataaggtggtgagggttcaacgtccagccaagaacggtacagttatggatgtaatctcaagaagggatcaaagaggtagtggacaagttggaacatatgggttgaacacattcacaaatatggaagctcaactaattcgacaaatggaaagtgaaggaatctttctaccatccgaattggaaacaccaaacttagcagaaagagtactagactggctagaaaaacacggagttgagagattaaagcgcatggcaatatcaggggacgattgcgtggtgaaacctatagatgatagatttgctacggcactaaccgcattaaatgacatgggaaaagtcagaaaagatattccacaatgggaaccctccaaaggatggaatgactggcagcaagtacctttttgctcacatcactttcaccagttaatcatgaaggatggtagagaaatagttgttccatgtcgtaaccaagatgaattggtaggtcgtgcgagagtctcacaaggtgctggatggagtcttagagaaacagcatgcttagggaaatcatacgcacaaatgtggcagctcatgtattttcatagaagggatctcagactggccgctaatgccatttgctcggcagtacctgtggactgggtaccaacctcaaggactacctggagtattcacgctcatcatcagtggatgacaactgaagatatgctaagtgtgtggaaccgagtctggatagaagagaacccttggatggaagacaaaacacacgtaagtagttggggagatgtaccgtatcttggtaaacgagaagaccaatggtgtggaagtttaattggactcactgcaagagccacttgggcaagcaacatacaagtagcaataaaccaagtaagaagactaataggcaatgaaaattatctagattacatgacctcaatgaaacgatttaaaaatgaaggcgacccggaaggagcattatggtga

SEQ ID NO: 21171 - RNA, 9879 nt, synthetic construct
  misc_feature 1..9879: note = derived and/or modified CDS sequence (opt6) from DENV-1__GU131922__SS-prME
  source 1..9879: mol_type = other RNA
tccgtaataatgctgctaatgcttatgcctacagctttagctttccatcttacaaccagaggaggggaaccacatatgatagtaagcaaacaagaaaggggaaaatcactactatttaaaactagcgcaggagttaacatgtgcacactaatagcgatggatttaggtgaactatgcgaagacacgatgacatacaaatgccctcgtataaccgaagcggaaccggatgatgtagactgttggtgcaatgcgactgatacctgggtaacttacgggacatgcagtcaaactggtgaacatcgcagagacaaaaggtccgtggctctcgcacctcatgtaggactaggactagaaactagaacagaaacatggatgtcgtccgaaggtgcttggaaacaaatacaacgggttgagacctgggcgttaagacatcccggattcacagtcattgcactattcttagcacatgccataggtacttcgattacacaaaaaggtataatctttatattactaatgttggtaacaccaagtatggcaatgagatgtgtgggaattggatccagagatttcgtagaaggactgagcggagctacgtgggtcgatgttgtattggagcatggaagctgtgtgaccacaatggcaaaagacaaaccaaccttggatattgaacttctaaaaacagaagtcacgaatcccgcgatacttagaaaattgtgcattgaagcaaaaatcagtaacaccacaaccgactccagatgcccaacacaaggggaggctactttggtggaagaacaagatgccaacttcgtgtgtcgaaggacattcgtcgatcgaggatggggaaatggatgtggattatttggaaaaggaagtcttataacatgcgcaaaatttaaatgtgttacaaaattggaagggaaaattgttcaatatgagaatctaaaatactcagtgatagtaacagtacacacgggtgatcaacatcaagtcgggaatgaatcaacagaacacggaacgacagcaaccataacaccacaagcgcctactacagaaatacaattgacggattatggagcactaactctggattgttcaccaagaacaggattggattttaatgaaatggttctgctgacaatgaaagagaaaagttggctagtgcataaacaatggtttttggatttgccacttccatggacctccggtgcttcgacaagccaagagacctggaataggcaagacctattagttacattcaaaacagcccatgccaagaaacaagaggtcgttgtgttaggatcacaggaaggcgcaatgcatacggccttaacgggggctacagaaatccagacctcaggtaccacaacaatatttgcaggacatctaaaatgcagattaaaaatggataaactcactttaaaaggcatgagttacgtcatgtgtacaggtagtttcaaactagagaaagaagttgctgagacgcaacatggaaccgttttagttcagattaaatacgaaggcaccgatgccccctgcaaaataccttttagcacccaagacgaaaaaggagttacacagaatggccggttaatcacagcgaatccaatcgttactgataaagaaaaaccagtgaacatagaagctgaaccaccatttggagagagttacatcgtcataggagcgggggagaaagccctgaaactatcctggtttaagaaaggaagcagtataggcaagatgtttgaagcaacggctcgaggcgcaagacgtatggcgatacttggagatacagcgtgggacttcggaagtataggaggggtattcacgtctgtgggtaagctggtgcatcagatctttggcaccgcatatggggtccttttcagcggggtctcttggacaatgaaaattggtataggtgtgttgttaacatggctggggttaaactcacgatccacaagtttatcaatgacttgtatagcagtcggcctagtgaccctgtatttaggagtaatggttcaagccgacagtggatgcgtaataaattggaaagggcgcgagctaaaatgtggtagcggcatctttgtaacgaacgaagtgcatacatggacagagcaatataagtttcaagctgacagtcctaagcgcttatcggctgcaataggaaaggcttgggaagaaggagtatgtggtattagaagtgcgactcgccttgaaaatattatgtggaagcaaatttcaaatgaacttaatcacatactgctagagaatgatatgaaattcacggttgtagttggagacgtagctggtatcttagcccaaggaaagaagatgatacgtccacaacctatggagtataaatattcttggaagagttggggaaaggcaaagatcataggggcagatgtccagaacaccacgtttataatcgatggacccaatacgcccgaatgcccggatgaccagagagcttggaatatatgggaagttgaagattatggattcggtatttttacgaccaatatatggctaaaacttagagactcttatacgcaagtatgtgaccaccgattaatgagcgctgcaattaaagatagcaaagcggttcacgcagatatgggatactggatagaatcagaaaagaatgaaacctggaaattagcaagagcctcgttcattgaagtcaagacatgcatttggccgaaaagtcatacactctggtcaaacggcgtactggagtcggaaatgataatcccaaaaatatacggaggtcctatttcgcaacataattatcgcccagggtacttcacacagactgcaggaccgtggcatttaggtaaactagaactcgattttgacctctgtgaaggaacaaccgttgtcgtcgacgaacactgcggtaatcgaggaccctctcttagaacaacaacggtaactggaaagataattcatgaatggtgttgtagatcctgcacattaccccctttgagatttcgaggagaagacgggtgttggtatggaatggaaatacgcccagtaaaggaaaaagaagaaaatttagtgaaatcaatggtcagtgcaggtagcggggaagtagattccttcagtctcggtctgctatgcatatcaattatgatagaagaagtgatgcgttcacggtggtctagaaaaatgcttatgacaggaactttagctgtgttcttactcttaatcatgggacagcttacctggaatgatttgatacgattatgtatcatggtaggcgctaatgcctcagataggatgggaatgggtacgacatatttagctttaatggcaacatttaaaatgcgacctatgtttgctgttgggttattatttaggagactgacaagtagggaagtactgctacttacgatagggttaagtcttgtagcgagcgtagagctgccaaattcgttagaagaattaggagatggtttagcgatggggataatgatcctcaagttactaacagatttccaatctcatcaattatgggccacactgttatcacttaccttcattaaaacaactttttcacttcattacgcgtggaaaacgatggctatggtattgagcattgtatcgttattcccgttatgccttagtaccacctcacagaaaactacatggctcccggtactcctaggaagtttagggtgtaaaccattaacaatgtttttaatagctgaaaataaaatctggggtagaagatcttggcctctcaatgaaggaataatggcagtgggcatcgtatcgatactactaagcagcttactcaaaaatgatgtaccactagcagggccattgatcgcaggagggatgttaatagcttgctatgtaatttcggggtcctcagccgacctatcgctagaaaaggctgcagaggttagttgggaagaggaggcggaacactcaggagccagtcacaatattcttgtggaagtacaagatgacggaacaatgaaaataaaggacgaagaaagggatgatactctaactattttattgaaagcaactttattagctgtaagcggagtatacccacttagtataccagcaacactttttgtatggtatttttggcagaagaagaaacaaagaagcggagtgctatgggatacgccgtcaccacccgaagtggaaagagcagtactagatgacggtatctatcgtataatgcaaaggggtctattaggtagatctcaagtgggagttggtgtcttccaggagaatgttttccacactatgtggcacgtaaccagaggggcagttttaatgtaccaaggaaaacgattggagccctcttgggcgagtgtcaagaaagatctaatctcatacggaggaggttggcgtttgcagggatcttggaatactggagaagaggtgcaagtaattgctgtcgaaccaggcaaaaatcccaaaaatgtacaaactgccccagggacatttaaaacaccagaaggggaagtaggcgctatagcgttagattttaaaccgggaacaagtggaagccccattgtaaacagagaaggaaaaatcgtaggattatatggcaacggagtagttactacctccgggacttatgtctccgcgatcgcacaggcgaaagcaagccaagaaggaccactgcctgagattgaagatgaagttttcaggaaaagaaatttaacgataatggacctacatccaggttccggcaaaacacgtagatatttacctgccattgtaagagaggccatcaaaaggaaattgcgaacactaatcctggctcccacgagggtagttgctagcgaaatggctgaggcattgaaaggaatgcccattcgatatcaaacaacagccgtaaaatccgagcatacgggaaaggaaattgtagacttgatgtgtcacgcaacttttaccatgcggcttttatctccagtgcgcgtaccaaattataatatgattataatggacgaagcacattttactgatccatcttccattgcagcaagaggatatatatccactcgagtaggaatgggagaagctgcggccatattcatgacagctactccaccaggaagtgttgaagcattcccacagtccaatgcggtcattcaagatgaagagagggatataccagaaaggagttggaactcaggttacgagtggatcacggattttcctggtaaaactgtatggtttgtgccatcaattaagagtggcaatgatatcgcaaactgtcttcgaaagaatggtaagcgagtcatccaattaagcagaaaaacattcgacactgagtaccagaaaactaaaaacaatgattgggattacgtagtaacaacagatatcagtgaaatgggggcaaacttcagagctgatagagtaatcgatcctagaaggtgtttaaaaccggtgatactaaaagatggaccggaacgtgtcatattggcaggccctatgccggttacagtagcttcagccgcacagcgaaggggtcgtatcgggcgaaatcataacaaagaaggtgaccaatatatatatatgggacaaccgctaaacaacgacgaagaccatgcacattggacggaagcaaaaatgcttcttgacaacattaacacaccagagggtataatacccgccctttttgaacctgaacgcgagaaaagtgccgctatagacggagaatataggctccgcggagaagcaagaaaaacttttgtggaactgatgagaagaggagatcttccagtatggctcagctacaaagttgcatccgaggggtttcaatattccgatagacgttggtgttttgacggagagagaaacaatcaagtacttgaagaaaacatggatgtcgagatatggacaaaagaaggagaacgtaaaaagttacgcccaaggtggcttgatgcccgtacatacagtgatccactcgccctccgcgaatttaaagagttcgctgctggccgacgcagtgtcagcggtgatttgatcctagaaataggaaaattgccacaacatctaacgcagagagcccagaacgcattagacaatttagtcatgttacacaactctgaacaaggtggacgagcttatcgacatgcgatggaagaattaccagacaccatcgagacgctgatgctcttagcccttatagcagtgttaacgggcggcgttacactattcttcctttctggaagaggcctgggaaaaacctctataggattactttgcgtaatggcctcctccgttctactctggatggcaagtgtagaaccacactggatagcggccagtataatcttagagttcttcttaatggtactattgatacccgaaccagacagacagagaacgccacaagacaaccaacttgcttatgtcgttattggcttactatttatgatattgacggtagcagcgaatgagatggggctgctggaaacaactaagaaagaccttggtatcggacatgtagcagtgggaaaccatcaccacgcggccatgctggatgtcgatttacatcctgcttctgcatggacactctatgctgtcgccacgactataattacaccaatgatgcgtcatacaatagaaaatacaaccgcaaacatctcactgacagcaatagcaaatcaagcggctattttgatgggtctcgataaaggttggcctatatcaaaaatggacataggcgtcccactactcgctttgggatgttatagtcaggtgaatccactgacattaacggcagcggtactaatgctggtagcacattatgccattattggccccggactccaggcgaaagcgacacgagaggcccagaaacgcacggcagcggggattatgaaaaacccaactgtcgatggcattgttgcgatcgacttagatccagttgtatacgatgctaaattcgagaaacaactaggacagataatgctacttatactctgtacttcccaaatcttgttaatgcgaacaacttgggcgttatgtgagtcgatcacacttgccactggaccattaacaacattatgggaagggagtcccggaaaattttggaacactacaattgcagtaagtatggcaaatatcttccgagggagttatttagctggggcaggattagcattctctcttatgaagagtctagggggtgggaggagggggacaggtgcacaaggtgaaacactgggtgagaaatggaaaagacaattaaaccaattgtcaaaatctgagttcaatacttacaaaagaagcgggatcatggaagtcgacaggtctgaagcaaaggaaggtttaaaacgaggagaaacgacgaaacatgcagtttcacgaggaacagcgaaactgaggtggtttgtagaacgtaacctagttaaacctgaagggaaagtaattgatctaggatgcgggaggggtggttggtcatactactgtgcagggctcaagaaagtaacagaagtgaaaggatacacgaagggagggccaggacatgaagaacccatccccatggcaacatatgggtggaatctcgttaagttgcactcgggaaaagacgtcttcttcattcctccggaaaaatgcgatacgctattatgtgatataggtgagtcatcacccaaccccaccatagaagaagggagaacgctcagagtactaaaaatggttgaaccttggctaagaggtaatcagttttgtataaaaattctaaatccttatatgcctagtgttgtcgaaacattagaacagatgcaaagaaaacacggagggatgcttgtaagaaatccactttctcgaaattccacccatgagatgtattgggtaagctgcggtaccggtaatattgtgagtgcagtaaatatgaccagcaggatgttacttaaccgtttcactatggcacatagaaaaccaacttatgaaagagacgtagatctaggagctggcacacgtcatgtagcagtggaaccagaagtagctaatttagatataataggtcaacgcatagagaatattaaacatgaacacaaatccacatggcattatgatgaagataatccgtataaaacatgggcatatcacgggagttatgaagttaaaccaagtggttctgcatctagcatggtaaacggtgtcgtcaaattattgacgaagccatgggatgtcatcccgatggttacacaaattgctatgacggatacaactccattcggtcaacagcgagtatttaaagaaaaagtagacactcgaacccctaaagcgaaaagaggtacagctcaaatcatggaagtaactgcaaagtggctgtggggctttctatcgcgtaacaagaaaccacggatatgtacgcgtgaggagttcaccaggaaagtaagatcgaatgctgcaatcggggccgtattcgtcgacgaaaaccaatggaacagcgcaaaggaggccgttgaagacgaaaggttttgggatttggtccacaaagaaagagaattgcataaacaagggaaatgtgcaacatgcgtgtataacatgatggggaagcgagagaagaaattgggtgaatttgggaaggccaaaggaagtagagcaatatggtacatgtggctcggagctcggttcttagagttcgaagcgttgggatttatgaatgaggaccattggttctctcgggagaactctctaagcggagttgaaggtgaagggctgcataaattaggatacatacttcgagatatctctaagatccctggtggtaatatgtatgcagatgatacagccggatgggatacaagaattactgaagacgatcttcaaaacgaagcaagaattacagatatcatggaaccggaacatgccttattggcaaaatcaatatttaaactaacatatcaaaacaaagtagttagagtccaaagaccagccaaaaacggaacggtgatggacgtcataagtcgtcgagatcagagagggagtggacaagtaggcacatatggcttaaacacatttacaaatatggaagcgcaactaattaggcagatggaaagtgagggcatattttccccaagcgagctcgaaacaccgaacctggccgaacgggtactagattggttagaaaaatatggagtcgagcggctaaaacgaatggcaatatccggagatgattgtgtggttaaaccaattgacgatagattcgctacagctttaaccgccctgaatgatatgggcaaggttcgaaaggatatacctcaatgggagccaagtaagggttggaacgactggcagcaagtacctttctgttctcaccactttcaccagcttattatgaaagatggaagggaaatagtagtgccttgtcgcaaccaagacgagctagtcggcagagcacgtgtgtctcaaggcgcagggtggtctctaagggaaacagcgtgtcttggcaaaagctatgcgcaaatgtggcaactcatgtattttcacaggagagatttacgactagcagcgaacgctatttgtagcgcagttcccgttgactggatacctacaagccgaactacatggagtatacacgctcatcatcaatggatgaccaccgaagatatgttaagcgtatggaacagggtatggatagaagagaatccatggatggaagataaaacccacatatcaagctggggagatgtaccatatcttgggaagagagaggatcaatggtgcggttctctaatcggacttacagcacgcgctacatgggcaacgaatattcaagttgcaataaatcaagtaagaagacttataggcaacgaaaactaccttgactatatgacttcaatgaaacggttcaaaaacgaatcagatccggaaggagcgttatggtaa

SEQ ID NO: 21172 - RNA, 9879 nt, synthetic construct
  misc_feature 1..9879: note = derived and/or modified CDS sequence (opt6) from DENV-1__GU131923__SS-prME
  source 1..9879: mol_type = other RNA
agcgttacgatgctactaatgcttatgcccactgccctggcatttcatcttacaacacgcggaggagaaccacatatgatagtatccaaacaagaaagaggtaagagtcttctctttaagacaagcgcgggagtgaatatgtgtactttgattgcaatggatttgggagaactctgcgaagatacaatgacatataaatgtcctcgaattacagaagcggaaccagacgacgtagattgctggtgcaatgccacagatacatgggtaacctatggtacttgttcacaaacaggtgaacatcgaagagataaaagaagtgtcgcactggcaccccatgttggtctaggtctagaaactagaacagaaacatggatgagtagtgaaggtgcatggaaacaaatacaaagggttgaaacatgggcattaagacatcctggattcacagtgatagctcttttcttggcacacgctatcggaacctccataacacagaaaggtataatcttcatattattaatgttagtgacgccatctatggccatgagatgcgttgggatcggatcaagagattttgttgaaggattgtcaggagcaacttgggtagatgtcgtcttagaacatggaagttgtgtaacgactatggcaaaggataaaccaacattggatatagaactactgaaaactgaagtaacaaaccccgctatcttacgaaaattgtgtattgaagcgaagatcagcaacactactactgattctcgttgcccaacgcaaggagaagcgaccctggtagaagaacaggatgcaaactttgtctgcagaaggacagttgtcgacaggggttggggcaacggctgtggattgttcggcaagggttcattaattacctgcgccaaattcaaatgcgttactaaattggaaggaaaaatagtccaatatgaaaatttaaaatacagtgttatagttacagtgcataccggtgatcaacatcaagtaggcaacgaatctacagaacacgggactacagcaaccattacgccgcaagctccaacaactgaaatccagttgacagattacggtgctctcacattagattgttcccctcgaaccgggttggactttaatgagatggttctgctaaccatgaaggagaaatcatggctagttcataaacaatggttcttagacttgccactcccatggacaagcggtgcttctacaagccaagaaacatggaatagacaagacttattagtaacttttaaaaccgcacatgcaaagaaacaagaagttgtagtactcggatcacaagaaggtgcaatgcacactgcgttaacgggggcaactgaaatacaaacatctggcacgactactatattcgctggacacttgaagtgtcgactcaagatggataagctaacacttaaaggaatgtcgtatgttatgtgtactggttcgttcaaattagagaaagaagttgccgaaacacaacatggcactgtattagttcaaataaaatacgaaggaacagatgccccatgtaaaattccgttcagcacacaagacgaaaaaggaataacccaaaatgggcgactgataaccgcaaacccaatagtaacggataaggaaaaaccagtcaatattgaagctgaaccacctttcggcgagtcctatattgtaataggagcaggagaaaaggctttaaagctgtcatggttcaagaaaggttcgtcaataggtaaaatgtttgaagcaaccgccaggggcgctagaagaatggccattttaggggacacggcatgggatttcgggagtatcggcggagtgtttacatctgttggcaaattagtgcatcaaatattcggaactgcatatggagtgctattttcaggagtaagctggaccatgaaaataggaattggagtgttgttaacttggctcggcctaaattcaaggtctacgagtttaagtatgacctgcatagcagtaggattagtcacgttgtatctgggtgttatggtgcaggctgactcaggctgcgtcatcaattggaagggaagagagttaaaatgtggaagtggcattttcgtaaccaacgaggttcacacgtggacagaacaatataaatttcaggcggactcacctaagcgcttaagtgcagctataggtaaggcatgggaggaaggagtatgcggtatccgaagtgcgacacgactggaaaacattatgtggaagcaaataagtaacgaactgaaccatatcttattagaaaatgatatgaagttcaccgtcgtggtaggtgacgtagcaggtattctcgcgcagggcaagaaaatgatccgtccccaaccaatggaatataaatattcatggaaaagctggggaaaagcaaaaattataggagcagacgtacaaaatacgactttcattatagatggacctaacactcctgaatgtccagatgatcaaagagcttggaatatatgggaagtcgaagattacggatttggaatctttacaacaaacatatggttaaaacttagggattcatatacgcaagtctgcgaccatcgtcttatgtctgctgcgattaaagatagcaaagcagtgcacgctgatatgggttactggattgaatccgagaaaaatgagacttggaaactagcaagagcctcatttattgaagtgaaaacttgtatttggcccaaaagtcatacactatggtcaaatggtgtattagaaagcgaaatgataatacccaaaatctatgggggtccaataagccaacacaactatcggcccggatactttacacaaactgcaggcccctggcacctaggaaagctagaattagacttcgatttatgcgaaggaacaaccgttgttgtggacgaacactgtgggaaccggggtccatctctccgcacaactacagtgactggaaaaataatacacgaatggtgctgtagaagttgcactctaccaccactcagattcagaggggaagatggctgttggtatgggatggagatccggccagttaaggaaaaagaagaaaacctcgttaaatcaatggtgtctgcaggtagcggagaagtagactccttctcgttgggattgctctgtataagtataatgatagaagaagttatgcgatctcgatggagtcgaaaaatgctaatgacagggaccctggcagtgtttctcttactcatcatgggacaacttacatggaatgaccttataagattatgcataatggtgggtgctaatgcgtccgatcgaatgggcatgggtactacctacttggcactcatggctacctttaaaatgagacccatgtttgctgttggtttattgtttaggagattaacatcacgagaagtgttattactcacgataggactttccctcgtcgcttccgttgagttgcccaacagtttagaagaactaggtgatggattggcaatgggtataatgattttaaaactattaactgattttcaaagtcatcaactgtgggcaacgttactatctctcacttttataaaaacaactttctcgttacattacgcctggaagacgatggcaatggttttatcaatcgtaagtctatttccattatgcctatcgacaacaagccagaaaactacgtggttaccagtattattaggtagtcttggttgcaagccactgacgatgttccttatcgcggaaaataaaatatggggcaaaagatcttggcctttaaatgaaggaattatggctgttggtatagtgagtattctgctaagttcacttttgaaaaacgatgtaccgctagctggacccttaatagccggtggtatgctaattgcatgctacgtaataagtggaagtagtgcagatctctcgcttgagaaagcggctgaagtaagctgggaagaagaagccgagcatagtggagcttcacataacatcctagtggaagtccaggatgacggtactatgaaaataaaggatgaagaaagagatgacacgcttacaatactgctgaaggcgaccctactcgctgtaagcggagtttatccactaagtatacccgccacgctttttgtatggtacttctggcagaagaagaaacaacgttcaggggttttgtgggatacaccatcacccccggaagtagaacgcgctgtgctagatgacgggatatacaggattatgcaacgtggcctgctaggaaggtcacaggttggtgttggtgtattccaagagaacgtatttcacactatgtggcacgttactcgaggagcagtacttatgtatcaagggaaacgattagaaccatcttgggcttcagtcaagaaagatcttatctcgtatggaggaggatggcgactacaagggtcgtggaacacaggagaagaggtacaagttattgcagtcgaaccgggcaaaaatccgaaaaatgtgcaaacagctcccggcactttcaaaacaccagaaggtgaagtaggagcaatcgcacttgatttcaaacctggtacaagcggctcccccatagtaaatcgagaaggaaaaatagtgggcctatacggaaatggagtagtaacaacgtcaggtacatatgtaagtgcgatcgcgcaagcaaaagcatcccaagaaggacccttacccgagatagaagacgaagtgtttcgaaaaagaaatctgactattatggatttacatccaggaagtgggaaaacgcgtcggtacctaccagctatagtgcgagaggcgattaaaagaaagttacgcacactaatactagcacctactagagtcgtcgctagcgaaatggctgaggctttaaaaggtatgccaataagatatcaaaccaccgcagtgaagtcagagcacaccggtaaagaaatagtagaccttatgtgccatgccacttttacaatgagactactttcacccgtgagagtaccaaactataatatgataataatggacgaagcgcactttaccgatccatcttctatagctgcaagggggtatataagtacgagagtaggaatgggagaggctgcagccatcttcatgactgctacccctccgggttcggtcgaagcatttccacaaagcaacgccgtaatacaagatgaagaaagagatattccagaacgatcttggaatagtggctatgaatggattacagacttcccaggaaaaactgtctggttcgtgccgtctataaaatcaggaaatgacatagcgaattgcttaaggaaaaatgggaaacgagtaatacaactatcaagaaagacatttgacacagaatatcaaaagaccaaaaataatgactgggattacgtcgtaaccactgatatttcagaaatgggagccaattttagggccgatagagtcattgatcctcggcgttgcttaaaaccggtgatactaaaagacggaccagaaagagtcatactagctggtccaatgcctgtcacagttgcatcagctgcacagcgacgtggtcggatcggtagaaaccataataaggagggtgatcaatatatatacatggggcaaccacttaataatgacgaagaccatgcccattggacagaagcaaaaatgttattagataatatcaacactccagaagggataataccggcattattcgaacccgagcgcgaaaagagtgctgcaatagatggagagtacagattaagaggagaagctagaaaaactttcgtagagttaatgcgtagaggtgacctaccagtatggttgagctataaagttgcgagcgaaggttttcaatattctgatcgtcgctggtgttttgacggcgaaagaaataatcaagtcctagaagaaaatatggatgtggagatatggacgaaggagggagaacgcaaaaagctgcgtccccgatggctggatgcaaggacatactctgaccccctcgcattaagggaatttaaagaatttgcagccggccggaggtccgtcagcggtgacctaatcctagaaattggaaaattgccccaacatttaacgcagagagcgcaaaatgctctcgacaatctagtaatgttacataattcagagcagggtggcagagcatatcgtcatgctatggaagaactaccagacactatagaaactctaatgctgctggcattaatagctgtactaaccggaggggtgacattattcttcctaagcggaaggggtctaggaaaaacgtcaataggcctactatgcgtaatggcttcatcagttctcttgtggatggcaagtgttgagccacattggatcgctgcgtcaattattttagagttctttctcatggtattacttatacctgaaccagacagacaaaggactccccaagacaaccaattagcatatgtagtaattggcctcctatttatgattttaactgtagctgcgaatgagatgggattactggaaacgaccaagaaagatttggggataggccacgaagctgtcggaaaccatcatcacgcagctatgctagacgtagacctacatccggctagtgcgtggactctgtatgctgtggcaacgacaataattacacccatgatgcgacacacaatagaaaacacaacagcgaacatctctttgacagctatagcaaatcaagctgcaattctaatgggactagataagggatggcccatttctaaaatggatatcggagttcctcttcttgcacttggttgctattcgcaggtaaatccacttacgctaacagccgctgtattaatgcttgtggcccactatgcgataataggaccaggactccaagcaaaggcgacacgcgaagcacaaaagcgtaccgctgcaggaataatgaagaatccgaccgtggacgggatagttgcaatcgacttagacccagtagtatacgacgctaaatttgaaaagcaactcggacaaattatgcttcttatactgtgtacgtcacaaatattgctaatgaggacaacctgggctctatgtgaatcaataacgctagctacaggaccgctaactacgttatgggagggatctcctggaaagttctggaacaccacaattgcagtatctatggcgaatattttcagaggatcatacctcgcgggcgcagggttagcatttagcctcatgaaaagcctaggagggggtcgtcgaggaacaggagctcaaggtgaaacattaggagagaagtggaaacggcaactcaaccaattaagcaagtcggagttcaatacttataaacgttcagggatcatggaagtagatagaagtgaggcaaaagaaggccttaaacggggagaaacaacaaaacacgcagtgagtcgcggaacagcaaagttacgatggtttgtggaaagaaatttggtaaagcccgaaggtaaagtcattgatcttggttgtgggagaggaggctggagctattactgtgcgggcttaaagaaggtaactgaagtcaaaggttacaccaagggtggacccggacacgaagaacctatcccaatggctacatatggatggaatttagttaaactacatagtggaaaggacgttttctttatacctccagaaaaatgtgacactctcttgtgtgatataggcgaatcgtcaccgaacccaaccatagaagaagggcgaactctaagggtattaaaaatggtcgaaccttggctccgtggaaatcaattttgcataaaaatacttaacccatatatgccgtcagtagtggaaaccctggaacagatgcaacgcaaacatggaggaatgctcgtaagaaatccccttagtcggaatagcacccatgaaatgtactgggtatcttgcgggactggcaacatagtttccgctgtaaatatgacaagcagaatgttacttaatcgcttcacgatggcgcataggaaaccaacatacgaacgagacgttgatttaggggcaggaacaagacatgttgccgttgaaccggaagtagcaaatttggatattatagggcaacgcattgagaatattaaacatgaacacaaaagtacctggcactatgatgaagataatccttacaaaacgtgggcttatcacggatcatatgaagtaaaaccttctggatcagcaagttctatggtcaatggagttgtaaaattattgacaaagccctgggacgtgataccaatggtgacccaaatagccatgacagatacaacaccattcggtcaacaaagagtctttaaggaaaaagttgatactagaacacctaaggctaaacgtgggactgcacagataatggaggtgacagcaaaatggctttggggatttctgtcacgtaataagaaaccaagaatatgcacacgcgaagagttcaccaggaaagtgcgatcaaatgcggcaatcggagcagttttcgttgacgagaatcaatggaactcagcaaaggaagcggtagaggatgaaagattttgggatttggttcaccgtgaacgagaactacataaacaaggaaagtgcgcaacctgtgtatataacatgatggggaagcgagaaaagaagctcggagagttcggtaaagcaaagggatcaagagccatttggtacatgtggttgggtgctaggtttctcgaatttgaggctttaggatttatgaacgaagaccattggttctctcgcgagaatagcttatctggagttgagggggagggcttgcacaagctgggttacatcttaagagatatttcaaaaataccaggaggtaatatgtatgcggatgacacagctggctgggatacaagaataacagaagatgatttacaaaacgaagctcgaatcactgacataatggagccagaacacgctttactcgctaaatctatttttaaactaacatatcagaacaaggttgttagagtgcaacgacctgctaaaaatggaacagtaatggacgtaatatctcgaagagatcaacgtggatcgggacaggttggcacatacggactcaatactttcacgaacatggaagctcaattaattagacaaatggaatctgagggaatattctctcccagtgaactcgaaacccccaacctagcagagagagttttagattggctcgaaaagtatggagtcgaacgcttaaagagaatggccatctccggagatgactgtgtcgttaaacccatagatgatagatttgcaacagcgttaaccgctttgaatgatatggggaaagtccgaaaggacattccacaatgggagcccagcaaaggatggaatgattggcaacaggtacctttctgctcacaccactttcaccaactcataatgaaagacggacgtgaaattgtggttccttgcagaaatcaagatgaactggttggtagggcgcgagtcagccaaggtgcaggctggtcccttcgcgaaacagcttgccttggcaaatcatacgcacaaatgtggcaactcatgtattttcatcggcgagatttaagattggcggctaacgcaatatgcagcgcagtaccagtagactggataccaacctcgcgcacaacctggtcaatacatgcacatcatcaatggatgactacggaagatatgctatcggtatggaaccgagtctggatagaagagaacccctggatggaagataaaacgcacataagtagctggggagatgtaccatacttagggaagcgggaagaccaatggtgtggcagcttaataggtctgacagctcgcgcaacctgggcaactaatattcaagttgctataaaccaagtccgcaggttaataggcaatgagaattatctagattatatgacaagcatgaagcgattcaaaaacgagtcagatccagagggagcgctttggtag

SEQ ID NO: 21173 - RNA, 9879 nt, synthetic construct
  misc_feature 1..9879: note = derived and/or modified CDS sequence (opt6) from DENV-1__GQ868637__SS-prME
  source 1..9879: mol_type = other RNA
agtgttactatgttgcttatgctgatgcctactgcactagcgtttcatctgactactcgaggaggagaaccacacatgattgtttccaaacaagaacgtggaaaatccctgctatttaaaaccagtgctggtgtaaatatgtgcactttgatcgctatggatcttggtgaactatgtgaggatactatgacttataaatgtccgcggataaccgaggttgagccagacgatgtagattgttggtgtaacactaccgatacgtgggttacttatggtacatgcagccaaaccggtgagcatagaagagacaaacgttcggtagcactcgcacctcacgttggactcggtttagaaacaagagcagaaacctggatgagttcggaaggggcatggaaacaaatacaaagagtagaaacatgggctctgaggcaccctggatttacagtaatagctttatttttagcgcatgcgattgggacatcaattactcaaaaagggatcatatttatccttctaatgcttgtaacacctagcatggctatgagatgcgttggaatcgggtcaagagattttgtagagggtctttcaggggctacgtgggttgatgtagtactagaacatgggagttgtgtcaccacgatggccaaagacaaaccaacactggatatagaactgctaaaaaccgaagtgactaatcctgcggtcttgcgaaaattgtgtatagaagcaaaaataagtaacacaacaactgacagtcgatgccctacacaaggggaagctacgctcgtagaagaacaagatgctaactttgtatgccgccgcacttttgttgaccgaggctggggcaacggttgtggcctcttcggtaaaggatcgctaatcacatgcgcaaaattcaaatgtgtaacaaaactggagggtaaaatcgtgcaatacgaaaatttgaaatacagtgtaatcgtgacggttcacacaggagatcaacatcaagttgggaacgaatctactgagcatggcactaccgccaccataactccacaagctcctacatctgaaatccaattgacggattacggcgctttaactttagactgtagtccaagaacaggccttgactttaacgaaatggttctactaacaatgaaagagaaaagctggttagtacataaacaatggtttttggacttacctctgccctggaccagtggggctagtacatctcaagaaacctggaacagacaagatttgctcgtcacatttaaaacggcacatgccaagaaacaagaagtagtcgtgttaggttcccaagaaggcgcgatgcacaccgcactgacgggtgcaacagaaattcaaacctcaggtacaaccacaatctttgccggacacttaaagtgtagattaaagatggataaactaacattaaaaggcatgtcttatgtcatgtgtacaggtagttttaaactagaaaaagaggtagcagaaacccaacacgggaccgttttggtacagataaagtatgaaggaacggacgcaccctgtaaaataccatttagtacgcaggatgaaaagggagtaacgcaaaatggcaggttaataacagctaaccctatagtaacagataaagaaaagccagttaatatagaagcggagccgccattcggtgaaagctatatcgtaattggcgccggagaaaaggcgctgaaactttcatggttcaaaaagggatcctcgatcggaaagatgttcgaagcaacagctagaggagctagacgaatggcaatactcggcgatacagcatgggacttcggttcaatcggaggagtgtttacaagtgtaggaaaacttgtacaccagatattcggtactgcttatggtgttctatttagcggggtatcatggacgatgaaaattggaatcggggttctactgacttggctaggattaaactcgcgaagtacgtcactatcaatgacatgtattgccgtaggcttagttacactatatctcggagtaatggtacaagccgatagtggatgcgttattaactggaaaggtagagagcttaaatgcgggagtggaatctttgtaactaatgaagttcacacatggaccgaacaatacaaatttcaggctgactcaccaaaaaggttaagtgcagctattgggaaagcatgggaagagggggtatgtggcatcagatctgctacgagactagaaaatattatgtggcgacaaatatcaaacgaactaaatcacattttgttagaaaatgatatgaaatttactgtcgtagtaggggacgttgtagggatcctagcacaaggaaagaagatgatccgacctcaacctatggaacataagtacagctggaaatcatggggaaaggccaaaataattggcgcagacgtacaaaacaccacttttataattgatggacctaatacaccagaatgtccagacgaccaacgtgcatggaacatttgggaagtagaggattatgggtttggaatcttcacaacaaacatatggttaaagctcagagattcctatactcaagtgtgcgatcatcgactcatgagcgcagctattaaagattcaaaggccgtgcatgcagatatggggtattggatagaaagcgagaaaaatgaaacatggaagctagcacgtgcgtcgttcatagaagttaagacatgcatatggccaaagtcacacactttatggtcaaacggagtgttggaatccgaaatgatcataccgaaaatttatggagggccgataagccaacataattatcgcccaggatattttacccaaactgctggaccttggcacttaggaaaattggagctagattttgatttgtgcgaaggtacaacagtcgttgtggatgaacactgtggtaatcgaggaccatctttaagaacaacaacagtgaccggaaagatcatacacgaatggtgttgccgaagctgcacattgcctccactaaggttcaaaggggaagatggttgctggtatggtatggaaataagacctgtaaaagaacgagaagaaaacctagtcaagtccatggtaagtgctgggtcgggtgaggtagattcgttcagtttagggttgctctgcattagtataatgatagaagaagtaatgcgttctagatggagtcgaaaaatgctgatgactggaacgcttgcagtattcttcttattgataatggggcaactgacatggaatgatttaataagactatgtatcatggtaggtgcaaatgcaagcgaccgtatggggatgggaactacatatcttgccttgatggctacatttaaaatgcggcccatgtttgcagtaggtctactctttagaaggctaacgagtagagaagttttattactaactattggcctcagcctggtagcgtcggtagagctccctaattcgctcgaggagcttggcgatgggctggcaatgggaataatgatattgaaactcttaacagactttcaaagccaccagctttgggcaacactactgtcgttaacatttataaaaacgacattctcactacattacgcgtggaagacaatggcaatggtacttagtattgttagtttactaccgctgtgtctgtccactacgtcgcagaaaacgacctggctccctgttctattaggatctttagggtgtaagccattaacaatgttcctgatagctgaaaacaagatatggggtcgtaagtcttggcctttaaacgaaggaattatggcagtaggaatagtctcaatactcttgtcctcactacttaaaaatgatgtaccgctagccggaccacttatagctggaggaatgctcattgcgtgttatgtaatatctggtagttcagcggaccttagtttagaaaaagccgccgaggtgtcttgggaagaggaagctgaacattcaggggcctctcataatatcctggtagaggtacaagacgatggaacaatgaagataaaagatgaagaacgcgatgacacactaaccatacttttaaaggctacactcttagcagtttcaggtgtatatcctctctcaattccagcgactctgttcgtgtggtacttttggcagaagaagaaacagagaagcggcgtgttatgggataccccaagcccgccagaagttgaacgagcagtgctagacgatggtatataccgaattatgcaaagaggcctcctaggacgatcccaagttggagtcggagtctttcaagaaaacgtctttcatacaatgtggcatgttacaagaggagctgttcttatgtaccagggcaagagactggaaccttcgtgggcatctgtcaagaaagacttaatatcgtacgggggcggttggcggctccagggaagttggaatacgggagaagaagtgcaagttatagcagtagagccaggcaaaaatcccaaaaatgtccaaacagctcctggaacattcaaaaccccagagggagaggttggtgcaattgctttggactttaaaccaggtacaagtgggtctcctatagtaaatagagaaggaaagatagttggattgtacgggaacggagttgtcaccacatctggaacatatgtatccgcaatagcccaggccaaagcatcacaagaaggtccattgcccgaaattgaagacgaggtctttagaaaaaggaatttaactataatggatcttcatccagggtctgggaaaacaagaaggtacctaccagcgatagtaagagaggctattaaaagaaaacttcgtactttaatcctcgccccaactagagtagttgcctccgaaatggctgaagccttaaaaggaatgccaattagatatcaaaccactgctgttaaatcagaacacactggaagggaaatcgtagatcttatgtgtcatgcaacttttaccatgagactattaagtcccgttcgagttccaaactataatatgataattatggatgaagctcattttacagatccaagttcaattgcagcgagaggttacatatcaacaagagttgggatgggtgaagccgctgccatattcatgacagcaacacccccaggaagcgttgaagcatttccacaaagtaatgcagtaatccaagacgaggaacgagacattcccgagagatcgtggaacagcggatatgaatggattacagattttccgggaaaaactgtatggtttgttcctagtataaaatcaggaaatgacatagccaactgcctaaggaagaacggaaaacgcgtgatccagttgtccagaaaaacattcgacactgaatatcagaagacgaagaataatgactgggactacgtcgtaacgacagatatttcagaaatgggagctaacttcagggcggatagagttatagatccacgacgttgtttgaagcctgtaatattgaaagatggacctgagagagtgatactggcaggcccgatgccagtaactgtcgcttccgcagcccaaaggagaggtcggattggaagaaatcacaacaaagaaggggatcaatatatttatatgggacaaccacttaataatgacgaagatcacgcccattggacagaagcaaagatgttactagataacattaatacaccagagggtataataccagctttatttgaaccagagcgtgagaaaagcgctgccattgatggggaatacagactaagaggtgaagcacgaaaaacttttgtagaattaatgagaagaggagatcttcccgtatggctaagttataaagttgcatccgaaggattccaatactccgatagaagatggtgcttcgacggcgaaagaaataatcaagtactcgaggagaatatggatgttgaaatctggactaaagaaggtgaaagaaagaagttaagaccaagatggttggacgcccgaacgtacagcgacccactggcgttaagagaatttaaggagttcgcagcaggacgacgaagcgtcagcggagatttaatactagaaattgggaaattaccgcaacacttaacccaaagggcacaaaacgcgctagataacctagtcatgttgcataactccgaacaaggagggcgggcataccgacatgctatggaagaactcccagatacaatagaaactttaatgcttttagcattaattgcagtactgacaggaggagtaaccttatttttcttgagcggaagaggtctgggcaagacaagtataggactcttgtgtgtcatggcatcatcagccctgctatggatggcgagtgtggagccacactggatagctgcaagtataatcctcgagttctttcttatggtattgttaattccagagcccgaccggcaacgaactccacaagataaccaactcgcgtatgtggttatcgggttattatttatgattttaactgtagctgcaaacgaaatgggactgctggaaactacaaagaaagatctaggcataggccatgtcgcggtagaaaatcaccatcatgcaacaatgttagacgtagatctacatcctgctagcgcttggaccttatatgcagtcgctactacaattataaccccaatgatgagacatacgattgagaacacaactgcgaacatatctctcaccgcaattgcaaatcaagccgccatcctaatgggattagacaaggggtggccgatcagcaagatggacattggggtgcccctacttgctttaggctgttactcccaagtgaatcccctgactctcatagctgcggtattgatgctcgtcgcacattatgcaataatcggtccaggtctacaggcaaaggctacaagagaagcacagaaaagaactgcagctggcattatgaagaacccaaccgttgacggcattgtagcgattgatcttgatcctgtagtatacgacgcaaaattcgaaaaacaactaggacagataatgctactaatattgtgtacctcccaaatattgctaatgagaacaacatgggccctatgtgaaagcattactttagctaccggcccattgactactctttgggaaggttcgccaggaaaattctggaacacgaccatagccgtgtctatggcaaacatcttccgtggttcatatctagccggagctggacttgcgttttctttaatgaagagtttagggggtgggcgccgtggaactggagcacagggagaaacattgggtgagaaatggaaaagacagcttaatcaactctctaaaagtgaatttaatacctataaaaggtctgggattatggaagtagatcgttcggaagcaaaagagggactgagacgtggtgagacgacaaaacacgctgtgagtcgagggacagcaaaactcagatggtttgttgaaagaaatcttgttaaaccagaaggaaaggtaatagacttgggatgtggccgaggtggctggtcctattattgtgctggcctaaagaaagtcacagaggtaaaaggatatacgaaaggaggcccgggccatgaggaaccaataccaatggctacgtatggatggaacttggtaaaattacatagtgggaaagatgtcttctttataccacctgaaaaatgtgatacactcctatgtgatataggagagtcatctccaaacccaactattgaagaggggagaacgttaagggttctaaaaatggtagaaccgtggctacgtggtaatcaattctgcatcaaaatactcaatccatatatgccttcagtggtagaaactctagaacagatgcagagaaaacatggaggaatgctagtaagaaatccactatcgcggaacagcactcacgaaatgtactgggtgagttgtggtactggcaatatagtgtcagctgttaacatgacaagtagaatgcttttaaaccgcttcactatggcacatcgcaaacccacatacgaacgagatgtagacctcggtgcaggcacgagacatgttgctgttgaaccagaagtagcgaatttagatataatagggcaacgtatagagaatattaaacatgaacacaagtcaacctggcactatgacgaagataatccatacaaaacctgggcttaccacggatcttatgaagtaaaaccaagcggaagtgcatcgtcaatggtaaacggagtagtgaaattgcttacaaagccatgggatgtcattcctatggttactcaaattgcgatgaccgacactacccccttcggtcaacagagagtattcaaagaaaaagttgataccagaacccctaaggctaaaagagggactgcccaaataatggaggtcacagcacgatggctatggggattcttgagtcgtaacaagaaacctcggatatgcacaagagaagaatttactcgaaaagtccgatctaacgcggctataggtgcagtattcgtagatgagaaccagtggaactcagccaaagaagccgtagaagatgaaaggttttgggatttagtccatcgagaacgagaattacataaacagggtaaatgtgctacttgtgtctacaatatgatggggaaaagagagaagaaacttggggagtttgggaaagccaagggttctagagcgatatggtacatgtggctcggtgctaggttcttagagtttgaggcattaggtttcatgaatgaagatcactggttttccagagaaaatagcctctcaggagtagaaggtgaaggactacataaactcggttatatactacgtgatatcagtaaaattccaggaggtaatatgtatgcagatgatactgctggatgggacacgcgaataaccgaagacgatctgcaaaatgaagcaaaaattacagatatcatggagcccgaacacgcattattagcaacctctatttttaaattaacatatcagaataaggtagtacgggtccagcgaccggcaaagaatggaactgtcatggatgttatatctagacgagatcaaagaggaagtgggcaagtaggtacatacggactgaatacgttcactaatatggaagcccagttgattcgacaaatggagtccgaagggattttctcaccatcagagctcgaaaccccgaacctggctgaaagagttcttgattggctcgaaaaatacggggtcgaaagactgaaaagaatggccatatctggtgatgactgtgtagtaaagcccatagacgatagattcgcaacagcgcttacagcactgaatgacatggggaaagttaggaaagatattccacagtgggaacccagcaagggatggaatgattggcaacaagtaccgttctgctcccaccacttccaccaacttataatgaaagacggtcgggaaattgtagtaccctgccgtaaccaagacgaattagtaggcagagctagggtgagccagggagccggatggtcacttagggaaacagcatgtttagggaagtcatatgcgcagatgtggcaactcatgtattttcatcggcgggatctgagattagcggctaacgctatttgttcagcagtaccagttgattgggttccaacatcaagaacaacttggtcaatacacgcacaccaccaatggatgacaaccgaagatatgctttcagtgtggaatagagtttggatagacgaaaatccttggatggaagataagacccacatatctagctggggagatgtaccttatcttggtaaacgcgaagatcaatggtgcggttcactaattggactaactgctagagcaacatgggctacaaacattcaagtagctatcaaccaagtacgcagattaataggaaatgagaattatttggactatatgacaagtatgaaacgattcaagaatgagagcgatccagaaggtgcattatggtaa

SEQ ID NO: 21174 - RNA, 9879 nt, synthetic construct
  misc_feature 1..9879: note = derived and/or modified CDS sequence (opt6) from DENV-1__GQ868639__SS-prME
  source 1..9879: mol_type = other RNA
agtgttactatgttgcttatgctgatgccgacggcacttgcatttcatctaacaacaagaggaggggaacctcacatgattgtatcaaaacaagaaagaggaaaaagtctactatttaaaacctccgctggagttaatatgtgtacgttgatagcaatggaccttggagaattttgtgaagacactatgacatacaaatgtccgagaatttcagaagcagaacccgatgatgtggactgctggtgcaacgctacagatacgtgggtaacgtacggaacatgcagccaaactggagaacaccgacgagacaaaagaagcgtagctctagctccacacgtggggctaggcttggaaaccaggacagaaacgtggatgagctcagaaggggcttggaaacaaatacaacgagtagaaacgtgggcattaaggcacccaggatttaccgtaatagcactttttctagcacatgcgattggcacttctataactcaaaaaggcattatattcatactgttaatgttggtcactccctctatggccatgagatgtgtaggcattgggtcacgagactttgttgaagggttaagtggagccacttgggtggatgtagtattggaacacggttcttgtgttaccacaatggcaaaagacaaacccactttagacatagaactactgaaaactgaagttacaaatccagccgtgttacgcaaattatgcatcgaagctaaaatatctaatacaaccacagattccaggtgtcccactcaaggtgaggcaactctagtggaggaacaagatgcgaattttgtatgtcggcgaacatttgttgatagaggttggggtaacggctgcggattatttggtaaaggatcattaataacttgcgcaaaattcaaatgtgtaacaaaattagaagggaaaattgtacaatatgaaaacttgaaatactctgtaatagtaacagtccatactggagatcaacaccaagtgggaaatgagagtactgaacatggtactacggctacaataactcctcaggcgccaagcacagaaatacaactaactgattatggtgcactaacattggattgcagcccgcgcactggactagacttcaatgaaatggtgttacttacaatgaaagaaaaatcgtggctagtacacaagcaatggttcctagacctaccactaccatggacgagtggagcaagtacatcccaagaaacatggaataggcaggacctcctagtcacatttaagacagcacatgcgaagaaacaagaggttgtagtattagggagtcaagagggggctatgcacacagcactcacgggggccacagaaatccaaacctctggcacaacaacaatattcgcaggacatttgaagtgccgccttaagatggacaaactcactttaaaaggaatgagttatgtgatgtgtaccggtagtttcaagttagaaaaagaagttgctgaaacccaacacggtactgtgcttgtacaaattaagtatgaggggacggatgcaccttgcaagataccgttttccactcaggatgaaaaaggggtgactcaaaacgggcggttaataacagcaaacccaatcgtaacagataaggagaaaccagtaaatatagaagcagaacctcccttcggcgagagttatatagtaattggtgctggagaaaaggcattaaagctgtcttggttcaagaaaggaagtagcataggaaaaatgttcgaggcaacagcacgaggtgctagaagaatggcaattttgggggacactgcctgggactttggatctatcgggggagtattcacttcagtgggaaaattagttcatcaaatattcggaacagcctacggcgtcctattttcgggcgtttcttggactatgaagattggcataggagtactgttaacatggctcggtctaaattcaaggtcaacatcattgtcaatgacgtgtatagcagttggcttggttacattatacctaggagtaatggtacaggccgattccggttgcgttataaattggaaaggccgagaattaaagtgtggatcaggaatattcgtaactaatgaagtccatacttggactgagcagtataaatttcaagccgattctccaaaaagacttagcgcagcaataggaaaggcttgggaggaaggtgtttgtggaattaggtcagcgacaagactagagaatattatgtggaaacaaatatcaaatgaattaaatcatatactattagagaatgacatgaaattcacagtagtagtaggagatgtcgcaggcattctagcacaagggaagaaaatgataaggcctcaaccaatggagtataagtattcatggaaaagctggggaaaagcaaaaattattggtgcagacgtacagaacactacatttataatagatggtcccaatactccagaatgtccagacgatcaacgtgcatggaacatctgggaggtcgaagattatggatttggaatattcacgacaaacatatggcttaagctccgggattcatacacccaagtatgtgatcatcgacttatgtcagctgccattaaagatagcaaagcagtccacgcagacatggggtattggatagagtcagagaaaaatgagacctggaaactcgcccgagcatcatttatagaagttaaaacctgtatatggccaaaatcacacactctatggagtaatggagtactagaaagtgagatgataatacccaaaatatatggagggcccatctcacaacataattatcgcccaggctattttacgcagacggcgggtccatggcaccttggcaaactcgagttagactttgacctttgcgaagggacaacagtagtggtagatgagcattgtggcaatcggggtccaagcctaagaactacaactgtgactggtaaaattatacatgaatggtgttgtcgttcttgtaccttaccccctctaagattcaagggcgaggatggctgttggtatggaatggaaatcagaccagtaaaagagaaagaagaaaatttggttaaaagtatggttagtgccggctcaggagaagttgactctttttctctagggctactatgcatctcgatcatgatagaggaggtaatgaggagtagatggtccagaaaaatgctgatgaccggaaccctggcagtattctttcttttgattatggggcaactaacatggaatgacctgattagactctgtataatggtcggcgcaaatgcgtcagataggatggggatgggaatgacttatctcgcactgatggctaccttcaagatgaggccaatgtttgcagttggattgttatttaggaggttaacgtcaagggaggtgcttttgttaacaataggtctatcattggtagcgtccgtagaattaccaaatagtttggaagaattaggtgatggtctagcgatgggcatcatgatattgaagttgttagccgatttccaatctcatcaattgtgggctactctgctttctctcacgttcatcaaaactaccttttcactgcactacgcctggaaaacaatggctatggttctatcaattgtatctttatttcccctatgcctaagcacaacatcacagaaaaccacctggttgcccgttttacttggtagtctaggctgtaaacccctcacaatgttcctaatagcggaaaacaaaatctggggtagaaaatcatggccattgaatgaaggaattatggctgtaggaattgtatctattctgttgagtagcctacttaagaacgacgtaccactagccggacctcttattgcaggagggatgttaattgcgtgttatgtcatatctggcagctctgctgatctaagtttggaaaaagcagcagaagtctcatgggaagaagaagccgagcattcaggggcctcccataacattctggtcgaggtacaagatgacggcaccatgaagattaaggacgaggagcgtgacgataccctaactattttgttgaaggcgactttattagcggtctccggcgtctatccattaagtatcccagctacattatttgtctggtatttctggcagaagaagaaacaaagatccggtgtgctatgggatacaccgagtccaccagaagttgagagagcagtgttagatgatggaatttacagaattatgcaacgcggattgctgggtagatcacaagtcggggtgggggtcttccaggaaaatgtattccatacaatgtggcatgtaacacggggagcagtgctcatgtatcaaggtaaaagactagagccctcatgggcgtctgtaaagaaagacctaattagctatggtggcgggtggagactgcaaggatcttggaatactggagaagaagtgcaggtaatagccgtagaacccggcaaaaatccgaaaaacgtacagacagccccaggtactttcaaaacctcagaaggtgaagttggggccatagcattagacttcaaaccggggacgagcgggagtcctatagtaaatagggaaggaaaaatagtaggtttgtacgggaacggtgtagtaacaacatcaggtacgtacgtttcagcgatcgcacaagcgaaagcatctcaagaaggtccactacccgagattgaagacgaggtctttaggaaaaggaatttaactattatggacttgcatccaggatcgggaaaaacgagaaggtacttgccagcgattgttcgtgaagcgatcaaaagaaaactaagaacgttaattcttgcaccgactcgagtcgttgccagcgaaatggcagaggcattaaaaggaatgccaattagataccaaacgactgcagtgaaatcagagcatacggggaaagaaatagtcgacctgatgtgccatgcgaccttcactatgcgcctattatcaccagtcagggtaccaaattacaatatgattattatggacgaagctcattttacagacccgagttcgattgcggctaggggttacatctcaacgagagtcggtatgggagaagcagctgcaatttttatgacggcaacacccccgggttccgctgaggcatttccacaatcaaacgcagtaatccaagacgaagaaagagatattccagaaaggtcttggaactctggttatgaatggataacagacttccctggtaaaacagtatggttcgtcccatctataaaaagtgggaatgacatagcaaattgtcttcgcaaaaatggcaaaagagtaatacagttaagtagaaagacatttgatactgagtatcagaaaaccaaaaataatgattgggattatgtggtaacaaccgatattagcgaaatgggagcaaactttagagctgatagggtcatagatccgcgtcggtgcttgaagcccgttattctaaaagacggacctgaaagagtgatccttgccggtccaatgcccgtcacagtcgcaagcgcagcgcaacgcagaggtagaattggaagaaatcataataaagaaggggatcaatatatttacatgggacagccacttaataacgatgaagaccatgcacattggaccgaggcaaaaatgttactggacaatataaacaccccggaggggataatacctgcgctattcgaacctgaaagggaaaaatcagcagctatagatggagaatatagactaagaggagaagcacgaaaaacatttgttgaactgatgagaaggggagacttaccagtttggctcagctataaagttgcttcggaaggatttcaatattcggatcgaagatggtgctttgacggagaaaggaataaccaggtcttggaagaaaacatggatgtagaaatatggacgaaagaaggcgagcggaagaaactgcgaccgaggtggctggatgctaggacttacagtgatccactagcgctgcgcgaatttaaggaatttgcagctggacgtagaagtgtgtcaggggatctaatcttggaaataggcaaattacctcaacatctaacgcaaagagcacagaatgctttagataatttggtcatgttacacaactccgagcaaggaggacgtgcgtatcgacatgctatggaggaattaccagataccatcgaaaccctaatgctattagcattaatagcggtattaactggaggggtcacattgttcttcctttcaggaaggggactaggaaaaacttcgataggactactatgcgttatggcttcatcagttttactttggatggcgtccgtagagccacattggattgctgcatcaattatacttgagttctttttaatggtgcttttaattccggaacccgacaggcaaagaacacctcaagacaatcaactggcatatgttgtcattggactcctattcatgattctgacagtagcagcgaatgagatgggtttgctagaaacgactaagaaagatttaggaatcggtcacgtcgccgtcgaaaaccaccatcacgcggcaatgctcgatgtggatctgcacccagcaagtgcatggacattatatgcagtcgcaacaacgataataaccccaatgatgagacatacgatagaaaacactactgctaacattagtttgacggcgatcgccaatcaagcagcaattctcatgggcttagacaaaggatggcccattagtaaaatggatattggggtacctctattagcattagggtgctattcacaagtcaacccattgactttgactgcagcagtattgatgcttgtcgcacattacgcgattatcggccccggtctacaagctaaagcgactcgagaagcgcaaaaacgaacagccgcgggtataatgaagaatccaacagtagatggaatagtcgccatcgatctcgatccagtggtttatgatgccaaatttgaaaagcaactaggccaaattatgttactaattttatgcacatcgcaaattttactaatgagaacgacgtgggctctatgtgaatcgataacgctagcaacgggcccactgaccactttatgggaaggaagcccaggaaaattctggaacacaacgatagcggtaagcatggcaaacatattcagaggaagttacttggcgggtgcaggactagcattcagccttatgaaaagtttaggaggtggacgtagaggcaccggggcccaaggcgagactcttggagaaaagtggaaaagacaactaaaccaattgagcaaatcagagttcaatacctataaaagatcaggaataatggaagtagataggtcagaggcaaaggaaggactaaagcgtggtgagacaaccaaacacgctgtaagccgaggtacggcaaaattgagatggtttgtggaacgcaatctagtaaaacctgaagggaaagttatcgaccttggctgcggtagaggtgggtggtcatattattgtgcgggattaaagaaagtaacagaagtaaaaggttatacgaaaggaggtccaggacacgaagaaccgattccaatggcaacatatggctggaacttggttaaactccattcaggtaaagatgtattctttgttccgccagaaaaatgcgacacactcctctgtgacatcggagaatcatcaccaaatcctacaatagaagagggccgaaccttacgtgtattgaagatggttgaaccatggttacgtggcaatcagttctgcattaagattctaaacccatacatgccaagtgttgtagagactctggagcaaatgcaacggaaacatggaggtatgttggtcagaaacccactatcccgtaattcgacacatgagatgtattgggtatcctgtggaaccgggaatattgtctccgctgtaaatatgacttcccgaatgctattaaacagatttactatggcgcaccgaaaaccaacatatgagagggatgtggacttaggagcggggacccgccacgtagctgttgaacctgaagtggccaacttagacataattggacaacgtatcgaaaatattaagcatgaacataaatcaacatggcattacgatgaagataatccgtacaagacatgggcctatcacggaagttacgaagtcaaaccctctgggtcagcaagctccatggtaaacggcgtagtaaagctacttaccaaaccctgggatgtcattccaatggtaacacaaatagcaatgaccgataccacaccctttgggcagcaaagagtcttcaaagaaaaagtggacacacgaaccccaaaagcaaagcgggggactgctcaaataatggaagtcacagcgaagtggttgtggggctttttgtcaaggaacaagaaacctagaatttgtacgcgagaagaatttactagaaaggtaagatctaacgcagcgataggagctgtgtttgtagatgagaaccaatggaactcagccaaagaagcagtagaggatgaacgtttctgggacttagtgcaccgtgaaagagaattgcataaacaaggaaaatgcgcaacttgtgtatataacatgatgggaaagagagagaagaaactaggcgaatttggaaaagcaaaagggtcaagggccatctggtatatgtggttaggagctagatttctagaatttgaagcattgggttttatgaatgaggaccattggttttcgagagaaaattcattgtcaggcgtggaaggggaagggctacataaactaggatatatattgcgagacatttctaaaatctcagggggcaatatgtacgccgatgatacagctggctgggatactcggataactgaagacgacttacaaaacgaagcaaaaataacggacataatggaaccagagcacgcattattagccaagtctatatttaaattgacatatcaaaataaggtggtgagggttcagaggcccgccaaaaatggtacggtaatggacgttattagtaggagggatcaacgaggcagcggacaggttggaacatacggactgaatacattcaccaacatggaagcccaactcatccgtcaaatggagtcggaaggaatctttagccccagtgaattagaaacccctaacttggcggaacgggctttggactggttagaaaaacacggagtagaaaggttaaaaagaatggcaataagcggtgacgattgtgtagttaaaccgatagacgacagatttgctacggctctgacggcacttaatgacatgggtaaagtgagaaaggacattcctcaatgggaaccgtcaaaaggctggaacgactggcaacaggtacctttctgttctcatcattttcatcaattaattatgaaagacggccgagaaatcgtcgttccttgtcgtaaccaagatgagctggttggcagagctagagtaagtcaaggggcaggatggtctcttcgggagactgcatgcttagggaaaagttatgcacaaatgtggcaactaatgtactttcatcggcgtgaccttaggttagcagccaatgcaatatgttcagcagtcccggttgattgggtacctacaagtcggacaacgtggagcatccatgcacaccatcaatggatgaccacggaagacatgttgtcagtttggaatcgggtttggatagaagaaaatccatggatggaagataagacccatatatcctcatgggaggacgtaccctatttaggtaaaagagaagaccaatggtgtggtagcttaataggattgactgctcgggcaacctgggcgacaaatatacaagttgccattaatcaagtacggagactcataggaaatgagaattacttagattacatgacgagcatgaaaagatttaagaatgagtccgacccagaaggtgctttatggtaa

SEQ ID NO: 21175 - RNA, 9879 nt, synthetic construct
  misc_feature 1..9879: note = derived and/or modified CDS sequence (opt6) from DENV-1__GU131925__SS-prME
  source 1..9879: mol_type = other RNA
agcgttactatgttattgatgttaatgccgacggctttagcgttccatctaacaacaagagggggcgaaccacatatgattgtaagcaaacaagaaagaggtaaaagtctacttttcaaaacatcagctggagtaaatatgtgcacattaatcgctatggatctgggtgaactgtgtgaagatactatgacatacaaatgccctcgcattactgaagctgaaccggacgatgtagactgctggtgcaacgccactgatacctgggttacttatgggacttgtagtcaaacgggagaacaccggagggataaacgttcagtagccctagctccacacgtagggttgggactggaaacaagaactgaaacgtggatgtcatctgaaggggcctggaaacaaattcagagggtggaaacttgggctttaaggcatccaggttttactgtcatagcattgtttttagctcatgcgattggaacatcaatcacacaaaaaggcataattttcatattactaatgctagttactccatcaatggctatgagatgtgtagggataggatcaagggactttgtcgaaggattgagtggagctacttgggtcgatgttgtattagaacacggatcgtgcgtgacaactatggcaaaagataaaccaactctagatatcgaattattaaaaacggaagtgacaaacccagctatattgcgaaaattatgtattgaagcaaaaattagtaataccacaaccgatagtcgttgtcccacacaaggtgaagcaaccttggtcgaagaacaagatgcgaacttcgtgtgcagaagaacttttgtagacagagggtggggcaatggatgtggcctatttggtaaaggcagtctaattacctgcgccaaattcaaatgcgtgaccaaactagaaggtaaaatcgttcaatatgaaaacttaaaatactctgtgatcgttacggtacatactggggatcaacatcaggtaggaaacgaaagtacagaacatggaacaacggcgacaattacccctcaagcacctacgacggaaatacagttgacagactacggcgctctaactttagattgttcaccgagaacaggattagattttaacgaaatggtgttactcactatgaaagagaaaagttggttagtacataaacaatggtttttagatttacctctaccatggacctcaggagcatcgacaagtcaagaaacctggaatcgccaagatttactggtcacatttaaaactgctcatgctaagaaacaagaagtagtagtattgggtagtcaagaaggtgcaatgcataccgctttaacgggagcaacggaaatccaaactagcggtacgactacaatcttcgcaggacatttaaaatgtagactcaaaatggacaaattgacattaaagggaatgtcatatgttatgtgcacgggcagtttcaagctcgaaaaagaagtagcagaaacacaacatggtactgtattagtacaaatcaaatatgaaggcacggatgccccctgcaagattcccttcagtacacaggatgaaaaaggtgtaacgcaaaacgggaggctaattacggccaacccgatagttactgataaagaaaaacccgttaacatagaagcagaaccaccattcggagaatcttatatagtcatcggggcaggagaaaaggctttaaaactttcctggttcaaaaaggggtcctcgatagggaaaatgttcgaagcaacagcccgcggtgctagaagaatggcgatactaggagatacggcgtgggattttggtagtataggaggcgtattcacctctgttggaaaacttgtacatcaaatcttcggtacagcctatggagtcctattttcaggagtatcttggaccatgaaaataggcataggagtcctgttaacttggctaggtcttaactcaagatctacaagtttaagcatgacgtgtatagcagttgggctagttactttatatttaggagtcatggtgcaagcagattctgggtgtgttattaactggaagggtagagaattaaaatgtggatccggtatatttgtaactaacgaagttcatacatggacagagcagtataagtttcaagctgattcaccgaaaaggttatcagcggccattggtaaagcctgggaagaaggtgtttgtggcatacggagtgccacaagacttgaaaacatcatgtggaaacaaatctcgaacgaactcaaccatattcttcttgaaaatgacatgaaatttactgtcgtagtgggagatgttgccggtattttagcgcaagggaagaaaatgatccgccctcaacccatggaatacaagtacagttggaagagttgggggaaggcaaagataataggcgcggacgtacaaaacacgacatttatcatcgatggcccgaacacacctgaatgtcccgacgatcaacgagcttggaacatttgggaggtggaagactacggatttggaattttcaccacaaacatatggctaaagctgagagactcctatacacaagtatgtgatcacagactaatgagtgccgctattaaagatagtaaagctgtacacgcagatatgggatactggattgaatcagagaaaaacgagacctggaagctcgcaagggcctcatttatagaagttaagacctgcatatggcctaaaagtcataccttatggtctaatggggtcttagagtccgagatgattataccaaaaatatatggaggaccaatctctcagcacaattaccgcccggggtacttcacacaaacggctggaccatggcaccttggaaagttagagttggacttcgacttgtgtgaaggaacgacagtagtagtagacgagcactgtggaaacagaggaccgtctcttcgcacaacgacggtcacaggcaaaattatacatgagtggtgttgtaggtcatgcacgttgccaccgctgaggtttagaggagaagatgggtgctggtatggcatggaaattagaccagttaaagagaaagaagaaaacttagttaaatctatggtaagcgcaggttccggagaagttgattcatttagcctcgggttactatgcatttctataatgatcgaagaggtgatgcgatctcgttggtcacgtaaaatgctaatgactggtactcttgctgtcttcttgctacttatcatgggtcaattaacatggaacgacctaataagactctgcatcatggtcggggcaaatgcaagtgatcgtatgggaatgggaacgacgtatctagcgttaatggcaacgttcaaaatgagacccatgtttgcagtgggccttctatttcgaagattgacttcgcgtgaagttttattacttactataggcttgtcactcgtcgcgtctgttgaattaccaaactcgctagaggagcttggagatgggttagcaatggggattatgatcttgaaactccttacagatttccaaagtcaccagttatgggcaacacttctttctttaacattcataaaaacaacattttcactccattacgcatggaaaactatggctatggtattaagcattgtgagtctctttccattatgcttgtcaacaactagccaaaagactacgtggctgccggtactattaggatcattaggatgtaaaccactcacaatgtttcttattgcggaaaacaaaatatgggggagacgaagctggcccttaaacgaaggcatcatggccgtcggtatagtaagtatactactgagtagcctgctcaaaaatgatgtgccactagctggtccactcatcgctgggggaatgttaatagcatgctatgtgatatcaggttctagcgcagatttaagtcttgaaaaagctgcggaggtttcatgggaggaagaagccgaacactctggggcttcacacaacatcttagtcgaagtacaagatgatgggaccatgaagataaaggacgaagagagagatgacactctgacaatcctgttaaaagcaactcttctagcggtatctggggtgtaccctctgtcaataccagcaacacttttcgtttggtatttctggcagaagaagaaacaacgctctggggtactttgggatacgccgtcaccaccggaagtagaaagggcagttcttgacgacggtatttaccgtatcatgcaaagaggattattaggacgaagtcaagtaggtgtaggcgtattccaagaaaatgtcttccacactatgtggcacgtaactaggggagcagtccttatgtatcaaggaaagcgattagaaccgtcttgggctagcgtcaagaaagatttaataagttatggcggcggttggagattgcagggatcttggaacacgggtgaagaagtccaagtaatagcagttgaacctggtaaaaaccccaaaaatgttcaaacagcacccgggacttttaagactcccgaaggagaagttggcgccatcgcgttagatttcaaaccaggtacatcaggttcaccaatagttaaccgcgaaggtaaaatagttggattgtacggaaatggggtggttacaacctcaggaacatatgtttcggctatagcgcaagcgaaggcctcacaagagggtccattaccagaaatagaagatgaagtgtttcgaaaacgcaatctaactataatggatctacacccaggaagcggcaaaaccagaaggtatcttccagcaattgtaagagaagctataaaaagaaaactaagaactttgattctggcacccaccagggttgtagcgagtgaaatggctgaagcattaaaaggcatgcctattaggtaccaaacgacggctgtaaaatcggaacacaccggaaaggagatagtcgacctaatgtgtcatgctactttcactatgagattattaagtcctgtccgtgtaccaaattataatatgattatcatggacgaagcccactttacagatcctagctccatagcagctagaggatacatatcgacgcgtgtaggtatgggggaagctgctgcaatattcatgactgccacaccaccaggttctgtagaagcatttccacagtcaaacgccgtaattcaagacgaagaacgtgatattcctgaaaggtcatggaactccggctatgaatggattacggattttcctggaaaaaccgtatggtttgtaccatcaataaaatccgggaacgatatcgccaattgcttacgtaagaatggaaaaagggttattcagctttcgagaaaaactttcgatacagagtatcagaaaaccaaaaacaatgattgggactatgtcgttactacggatataagcgaaatgggtgccaattttagggcagacagagtgatagatcctagaagatgtctcaaaccggtaattctaaaagacgggcctgagcgcgttatactagctggcccgatgccagtgacagtagcaagtgccgcacaaagacgcggcagaataggaaggaatcataataaggaaggagatcaatacatatatatgggacaaccactaaataacgatgaagaccacgcccactggactgaagcaaagatgttattagataacatcaatacacctgagggtatcattccagcgctattcgaacctgaaagagagaaaagcgctgccattgacggcgaatacagattaagaggtgaagcaagaaaaacatttgtagagttaatgcgccgaggagatttaccagtatggctgagttataaagtagcttctgagggtttccaatacagcgatagaagatggtgcttcgatggagaacgcaacaatcaagtgttagaagaaaacatggacgtagaaatctggacaaaagaaggagagcgaaagaaattaaggccacggtggctggacgctagaacctactcagacccattagccttacgcgaatttaaagagttcgcggcaggtagacgttctgtatcaggagacttaattttggaaataggcaaactaccacaacatctaactcagcgtgcccagaacgccctagacaacctagtcatgttacacaattcagaacaaggtgggagagcctatcgccacgcaatggaagaattacccgatacaatagaaacactgatgttactcgcgctaatagcggttctaacagggggcgtaacattatttttcttatcaggaagaggactaggcaaaacatcaatagggctattatgcgtaatggcctcatcagttttactttggatggcttctgttgaaccacattggatagccgcatcaatcattttagagttctttttaatggttttattaataccagaacccgaccgacagcgaaccccgcaggataatcaactcgcatatgtcgtaattgggttactctttatgatactgacagtggcggcaaatgaaatgggtttactagaaaccactaagaaagatctcggaattggacacgttgcagtgggtaatcaccaccacgctgccatgttagatgtagacctacatcccgctagtgcgtggaccttatatgctgtagcaactacaataattaccccaatgatgcgacacaccattgaaaacacaacagcgaatatttcattaacagcaatagcaaatcaggcggcaatactaatgggcctcgacaaagggtggccaattagcaaaatggatatcggggtccctcttctggcattaggttgttattctcaagtaaacccgttaacattaacagcagctgttcttatgttggtagcacactacgcaataataggaccgggacttcaagccaaggctacaagagaagctcaaaaacgaacggctgcaggtataatgaaaaatcctactgttgacggtatcgttgccatagacctagatccagtggtatatgatgcgaagtttgaaaagcaattaggtcagataatgcttctaatcttgtgcacatctcaaatcttacttatgaggaccacttgggcgctatgtgaaagcatcactttagccaccggtccattaaccacgctttgggaaggttcgccgggaaaattttggaacacgacaatagctgtttctatggcgaacatctttcgaggatcgtacttagccggagcagggctcgccttctcattaatgaagtctttaggaggtggacgaagaggtactggagcccagggtgaaacgctaggtgaaaaatggaaacgacaactcaatcaactaagcaaaagcgagttcaatacatataaaagaagtggaatcatggaggttgatagatcagaagcaaaggaagggctgaaaagaggtgaaacaactaagcacgcagtatcgaggggaacagccaaattaagatggtttgtagaaagaaatctggtaaaaccggaaggaaaggtcatagacttaggatgtgggcgaggaggatggagttactactgcgcaggccttaaaaaggttacagaagtgaaagggtatactaaagggggtcccgggcacgaggagccaattccaatggcaacatatggatggaatcttgtcaaactacatagtggaaaggacgtatttttcataccgcctgaaaaatgtgacacgctactgtgcgacataggagaatcgtcaccgaatcctactatcgaagaaggtaggaccttacgtgtgttaaaaatggttgaaccgtggttacgtggtaatcaattttgcataaaaatactaaatccatatatgccatctgtcgtcgagaccctagaacagatgcagcgaaaacacgggggaatgctagttagaaacccattatcacgaaatagtacacacgagatgtattgggtctcgtgtggaacgggtaatatagtctcggctgtaaacatgacaagtcggatgctcttgaataggttcaccatggctcacagaaaaccaacatacgaaagggatgtagatttgggagcaggcaccagacacgtagcagtagaaccggaggtcgccaacttagatatcattggccaaagaatcgaaaacataaaacacgaacacaaatctacatggcattatgacgaagacaatccttacaaaacttgggcttatcacggaagctatgaggttaaaccatcaggcagtgcctcttcaatggttaacggggtcgtaaaattgttaacaaaaccatgggatgtgattccgatggttacacaaatcgctatgacagacactacaccatttggtcaacagagggtattcaaggaaaaagtcgacacaagaacaccgaaagcaaaacgaggaactgcgcaaatcatggaagtaactgccaagtggctttggggatttctaagcagaaataaaaagcccagaatttgcaccagagaagagttcacccgaaaagttagatctaatgctgctataggagccgtgttcgtagatgaaaaccaatggaacagtgctaaagaagctgtagaagacgaaagattttgggaccttgtacatcgagaacgtgaactacacaaacaggggaagtgtgcaacatgtgtatacaatatgatgggtaaaagagagaagaaacttggtgaatttggcaaggccaagggatcgagagcgatatggtatatgtggttaggcgcaaggtttttagagttcgaagcgctagggtttatgaatgaagaccattggttttctagagaaaactctttatccggcgttgagggtgaagggctccataaactgggttatatcctgcgtgatatttcaaaaatcccaggaggaaatatgtacgcagacgatacagcggggtgggacactcgaataacagaggacgatttacaaaacgaagccagaattacagatataatggaaccagaacacgcattattagcaaaaagcattttcaaattaacatatcaaaataaagtggtacgagtccaaagacccgctaaaaatggtacggtaatggacgttatatcaagacgtgatcagagaggctcaggacaggtaggcacctacggcctaaacacctttactaacatggaggctcaactcataaggcagatggagtcagaaggaatttttagcccatcagaactggaaaccccgaacctcgctgaacgagtactggattggctggaaaaatatggtgtcgaacgactaaaacgcatggccatcagtggggacgactgcgtggttaaaccaatagatgaccgctttgccaccgcattaacagcactcaatgatatgggaaaagtaagaaaggacattccacaatgggagccgtcgaaaggatggaatgattggcaacaagttcccttttgtagtcatcattttcaccagttaattatgaaagatgggcgcgaaattgtcgtgccgtgcagaaaccaagatgaattagttggtcgggcgagggtatcgcaaggggcgggctggtcactacgtgaaacagcatgcctggggaagtcttatgctcaaatgtggcaattaatgtactttcataggagggatctgagactagcagctaatgcaatatgttcagctgttccggtggattggataccaacgtccagaacaacatggtccatccatgctcatcatcaatggatgacgacagaagatatgctatctgtttggaatagggtgtggatagaagaaaacccttggatggaggataaaacgcatatttcttcctggggcgatgttccttatctaggtaagcgggaagaccaatggtgtgggtccctaatagggttaacagcacgcgctacttgggcaactaacatccaggtagccatcaaccaagtgagaaggctaattggaaacgaaaattatttagattacatgacgtcaatgaaaagattcaaaaatgagtctgatcctgagggagcgttgtggtag

SEQ ID NO: 21176 - RNA, 9879 nt, synthetic construct
  misc_feature 1..9879: note = derived and/or modified CDS sequence (opt6) from DENV-1__GU131926__SS-prME
  source 1..9879: mol_type = other RNA
tcggtaaccatgttattaatgttaatgccaacagctcttgcctttcacctcaccacccgcggaggggaaccccatatgatcgtcagcaaacaagaacggggaaaatctttattattcaaaacaagtgccggagtaaatatgtgcactttaatcgcgatggatttaggagaattttgtgaagatacaatgacgtataaatgcccacgaatctccgaagcagaacccgatgacgtagattgttggtgtaatgcgactgatacttgggtaacctacggaacatgtagccaaaccggagaacatcggcgagacaaacgatcagttgctctcgccccacacgttggattagggcttgaaactagaacagaaacgtggatgagctcggaaggagcttggaaacaaatacaacgggtagaaacatgggcacttcgtcacccgggattcactgtaatagcgctttttctagcacatgcaattggaacatccatcacacaaaaaggcatcatttttattttactaatgctagtcaccccttctatggcaatgagatgcgtaggtattggtagtagagactttgtggaaggattgagcggggctacgtgggtggatgtcgtgctagaacacgggtcatgtgtaacaacaatggccaaagacaaaccaactttagatatcgaacttcttaaaacagaagtcacaaaccccgcagtactcaggaaactgtgcatcgaagcgaaaatatctaatactacgaccgattctaggtgtccgacacaaggagaggctactctcgttgaggaacaagatgcaaactttgtctgtagacgaacgttcgtagatagaggatgggggaacggttgtggactgtttggaaaaggcagcttaataacatgcgcaaaatttaaatgcgtaactaaactagaaggaaaaatagtacaatatgaaaatctgaaatactctgttattgtgacagtccatacaggggaccaacatcaagtcggaaatgaaagtactgaacacgggacaactgcaactataacgccacaagcacctagcacagaaatacaactaacggactacggggcattaactctcgactgttccccaagaacaggtctagattttaatgagatggttcttttaacgatgaaagagaaaagttggcttgtccataaacaatggttcttggatttacccttaccgtggacaagtggcgccagcacaagtcaagagacatggaatagacaagatctattagtaacattcaaaacagctcatgcgaagaaacaagaagtagtggtccttggctcgcaagaaggcgcgatgcatacagctttaactggtgccactgaaattcaaacatctggaaccacaacaatcttcgcgggacacctgaaatgcaggctcaaaatggacaaactaacacttaaaggtatgtcctatgtcatgtgtacagggagctttaaactagaaaaagaagtggcagaaacacagcacggaacagtactcgttcaaataaaatacgagggaacagacgctccatgtaaaatcccattcagcacacaagacgagaaaggggtgacccagaatggaagattaataacggcaaacccaatagttaccgacaaagaaaaaccggtaaacatagaagcagaacctccattcggagaatcatacattgtaataggcgccggagaaaaagcattaaaactgtcttggttcaagaaaggtagctcaatcggaaagatgttcgaagctaccgcaagaggggcacgacgaatggccatcctcggtgacactgcttgggattttgggtcaatcggtggggtatttacaagtgtcgggaaacttgtccaccaaatattcggtacagcatacggagtacttttctcaggggtcagttggacaatgaagattggtataggcgtacttctaacttggttaggtgtaaatagccgatcaacctctttatctatgacctgtatagctgttggccttgttactctctacttgggtgtaatggtacaagctgatagtggctgcgttatcaattggaaggggcgtgagttaaaatgcggatcgggcatttttgtgaccaatgaggtgcatacttggactgaacaatataaatttcaagctgattccccgaaaaggcttagtgcagcaattggaaaggcttgggaagaaggtgtatgtggtattcggagcgccactcggctagaaaacattatgtggaaacaaatcagtaacgagcttaatcacatactattagaaaatgatatgaaattcaccgtagtcgtcggagatgttgccggtatcttagcccagggcaagaaaatgatcagaccacagcccatggaatataagtacagctggaaatcttggggcaaagctaaaattataggagcagatgtccaaaatactacgtttattatagatggacctaatacacctgaatgtccagacgatcagagagcatggaatatttgggaagtagaggattacgggttcggcatattcaccacgaatatttggctcaaactaagagactcttacacacaagtttgcgatcacagactgatgtcagcagctattaaagactctaaagcagtacacgcagacatgggctactggatagaatcagaaaagaatgaaacgtggaaattagcccgggcatccttcattgaagtcaaaacgtgtatttggcctaaatctcacactctatggtcgaacggggttctggaaagcgagatgattattccaaaaatctatggaggtccaatttcccagcataattatagaccagggtatttcactcaaacagccgggccatggcacttagggaagttagaattggatttcgatctatgtgaaggtactacagtagttgtcgatgaacactgtggaaatcgtggtccatctttaagaactaccactgtaacaggtaaaatcatacacgaatggtgttgcagatcatgtacgctgccacccctgaggtttaaaggggaggatggatgctggtatggaatggaaatacgcccggtcaaagaaaaagaagaaaaccttgttaaaagtatggtatctgccggatcaggagaagttgatagcttcagcctagggcttttatgtatttcaattatgattgaggaagtaatgagatcaagatggtctcgaaaaatgttaatgaccggaactcttgctgtatttttccttttaattatgggacagcttacatggaatgacttaattagattgtgcataatggtaggagctaatgcttcagacagaatgggaatgggcatgacatatctagcgcttatggcaacgtttaaaatgcgcccaatgttcgctgtcggactattatttagaaggctaacctcaagagaagtactcctgttaacaatcgggctctctttggtagctagcgtcgaattgccaaactcactggaagaactcggagatggtctagctatggggattatgatcttaaaactattgacagattttcaatcgcatcagttatgggctacactgctatcgctcacattcattaagacgactttttcattacactacgcctggaaaaccatggcgatggttctatcaatcgtatcattgtttccactctgtctttcgaccacatcacagaaaactacgtggttaccggtattactcggctcgttaggctgtaaacctctaacaatgttcttgatagcagaaaacaaaatttggggtagaaaatcttggcctttaaacgagggaatcatggccgttggtatcgtatcgattttattatcttcactattaaagaatgatgtaccattagcggggccgttaatagcgggagggatgttaattgcatgttatgtaatcagcggatcttcagccgacttaagcctagaaaaagccgctgaagtaagttgggaagaagaggctgagcattcgggcgcgtcccacaatatacttgtagaagtacaagatgatgggaccatgaagattaaggatgaggaaagggacgacacactaacgatattattgaaagcgacattattggctgtaagcggagtgtatcctttatctatacctgcaacattatttgtttggtatttttggcaaaagaagaaacaacgaagcggtgttttatgggacacacccagtccccctgaagtagaaagagccgtactagatgatggtatatatagaattatgcaacgtggcctactaggtagatcacaagtaggagtgggcgtctttcaagaaaatgtttttcacacaatgtggcatgtaacaaggggagcagtgctgatgtatcagggcaaacgacttgaacccagctgggcatcggtcaaaaaggatcttatatcatatggaggcggatggagacttcagggcagttggaacactggggaagaagtacaggttattgcagtggaacccggaaagaaccccaaaaatgtacaaacggctcctgggacattcaagaccagtgagggggaggtaggagcaatagcacttgacttcaaacctgggacatcaggaagccccatagtcaatagagagggtaaaatagtcggattatacggtaatggggtagtaacgacttctggtacatacgttagtgcaattgcacaagcgaaggctagccaagaaggaccactaccagaaattgaagatgaagtatttagaaaaagaaacctgacaatcatggacttacatccgggtagtggtaaaactcgtaggtaccttcccgcaattgtaagagaagctattaagcggaaacttcgtactttaatcctagcgcccactagagttgtcgccagtgagatggctgaagcactgaaaggcatgccaataaggtaccagacaacagcggtcaaaagtgaacatacaggtaaagaaatagtagatctaatgtgtcacgcaacgttcactatgcggcttttatcaccagtaagggtaccgaattataacatgattataatggatgaggctcactttaccgatccttcaagtattgcggcaagaggatacatttcaacaagagttggtatgggtgaagccgctgctatatttatgacagcaacaccaccaggctcagctgaagcgtttccacaatcaaatgcggtaattcaagatgaggagagggacataccagaaagatcttggaacagcggatatgaatggattacagatttccccggtaaaacggtttggttcgtaccaagtataaaaagcgggaatgatatagcaaactgccttcgaaagaatggtaaaagagtcattcaattgagccgtaaaacgtttgatacagaatatcagaaaactaaaaataatgattgggattacgttgttacaacagacatctccgaaatgggagcaaatttccgagcggatcgagtcatagacccaagaagatgtctaaaaccggttatattaaaagacggacccgaaagagtaattctggctgggcctatgccggtcactgtggcctcggcagcccagagacgtgggaggattggaaggaaccataataaagaaggagaccaatatatttatatgggccaacctctaaataatgatgaagaccacgcacactggacggaggccaaaatgttattggacaatattaacacaccagaagggatcataccagcattgtttgaaccagagcgagagaaaagtgcagctattgacggtgagtaccgcctaagaggagaagccagaaaaacatttgtcgaactgatgcgacgcggagacttacccgtctggttgtcttacaaagttgccagcgaaggatttcaatactccgaccgtagatggtgttttgatggggaaagaaataaccaagtcctagaagagaacatggatgtagaaatatggacgaaggagggtgaaaggaagaaattgagaccaagatggcttgatgctcgaacttactcggacccactagcactgagagagtttaaagaatttgctgctggacgccgttctgtcagtggagatcttattctcgaaataggcaagctccctcaacatctaacgcagagagcgcaaaatgcattggataacttagtaatgttgcataatagtgaacagggaggacgggcctatagacatgcaatggaagaattacctgatactatagaaacccttatgttattagcacttatagctgttctaacaggaggggtaaccctgttctttctcagtggaagaggcttggggaaaacatctattgggctcttatgtgtaatggcgtcttccgtactgctatggatggcgtctgtagaaccacactggattgctgcgtcaatcattttggagttcttcttaatggtactgttaataccagaaccggaccgtcaaagaacaccccaggacaatcaacttgcatatgtggtcattggtttactttttatgattttaacagtcgcagcaaatgaaatgggattactggaaacaacgaagaaggatctaggaatcggccatgttgcagtagaaaaccaccatcatgctgctatgttggacgtcgatttgcatccagcgagtgcatggacattatatgctgtggctacaacgataataaccccaatgatgagacataccatagaaaacacaacagccaatataagtctcacggcaatagccaaccaagcagcaatattgatgggtttagacaaaggatggcctattagcaaaatggatattggagtccctctactagcactaggatgttattcacaggttaatcctttaacactaacggcagcagtgttaatgttagtagcgcactatgctataatcggtccaggattacaagccaaagcgactcgcgaagcacagaagcgaactgcagctggcattatgaagaatccgactgtagacggaatcgtggcaattgatctagatccagtcgtatacgacgctaagttcgagaagcaattaggccaaataatgctcttaatactctgcacttcgcaaatacttttaatgaggactacgtgggcgttgtgcgaatctatcacactggcaactggacctttgacaacattatgggaaggctcgcctggcaaattttggaatactacaattgcagtaagcatggctaatatattcagaggttcttatttggccggagccgggctagcctttagtctaatgaagtcgttgggaggaggacgacgaggaacaggagctcaaggagaaacgttaggtgaaaaatggaagagacaactcaaccagctcagcaaaagcgagtttaacacatataagagatcgggtataatggaagttgaccggtctgaagcaaaagaggggctaaaacgaggcgaaactacaaaacacgcagtctcaagaggtacagcaaagttgaggtggttcgttgaaaggaatctagtgaaacctgaaggcaaagtcattgacttagggtgcggaaggggtggatggagttactattgcgccgggctaaagaaagtcaccgaagttaaagggtacactaaaggaggaccaggacacgaagaacccatacctatggcgacgtacggatggaatttggttaagttgcattctggaaaagacgtcttctttgtaccaccagaaaaatgtgacactctcttgtgcgatattggggaatccagtcccaatccaaccatagaagaaggcagaacacttagagtcttaaaaatggtagagccatggttaaggggaaatcagttctgtataaagatcctaaatccttacatgccatccgtagtagaaacattagaacagatgcagcgaaaacacggaggtatgctagttcgaaatcctttgtcaagaaacagtacgcatgaaatgtactgggtatcatgtgggaccggaaacattgttagcgctgtaaatatgacctcgaggatgctactcaatagatttacaatggcgcatcgcaagcccacttacgaacgtgatgtagatttgggagcaggaaccaggcacgttgccgtcgaaccggaagttgccaatttagatattatcggacaacgtattgaaaacattaagcacgaacataaatctacatggcattatgatgaggataatccgtataagacctgggcataccacggttcctacgaagtaaaacctagtggatcggcaagttcaatggtaaatggtgttgtaaagctgctgaccaaaccctgggatgtcatacccatggtaactcaaatagccatgactgatacaactccgtttggacaacaaagagtctttaaagagaaagtagacacacgaacgccaaaggccaagaggggtacagcgcaaataatggaagtaactgctaaatggttatggggatttttaagtagaaacaaaaagcctagaatatgcacaagggaggaatttactcgaaaagttagaagcaacgcagccataggcgcagtattcgttgacgaaaatcagtggaactctgcaaaagaagcagtagaagatgaaagattttgggatttagtacatcgcgaaagggaattacataaacagggtaaatgtgctacatgtgtatataacatgatggggaaaagagagaagaagttaggagagttcgggaaagctaaaggcagtagagcaatatggtatatgtggctaggcgcaaggtttctcgagttcgaggctttgggctttatgaatgaagaccattggttcagtagggaaaactcactctctggagtagaaggagaaggcttacataaattaggatatatcctcagagacattagcaaaatatctggaggcaacatgtacgccgacgatacagcaggctgggacaccagaattacagaagatgatctccaaaatgaagcaaaaattacagacattatggagccagagcacgctttactggcaaaatcaatatttaaattgacatatcaaaataaagtagtacgagttcagagacctgcaaagaatgggactgttatggacgtaatcagtagaagagaccaacgaggatcaggacaggtagggacatatggtctaaatactttcaccaatatggaagcacagttaatccggcaaatggaatccgaaggcattttcagtccctctgaactcgaaactccaaatcttgcagagagagctttagattggctcgaaaagcatggagtggaacgtctaaaaagaatggccatatctggtgacgattgtgtagtgaaacctattgatgatagatttgcgacggccttaacagcactcaacgatatggggaaagtgcggaaggatatacctcaatgggaaccaagtaaagggtggaatgattggcaacaggtacccttctgctcccatcattttcatcaacttattatgaaagacggcagggagatagtcgtaccatgtaggaatcaagatgagcttgtcggcagagctagagtcagtcaaggcgcaggttggtccctcagggaaacagcatgtctaggaaaatcatatgcacagatgtggcaattaatgtatttccatagaagagacctcagactagcggctaacgcgatctgcagtgctgtgccggtagattgggtacctacgtctagaacgacctggagtatacacgctcaccaccaatggatgacgacggaggacatgctcagtgtgtggaatagggtctggattgaagaaaatccatggatggaagataaaacacatatatcatcttgggaagacgtaccgtacttgggaaaaagagaagatcaatggtgcggctcgttgataggcttgacagcaagagcaacatgggcaacgaatatacaggttgctattaatcaagtgcgaagacttatagggaatgaaaactacttggactatatgacatccatgaaaagatttaagaacgagagcgaccctgaaggggcattatggtag

SEQ ID NO: 21177 - RNA, 9879 nt, synthetic construct
  misc_feature 1..9879: note = derived and/or modified CDS sequence (opt6) from DENV-1__FJ639669__SS-prME
  source 1..9879: mol_type = other RNA
agtgtaactatgctacttatgcttatgccaactgcattagcatttcatctaacgactcggggtggggaaccacacatgatagtatctaaacaagaaagggggaaaagtcttctttttaaaacatcagctggagtaaatatgtgcactttgatagcgatggacttgggagaactttgtgaagacactatgacatataaatgtccaagaatcaccgaagcagaacctgatgatgtagattgctggtgtaacgctaccgacacatgggtgacttacggaacctgctcacaaactggtgaacacaggagggataaacgctctgttgcactagcaccacatgtagggttgggattggaaacgcgaacagaaacctggatgtcctcagaaggtgcatggaaacaaattcaacgtgtagaaacatgggccctaagacatccaggatttacagttatagccctatttttagcgcacgcaataggaacatctataacccaaaaagggataatattcattctactcatgctagtgaccccttcaatggctatgaggtgtgtaggcataggaagtcgcgattttgtagaagggctatctggagcaacgtgggtagatgtagttcttgaacatgggtcttgcgtgacaactatggcaaaagataaacctacattagatatagaattattaaaaaccgaggtaacaaacccggcagtgttaagaaaactatgcatagaggccaaaataagtaacaccacaacggacagcagatgcccaacccaaggagaggctacactcgtggaggaacaagatgccaactttgtatgtagacgtactttcgtagacaggggatggggaaacggttgtggtttatttggaaaaggatcccttataacatgtgcaaaatttaaatgcgtgactaaactcgaaggaaaaatagttcaatatgaaaatctcaaatattcagtcattgttactgtgcacactggagaccaacatcaagtcggaaacgaatcaacggaacacggaactactgcaactataacgccgcaagcacccacaaccgaaattcaactcacagattatggcgcactaacgttagactgctccccgagaacgggattagatttcaatgaaatggtactactaactatgaaagaaaaatcctggcttgtgcataaacaatggttcttggacctacccttaccatggacaagtggagcaagcacatcccaagaaacatggaaccgacaagatttgttggttacgttcaagactgcccacgccaagaaacaagaggttgtagtattaggatctcaagaaggcgccatgcatacagcgttaacaggcgccacggagatacaaacaagtggaacaacgacaatatttgctggtcatctgaaatgtaggctaaaaatggacaaattgacattaaaaggaatgagttatgtcatgtgtacaggatcattcaaattagaaaaggaagtagccgaaactcaacacggaacagttttagtacaaataaaatacgaaggtactgacgcaccttgtaagattccgttttcaacacaagacgaaaaaggcgtaacacaaaatggaagattaattactgcaaacccaattgtaacggacaaagagaaaccggttaacatagaagcggaaccgccatttggggaaagctatatagtaataggcgcgggggaaaaggcactaaaactaagctggtttaagaaaggatcatcaattggcaaaatgttcgaggcaaccgcaaggggtgcccggcgtatggcaattttgggagatacggcatgggacttcggatctatcggaggagtgttcacctcagtagggaaactggtacatcagatctttggaactgcctatggcgtcctctttagtggggtatcttggacaatgaaaatagggattggagtgcttttaacgtggttaggtcttaatagcaggagcacaagtttgagtatgacctgcatagcggtcggcttagtaacactatacttaggggtaatggttcaagccgacagtggctgcgtaatcaactggaagggcagagaactaaaatgtgggtcgggaatttttgtaacaaatgaggttcacacgtggacggaacagtacaagtttcaagccgattcacccaaaaggcttagcgcagcaattgggaaagcatgggaagagggagtttgtggtataagaagtgcaacaaggttagaaaatattatgtggaaacagatatccaatgaactaaaccacattttactggaaaacgacatgaaactcactgtcgttgtaggcgatgtcgctgggattttagcgcaaggcaagaaaatgattcgacctcaacccatggagtacaaatattcatggaagtcctggggtaaggctaaaatcataggtgcagatgttcaaaacacaacatttataatcgatggcccaaacactcctgagtgtccagatgatcaaagagcttggaacatttgggaagtggaagactatggatttggtatctttactactaacatttggttgaaattaagagattcatatactcaagtttgtgaccacagattaatgtcggctgcaataaaagattcaaaagcggtccatgcagatatgggctattggatagagtcagagaaaaatgagacctggaaactagctagggcgtcttttattgaggttaagacttgtatctggcctaaatcccatactctatggagcaatggggtcttagaatctgaaatgattatacccaaaatttacggcgggccaatttcgcaacataattacaggccaggatacttcacgcaaactgcgggaccctggcatctgggtaaattagagttagatttcgatctatgcgaaggaactactgttgtagttgatgaacattgtggtaatcgaggcccatcattgagaactactacagtaactggtaaaatcatacatgaatggtgttgcagatcatgtacattaccgccacttaggttccgtggggaagacggctgctggtatggaatggagattagacccgtcaaagagaaagaggaaaatctagttaagagtatggtatctgccggttcaggagaggtagactcgttctctcttgggttgctatgtatatcaatcatgatcgaggaagttatgaggtcaagatggagtcgtaaaatgcttatgactgggacgttggcagtgttctttctactcatcatgggacaattaacctggaatgatctgattcgattatgtattatggtgggggctaacgccagcgacaggatgggcatgggaacaacttacttggcattaatggctacctttaaaatgcgccccatgtttgcagtaggtctactatttagacgactcacaagtagagaggtgttattgctaacaattggcctcagcctggtagcctcagtggaattgcccaattctctagaagaacttggagacgggcttgcaatgggtataatgatcttaaagttgttaactgactttcaatcccaccaactatgggcgacactgctttccctaacgttcattaaaaccacattctcattacactacgcctggaaaacgatggcaatggtcttatccatagtatccctattccctttatgcttatcgactacatcccaaaagacaacttggttacccgtcctacttggaagtctaggatgtaagccattgaccatgttcttaatagctgagaataaaatttggggaagaaaatcctggccccttaatgaaggcatcatggcagtaggcattgtatctatacttctaagttcactgctcaaaaacgacgtaccgctagcaggaccactaatagctggcggaatgctaatcgcttgctatgtaatatctggttctagtgcggatctaagcctggaaaaagcagcggaagttagttgggaagaagaggccgaacattcaggagcctcacacaatatcctagttgaagttcaggatgacggaaccatgaaaataaaagatgaggaaagagatgacacattaactatactattgaaggccactctacttgcagtaagcggcgtttaccctttaagtatacctgccactctatttgtttggtacttttggcagaagaagaaacagagatcaggagtgttatgggatactccgtcacctccagaggtagaacgcgcagtgttagatgatggtatatatagaatcatgcaaagaggtctgttaggacgatcgcaagtcggagtaggagtgtttcaggagaatgtctttcatacaatgtggcatgttacacgaggcgcagtcctaatgtatcaaggaaagcgcttagaaccttcttgggcatccgtgaagaaagatctaataagctatggaggaggatggcggttacagggatcctggaacacaggtgaggaagttcaagttatcgctgttgagccaggcaaaaacccgaagaatgttcaaacagctcccggtacattcaaaacacccgaaggtgaagtaggagcgatcgccctggattttaaaccaggtacgagtggatcccctatagttaatagagaaggaaaaattgtcggactttatggtaatggggtggttacaacaagtgggacctacgtatcggcaattgcacaggcaaaagcgtcccaagaaggtccgctacctgaaatagaagacgaagtatttagaaaacggaacttgacaataatggacctccatccaggttcaggaaaaacacgacgctacttaccagctatagttcgagaagccattaaaagaaaactgcgtactttaatcttggcgccaacacgcgtcgtcgccagtgaaatggctgaggcattaaagggaatgcctataagataccaaacgactgcagttaaatccgaacataccggtaaagagatagttgatctaatgtgccacgctacttttaccatgcgtctattatctcccgtacgtgtacctaattataatatgataataatggatgaggcacattttacagaccccagttccattgcggcaaggggatacatttctacaagagtcgggatgggagaagcagctgcaatattcatgacagccacaccgccaggatcagttgaagcatttcctcagtccaacgcagtaatacaagacgaagaacgtgacatacctgaaaggtcatggaacagtggatatgagtggataactgactttcccggaaaaacagtatggttcgtaccgtcaataaagtcgggcaatgatattgcaaattgtctacgtaaaaatggaaaaagagtaattcagttaagtcgaaaaacttttgacacagagtaccagaaaactaaaaataacgactgggattacgtcgtcactacggatatatctgaaatgggtgctaactttcgggctgatagagtaatagacccgcgtcgctgtctgaaaccagtaatcctaaaagacggacctgaacgtgtaatcttagcaggaccaatgccagttactgtcgcttcagccgcacaacgaaggggcagaattggcagaaaccataacaaagaaggagatcaatatatatatatgggacagcctctaaacaacgatgaagaccacgctcactggacagaggcaaagatgttactcgataatattaatacaccggagggaataataccagctttgtttgaaccagaaagagaaaagagcgcagctatagatggagaatatcgcctaagaggtgaagcaagaaaaaccttcgtcgagcttatgcgacgtggcgacttacctgtatggctcagttataaggtagcgtcggaagggtttcaatatagtgatagaaggtggtgtttcgatggggagagaaacaatcaagtattagaagaaaatatggacgtagagatatggactaaagaaggcgaacgaaagaaacttagacctaggtggctagatgcaagaacctatagtgacccattggcattacgagaatttaaagagttcgcagctggaagaagaagtgtctcaggagacctcatactagaaattggaaaactacctcaacacttaactcagagagctcagaatgcacttgataatctcgtaatgcttcataatagtgaacaagggggccgagcatatcggcacgcgatggaggaactgccagatacgatagaaaccttgatgcttctcgctttaatagccgtccttacagggggcgtaaccttattcttcctatccggacgaggcctaggaaaaacatccatcggattgttatgtgttatggcatcgagcgtacttctctggatggcaagcgtagaaccacattggatcgcggcctcaatcatactggaatttttcttaatggtattattaatccctgaaccagacagacagcgaaccccacaggataaccaattagcatatgttgtgatagggttattattcatgatactaacggtggcagcgaacgaaatgggtctacttgaaaccacgaagaaagacttgggaatcggtcacgtcgctgttgaaaaccatcaccacgcggctatgttggatgtagaccttcacccggcatcagcgtggacactctatgcagtagccacaactattatcacaccaatgatgaggcatactatagaaaatacgaccgccaatatatcacttacagctatagctaatcaagcagctatacttatgggtttagataaaggatggccaataagcaaaatggacattggcgtacctttactcgcactaggttgttattcgcaagtaaatccccttacgttaactgccgctgttcttatgttagtagcgcactacgccattattggtccgggcctccaagctaaagctacaagagaagcacagaaacgcactgcagctggcataatgaaaaaccccactgtagacgggatcgttgcgatcgatttagacccggttgtgtacgatgcaaaattcgaaaaacaattagggcaaataatgcttttgatactatgtacaagtcaaatactactgatgcgtaccacttgggcattatgtgagagtataacattggcaacaggaccccttacgacattatgggaaggttcccctgggaaattttggaataccaccatcgcagtatcaatggcaaatatctttagaggaagctatctagctggcgctggattggcgttttcactaatgaagtcactaggagggggaaggagaggaactggtgcacaaggggaaacactgggcgaaaaatggaaacgacagctaaatcaactttcaaagtctgaatttaatacgtataaaagatcaggcataatggaagtagatcggtctgaagcaaaggaaggcttgaaaagaggagaaacaacaaaacatgcagtcagtcgaggaacagcaaaactacgatggtttgtagaacgcaaccttgtcaaaccggaagggaaagtaattgacttgggatgtggccgaggtggatggagctactattgcgctggcctaaagaaagtaacggaagttaaaggatatactaaaggtggtccgggtcacgaagaaccgataccgatggcaacgtatggctggaatctagtcaaacttcattctggtaaagatgtattcttcataccaccagaaaaatgcgacaccttactgtgtgatatcggtgaaagcagcccgaacccgacgatagaggaaggccgaactctaagagtcctaaaaatggtggaaccatggcttagaggaaatcaattttgcataaaaatattaaacccatatatgccttccgtggtggagaccctagaacaaatgcagcgcaaacatggcggtatgctggtgagaaacccattatcaaggaacagtacccatgagatgtattgggtttcatgcggaaccggtaacattgtaagtgcagtgaatatgacatccagaatgttattaaaccgattcactatggcacatagaaaaccaacttacgaaagggacgtcgatctaggtactggaactagacatgtggcagttgaaccagaggtagccaatttagacataatagggcaaagaatagagaacataaaacacgaacacaagtcaacatggcattacgatgaagataatccttataaaacatgggcctatcacgggtcatatgaagtaaaaccttcaggttcggcatcctcaatggttaacggtgtagtaaaattacttactaaaccatgggatgtgattcctatggtcacacagattgcaatgacagatacgacaccttttggtcagcaacgcgtgttcaaagagaaggttgatacaagaacaccaaaagccaaaagaggaactgcacagatcatggaggtcactgcgagatggctgtggggatttttaagtagaaataagaaacctcgtatttgcactagagaagagttcacacgaaaggtccggagtaatgcggctatcggagccgtattcgtggatgaaaaccaatggaactccgccaaagaagccgtagaagatgagagattttgggatctcgtccatcgagaacgggaacttcacaaacaaggaaaatgtgcaacttgcgtatataatatgatgggcaaaagagagaagaaacttggcgagttcggcaaagcaaaagggtcacgagccatctggtacatgtggttaggggcaagattcttggaatttgaagcacttggtttcatgaatgaagatcattggttcagcagggagaatagcctatcaggagttgaaggagaagggttacataaattaggatacatactcagggacatatctaaaattcccggtggaaatatgtacgcagacgacactgcgggatgggatacacgaataaccgaagatgatttacaaaatgaggcaaaaataactgatattatggaacctgaacatgcattactggcaaaagcaatattcaagctcacatatcaaaacaaggtcgtaagagtacaaagaccggctaagaacggaacagtaatggacgttataagtagacgagatcagagaggtagcggtcaggtagggacatatggactaaatacttttacaaacatggaggctcaactgatcaggcaaatggaaagcgaaggtatattttctccttcggagttagaaacacctaaccttgcagagcgagcactagattggttggaaaaatatggtgtcgagagactaaaaagaatggccatatctggtgacgattgcgtagtcaagccaatagatgatcgtttcgcaactgctctcactgcgctcaacgacatgggtaaagttcggaaagacataccgcaatgggagccaagcaaaggatggaatgattggcaacaggttcctttttgttcacaccactttcaccagttaataatgaaagacgggagggaaatagtggtgccgtgtcggaatcaggatgaattagtgggcagggcaagagtctcacagggagccggctggagtctccgagaaacagcgtgtctcggcaaatcttatgctcagatgtggcaattaatgtactttcatcggagagacctacgattagcggcgaacgcgatatgctctgcagtccccgttgactgggtccccacttcacgaacaacatggtcaatacatgcacatcaccaatggatgacaactgaagacatgctctccgtttggaatagagtctggattgaggaaaatccttggatggaagataagacacacatatcaagctgggaagatgtgccttacctaggaaaaagagaagaccaatggtgcggatcgttgataggacttaccgccagagcgacatgggctacgaatattcaggtcgctattaatcaagtacgtcgtcttataggaaatgaaaactacctagattacatgacctcaatgaaaaggtttaagaatgagtcggatcctgagggtgctctttggtaa

SEQ ID NO: 21178 - RNA, 9882 nt, synthetic construct
  misc_feature 1..9882: note = derived and/or modified CDS sequence (opt6) from DENV-1__FJ639670__SS-prME
  source 1..9882: mol_type = other RNA
tccgttacgatgcttttaatgttgatgccaacagcgttagcattccatctaactacaaggggtggggaaccgcatatgatagtgtctaaacaagaaagaggtaaatccctattatttaaaacgtcggcgggtgttaatatgtgcacactaatagcaatggatctaggtgaactatgcgaagatactatgacgtacaaatgtccccgtattacagaagcagaacccgacgatgttgattgctggtgcaacgcaacagatacatgggtgacatacggaacatgttcacaaacgggtgaacatcggagggataaaagatcggtagctttagcaccccatgtagggctcggattagaaacacgaacagaaacatggatgagcagtgaaggagcgtggaaacaaatacaaagagtggaaacatgggcgctacgccatcctgggtttacagtaattgcgttgttcttggcccatgcaataggaacttcgatcacacaaaaagggatcattttcatattactgatgttagtaacaccttccatggcgatgcgatgtgtaggtattggatctagggactttgttgaaggtctatcaggtgcaacttgggttgacgtagtattagagcacggaagttgtgtgactacaatggccaaagataaaccaacgttggatattgagctattaaaaacagaagttacaaatccagctgtgttaagaaaactctgtatagaagcaaaaatatcgaatactactacggattcccgatgcccaactcaaggagaagcgactctagtagaagaacaagatgcgaacttcgtatgccggagaacatttgtagataggggatggggaaatggttgtggtttgtttggtaaaggttctttaattacatgcgcaaagttcaaatgtgttacgaaacttgaaggaaaaatagtacaatacgaaaacttaaaatattcagtaatagtgactgtacatacaggagatcagcatcaggtcggtaatgaaagtacagagcacggaacaactgctacgatcacaccgcaagctccaactacagaaatacaactaacagactatggcgccctgacacttgattgcagcccccgaacgggcctcgattttaacgaaatggtcctgctaactatgaaagaaaaatcctggttagttcacaaacaatggtttcttgacctacccttgccatggacgagtggcgcaagcacaagtcaagaaacatggaacagacaagacctattagtgacgtttaagactgctcatgccaagaaacaagaagtcgtcgtcctggggtcacaagaaggcgctatgcatactgcgttaactggagctactgaaatacaaacctcaggcacaactacgatatttgctggacatcttaaatgtcgattaaaaatggacaaactaactctaaagggcatgtcctatgtaatgtgtacgggaagttttaaactggagaaagaggtagcggaaactcaacacggtacagttctcgtgcaaatcaaatatgaaggaactgacgcaccctgcaaaataccctttagcacccaagatgaaaaaggcgttacccaaaatggaagattgataacagccaatcccattgtcaccgataaggaaaaaccagtaaatattgaggcagaaccacccttcggtgaatcatacatagttataggagctggagaaaaggctttaaaattgtcatggttcaagaaaggcagttcaataggaaaaatgttcgaagccacagcaagaggtgcacgcagaatggccatactaggggacaccgcgtgggattttggaagcataggaggggtatttacgagcgtcggaaaactggttcaccagatcttcggaaccgcatatggagtcctatttagcggtgtcagttggaccatgaaaatcggcataggtgttttactaacgtggttggggctcaattcgagaagtacctcactatctatgacgtgcatcgctgttggcttagtcacgctctatctaggtgttatggtccaggcagatagcggctgtgttatcaattggaaaggacgcgaacttaaatgtgggtcaggaatattcgttacaaatgaagtccatacctggacagaacaatataagtttcaagctgattcacctaaaagactatcagcggccataggaaaggcatgggaagaaggagtgtgcggcattcgctcagccaccaggctcgaaaatattatgtggaagcaaatctctaatgaattgaatcacattttacttgaaaatgatatgaagctaaccgtagttgtaggtgatgttgcaggaatattggcacaaggcaagaaaatgatcagacctcagccaatggaatataaatactcatggaagagttggggaaaagctaagattattggtgccgatgcgcagaatactacattcataatagatggacccaatacaccagagtgcccggatgatcaacgagcgtggaacatttgggaagtagaggattacggctttggaatatttaccactaatatatggcttaaacttagggacagttacacacaagtatgcgaccaccggctaatgagtgccgctattaaggattcaaaagcagtacacgcagatatgggatactggattgaaagtgagaaaaatgaaacttggaaactagctagggcgtctttcatagaagtgaaaacctgtatttggcctaaatcccatacattatggtcaaatggtgtactcgagtcagaaatgatcatacctaaaatatacgggggacccatctcgcagcacaactatagaccaggttactttactcaaacagccggcccgtggcatcttggcaaactagagttagatttcgatttatgtgaaggaacaactgttgttgtcgatgaacactgtggaaaccgcggcccaagcctccgaacgacgaccgtaactgggaaaataatacacgaatggtgctgtaggagttgtacattacctccactaaggttcaggggtgaggatggatgctggtatgggatggaaatacggccagtgaaagaaaaagaagaaaacttagtgaaaagtatggtcagcgcgggttcgggcgaggtagattcttttagtctgggacttttatgcatatctatcatgattgaggaagtaatgcgttcaaggtggtctcgcaaaatgctaatgactgggactttggctgtattcttcctactaattatggggcaattaacatggaatgacctaataaggttatgtataatggtaggtgccaatgcgagtgacaggatgggaatgggaaccacatacctggcacttatggccacattcaaaatgcggccaatgtttgctgttggactattatttagaagactaacaagtcgtgaagtactacttttaactataggtctcagcttggtagcaagtgttgagctaccaaactcattggaagaactaggggatggattagcaatgggtattatgatactaaagttattaacagattttcagtctcaccagttgtgggccacattgctaagtttaacttttataaagacgactttttctctacattacgcatggaaaacaatggctatggtcttaagtattgtgagcttatttccactatgtttgtctacaacttctcagaaaacaacatggcttcccgtgcttcttggctcattaggatgcaaacccttaactatgtttttgattgctgaaaataaaatctggggaaggaaatcgtggccattaaatgaaggaattatggcggtcggcatagttagcatactattaagctctttactcaaaaatgacgtaccattagccggtcctttaatagcaggaggaatgttaattgcctgctatgttataagtggtagttcagctgatttaagtttagaaaaagccgccgaggtgtcctgggaagaggaagcagaacacagtggcgcttcacacaatatattagtggaggtacaagatgatggaacaatgaaaataaaagacgaagaacgtgacgacacattaaccatactgctaaaggcaactttacttgccgtatccggagtttatccgcttagcatcccggctacacttttcgtatggtacttctggcagaaaaagaaacaaaggtctggtgttttgtgggatactccgtcaccgccagaagtagaacgggccgtgttagatgatggtatttacagaataatgcaacgcggtctactaggcagatcacaagttggagttggtgtgtttcaagaaaatgtcttccatacgatgtggcacgtaacaagaggagctgtgttaatgtaccaaggcaaacgactagaaccgtcatgggcaagcgtaaagaaagatttaatatcttatggcggaggctggcgtcttcaaggctcatggaatacaggagaagaagtacaggtcatagccgtagaaccaggtaaaaatcctaaaaatgtgcaaactgcaccaggaacttttaaaacaccagaaggagaagttggtgctatagctttagattttaaaccaggcacgagcggatcgcccatagtgaatcgcgaaggaaaaatagttggactatatggcaatggagtagtaacaacttcgggtacttatgtatcagcaatagctcaagctaaagcaagccaagaaggaccattaccggaaatagaagatgaagtctttagaaagcgtaaccttacaattatggacctccatccgggttcaggaaagacacgaagatatctccctgcgatagtccgagaggccatcaaaaggaagttaagaacacttattttggctcccacacgcgtagttgcatcagagatggcagaagcgttaaaaggaatgccaattagataccaaaccacagctgtgaaatcagaacatacgggtaaggagattgttgatctcatgtgtcacgcaacgtttacaatgagactccttagtcctgttcgcgtccctaattacaacatgataataatggacgaggcacattttacggatcctagttcaatagcagccaggggttatataagtacacgggtcggaatgggggaggcagctgcaatcttcatgactgctactccccctggatccgtggaggcattccctcaaagtaatgctgttattcaggacgaggagagggatataccagaacgctcatggaatagtggatacgagtggatcacagattttccgggtaagacagtatggttcgtaccatccatcaaatcaggcaatgacatagctaattgcttaagaaagaatggaaaaagagtaatacaattaagccgaaaaacattcgataccgaatatcagaaaaccaaaaataatgactgggattatgtagtaacaaccgatatttctgagatgggtgcaaattttagggcagatagagttattgacccccgtagatgtttaaaaccagtaatactcaaagatggaccagaacgagtaatattagcagggccgatgccagttacagtagcctcagctgcacaacgacgaggtagaattgggagaaaccataataaagagggggaccaatacatatatatgggacaacctctcaataatgatgaagatcatgcgcactggacggaagccaaaatgttactagataatataaacacacccgagggaataataccagctctctttgaaccagaaagagagaaatcagccgctattgacggtgaatatagacttcgtggagaggctagaaagacattcgtagaattaatgcgccggggtgatttaccagtctggctcagctataaggtagcgtctgaaggttttcaatacagcgacagaagatggtgttttgatggtgaaagaaacaatcaagtattagaagagaacatggatgtggaaatatggaccaaagaaggtgtatctagaaagaacttaagacctagatggctcgacgcacgtacatattcggacccgttggcacttcgcgaatttaaagaatttgcggcagggagaagaagtgtgagtggggatcttatactcgaaataggaaagctaccgcaacatttaacacagagagctcagaacgctctagataatctagtcatgttacataatagcgaacaaggtgggcgagcttatcgacacgccatggaagaactacctgacaccatagagacacttatgctgttagctctcatagctgtcctaacgggtggagtcacccttttcttcctctcagggcgagggctgggaaaaacttctatagggttattatgcgtgatggcatcatcggtcttactatggatagcatcagtcgagccgcattggatagctgcatctataatcctggagttctttcttatggtactactgatccccgaaccggatcgtcaacgtacaccacaagacaaccagttagcttatgtagttataggtcttctgttcatgatactaactgtggcagccaatgagatgggactgttggaaacaaccaagaaagacctaggcatcggtcatgtggccgttgagaatcaccaccatgctgcaatgttagacgtagacttacacccagcttctgcgtggacactatatgcagtcgcaactacgattatcacaccaatgatgcgccacacaattgaaaatacaactgcgaatatttcccttacagctatcgcaaatcaagctgcgatattgatgggacttgacaaaggatggcccatatccaagatggacattggcgtccctttattagcactcggatgttatagccaggtaaatcccttaactttgaccgctgcagtactaatgttagtagcacattatgcgattatcggaccgggattgcaagctaaagctacccgcgaggcacagaaaaggacagcagccggtataatgaaaaatccaacagtcgatggtatagtagctattgacttggaccctgttgtatacgatgcaaaattcgaaaagcaattaggacaaataatgctccttatactttgcacatcccagatactattgatgagaacaacatgggcattatgtgaatcaatcacactagcgacagggcctctaacaactctatgggagggctcgccaggaaagttttggaatactaccatagctgtaagcatggctaacatcttccgggggtcttacttagccggtgctggactggcatttagtttaatgaagtcattagggggtggacggagaggaactggagcccaaggcgagacgctaggtgaaaaatggaaacgacaattaaatcaattgtcaaagtctgagtttaacacctataaaagaagtgggataatggaggtagacagatccgaagcaaaggaaggactcaaacgtggggaaacaacaaaacatgcggtttcacggggaaccgccaaacttcgatggttcgttgaacggaacctggtaaaaccagaggggaaagtaatagacttgggctgtgggcgaggtggttggtcgtattattgtgcaggcttaaagaaagtgacagaggtcaaaggatatacgaaaggcggtcccggacacgaggaaccaatacctatggcgacatatgggtggaatttagttaaattacattccggtaaagatgtatttttcataccgcctgagaaatgtgacactttactttgcgatattggcgaatcaagtagtaaccccacgatcgaagaagggagaacgcttagggtcttgaaaatggtcgaaccatggttacgaggaaaccaattttgtatcaaaatccttaacccatacatgccatcggtagttgagactctagagcaaatgcaaagaaaacatggagggatgctagtgaggaatccgctaagtagaaattccacacacgaaatgtactgggtatcctgcgggacaggcaacatagtaagtgccgtaaacatgacatcacgcatgcttctgaataggtttactatggcgcatcgaaaaccaacctatgagagggatgtcgatttgggaaccggtacgagacatgtggcggttgaaccagaagtagccaatttagatataatcggccaacgaatagagaacattaaacacgaacataaaagtacgtggcactatgatgaagacaatccttataaaacatgggcataccacggttcatatgaagtcaaaccatcaggaagcgcctcgtctatggttaatggcgtcgttaaattattaactaagccctgggacgtaataccaatggttacgcaaatagcaatgactgacaccacacctttcggacaacaacgcgtattcaaagaaaaagtagacacaagaaccccaaaagccaaaagaggtactgctcaaattatggaagtaactgctagatggttatggggatttttatcacggaataagaaacctagaatttgcacgcgagaagagttcacaagaaaagtacggtcaaacgctgcaattggagctgtatttgtggatgaaaatcaatggaactcggcaaaagaagcggttgaagatgaacgcttttgggaccttgtacatcgcgaaagagaactacataaacaaggaaaatgcgctacgtgcgtatataacatgatgggaaaaagagagaagaaattaggggaatttggtaaagcaaaaggctccagagcaatatggtatatgtggttgggtgctaggttcctcgaatttgaggcacttgggttcatgaatgaagatcattggttctcacgcgaaaatagtttatctggagttgaaggagaaggtctgcataagctcggatatattttaagggatataagcaaaatacctggcggcaacatgtacgccgacgataccgctggttgggatacacggatcacggaagacgacttacaaaacgaggctaaaattacagatattatggaaccagaacacgctttactcgccaaagccatatttaaattaacttatcaaaataaagtagtacgagtacagcgacccgctaagaatggtaccgtaatggacgtgattagtaggagagatcagagaggatctggacaagtgggcacgtacggtcttaacacgttcacaaacatggaagcccagttaataagacaaatggagtcagaaggcatattctctccgagtgaattagaaacaccgaacctcgcggaacgagcattagattggttagaaaaatacggtgtcgaaaggttaaaaagaatggcaataagtggtgatgactgtgtcgtaaaaccgatagacgatcgtttcgctactgcgttgaccgcactaaacgatatggggaaagtacgtaaagatataccccagtgggaaccctcaaaaggttggaatgactggcaacaggtgccattctgtagtcaccatttccaccaactaataatgaaagatggcagagagatcgtggtgccgtgtcggaaccaggatgaattagttgggagagcacgggtatctcagggcgcgggatggtccttgagagaaacagcctgtctggggaaaagctacgcacaaatgtggcaattaatgtatttccatcgtcgcgatttgagactagctgcgaacgcaatatgcagtgcagttccagttgattgggtaccaacgtcgcgaacgacatggtccattcatgcccatcaccagtggatgacgactgaagacatgttaagtgtttggaatagggtgtggattgaggagaatccctggatggaagacaaaactcacatcagcagttgggaggatgtaccttacttaggcaaaagagaggatcaatggtgcgggagcctgatagggttaaccgcaagggccacttgggcaaccaacatacaagtcgctataaatcaggttcgacgacttataggtaatgaaaactaccttgattacatgacatcgatgaaacggttcaaaaacgaaagtgatcctgagggcgccttgtggtag

SEQ ID NO: 21179 - RNA, 9879 nt, synthetic construct
  misc_feature 1..9879: note = derived and/or modified CDS sequence (opt6) from DENV-1__FJ639671__SS-prME
  source 1..9879: mol_type = other RNA
tcagtgacgatgctcttaatgcttatgcctacagcacttgcttttcatttaacaacaagaggaggagaacctcatatgatagtctctaaacaagagcgtggtaaaagtctccttttcaaaacatctgcaggagttaatatgtgtacacttattgctatggaccttggagaattatgcgaagatacgttaacatataaatgtccaaggattactgaagttgaaccggacgatgtagactgctggtgtaacacgaccgacacgtgggtaacatatggtacttgttcacaaactggagaacatagaagagataaaaggagcgttgcacttgcgccccatgttggactcggcctagagacacgcgctgaaacatggatgagctccgaaggagcatggaaacaaatacagcgtgtggaaacgtgggcacttaggcatcctggttttaccgtcattgcactatttttagcacatgcaatcggcacctcgatcactcaaaaaggaattatttttatattactcatgttggtcacgccgagtatggctatgagatgcgttgggattggtagtcgagactttgtagaaggactatcaggggctacttgggtagatgtagtattagaacacggatcttgcgtaacaactatggcaaaagataaaccaacattagacatagagttgctcaaaaccgaggtaacaaacccagcggttttaagaaaactgtgcatcgaagcgaagataagcaatacaacaactgactctcggtgtcccacacaaggagaggcgacattagtcgaagaacaagatgcgaattttgtatgccgtagaacattcgtggatcgaggctggggtaacggttgtggactatttggaaagggttctctcatcacttgtgcaaaatttaaatgtgttactaaattggaaggcaagatcgttcaatatgaaaatttaaaatactcagtaatagttactgtacatacaggtgaccaacatcaagtgggcaatgaatcaaccgaacacggtacgactgcaaccataactccacaagcaccaacctccgaaatacaattaacggattacggagccttaactttagattgcagtccgaggacaggattagactttaatgaaatggtgcttctaacaatgaaggaaaagtcctggttagtacacaagcaatggttcttagatctaccacttccttggacaagtggagctagcaccagccaagagacttggaaccggcaagatttacttgtgacatttaaaacagcgcatgctaaaaagcaggaagtggttgttctcggtagtcaagagggtgccatgcatacggctttaacaggagctacagaaatccagacctcagggacaacaactatatttgcaggccacctaaaatgtaggttaaaaatggataaactcactctcaagggaatgtcgtatgtcatgtgcacaggttcttttaagctagaaaaggaggtagccgaaacccagcacggaacggtcctggttcagatcaaatacgaaggtacagatgcaccatgtaaaatcccattttccacccaagacggtaagggtgtaacacaaaacggccgattgatcacagcgaaccctatagtaactgataaggagaaaccggtaaacatcgaagccgaacctccatttggcgaatcatatatagttattggagcgggagaaaaagcgttaaaactgagttggttcaagaaaggatctagtataggcaaaatgtttgaagcaacagctcgcggtgcacgtagaatggcaatattgggagacacagcgtgggattttggcagcgtaggcggagtgtttacatcggttggaaaattggtccatcaaatcttcggcacagcttatggagtactattttctggcgtatcttggacaatgaaaatagggatcggtgtattattaacctggctgggacttaacagtcgaagcaccagtttatcaatgacgtgcattgcagttgggctagtaacgctctatctaggagtaatggttcaggctgactccggatgtgttataaattggaagggccgtgaactaaagtgcggatctgggatatttgttacgaatgaagtacatacgtggacggaacaatataaatttcaagcagattctccaaagagattatcagcagctattggcaaagcctgggaagaaggagtatgtggcattagatcggcaacgaggcttgaaaatgtcatgtggagacagatttccaatgagttgaatcacatcttgctggaaaatgatatgaaatttactgttgtagtcggtgatgtcgtaggcatcttggcgcaaggcaagaaaatgatacgaccacaacccatggagcataaatactcatggaaatcttggggaaaagcaaaaataataggcgctgatgtacaaaacacgacttttatcatagatggtcccaacacaagtgagtgcccagatgaccagagagcatggaatatttgggaggtagaagattacggctttggtatctttacgactaatatatggctgaaactaagagactcatatactcaagtatgcgatcacagattaatgtccgcggcaattaaggactcaagagcagtacacgctgacatgggatactggattgaatcagagaaaaatgaaacatggaaactagccagagcctccttcattgaagtaaaaacgtgcatatggccaaagtcccacacgttatggtcaaacggcgttctcgagtccgaaatgataataccaaaaatatacggagggccaatcagtcaacataactatagacccggttatttcacacaaacagctggtccatggcaccttggaaaactggaacttgattttgatttatgcgaagggaccacagttgttgttgacgaacattgtggcaatcgaggccctagtttacgtacgacaaccgttacgggaaaaattatacacgaatggtgttgcaggagctgtacattacctccgctaagatttaaaggggaagatggttgttggtatgggatggagattagacctgtaaaggaaaaggaagaaaacctagtcaaatccatggttagcgcaggctctggtgaggtcgatagttttagtttagggctcctttgcatctcgataatgatagaagaagtaatgaggtcaaggtggagtcgaaagatgttaatgacaggaacattagcggtattctttctactcataatgggtcaacttacctggaatgacctaatccgactttgtatcatggttggcgcaaacgcatctgacagaatgggtatgggaaccacttatctcgcgttaatggcgacatttaaaatgcgtccgatgtttgctgtgggcctactattccgtcgtttaacaagccgcgaagtacttttattaactataggtttgagccttgttgcatcagtggaactcccaaattcgcttgaagaacttggagatggcttagcaatgggaataatgattcttaaactgttaacggacttccaatcctaccaactatgggcaactctactaagcctaacttttataaaaacgacattttcgttgcactacgcatggaaaacaatggcaatggttctcagcatcgtttcgctattgccactctgtttatcaactacatctcagaaaactacatggttaccggtcctcctaggtagcttgggctgcaaacctctaacaatgttccttatagcggaaaataagatttggggacgcaagtcttggccgctcaatgaagggatcatggctgtaggcattgtatctatacttttaagctcgcttctaaagaatgatgtccccttagctgggccactaatcgcaggaggaatgttaatcgcctgttatgtaatatcgggatcttcggcagacctgtctttagaaaaagcagcagaagtttcttgggaagaagaagccgaacactcaggcgcgtctcacaatattctcgttgaagttcaagatgatggtacaatgaaaattaaagatgaagaaagggacgacacacttaccattctattaaaagccacattgctcgccgtaagtggagtataccccctgagcattccagctacactatttgtttggtatttctggcagaaaaagaaacaaagaagcggcgtactatgggataccccgtccccacctgaggtagagagagcggtactcgacgacggtatatacagaattatgcagcgtggactattaggaagatctcaggtgggagtaggcgtctttcaagagaacgtatttcatacaatgtggcatgtaaccagaggtgcggtactaatgtatcaagggaaaagactcgagccgtcttgggcgagcgtaaagaaagacctgattagctatggcgggggttggaggcttcaaggaagctggaacacgggtgaagaagtgcaagtgatagctgtcgaaccgggtaaaaacccgaaaaacgtccagacagccccaggcacatttaaaacacctgagggagaagttggcgcaatcgcactagacttcaaacctggaacctcaggctctcctattgtaaatagagaaggaaaaatcgttggtctctatggtaatggagtggtaacgacatcagggacttatgttagcgctatagcacaagctaaagcatctcaagagggacctttaccagaaattgaggacgaggtttttagaaaaaggaacttaactataatggaccttcacccggggtccggtaaaacgcgacgatatctaccagctatagtcagggaagcgataaaaagaaaattaagaacattaatcttagcacctactagggtggttgcatccgagatggcagaagcattaaagggaatgcccataagatatcaaactacagccgttaaatcagaacacacgggtcgagaaattgtcgacttaatgtgccatgccaccttcactatgcgactgcttagcccagtccgtgtccctaactataatatgataataatggatgaagctcattttacagatccttcatcgatagctgcaagaggttatatttctacacgcgttggaatgggtgaagcggcagcaattttcatgaccgcgacgccgcctggatcagttgaagcatttccgcaatctaatgctgtcatccaagacgaagaaagggacatcccggaacgatcatggaactcgggttacgagtggataacagacttccccggtaaaactgtttggtttgtgcctagtattaaatcaggaaacgatatagcgaactgcctgaggaaaaatggaaaaagggtaattcaactttcgcgaaaaacatttgatacggagtaccaaaagacaaagaacaacgattgggattatgtagttacgacagatatttccgaaatgggagctaactttagggcagaccgggtaatagatcctagaagatgtttgaaacctgtcattttaaaagatggcccagaaagagtaattctagccggtccaatgccggtcaccgtggcatctgccgcgcaacgaagaggacggataggacgcaaccataacaaagaaggagaccaatatatatatatgggtcagcctttaaacaacgatgaagatcacgctcattggactgaagctaagatgttactagacaatattaatactcccgaaggcattataccggcattatttgaaccggaaagagagaaaagcgcggctatagatggagagtatcgactaagaggggaagcccgaaaaacttttgtagaactcatgagaagaggtgatctgcctgtgtggctctcttataaagtagcgagtgagggctttcaatactctgatagacgatggtgttttgatggagagcgaaacaaccaagttttagaagagaacatggacgttgaaatatggacaaaggaaggcgaacgaaagaaattacgcccaagatggctagatgctagaacatattcagatcccttagccttgcgagaatttaaggaatttgcggcaggacgaagaagcgtctccggtgatttaattcttgagattggtaaattgcctcaacatctcacacaacgagctcaaaacgctttagacaatttagttatgttgcataactcagaacaaggaggaagggcttatcgacacgcaatggaagagttaccggagacaatagaaacgttgatgttgttagcgttaattgcggtacttacaggtggcgtgaccctattctttttatcaggtcgtggtctagggaaaacttcgattggtctattgtgcgtaatggcctcatcggcactactatggatggcaagcgttgaaccgcattggatagcagctagcataatcctagagttctttttgatggtactattgataccagaaccagatcgacaacggacacctcaagataatcaattggcgtatgtcgtgataggattattatttatgatcctaactgtagcagctaatgaaatgggactactagaaacaaccaagaaagatcttggtattggacatgttgccgttgaaaaccatcatcatgcaactatgctagatgtggacctacatcctgcctctgcatggaccttgtacgcagttgcaaccactattataaccccgatgatgagacacaccattgaaaatacgacggcaaatattagtttgacagcgatcgccaaccaagccgcaatcctaatggggctagataaaggttggcccatcagtaaaatggatatcggggtaccattacttgctttgggatgttattcacaggtaaatcctctcacgcttaccgcggccgtactaatgcttgttgcccactatgcgattataggaccaggcctacaagccaaagcaacacgagaagcacagaagaggacagctgcaggaataatgaaaaatcctacagtggatggtatagtagcaatcgatcttgacccagttgtatatgatgccaaattcgaaaaacaattaggccagataatgctactcatattatgcacatcacaaatccttctaatgaggacaacctgggccttgtgtgaatcgataacattagcgaccggaccgctaacgacactatgggaaggctcacccggtaaattctggaacacaacaattgccgtcagcatggcaaatatctttcgtggttcatatttagctggagcaggactcgcgttctcattaatgaaatctttagggggcgggcgaaggggtacgggagctcaaggtgaaaccctaggcgaaaaatggaagcgacaactcaatcaattatctaaatcagagttcaatacttacaaaagaagcggaattatggaagtagaccgttcagaagctaaagagggcttaagaagaggagagacaacaaaacacgccgtaagccgcggaacggcaaagttaaggtggtttgttgaaagaaatctggtgaaaccagaggggaaagtaattgatttaggttgtggacgtgggggatggtcatattactgcgcggggttgaagaaagtaaccgaagtgaaaggatataccaaagggggtccaggtcatgaagaacccatccccatggcgacatacggttggaacttagttaaattacactcaggaaaagatgtattctttattccacccgaaaaatgcgatacccttttatgcgacataggtgaaagcagccccaacccgacaatcgaagaaggcaggacgctgcgagtactaaaaatggtagaaccatggctacgtggtaatcaattttgcattaaaattctaaatccatatatgccatcagttgttgagacgctcgaacagatgcaacgtaaacatggagggatgctagtacgaaatccattgtctcgaaacagtacgcatgagatgtattgggtaagttgcgggacaggtaatatagtgagcgcagtaaatatgacgagtagaatgttacttaaccgctttacaatggcacatcgtaaacccacatatgagagagacgttgacctaggcgcaggaactaggcatgtcgcagtagaacctgaagtggcaaacttagatatcattggccagagaatagaaaacatcaagcatgagcacaaatcgacatggcattatgacgaagacaacccatacaaaacctgggcatatcatggctcctatgaagttaaaccatcaggaagtgcgtcgagtatggtaaatggtgtagtaaaattactaaccaagccctgggacgtcattccaatggtaactcagatagccatgactgatactaccccgttcgggcagcagcgagtatttaaagaaaaggtggacacacgaaccccaaaagcgaaacgcgggacagcacaaataatggaagtcacagcacggtggctatggggtttcttatcgagaaataagaaacctagaatttgcacgagagaagaatttacacgtaaagtaagaagtaacgcggcaattggagcagtattcgtcgacgaaaatcagtggaactccgcgaaggaagcagtagaggatgaaaggttctgggaccttgtacatcgagaacgggaattacacaaacaaggaaagtgcgctacatgtgtatacaatatgatgggtaagagagagaagaaacttggagagtttggaaaggcgaagggctccagagccatatggtacatgtggttaggcgctagatttctcgaatttgaagcattaggtttcatgaatgaagatcattggtttagcagagaaaactcgctaagtggcgtcgaaggagaaggtctccacaaattgggatatatattaagagatatatcgaaaattccaggagggaatatgtacgctgatgatactgcaggctgggacacacggataacggaagatgacttacaaaatgaagcgaagataacagacataatggaacctgaacacgcccttttagcaactagcatattcaaattaacctatcaaaataaagtagtgcgggtccaaaggcctgccaaaaatggtactgtaatggatgtgatatctcgaagagatcaaagagggtcagggcaggtagggacctatggattaaatacctttaccaatatggaagcgcaacttattagacaaatggaatcggaaggaatcttcagcccaagcgagctagaaacaccgaatttggcagaacgggtccttgattggttggaaaaatacggagtggagagactgaaacgtatggctataagcggggatgactgtgttgtaaagcctatagatgatagattcgccaccgctctcactgctctcaacgatatgggaaaagtacgcaaagatataccacaatgggaacctagtaaagggtggaatgattggcaacaagtcccattctgcagccatcattttcaccagttgattatgaaagacgggagggaaatagtagtaccatgcagaaatcaagacgaattagtaggacgcgcgcgtgtgtctcaaggagctggttggtctttaagagaaacagcatgcttagggaaatcttacgcacaaatgtggcaactgatgtactttcaccggagggatcttagattagctgcaaatgcaatatgctctgctgttccagtcgattgggtacccacaagtaggacaacatggtcaatacatgcgcaccaccaatggatgacgactgaagacatgctatcagtgtggaaccgcgtttggatagaggaaaatccatggatggaagataaaacacacatttcttcttggggtgatgtgccatatctgggaaaacgcgaggatcaatggtgcggcagcttaattggattaacggcacgtgcgacctgggcaacgaacattcaagttgcaataaaccaggttagacgtttaattggtaatgaaaattatttggattatatgacatcaatgaaaagattcaaaaatgaaagcgatccggaaggagcactatggtaa

SEQ ID NO: 21180 - RNA, 9879 nt, synthetic construct
  misc_feature 1..9879: note = derived and/or modified CDS sequence (opt6) from DENV-1__JN819423__SS-prME
  source 1..9879: mol_type = other RNA
tctgtaactatgctgttaatgctaatgccaactgcactggcatttcacttaactactaggggtggagaaccacatatgatcgtttcaaaacaagaacgaggtaaaagtctactgtttaaaacaagtgcaggcgttaatatgtgcacattgatcgccatggacttgggggaactttgcgaagacacacttacgtacaaatgtccacgaattacagaagtcgagcctgatgatgtagattgttggtgtaatactacggatacttgggtaacatatggaacctgtagtcaaacaggagagcatcgaagggacaagcgttcagtagcactggcgccgcacgttggcctgggacttgaaacacgggcagaaacttggatgtcgtctgaaggagcctggaaacagattcagcgggtagaaacatgggctctgagacacccgggatttacagtaatcgcgttatttcttgcccatgctatcgggacaagcatcacacaaaagggtataatttttatattacttatgttagtcactccaagcatggcgatgaggtgcgtcggcattgggagcagagacttcgttgaaggtctctcgggagcaacatgggtcgacgtagttcttgaacacggttcatgtgtaactaccatggcaaaggacaagccaacattggatatcgaattgctaaaaaccgaagtgactaatcccgctgtcctacgaaaactatgcatcgaagcgaaaatctcgaacacaactactgatagtaggtgcccgacccagggcgaagcgaccctagtagaagaacaagacgctaattttgtatgccgtagaacattcgtagaccggggttgggggaatggttgtggattattcgggaaaggtagcctcataacttgcgctaaattcaagtgtgtcactaaattagagggcaagatagttcaatacgaaaacctcaaatacagtgtgattgtcactgttcatactggcgatcaacatcaagttggaaacgagtccactgaacacggaactacggcaaccattacaccacaagcacctacatccgaaatacagttaacagattacggggcgttgaccctggattgcagccctaggaccggcctagattttaatgaaatggttcttttgacaatgaaagaaaagtcatggctcgttcataagcaatggtttttggatttacccctaccatggacaagcggtgcctccacctcccaagaaacttggaatcgtcaggatctcttagtgacgtttaaaacggcacacgccaagaaacaggaggtagttgtcttaggcagccaagaaggagccatgcatacagcgcttaccggtgcaacagaaatacagacaagtggcaccaccacaatcttcgcaggacatctcaaatgtagacttaagatggacaaattaacattaaaaggtatgtcctacgtgatgtgtacaggaagtttcaagttagaaaaagaagttgcagaaactcaacacggaacggtattagtacaaataaaatacgaaggcactgatgcaccatgcaaaattcccttttccacccaagacgggaaaggggtaactcaaaatggacgtttgatcacagctaatcctatcgtcacagacaaggaaaagccagtaaacatagaagctgagcctccattcggtgaatcctatattgtaattggcgcaggagaaaaagcactcaaattatcttggtttaagaaaggatcttcaataggtaaaatgtttgaagccactgcaagaggtgcacgaagaatggcaattcttggagatacggcgtgggattttggctccgtcggaggggtgtttacgtcagtcggcaagttagtgcaccaaatttttggcactgcatatggagtactcttctctggtgtctcctggactatgaaaataggtataggggtgttgctcacatggttaggactgaatagccgctcaacctctttatcgatgacctgtatcgcggttggtttggtgacgttatacttaggggttatggtccaagccgattcggggtgcgttataaattggaagggtagagaactaaaatgcggatcgggaatattcgtaacaaatgaggttcatacatggaccgaacagtataagtttcaagcagatagtccaaaaagactttccgctgctataggtaaggcatgggaggaaggtgtttgcggaatacgatcagcgacaagactagagaatgtgatgtggagacaaatttcaaatgaactaaaccatattttgttagagaatgatatgaaattcactgtagttgttggagatgtcgtaggtatattagcacaagggaagaaaatgattagaccacagcctatggaacataaatatagttggaaatcatggggaaaagcaaaaataataggagctgacgtacaaaatacaacgttcattatcgatggacctaatacaagcgagtgcccggacgaccagagagcttggaacatatgggaggtggaggattacggttttggcatttttacaacaaatatttggttaaaattaagagattcatacacccaagtgtgcgatcaccgcttaatgtctgccgctatcaaggatagtcgtgcagtacatgcagacatgggatactggatagaaagcgagaaaaacgaaacatggaaactagcacgtgcatcttttattgaggtcaaaacttgtatatggcccaaaagccatacattatggtctaatggtgttctagaatcagagatgatcatccccaaaatttacggaggaccaattagtcaacacaattatcgaccgggatattttactcaaacagcaggaccttggcacttgggaaaattagaattagatttcgatctttgtgagggcacaacagttgttgtggacgaacactgtgggaatcgagggccaagtttgcgaacgactacagtaacaggtaagataatacatgagtggtgttgtagaagttgcacgcttccgccattgcgctttaaaggagaggatgggtgctggtatggaatggaaatcagaccagtaaaagaaaaagaagagaatttagtaaaatcaatggtatctgcaggatcaggagaagtcgactcatttagcctcggacttttatgcatatccataatgatagaagaagttatgcgctcacgttggagtaggaaaatgctgatgacagggacactagccgtattctttttacttattatgggccaattaacctggaatgatcttatccgtttgtgtattatggtaggggcaaacgcctcagacagaatgggaatggggactacatacttagccttaatggctacgttcaagatgcgaccgatgtttgcagtggggcttctgtttagacgcttgacttctcgggaagttttgctactaactattggactttctttagttgcgagcgtagaactaccaaactcattggaggagttaggagatggactagctatgggtatcatgattctcaaactgctaacagacttccaaagttaccaattatgggctacactcctctcactcacatttataaaaacgacattctcattacattacgcttggaaaacaatggcaatggttttaagcatagttagtttactaccactttgcttaagtacgacttcacagaaaacaacatggttaccggtattactaggaagtcttggatgtaaaccattaactatgtttctaatagctgagaacaaaatttgggggaggaagtcatggcctttgaacgagggcattatggcggttgggatagtgtcaatcttattatcaagtctgcttaaaaacgatgttcccctcgcgggacccttgattgcaggcggcatgttaatagcatgttatgtaatttcaggctcaagtgcggatctcagtcttgaaaaggccgccgaagtgagttgggaagaggaggccgaacactcaggggcttcacacaacatattagtagaagtgcaagacgacggtaccatgaaaatcaaggacgaagagagagacgataccctaaccatcctacttaaagctactttgctagccgtctcaggtgtatatcctcttagtatacccgcaactttatttgtatggtatttctggcagaaaaagaaacaacgatcgggggtactttgggatacaccaagtcctccagaagtagaacgtgctgtcttggatgatggcatttacagaataatgcagagaggacttctaggtaggagtcaagtgggtgttggagtctttcaagaaaacgtctttcatacgatgtggcatgtaactcgaggagctgtgttgatgtatcaaggtaagcgtctagagccgtcgtgggcatcagttaaaaaggacttaatatcctatggagggggatggcggctacaagggtcatggaacactggagaagaagttcaagtgatagcggtcgagccaggcaagaatcccaaaaatgtacagacggcaccaggtactttcaagaccccagagggagaagtaggtgcgattgcactcgattttaaaccgggtacatcaggttcaccgatagtgaatagagaaggcaagatagtggggttatacggtaatggcgtagtcactacaagcggaacatatgtaagcgcaatagcccaggctaaagcctcccaagaaggacctctcccggaaatagaagacgaagtctttcgaaagagaaatctaacaataatggatttgcaccctggctcaggtaagacgaggcgatacctcccagcaatcgtacgggaggcaataaaaaggaaacttagaacgttaatcctagcaccaacccgtgtagtcgccagtgagatggcagaagccttgaagggaatgcctataagatatcagacgactgctgtaaaaagcgagcacacaggacgggaaatagtagaccttatgtgccatgcaacattcacgatgagactgctatcgcccgtgagagtaccgaattataatatgatcattatggatgaagcgcatttcacagatccttcttctatagcagctaggggttatataagtacacgtgtaggaatgggagaagcagcggcaatcttcatgacggcgacccctccagggtcggtagaggcttttccacagtctaatgcggttatccaagatgaagaaagagatataccggaaagatcctggaactctggctacgagtggatcacagattttcctgggaaaacagtttggtttgtaccgagtataaagtctggaaatgatattgcgaattgtcttcgcaaaaatggtaagagagtaatacaactaagcaggaaaaccttcgatacagagtaccagaaaaccaaaaataatgattgggattacgtagtaaccacagacatatctgagatgggtgctaattttagggctgacagggtgattgatcctagaagatgcttgaaaccagtaatactgaaggatggccctgaaagggtaatacttgctggtcctatgccggtgaccgtggccagcgccgcacaaagacgaggaagaattggcagaaatcataacaaggagggggaccaatacatatacatggggcaaccgctcaacaatgacgaagatcacgctcattggacagaagctaagatgctattagataacataaatacccctgaagggataataccagctctgttcgagccggaacgtgaaaagtcagcagctatagacggcgaatatcgccttcgaggagaggctagaaaaacattcgtagaactcatgagacgtggagacttacctgtgtggttaagttataaagttgcgtccgaaggcttccaatattcagatcggcgatggtgttttgacggagaacgtaacaatcaggtgttggaagaaaacatggatgtagaaatttggactaaggaaggcgaaagaaagaaattgagacctagatggctcgacgccagaacgtattctgacccgttagcgctaagagagtttaaagagtttgctgctggacgaaggagcgtttccggggatttaatattggagataggcaaattgccacaacatttaacgcagagggcgcaaaatgcactagataatttagtaatgctacataactcagaacaaggaggtagggcatatcggcatgcaatggaagaacttccggaaactatagaaacactcatgttgcttgccttaatcgctgtactaacaggtggtgtaaccctattctttttatccggacgaggtctaggaaaaacaagtataggtttactttgtgttatggcgtcatctgcactattatggatggcaagtgtcgaacctcactggatcgcagcttcaattattctagaatttttcctaatggtcctattaattccagaacctgatcgtcaaaggacaccccaagacaatcaattggcatatgtggttataggccttctattcatgatattgaccgtcgccgctaatgagatgggactgcttgaaaccaccaagaaagacctaggaatcggacatgtagccgtagaaaatcaccatcatgctacaatgctcgacgtagatttacatcccgcttcagcctggactctgtacgcagtagcaactacaattattacgcccatgatgaggcatacaatagaaaatacaacagcaaatatatcacttacagccattgcgaatcaagctgcgatactaatgggactagacaaaggatggcccatctcaaaaatggatataggagttcctttactagcactcggatgctatagccaggtaaacccactaacattaaccgcggctgttttaatgctagtggcacattatgcaataatcggtccaggattacaggccaaagccactcgtgaggctcaaaaacgaacggcagctggaatcatgaaaaatccaacggtggacgggattgttgcaatagaccttgatcctgtagtctatgacgcaaaatttgagaaacaattaggtcaaataatgttattaatcctatgcacttcccagatattattaatgagaacaacttgggcattgtgcgagtccatcacattagccacagggcccttaacaacactatgggagggtagtcctggaaaattttggaatactactatagcagtcagtatggctaatatattcagaggcagttacctagcaggcgcgggcttagcattcagtctaatgaaaagtttaggaggtggaagacggggtacaggtgcgcaaggggagacgttaggggagaaatggaaacgccaactaaaccaactcagtaagtccgaatttaatacgtataagcgcagtggaataatggaagttgacagatcagaagctaaagagggattaagaaggggcgaaacgactaaacatgccgttagcagaggcactgcaaaattacgatggtttgtcgaacgaaacctggtaaaaccagaaggcaaagtgatcgatttaggttgcggaaggggcggttggtcttactattgcgctggcctaaagaaagttactgaggtcaaaggttacaccaaagggggacccggtcatgaagaaccaataccgatggccacctacggatggaatttggttaaacttcatagcggtaaagatgtcttctttattccacccgagaaatgtgacacacttctctgtgatataggagagtcctccccaaatccgacaattgaagaaggacgcactttaagggtcctaaaaatggttgagccttggttacgaggaaatcaattctgcataaagatcttgaacccgtacatgccaagcgtggtagaaactttagaacaaatgcaacggaaacacggaggaatgttagtccgcaatccactttccagaaattctacccatgaaatgtactgggtaagctgtggtaccggaaatatagtaagcgcagtcaacatgacgtccagaatgttattgaatcgatttacgatggcacatagaaagccaacttatgaacgagatgtagacctgggagccggtacacgtcatgttgcggtagaaccagaggtagcaaatttagatataataggccaaagaattgaaaacattaaacatgagcataaatcaacgtggcattacgatgaagacaatccttataaaacttgggcgtatcatgggtcatatgaagtaaaaccctcaggaagtgcatcatctatggttaacggtgtggtaaaattactaacaaagccatgggacgtaatcccaatggtaacacaaatagcaatgactgacactactccgtttggacaacaacgtgtatttaaagaaaaagtagatacacgcacaccaaaggcaaaaagagggactgctcaaatcatggaagttacagcaagatggctttggggttttcttagcaggaataagaaaccacgaatttgtactcgcgaggaatttacaaggaaggtgagatctaatgccgcaatcggagcagtcttcgtagatgagaatcagtggaactctgcaaaagaagcagtggaggatgaaagattttgggacttagtacatagagaaagagagttacataaacaagggaagtgtgcaacctgcgtttacaatatgatgggcaaacgggagaagaaattgggagaatttggtaaggcaaaagggtccagagcaatatggtatatgtggcttggagcaagatttctagagttcgaagcactaggattcatgaatgaagatcattggttttcgagagaaaacagtttatcaggagtggagggagaaggactacacaaacttggatatatattacgtgatatttctaagattcctggcggtaatatgtatgccgacgacaccgccggttgggatacaagaataacggaagacgatctacagaatgaagcaaaaattactgatattatggaaccagagcacgcgctcttagcaactagcatatttaaattaacttatcaaaataaagtggtgcgcgttcaacgtcccgccaaaaatggaacagttatggatgtaattagcagaagagaccaaagaggctcaggtcaggtcggaacttatggtctaaatacttttaccaatatggaagctcaactgattagacagatggaaagtgagggaatattcagtccgtctgagttagaaacaccaaatcttgcggaaagagtgttagactggttggagaaatatggcgtagagcgactaaaaaggatggcaatctcaggagacgattgcgtggttaaaccaatagatgatagatttgctactgcgctcacagcattaaatgatatggggaaagtccgtaaagacataccgcagtgggaaccttcaaaaggttggaacgactggcaacaagtgccattctgttcacatcactttcaccaattaattatgaaagacggacgagaaattgtcgtcccatgcagaaaccaagatgaacttgtaggtagagcaagggtcagccagggagcgggatggtcacttcgagaaaccgcttgtctaggtaaatcgtatgcccaaatgtggcaattaatgtactttcatcgtagggatcttcgattggcagcgaatgctatatgttcggcagtaccagtagactgggttccgacgtctagaactacatggtctatacacgcacatcaacagtggatgacaacagaagacatgctcagtgtatggaatagagtatggatagaggaaaacccatggatggaagacaagacacacatcagttcgtggggagatgtcccgtacttaggaaaaagagaggatcaatggtgtggctcgcttatagggctaactgctcgggctacttgggcaactaatatacaagtagcgatcaaccaggtgcgaagactaattggcaatgaaaactatctagattatatgacctcaatgaaacgttttaaaaacgaaagtgatcctgagggagctctatggtag

SEQ ID NO: 21181 - RNA, 9879 nt, synthetic construct
  misc_feature 1..9879: note = derived and/or modified CDS sequence (opt6) from DENV-1__FJ639672__SS-prME
  source 1..9879: mol_type = other RNA
tcagtaacgatgttattaatgttaatgccaacggcattggcttttcatttaactactagaggaggagagcctcatatgatagtatcaaaacaagaacgtggcaaatctttattatttaaaacaagtgccggtgtcaatatgtgcacattgattgcaatggaccttggagaattatgcgaagacaccatgacctacaaatgtcctagaatcactgaagcagagccagatgacgtcgactgttggtgtaatgcgacggatacttgggttacttatggtacctgtagtcaaacgggggaacatcgtagagataaacgaagtgtagcccttgctccgcacgtgggcctaggcttagaaacgaggacagaaacttggatgagcagcgagggggcatggaaacaaatacaacgtgtggagacatgggcgctgagacatccggggtttaccgttattgctctatttttggcgcacgcgattgggacttctataacacaaaaaggaataatctttatcttactcatgttagtcactccgtcaatggcaatgcggtgcgttgggatatcaagtagagatttcgtcgaaggacttagcggagcaacctgggtagatgtggtcctagaacatggttcatgtgtaactacaatggcgaaagataaaccaaccctagacatagaactgttaaaaactgaagtaacgaatcctgctgtcctacgtaaactatgtattgaagcaaaaatcagtaatactactaccgactcacgatgtccaactcaaggcgaagcaaccctagttgaagaacaagatgcaaacttcgtttgtagaagaactttcgttgatcgcggatggggaaatggatgcgggttatttggtaaaggatcactgataacctgcgcgaaattcaaatgtgtcacaaaattagaaggaaagattgtccaatacgaaaatttaaaatatagtgtgatagtaacagtacacacgggtgaccaacatcaagtaggcaatgaatcaacggaacatggaactaccgccactatcactccacaagctccaactacagaaatacaattgactgactatggagccttgacactggattgtagtccacgtacaggactagattttaatgagatggtcttactgaccatgaaagagaagtcctggttagtacacaaacaatggttcttggatttacctctaccatggacttcaggagcatcaacctcacaagaaacgtggaatagacaagatttgttagtcacttttaaaacagcccacgctaagaaacaagaagtagtcgtgttagggtctcaagaaggcgcaatgcataccgcactaacaggagctaccgagatacaaaccagtggaaccactaccattttcgctggacacctaaaatgtcgcttgaaaatggataaactaacactaaagggaatgtcatacgtaatgtgcactggcagttttaaattagagaaggaagtagccgaaactcagcacggaacggttttagtacaaataaagtacgaaggaaccgatgccccttgcaagataccttttagtacacaggatgagaaaggagtaacccaaaacggaagattgattacagccaacccaattgtgacagacaaagaaaaaccagtgaatattgaagcggaaccaccattcggcgagagctatattgtcataggtgcaggggaaaaagcattgaaactatcgtggttcaagaaaggttcgagcataggcaagatgttcgaggcaactgctagaggagcgcgacgtatggcaatcctgggagacacagcttgggactttggcagcataggaggcgtatttacttctgtaggtaagttagtacatcaaatattcggaacagcgtatggagttctattttcgggggtctcatggacaatgaagatcggtataggagttttattgacatggcttggattaaatagtagaagtacttctctttcaatgacctgcatcgcggttggattggttacattatatctcggggttatggtacaagcggattcagggtgcgtgattaattggaaaggccgagagttaaaatgtggtagcggaatttttgtaactaatgaagtacatacttggacagaacagtataaatttcaagcagattcaccgaaacgtttaagtgcggcaataggaaaagcatgggaagagggtgtttgtggcataagatctgcaactagactagaaaatatcatgtggaagcaaattagcaacgaactgaatcatatattgttagagaacgatatgaaactaactgtggtagtaggtgacgtagcaggtatattagcccaaggaaagaaaatgatacgccctcaacctatggaatacaaatatagttggaaatcttggggaaaagcgaagataatcggcgctgatgtgcaaaatacaactttcataattgacggtcccaatactcctgaatgtcccgatgatcaaagggcatggaatatatgggaggtagaagattatggatttggcattttcacaacgaacatatggctaaaactacgagattcatatactcaagtatgtgatcacagacttatgagcgccgcaattaaagactcaaaagctgtacatgcagatatgggatattggatagaatctgagaaaaacgagacttggaaattagcgagggctagtttcattgaagttaaaacatgtatctggcctaaatcccatacactgtggtccaatggcgttctagaaagtgagatgataatccctaaaatttatggtggaccaattagtcaacataactatcgaccaggttacttcacgcagacagccggtccatggcatttaggtaagttagaattagactttgatctgtgtgaaggcaccacggttgtcgttgacgagcattgtggtaatagagggccaagtctacgaaccacgaccgtaaccggaaaaattatacatgaatggtgctgtagaagttgtacattaccaccattgagattcagaggagaagatggctgttggtatggtatggaaatacgaccggtgaaggagaaagaagagaacctagtcaaatcaatggtgagtgcgggtagcggtgaagtggatagttttagtttaggattattatgtatctctattatgatagaagaggttatgcgaagccgatggtcacggaagatgttgatgacaggaactcttgcagtgttctttctactaattatgggacaattgacgtggaacgacctaatacgattatgtataatggtcggggcgaatgctagtgaccgcatgggcatgggaacgacatacttagcccttatggctaccttcaaaatgcgccctatgttcgcagtaggattattattccgaagacttacctctagagaggttttgctattaacaattgggttgtcattggtagcaagtgtagagctaccaaatagtctggaggaattaggcgacggtctggctatggggatcatgattctcaaattactaacggattttcagtcacatcaattatgggcaactttgttaagcctaacatttataaagacaactttttcccttcactatgcgtggaaaacaatggcgatggttttaagcatagttagcctctttccactttgtttatctacaacaagtcagaaaactacatggttaccagtattactcggatcgctggggtgtaaaccactaacaatgtttttaatagcggagaacaaaatctgggggaggaaaagctggccactgaatgaaggtatcatggcagtaggtatcgtgtcaattctactgtcttcacttctaaagaacgatgttccattagctgggccactgatcgcagggggaatgttaattgcatgctatgttataagtggcagttcggcagacttgtcactagaaaaagcagccgaagtatcgtgggaggaagaagcagaacattcaggagcttcacacaacatcttagtagaagttcaggacgatgggactatgaaaatcaaagatgaagaacgcgatgatactctaactatattactcaaggcaacattgcttgcggtttccggtgtttatccactatcgatcccagccacattgtttgtttggtatttttggcagaaaaagaagcaacggtcaggcgtgttgtgggatactccaagtccgcctgaagtggagagggctgtgctggatgacggtatatacagaatcatgcaacgcggattactcggcagaagtcaagttggggtaggtgtgtttcaagaaaacgtctttcatacaatgtggcatgtaaccaggggagccgtactcatgtatcagggtaagagattagaaccttcttgggcgtcagtcaagaaagatttaatttcttacggtggaggttggcgattgcaagggtcttggaatactggtgaagaagtacaggttatagctgtagaaccagggaagaatcccaaaaacgtacaaaccgcccccggaaccttcaagactccagagggagaagttggtgccatcgctctagactttaagccaggtacctccggttcgccgatagtaaatagagaagggaagattgtcgggttgtatggaaatggggtcgtaactacatcaggtacttatgtgtctgcaatcgcccaagctaaagcgtcacaagaaggccccttacctgaaattgaggatgaagtttttcgaaaaagaaatctcacaattatggacctccatccagggtcaggaaaaacacggagatatttacctgccatagtacgagaggcaatcaaaaggaaactcagaacccttattctagccccaacaagagtggtcgcatcagaaatggcggaagcactcaaaggaatgcccatccgttatcaaacaacagctgtaaaaagtgagcatactggaaaagaaattgtcgatctaatgtgccacgctacctttacaatgagattattaagtcccgtaagggtgccaaattataacatgataataatggatgaagcacatttcacggatccttcaagtattgcagcaagaggatatatatctactcgagtgggaatgggcgaagcagcagcgatttttatgactgctactccacccggaagcgtagaagcgtttccgcaaagtaacgctgttatacaagacgaggaaagagatatcccagaacggtcctggaacagcggatacgaatggataacagacttcccagggaaaacagtttggtttgtaccatctataaaatcaggtaatgatatagccaactgtctgcgcaaaaatggcaagagagtaatacaattatccagaaaaacttttgacacagagtatcaaaagactaaaaataacgactgggactacgtagtaacaacagacattagtgaaatgggggcaaacttcagagcggaccgggtaatagaccctcgcagatgcctgaaaccagtaatactcaaagatggtccagaaagagtaatactggcaggtccaatgccagtaacagttgctagcgcggcgcaacgtcgcggtcgtattggtagaaatcataataaagagggagaccaatacatctacatgggccaacctctaaacaatgatgaggatcacgcccattggactgaagctaagatgcttcttgataatataaatactccggaaggtatcatcccagctttattcgaacccgaaagggaaaagtcagcagctattgatggagaatatagactaagaggggaagcgcgtaaaacgttcgtcgaactcatgaggagaggggatctaccagtgtggttatcgtacaaggtagcttctgaaggcttccaatattctgaccgtcgatggtgttttgatggtgaacgtaataatcaagtcctggaagaaaatatggatgtagaaatatggacaaaagaaggcgaaaggaagaaactacgtccacgatggttagatgccagaacttactctgaccccttggcgttacgagagtttaaagagtttgcagctggaagaagatctgtaagcggggatttaatattagagatcgggaaattaccacaacatctaacgcagcgtgctcaaaatgcattagacaatttagtaatgttacataattccgaacaaggtggtagagcttatcgccacgcgatggaagaattacccgatacaatagaaactttgatgcttttagcacttatagcagtgttgacgggtggagtgaccttattcttcctcagcggacgagggcttggaaaaaccagtatcgggttactctgtgtgatggcgtccagtgtgttattatggatggctagtgtcgaaccgcactggatagcagcgtcgatcattctagagttctttttaatggtgttgttaataccagaaccagatcgacaaagaacaccgcaagacaaccaactcgcttacgttgtaatcggtttgttgttcatgatattgaccgtagcggcaaatgaaatgggcttacttgaaacaacaaagaaagacttaggaataggacatgtagctgtcgaaaaccatcatcacgcggccatgttagacgttgaccttcatcccgcgagcgcatggacattgtacgctgttgcgaccacaattattacaccaatgatgagacacacaattgagaatacaaccgctaacatttctttaacggccatagccaaccaggcagcaatcttaatgggtctggataaaggttggccgatatcaaaaatggatattggagtaccattattagcactaggttgttattcacaggttaacccgctaactttaacggcagctgttttaatgctcgtagcacattatgccattataggcccaggtttacaagcaaaagcaacaagggaagctcagaaaagaacggcggctggaataatgaagaatcccactgtagatggaatcgtagcaatagatctagacccagtcgtatatgacgcgaaatttgaaaaacaactgggccaaataatgttgttgatcttatgtacatcacaaattctattaatgcgtactacctgggctctatgcgaaagcattacgctcgccaccgggccgctaactacattgtgggaagggtctcccgggaagttttggaacacaactatcgcagttagtatggcaaatatattccgaggttcttatctagccggcgcgggtctcgcttttagtctgatgaaatctctaggaggtggaagaagggggacaggtgcacaaggagaaacattaggcgaaaaatggaaaagacagttaaaccaattatcaaaaagcgaatttaacacatataaaagatctggaatcatggaagttgatagatctgaggcaaaagaaggtctaaaaagaggtgaaactacaaaacatgctgtaagtaggggaacggcaaaattacgctggtttgtcgaacgcaacctcgttaaaccagaaggtaaagttatagatttaggttgtggaagaggagggtggtcatactattgtgccggtctaaagaaagtgaccgaagtaaaaggctacacaaaagggggtcccggacacgaagaaccaatacccatggccacatacggatggaatttagttaagttacacagtggaaaagatgcgtttttcatacctccagaaaaatgtgatacgttactctgtgacatcggagaatcaagtcccaatcccacgatagaagagggaagaacattaagagtactaaaaatggtagagccgtggttacgaggtaaccaattttgcattaaaatccttaacccgtatatgcctagcgtagtggagacgctagagcaaatgcaacggaaacacggagggatgctagttagaaacccactctcacgcaattcgacccacgaaatgtactgggtaagttgcgggacagggaacatagtctcggccgtaaatatgacctcaagaatgttacttaataggttcactatggcacaccggaaaccaacttacgagcgagatgtagacttagggacaggtaccagacacgtggccgtggaacctgaagtagccaatctggacataattggccaaagaattgagaatatcaaacacgaacacaagtcgacgtggcattatgatgaagataacccttacaaaacatgggcatatcatggcagttatgaggttaaaccatcaggatcagcaagctccatggtaaatggtgtggtcaaattgctcaccaaaccatgggatgtaataccaatggtcacccaaatcgccatgacagatacgacaccttttggacaacaaagagtgttcaaagagaaagtagataccagaactccaaaagctaaacgtggaacagcacagatcatggaagtcacagcgagatggttgtggggattcctttccagaaataagaaacctaggatatgcacacgggaggaatttactcgcaaagtccgctcgaatgctgcgataggtgctgtattcgtagatgaaaaccaatggaatagtgccaaagaagctgtcgaggatgaaagattttgggacctagtacatagagaaagggaactacataaacaaggaaaatgcgcgacatgcgtttataacatgatggggaagagagaaaagaaattaggagaatttggaaaggctaaaggttctcgagcaatttggtatatgtggttaggagctcgatttctcgaatttgaagcactaggttttatgaatgaagatcactggtttagtcgtgaaaatagtctgtccggagtagaaggagaaggacttcacaaactaggatatatcttaagagatatttctaaaataccaggaggaaatatgtatgccgatgacacagccggttgggataccagaataacggaagacgaccttcaaaacgaggcaaaaataacggatataatggagcctgaacatgccttattagcaaaagcaatctttaaattaacatatcaaaataaagtggtgcgagtacaaagaccggccaaaaacggaacggttatggatgtaatatcccgacgtgaccaacgtgggtcaggacaggtaggcacatatggattgaatactttcacgaatatggaggcccaactgatacgccaaatggagtctgaagggatattcagcccttctgaactagagacacctaacctcgcagaacgagcactggactggctcgaaaaatatggcgttgaacggttaaaaaggatggccattagtggcgatgattgtgtagtaaaaccaattgacgatcgattcgccaccgcactaacagcgctcaacgatatgggcaaagttcgtaaagatatcccccaatgggagccatctaagggctggaacgactggcaacaagttcctttctgtagtcatcacttccaccaactgataatgaaagacggcagagagattgtagtgccatgccggaaccaggacgaattggttggcagagctagagtcagccaaggggctggttggagcttacgcgagacagcttgtttgggcaagtcatatgcccaaatgtggcaactaatgtacttccacagaagagacttaaggctcgcagctaatgcaatctgtagcgcggttccagtcgattgggtcccgacatccagaacgacttggtcaattcacgcacatcaccaatggatgacaacagaagatatgttaagcgtctggaacagagtatggatagaagaaaacccctggatggaggacaaaacgcacatatcttcgtgggaagatgttccatatcttggtaaacgtgaagaccagtggtgtggctccctgataggacttacagctagagcaacatgggcaactaacattcaagtcgcgataaatcaagtcaggcgccttataggaaatgaaaattatctagattacatgacgtctatgaagcgtttcaagaatgagtcggacccagagggtgcactatggtaa

SEQ ID NO: 21182 - RNA, 9879 nt, synthetic construct
  misc_feature 1..9879: note = derived and/or modified CDS sequence (opt6) from DENV-1__FJ639673__SS-prME
  source 1..9879: mol_type = other RNA
tcggtgacaatgctccttatgctaatgccaacagcattagcttttcacttgacaacacgtggtggagaaccacatatgatagtatcaaaacaagaaagaggtaaatccttactttttaaaactagcgcaggagttaatatgtgtacactgatagcaatggatttaggagaactctgtgaagacacaatgacgtataaatgcccacgtataacagaagtagaaccggacgacgttgattgctggtgtaatacaactgatacatgggtaacctacggaacttgctcacaaacaggcgaacacagaagagacaaacggtccgttgcactcgcacctcatgttggtttgggtcttgaaacacgagcagaaacttggatgtcatccgagggcgcatggaaacaaatacaacgtgtagagacatgggctttacgtcatccaggttttactgttatagctctatttttggctcatgcaataggcactagcataacacaaaaaggaataattttcatccttttgatgttggtaactcctagtatggcaatgagatgtgttggaattggaagcagagatttcgttgaagggttatcaggtgcaacttgggttgacgtagtgctagaacatgggtcctgtgtgacgactatggcaaaagataaaccaaccctagacatagaattgttaaaaacggaggtgacgaatccagcagttctaagaaaattatgtatagaagcaaaaattagtaacactactacggactcaagatgccccacacaaggggaagcaaccttagtagaggaacaggatgctaatttcgtttgtagacgcactttcgtcgatcgaggttggggcaatggatgtggtctttttggcaaaggaagtcttataacgtgcgcaaaatttaaatgtgtgactaaactcgaagggaaaatagtacaatatgaaaacctcaaatacagcgtgatagtgacagtgcacaccggcgatcaacaccaggtagggaatgaaagtacagaacatgggactacagcaacaataacaccacaggccccaacttcagaaattcaattgacagattatggtgccctaactttagactgttcacctagaacgggcctagactttaatgaaatggtcttattaactatgaaagagaaaagttggttggtccacaaacaatggtttctagatctacccctcccatggacgagcggggcgtctactagccaggagacttggaatagacaggatttacttgttaccttcaaaacagctcatgccaagaaacaagaagtagtcgtactgggctcacaagaaggcgctatgcatactgctttgacaggagcaacggaaatccaaacatcaggaacaactaccatattcgccggacatctaaaatgtagattgaaaatggacaaattaacattaaagggaatgagttacgtcatgtgtacaggttcattcaaattggagaaagaagtggcagaaacacagcatggcacagttctagttcaaatcaaatatgaagggacagatgccccttgtaaaataccatttagcacacaagatgaaaaaggagtaacgcaaaacgggaggctaattactgctaatcctatagtcaccgataaagaaaaaccagtcaatatagaagcagaaccaccatttggggagagttatatcgtcattggggcaggggagaaagccctaaaactttcatggtttaaaaagggatcaagcatcggaaaaatgttcgaagcaaccgcgaggggtgctcgaagaatggccattttaggagatacagcgtgggactttggtagtataggaggagtttttacaagcgtcgggaaattagttcatcaaatattcgggactgcatatggagtattgttcagcggagtatcatggacaatgaaaataggaataggggtactcttgacttggcttggcttaaatagtagaagcactagcttatctatgacatgtatcgcagtaggtttagtgacactatacttaggagtaatggttcaagccgacagcgggtgcgttattaactggaaaggtcgtgaactgaagtgtggttccggcattttcgtcacaaatgaagtccatacatggacggagcaatataaatttcaagccgatagtcctaaaagactgtctgctgcgataggcaaagcatgggaagaaggagtatgcggtatccgcagtgcaactagactggaaaacataatgtggcgacagattagcaacgaactaaaccatatattacttgaaaatgatatgaagtttactgtcgttgttggagatgtagtaggtatacttgctcaaggcaagaaaatgatccgtccccagccaatggaacacaagtactcctggaaaagctggggaaaggctaagatcattggagcggatgtacaaaatacgaccttcatcatagacgggcctaacacaccagagtgtcctgacgatcaaagagcgtggaatatatgggaggttgaggactatgggttcggcatctttactacaaacatttggcttaagctacgagattcatacacgcaagtttgtgatcatagactcatgtcagcagcaatcaaagatagcaaagctgtccatgcagacatgggatactggatagaaagtgagaaaaacgaaacttggaaattggctcgcgctagttttatagaagttaaaacgtgcatatggccaaagtcacatacgctgtggtccaatggcgtcctagagtcagagatgattatacctaagatttacgggggtccaatctcacaacacaattacaggcccggatactttacacaaacggctggaccttggcacttaggaaaattagaactcgactttgatctttgcgagggaacaacagtggtggtcgacgaacattgtggaaatcgcggcccatctttaaggactactaccgtaacaggtaaaatcattcatgaatggtgttgccgatcatgcacacttccaccattaagattcaaaggtgaagatggctgctggtatgggatggagatccgccccgtaaaagagaaagaagagaatttggtgaaatctatggttagcgcgggttcgggggaagttgacagcttttctctgggactattgtgtatcagtataatgatagaagaagttatgcgaagtcgctggagcagaaagatgctgatgacaggaacgctagccgtattctttctgctaataatgggacaattaacgtggaatgacttaattaggagttgtatcatggtcggagcaaacgcaagcgatcgaatgggcatggggacgacttaccttgcgctaatggccacttttaaaatgaggccaatgtttgccgtaggccttctatttcgccgcttgacatcgagagaagtcctcttactaactataggtctctcacttgtagcgtccgtagagttaccaaactccctcgaggaacttggtgatggacttgcaatgggtataatgatcctaaaactattaacagattttcaatcataccaactgtgggcaacactactcagtcttacatttatcaaaacaacatttagccttcactatgcatggaagaccatggccatggttctaagtatagtttctctactacctctatgtctatcaacaacatcccagaaaacaacttggttaccagtactgttgggttcactagggtgtaaacccctaacaatgtttcttatagccgagaacaagatatgggggaggaaaagctggccattgaatgaaggtataatggcagtgggaatcgtatctatattattgtctagtctacttaagaatgacgtacctctcgctggacctttgatcgcaggaggtatgttaatagcatgttatgtgataagtggatcgtctgcagacctttccctagaaaaggcagcagtagtgagctgggaagaagaagcagaacacagtggagcaagccataacatactggtagaggtccaagatgatggcacaatgaaaataaaagatgaagaaagggatgacacattaacaattctacttaaagcaacattgttagcggtatctggagtttatccgttaagcatacccgcaaccctatttgtctggtacttttggcagaagaagaaacaacggtctggggtattatgggatactccttcaccaccagaagttgaacgagccgtactagatgacgggatttaccgcataatgcaaagaggtcttttgggtagaagtcaggttggagtgggagtttttcaagagaacgtatttcatacaatgtggcacgtaacgagaggtgctgtgctaatgtatcaaggtaaaaggctagaaccatcatgggcatcagtcaagaaagatcttatatcgtatgggggcggttggcgattacaaggaagctggaatacaggggaagaagtgcaggtaattgccgtagaaccggggaagaatcccaaaaatgtccaaactgcaccaggtacatttaaaacaccggaaggggaggtaggtgccatagcgctagactttaaaccaggaacctccggatccccaatagttaatcgagaaggaaaaattgttggtctttatggcaatggagttgtgacgacaagcggcacatatgtctccgcaatagcccaagcgaaggcttcacaagaagggcctctacctgagattgaagacgaagtatttcgtaagcggaacttgacgattatggatttacatccaggttctggaaaaacgagaaggtatctcccagcgatagtaagagaagcaataaagagaaaactgcgcacgcttatactcgcaccaacaagggtagttgcctctgaaatggctgaagccctcaaaggaatgccaattagataccagactacagcggttaaaagtgaacatacagggagagaaattgtcgaccttatgtgtcacgcaacatttactatgagattgctttctccagtcagagtgccaaattacaatatgataataatggatgaggcacatttcaccgatccttcgtcaatagcagcaagaggatacatatcaacacgggtaggaatgggtgaagcagcagcaatattcatgacagccacgccgccgggctcggtggaggcattccctcaatcgaatgcagtaatacaagacgaagaacgagacattccagagagatcttggaactcaggttacgaatggattacagattttcctggaaaaacggtgtggttcgttccttctataaaaagcggaaacgatatagcaaattgtctgcgcaaaaacggtaaacgagtcatccagctatctaggaaaacgttcgacacagagtatcagaaaaccaaaaacaacgattgggactatgtagtaacaaccgatatcagtgaaatgggtgccaatttccgggccgatagagtaattgatccgagacgttgcctaaaacccgtgattttaaaggatggaccggagcgcgtgatacttgcgggaccgatgcctgtaacagtggcttcagcagcacaaagaaggggaagaattggaagaaaccataataaagaaggcgaccagtacatatatatgggtcaaccgctaaacaacgatgaggaccacgcacactggactgaagctaaaatgcttttagacaacataaacaccccggaagggattataccggctttgtttgaacctgaacgtgagaaaagtgcagcgatcgacggagaataccgtttacgaggagaagcgaggaaaacttttgtagaacttatgcgtagaggtgatttacctgtttggttaagttataaggtggcttctgaaggattccaatatagtgaccgtcgttggtgctttgatggggaacgaaataatcaagtattggaggaaaacatggatgtcgaaatctggactaaagaaggggaaaggaagaaattgagaccacgatggctagatgctcgcacctattctgatccattggcactacgagagtttaaggaatttgccgcgggacgaagatcagtatcgggtgatcttattttagaaataggaaaactaccacaacatctaactcaaagggcacaaaacgctctagacaatttagttatgttacacaatagcgaacaagggggcagagcttatagacacgcgatggaagaacttccagatactatagaaactctaatgctgctagcattaatagccgtgttaactggaggcgtaacactcttctttttgagtggaagaggacttggcaaaaccagcataggacttctatgcgtaatggcatcgtcagcactactgtggatggcatcagtagagccgcactggatagccgcttccataatactggagttctttttaatggtgctactaatccctgagccagacagacaaagaacgccacaagataaccaattagcatacgtagtcattggactactcttcatgatacttacagtagcggcaaatgagatgggattattagaaactactaagaaagatttggggataggacatgtagctgttgagaaccatcatcatgccacaatgcttgatgttgatttgcatccagctagcgcctggacattgtatgcagtggcaactactatcataacacctatgatgaggcacacgatcgaaaatacgaccgctaacatatcacttactgctatagctaatcaagcggctatactaatgggtttagacaaaggctggcccataagtaagatggacataggagtaccactgttggcattaggatgctattcgcaagtgaatccattgacactcacagcagcagtgctgatgttagtagcacattacgccataatcggccctggattacaagcgaaagctactagagaggcacagaaaagaacggcggcaggaattatgaaaaatccaaccgtagacggtatcgttgcgattgacttagatcccgtcgtttatgatgccaaatttgaaaagcaattagggcagattatgctacttattctctgtacatcccaaattttgctcatgaggacgacttgggcactctgcgagtcaataaccctggccaccggacccttgacgactctatgggaaggaagtccgggaaaattttggaatactactattgcggttagcatggcaaatatctttcgcgggtcatatctcgctggcgccggactagcattttcattaatgaaatcattgggcggcggaagacgaggtacgggtgcacaaggggaaacgttaggagaaaaatggaaaagacaattaaaccaactttcaaaaagtgaatttaatacatacaagagatcaggtataatggaagtcgaccgatctgaagcgaaagaaggtttaagacgtggggaaacaacgaaacatgctgtatctcgaggaacggccaaacttagatggttcgtggaaagaaatcttgtgaaacctgaaggcaaagtaattgatctaggctgtggccgaggcggctggagctattattgcgccggccttaagaaagtaaccgaagtgaaaggttacacaaagggcggccccgggcacgaagaaccaataccaatggctacatacgggtggaatctcgttaaactgcatagtggcaaagacgtattcttcataccacctgaaaaatgcgacacattgttatgtgacataggggagagcagtccgaaccctacgattgaggaaggacgaacccttagagtgttgaaaatggtagaaccatggctaagagggaaccaattctgcataaaaatactaaacccatatatgccttctgtggttgagaccttagaacaaatgcagcgtaagcatgggggtatgttggtacgaaaccctttatcacgaaactcgacccatgaaatgtattgggtgtcatgcggaacaggaaatattgtgtcagcagttaatatgacatctagaatgcttctaaatcggttcactatggctcaccggaaaccaacatacgagagagatgttgatctgggagctggtacacgacatgtcgcggtcgagcctgaagttgccaatctcgatattataggacaacgtattgaaaatataaaacatgaacataaatcaacatggcattatgacgaagacaacccctataagacatgggcataccatgggagttatgaagtgaaacccagcggtagcgcatcttcaatggtgaacggtgttgtgaaattactaacaaaaccatgggacgttatacctatggtcactcaaatagctatgaccgatactactccctttggtcaacaaagggtatttaaagaaaaagtagacacgcgaactccaaaggctaaaagaggcactgcacagataatggaagtcacggcaagatggctatggggtttcctttcacgcaacaagaagccaaggatatgcacccgagaagaatttacccggaaagtaagaagtaacgcagctataggtgcggtttttgtggacgagaatcagtggaactcagcgaaagaagcagttgaagatgagagattttgggatttggtacatagagaacgagaattacacaagcaagggaaatgtgcaacatgtgtgtataatatgatgggaaaacgtgaaaagaagttaggagaatttggaaaggcaaaaggatcgcgagccatatggtatatgtggttaggtgcgcggttcttagagtttgaagcactaggatttatgaatgaagaccactggttcagtagagaaaattctttaagcggggttgaaggagaaggactccacaagttaggttatatacttagagatatttctaaaatacctgggggtaatatgtacgctgacgacacagcaggatgggacacgaggatcacagaagatgacttacaaaatgaagcgaaaataacagacataatggaaccagagcatgcgttactagccacctcaatatttaaactgacctaccaaaataaagttgtgagggtccaacgaccagccaaaaacggaacggtcatggatgtcatatccagaagagaccaacgaggatctggccaagtaggaacgtacggactaaatactttcactaacatggaagcccaattgattaggcagatggagagtgagggaatcttttcaccttctgaattagagacccctaatctagcggaacgagttttggactggttggaaaaatatggggttgagcgcctaaagaggatggctatttccggagatgattgtgtcgtcaaaccaatagatgaccgatttgcaaccgcgttaactgcactaaatgacatgggtaaggtgcgaaaagatataccacaatgggaaccttccaaaggctggaatgattggcaacaagttccattctgttcacatcattttcatcaactaatcatgaaggatggacgcgaaatcgtagttccctgtagaaatcaagatgagctagttgggagagcccgagtatcccagggcgctgggtggagcttaagagagactgcatgtctaggaaagtcatatgcccaaatgtggcaattgatgtacttccatagaagggacctacgattagcagctaatgcgatatgtagcgctgtcccagtggattgggtaccaacttctagaacaacttggtctatccatgcccatcaccaatggatgacaactgaagacatgctctcagtttggaatagagtttggatagaagaaaatccatggatggaggataagacacatatatcctcatggggagatgtaccatatcttggaaagcgggaagatcaatggtgtggatctttaatcgggcttactgcccgagctacgtgggcgacgaatatacaggtggcaataaatcaagttaggagactaataggaaacgaaaattatttggactatatgacgagcatgaaacgttttaagaatgaaagcgacccagaaggagcattatggtaa

SEQ ID NO: 21183 - RNA, 9879 nt, synthetic construct
  misc_feature 1..9879: note = derived and/or modified CDS sequence (opt6) from DENV-1__FJ639674__SS-prME
  source 1..9879: mol_type = other RNA
tcagttaccatgctacttatgttgatgcctactgctttagcatttcacttaaccacaagaggcggggaaccacatatgattgtaagcaaacaagaacgcggcaaatcattgttgtttaaaactagcgctggcgttaatatgtgtacgttaatcgcgatggaccttggtgaattttgcgaagacaccatgacatacaaatgtcctaggattacagaagccgaacctgacgacgtagattgttggtgcaacgcaactgatacttgggtaacgtacggcacgtgctcacaaacaggtgaacatcgacgggataaaaggtccgtagccctagcaccacacgttggtttgggtcttgagacgcgaaccgaaacttggatgtcaagtgaaggggcttggaaacaaatacaacgtgtagaaacctgggctttgcgacatccaggtttcactgtaatcgccttgttcttagctcatgctattgggacaagtatcactcaaaaagggattatatttattttgcttatgttagttaccccatcaatggcaatgaggtgtgttgggataggaagcagagattttgtagaagggttgagtggggcgacatgggtggatgtagtcttagaacatggaagttgtgtaacaaccatggcaaaagataaacctaccctagatatagaactattgaaaacagaagtgactaacccagctgtactgagaaaattgtgcattgaagctaaaatttccaacacgacgacggactctcgatgcccaacacagggggaggcaactctagtagaagaacaagacgccaatttcgtatgtcgaagaaccttcgttgacaggggatggggcaatggatgtggattatttggtaaaggcagtttaataacttgtgcaaaattcaaatgtgtgacaaaacttgaaggaaaaatcgtccaatacgaaaacctgaaatacagtgtcattgttacagtacatactggagatcagcatcaagttggtaatgaatcgacggaacacggtacaacggctaccatcacgccacaagctccaagtaccgaaatccaacttactgattacggagccctcacactcgattgctcaccaagaactggtttagactttaacgagatggtgttattaaccatgaaggaaaaatcatggttagttcataaacagtggttccttgatctaccattgccctggacttcgggagcatctacctctcaagaaacatggaatagacaggacctacttgtaacattcaaaactgcacatgcaaagaaacaggaagtagtggtactcggaagccaagagggcgcaatgcacacagcattaacgggagccacagaaatacaaacatccggaactaccacaatatttgccggacatttaaagtgccgcttaaaaatggacaaacttacactgaaagggatgagttacgtaatgtgtacaggcagtttcaaactagaaaaagaagtcgcggaaactcaacatgggacagtattggtacagataaagtatgaagggaccgatgctccgtgtaaaatccctttcagtacccaagacgaaaagggcgtcactcaaaatggacgattaattacggcgaatccaatagttactgataaagagaaacctgttaacatcgaagcagagcccccgtttggcgaaagctacatagtaataggcgcaggagagaaagcattaaaattaagctggtttaagaaaggaagctctatagggaagatgtttgaagcgaccgcacgaggcgctcgcaggatggcaatattgggcgacacagcatgggacttcggaagtataggcggagtattcacatcagtaggaaaattagtccaccagatctttggaaccgcatatggggtcctctttagcggggtaagctggaccatgaaaataggaataggggtattgcttacctggctaggactcaactccagaagcatgtcattatcaatgacttgtatcgcggtaggtttggtgactctatacctaggcgttatggttcaagcggactctggatgtgttatcaactggaagggtagagagctaaaatgtggcagcggcatatttgtcacgaacgaggtccatacttggaccgagcaatataaattccaagctgactctcccaaaagattaagtgcagcaataggaaaggcgtgggaagagggtgtgtgtggcattagatcagctaccagattagagaatataatgtggaaacaaatatcgaacgaactcaatcacattctcctggagaatgatatgaaatttaccgttgttgtaggagatgtagctggtatcctggctcaaggcaagaaaatgatcagacctcagccaatggaatacaaatactcatggaaatcttgggggaaagctaaaataattggggcagacgtacagaacactacatttatcatagatggacctaatacgccagaatgcccagacgaccaacgagcatggaatatatgggaagttgaagactatggatttggaatatttacaacgaatatatggcttaagttaagagattcgtatacacaagtttgtgaccaccgattaatgtcagctgcgataaaagattctaaagctgtgcatgccgatatgggctattggatcgagtctgaaaagaatgaaacctggaaattagctagggccagctttatagaagtgaaaacttgtatatggcctaaatcgcacactctatggagcaatggcgtattagaatcagagatgatcatacctaaaatatatggcggtccgatatcacaacataattataggccaggttattttacgcagactgcaggaccgtggcacttaggtaaactagaactcgacttcgacctctgcgaaggaacgacggtagtagttgacgagcactgtggaaaccgggggccttccttaaggactaccactgtaacaggaaaaattattcacgagtggtgttgtagaagctgtaccttaccaccactacgatttaaaggagaagatggttgttggtatggtatggaaatacgaccagtcaaagaaaaggaagaaaatctagttaaaagtatggttagcgctggctcgggtgaagtggattcattcagtctgggattattatgcatctcgataatgatagaagaagttatgcgtagccgttggtcaaggaaaatgttaatgacgggtacgttggctgtattcttcttgctcatcatggggcagcttacttggaacgatctaatccgcctatgtattatggtaggcgctaatgcctccgacagaatgggaatgggaacaacttacctcgcattaatggctactttcaagatgagaccaatgtttgctgtgggtttactttttaggcgattaacgtcccgagaggttctattactcacaatcggactatcattagtagcttcagtagaacttcccaattctctagaagaactcggagatggtctggctatgggaataatgatattaaaattgttaactgacttccaaagtcatcaactgtgggcaactctgttgtcccttacctttattaagacaacctttagccttcattatgcatggaaaacaatggccatggtactaagtatcgtcagtctattccctctttgcctttctacgacctcgcaaaagacgacttggctaccagtattattaggaagcctcggatgcaagccactgacaatgtttctcattgcagagaacaaaatttggggtcgaaaatcttggccattgaacgaaggaataatggcagtgggaatcgtatcgattctattatcttctctgctcaaaaatgatgtacccctagcaggcccgctcattgctggcggtatgttaatagcttgttatgtgatctcaggatcttcagctgacctatctctagagaaggcagcagaagtatcatgggaagaagaagcagaacacagtggtgctagccacaatatattagtcgaagtacaagacgacggaacaatgaaaataaaggacgaagaacgggacgatactttgacaattctactaaaagctacattgcttgcagtcagtggagtatatccactgagtatccccgcaaccctcttcgtgtggtacttttggcagaagaagaaacaaaggtctggggttttatgggataccccctctcctccagaagtcgaacgtgctgttttagatgatggtatttaccgaataatgcaacgcggattattaggtcgctcacaagtaggagttggtgtattccaagaaaacgtcttccacacaatgtggcatgtcactcgaggtgcagtgcttatgtaccaaggaaaaagactagagcctagttgggcgtccgttaagaaagatctaatctcttatggcggtggatggcgtttacaaggatcatggaatacaggtgaagaagttcaagtaattgcagttgaacctgggaagaatcccaaaaatgtccaaaccgcgcctggtacattcaaaacatctgaaggagaagtaggagcgatagccttagactttaaaccaggtacaagcggatcacctatcgtaaacagggagggtaagattgtaggactatatgggaatggagttgtaaccacaagcggaacttatgttagtgcaatagcgcaagcaaaagcatctcaagaaggtccattacctgagatagaagacgaagtttttagaaaaagaaacttaactatcatggacttgcatccaggaagcgggaagacccggcggtatctacccgcaattgtacgcgaggcaataaaaagaaaattacgaactttaatacttgcaccaactcgagttgttgccagcgagatggcggaagcactgaaaggaatgccaatcagatatcagaccacagccgtaaaatctgagcacacaggtaaagaaattgtagacctaatgtgtcatgcaacattcacaatgcggctacttagtcccgtacgtgtgccaaactataatatgataataatggatgaggcacatttcactgatccgtcttcaattgcagctagaggatatataagtacgcgtgtgggaatgggcgaagctgctgcaatctttatgacagcaactccgcccggatccgtcgaagcgtttcctcagagtaatgcagtaatccaggatgaggagagagatattccggaaaggtcttggaatagtggctacgaatggataactgacttcccagggaagacagtttggttcgtaccatctatcaaatcagggaatgacatagctaactgtttaaggaaaaacgggaaacgcgtaattcaattatcgcgaaaaacgtttgacacggagtatcagaaaaccaaaaataatgactgggactacgtagtcacaacagacataagtgaaatgggtgcaaattttagagctgatagggtaattgacccaaggagatgcttaaaacccgtgatattaaaggacggccctgaacgcgtgatattagcaggaccgatgcctgtaactgtagccagtgctgcacaacgtagagggaggattggtcggaaccataacaaagaaggagatcaatacatatacatgggtcaaccgttaaataacgacgaagatcacgctcactggactgaggcaaaaatgttattagataatattaatacccccgaaggaatcatccctgcactatttgaaccggaacgagaaaaatctgcagcgattgatggagaatatcggttacggggagaggcaagaaagacatttgtagaactaatgcgaagaggagatttgccagtttggctatcctataaagttgctagtgaaggatttcaatattccgaccgcagatggtgttttgatggagaaaggaataaccaagtactagaagaaaacatggatgtagaaatatggactaaagaaggcgaacgtaagaagttacgacccagatggctcgacgcacgaacttattccgaccctttagcgctgcgtgaatttaaagaatttgctgccgggagacgcagtgtctctggagacttgatactcgaaatcggcaaattgccacaacatctaacccaaagggcacaaaatgcattagataacttagtcatgttacacaattcggaacagggaggacgggcatatcgccacgcaatggaagaattaccagatacaatcgaaacgttgatgcttcttgcactaatagcagttttaactgggggtgtaacgcttttctttttgtctggtcgtggattagggaaaacgtcgataggcttattgtgtgtcatggccagttctgtgctactctggatggccagcgtagaaccccactggatcgccgcaagtataatacttgagttctttctaatggtactattgatacctgaacctgataggcagcgaactccccaagacaatcagttagcctacgtagtaataggtttattgtttatgattttaaccgtagcagccaacgaaatgggcttactagaaacaacaaagaaagaccttggcataggtcacgtagcagttgaaaatcatcatcacgcagcaatgttggacgttgaccttcatccggcttcagcctggacactatatgccgtagccaccacaatcataactcccatgatgcgccacacgatagaaaacacaacggctaatatttcactcacggccattgctaatcaagcggcgattttaatgggattagacaaaggctggcccatatcaaaaatggatataggcgttccactattagctctcggctgctacagtcaagtgaatcccttaaccttaacggccgctgtactgatgttggttgcacactatgcaattattggccctggcctacaggcgaaagccaccagggaagctcaaaaacgaacagctgccggaataatgaagaatcccacagttgatggaattgtcgcaatagacttagatccagtagtatacgacgcgaaattcgaaaaacagttgggtcaaattatgctactaatattgtgcacgtcacaaatcttgttgatgcgaaccacctgggccctatgcgaaagcattacacttgccacagggccattaaccactttatgggaaggtagcccaggaaaattttggaatactaccattgctgtcagcatggctaatatcttcagagggtcttacttagccggagcggggcttgctttttcactgatgaagtcattaggaggaggtagaaggggtacaggcgctcaaggtgaaacactgggggaaaagtggaagaggcaactaaatcaactgtctaaaagtgagttcaatacctacaaaagatcaggaatcatggaagtagaccggtctgaagcaaaagaaggtctcaagaggggagaaacaaccaaacacgctgtatctcgtggaactgcaaaacttaggtggtttgtagaaagaaatctggtaaaaccagaaggcaaggttatagatttaggctgtgggagagggggttggtcatattactgtgctggactaaagaaagttacggaggttaaaggatacacaaaaggtggtccaggccacgaagaaccaatacccatggcaacgtatggatggaacttagtgaaactacatagcggtaaagatgtattctttatcccaccagaaaaatgcgacacacttctttgcgacataggagagtcgagcccgaatcctacgattgaagaaggacgcaccctaagagtacttaaaatggtagaaccatggctccgaggcaatcaattttgcataaagattctgaatccatacatgccaagtgttgttgaaaccctcgaacagatgcaaagaaaacatggcggaatgttagtgaggaatcctctctctagaaacagtactcatgaaatgtattgggtatcatgtggcaccggaaacatagtatcagcagttaacatgacatcacgtatgctgttaaataggtttacgatggcacatcgtaaaccaacatacgaacgtgatgtagacctgggtgcaggaacaagacatgtggctgttgaacctgaagttgcaaatttagatatcataggtcaaagaattgaaaacataaaacatgagcacaaatcgacatggcattatgacgaagacaatccttataaaacatgggcatatcatggatcctatgaagttaagccgtccggctcggcatcatcaatggtcaatggagttgtgaagctcctcactaaaccttgggatgtaataccaatggtaacgcagatagccatgacggacaccactccatttgggcaacaaagagtatttaaagaaaaggttgatacgagaactccaaaggctaagagaggaactgctcaaataatggaagtcactgctaaatggctatggggattcctatcaagaaataagaaaccaagaatctgtacaagggaagagttcacaagaaaggtgagaagtaacgcagcaataggagcggttttcgttgacgagaatcaatggaactcggcaaaggaggctgtagaagatgagcgtttctgggacttagtacacagggaaagggaattacacaaacaagggaaatgtgccacgtgcgtttataatatgatggggaaaagagagaagaaattaggagagttcggtaaagcaaaaggaagtagggcaatttggtacatgtggcttggtgcaagatttttggagttcgaggctttagggtttatgaacgaagaccattggtttagtcgggaaaattcactatcaggcgtggaaggtgaaggattacataaactaggatacatattgcgcgacatatcaaaaataccaggtggaaacatgtacgcagacgacactgccggctgggatacccgaataacagaggacgatctacaaaacgaagctaaaataactgatattatggagccggaacatgctttactggctaaaagcatttttaagttaacataccaaaataaagttgttagagtccagcgcccggtcaaaaatggtactgtaatggacgtaatatctagacgagaccaacgcggatctggacaggtaggaacctatggcttaaatacttttacgaacatggaggcccaattgataagacaaatggaatccgagggaatctttagcccatccgaattagaaactcctaatcttgcaggtagagtcctagactggctggaaaaacacggtgtagagcgtttgaagcgtatggcaatttcgggagacgactgcgttgtaaagcctattgacgacagatttgcaacagccctcacagctttgaatgacatgggtaaagtaaggaaagacatcccacaatgggaaccaagtaaaggctggaatgattggcaacaagtgcctttctgctctcaccacttccatcaactaataatgaaagacggtagagagatagtggtgccatgtagaaaccaagatgagcttgttggtagggctagagtaagccagggagcaggatggtcactaagagaaacagcttgtttgggaaagtcgtatgctcagatgtggcagctcatgtattttcatcgaagggatttacgactagctgctaatgctatatgcagtgctgtccccgtggactgggtacctacatctagaacaacttggtcgatccacgcccatcatcaatggatgacaaccgaagatatgttgagcgtatggaatcgggtttggatagaagaaaatccatggatggaagataaaacacatattagttcctggggagacgtgccatatcttggtaaaagagaagatcaatggtgcggttcgttgattgggctcacagcaagggcgacttgggcaactaatattcaagttgccatcaaccaagtgaggagattaataggaaatgaaaattacctagactatatgacctcaatgaaacgttttaagaacgagtcggatcccgaaggtgctttgtggtag

SEQ ID NO: 21184 - RNA, 9879 nt, synthetic construct
  misc_feature 1..9879: note = derived and/or modified CDS sequence (opt6) from DENV-1__FJ639675__SS-prME
  source 1..9879: mol_type = other RNA
agcgttaccatgctccttatgctcatgcctacagctttagcgtttcaccttaccacgaggggaggcgaaccacacatgattgttagtaaacaagaaagaggtaaatcactcttatttaaaacaagcgcaggggttaatatgtgcacgttaatcgctatggatctcggagaattttgtgaagatacgatgacttacaaatgtccacgtataacagaagcagaacctgacgacgttgactgttggtgcaacgcaacagatacatgggtgacatacggtacatgtagtcaaacaggagaacatagacgagataaaagatcagttgcactggcaccacacgttggacttggcttagaaactagaacagaaacatggatgagtagtgaaggagcgtggaaacagattcaaagggtggaaacatgggcacttagacaccccggattcacagtcattgcactttttcttgctcatgctatcggtacatcaataacacaaaaaggcataatttttatcctgttaatgttggtaactccgtctatggcaatgagatgtgtcggcattggctctcgtgacttcgtagaaggcttatcgggagcaacgtgggttgatgtggtcttggaacacggttcatgtgtaacaacaatggctaaagataaaccaactttagatatagaactattgaaaacagaagtaaccaatccagcagttctaaggaaattatgtattgaggccaaaatatccaatacaaccacagatagtcgatgtccgacgcaaggtgaggcgactcttgtagaggaacaagatgctaactttgtatgtagacgtacatttgttgataggggatggggcaatggatgcggacttttcggcaaaggatctctgatcacatgcgcaaaattcaaatgtgtaacaaaattagagggaaaaatagtacaatacgaaaaccttaaatatagtgttattgtgactgttcatacaggggatcaacatcaagtaggaaatgaaagtactgaacatgggacaactgctacaatcacgccacaagcccccagtaccgagatccaactgaccgactacggagctctaacactagattgcagcccaagaacagggttagattttaacgagatggtactattaacaatgaaagagaaatcttggctagtccataaacaatggtttttagatctcccactaccctggacttcaggagcatctacttcccaagaaacatggaacaggcaagatctattagtaaccttcaaaactgcgcacgccaagaaacaggaagttgtagttttaggatctcaagaaggagccatgcataccgcactaactggtgccactgaaatacaaacttctgggaccaccacaatattcgcaggacatttaaaatgtcgactgaaaatggacaaacttactcttaaaggcatgtcgtatgttatgtgcacgggattattcaaactagaaaaagaagtagcggagactcaacatggtaccgtattagtacagatcaaatacgagggtacggatgcgccgtgcaaaataccgttctcgactcaggatgaaaaaggtgtaacacaaaatgggcggttaataactgcaaatccgatagtaacggataaagagaaacctgtaaatatagaagctgaacccccattcggagaaagttatatagtaattggagccggtgaaaaagcgttaaaattatcatggtttaagaaaggatcaagtataggcaaaatgttcgaagctactgcgagaggggcacgacgaatggcaatactaggtgatacggcttgggacttcggttctataggcggggttttcacctccgtaggaaaactggtacatcaaatattcggaactgcctacggtgtccttttcagcggtgtatcgtggacgatgaaaataggaatcggagtgctactcacatggttaggactcaatagcaggagtacttctctatcaatgacatgtatcgctgtaggcttagtaacgctatacttaggggtgatggtccaagcggattcgggatgtgtaatcaattggaaaggcagagagctaaaatgcggatctggaatttttgtcacaaacgaagtgcatacatggaccgaacaatacaagttccaagccgatagtcctaaacgactatcttctgctataggcaaggcttgggaagaaggtgtatgtggaatccgtagtgcgactcgacttgaaaatatcatgtggaaacaaattagtaacgaattgaatcatattcttttagaaaatgacatgaaattcaccgtggtagtaggtgacgttgcaggaatcctcgcacagggcaagaaaatgataagaccccaacccatggaatataagtattcctggaaatcttggggaaaggcaaaaataataggagcagatgtccaaaacacaacttttattatagatggacctaatacccctgagtgtcctgatgatcagagagcgtggaatatttgggaagtagaagattacggttttggtatattcacaaccaacatttggttaaagttacgcgacagctatacccaagtctgtgaccataggctaatgtctgcagcgatcaaagactcaaaagctgtacacgccgacatgggttactggatagaaagtgagaaaaacgaaacctggaagctagcacgtgctagttttattgaggttaaaacatgcatttggccaaagtcacatacactctggagtaacggagtcttagagtccgaaatgatcatacccaagatctatggtgggcctatttctcagcataattaccgaccaggttatttcactcaaacagcaggaccgtggcacctaggaaaattagagctcgactttgacttgtgcgaaggtaccacagtggtggtcgacgaacattgtggtaacaggggcccatcactcagaactacaacggttacaggaaaaataatacatgaatggtgctgtcgaagttgtacattgccaccacttcgatttaagggtgaagatggttgctggtatggaatggaaataaggccagtaaaagaaaaagaagaaaatctcgtaaagtccatggtctccgcagggtcaggggaagtcgattcattctcacttggactattatgcatctcgataatgatcgaagaagttatgcggtcaagatggagtaggaagatgttgatgacagggacactcgcagtatttttcttgctgattatgggacagctaacttggaatgatttgatacgattatgtataatggtgggggctaacgcatccgataggatgggaatgggaatgacgtatctcgcgttaatggctaccttcaaaatgcgacccatgtttgcggtaggcttactctttcgaaggttgacctctcgggaagtattgctactaaccataggattatctcttgtcgccagtgtggaattacccaatagtctggaagaactcggtgatggattagcaatgggaataatgatacttaagctattgaccgatttccagagccaccaactttgggcgactcttctatctttaactttcataaaaacgacgttttcacttcattacgcatggaaaaccatggcaatggtgctatcgatagtatcattgtttccgttatgtttgtctacgacatcacagaaaactacatggctacctgtcttactaggatcattaggatgcaagccgttaacaatgttcttgattgccgaaaacaaaatatggggtcgaaaatcttggccactaaatgaaggaataatggcagtaggcatcgtcagtattttattatcatcacttcttaaaaatgacgtacctttggctgggccgttaattgccggtggaatgttgatagcatgttacgttataagcggtagttccgcagacttatcgcttgagaaggcagctgaagtatcgtgggaagaggaagcggagcactctggcgcttcacataatatcttagttgaggtgcaagatgatggaaccatgaagataaaggacgaagaacgggatgacacgcttactatactgttgaaagctacactactagcggtatctggggtttatccactaagtatcccagcaacgttattcgtgtggtacttctggcagaagaagaaacaacggtctggtgttctatgggatactccttcaccaccagaagtagagcgtgccgtattagatgatggtatttatagaataatgcaacgtgggttattaggaaggagtcaagtaggagtcggcgtcttccaagaaaacgtcttccataccatgtggcacgtcactagaggggccgtcctgatgtatcaaggaaagcgtcttgaaccgagttgggcctctgtgaagaaagatctaatcagttacggaggaggatggaggttgcaaggttcatggaatacaggagaagaagtacaagttatcgcagtagaaccggggaaaaatcctaaaaatgtacaaacagctcccggcacatttaaaacatccgaaggagaagtaggggccattgctttggacttcaaaccaggcaccagcgggagtccaatagtcaaccgagaaggaaaaatagtcggtctttatgggaatggagtagtcaccacaagtggtacttatgtctctgcgatagctcaggcgaaagctagtcaagaaggaccactaccagaaattgaggacgaagtgtttcgaaaacgaaacttgacaattatggatttacatccaggttcaggcaagaccagaagatatttacccgcaatagtcagagaggcgattaaacgtaaacttaggacgcttatcctggcgccaaccagagttgtagcctcggaaatggcagaagcactaaaaggtatgccaatcaggtatcagaccaccgcggttaaaagtgaacatacaggtaaagaaatcgtagatttaatgtgtcatgcaaccttcactatgcggctattgtctcccgtaagagtgccgaactacaatatgattatcatggatgaagctcattttactgacccatcaagtatagcggctagaggatacataagtacccgcgtagggatgggcgaggcagctgccatctttatgacagctaccccaccagggagcgtagaagcatttcctcaaagcaacgcagtcatacaggatgaggagcgagacatcccagaaaggagctggaacagtgggtatgagtggataaccgactttccaggaaagacagtatggttcgtaccttcgataaaatccggaaatgacatagccaattgtctcaggaaaaacggaaaacgggtaatccagttatcgcgaaagacgttcgataccgaatatcagaaaactaaaaataacgactgggattatgtggtaacaacagacattagtgagatgggcgccaactttagagcagatagagtaatagaccccagaagatgccttaagcccgttattttaaaagacggaccggaaagagtgatattagcgggtccaatgccagtaaccgttgcatccgcagcacaacgtcgaggcagaataggacgtaaccataataaggaaggcgaccaatatatatacatggggcaaccgctgaataatgacgaagatcacgcacattggactgaagcgaagatgttgttagataatataaacaccccagaaggaataataccagctcttttcgagccggaaagagaaaaatcagccgcaatcgatggagagtaccgactaagaggggaagcaagaaaaacatttgtagaattaatgcgaagaggagacctgcctgtttggctctcttataaagtagcttcagaaggtttccaatatagtgatagaagatggtgtttcgacggtgaaagaaataaccaagtgttagaagaaaatatggacgtagagatttggacaaaggaaggagaacggaagaaattaagaccgcggtggttagacgcacggacttatagtgatccattagccctacgggaatttaaagaatttgcagcaggaaggagatccgtctcaggggatcttatcctcgaaattggaaaacttccacaacacctgactcagcgtgcgcagaacgcgttggacaacctagtaatgctgcacaactccgagcaagggggacgagcatatcgacacgcaatggaagaattgcctgatactatagaaactctgatgcttttagcgcttatagccgtgttaacagggggagtgacactattctttctgtctggaagaggacttggcaaaacttctataggactactatgtgtgatggcatcatctgtattgctctggatggcgtctgtcgaaccccattggattgctgcttcaatcatactagagtttttcctgatggtattgctcataccagagcccgacaggcaaagaactcctcaagataaccaattagcctacgtcgtaatcggtttgctctttatgattttaacagtggccgccaacgagatgggactactagagacaactaagaaagacttaggcataggacatgttgcagttgaaaatcatcaccatgcggcaatgttagatgtagatctacatccagcgagtgcatggaccctgtatgctgtggccacgacaataataacgcccatgatgagacatacaatcgagaacacgacagcaaatattagtctaacagcgatagcaaaccaagcagcaatcctaatggggttagataaagggtggccaatttccaagatggatataggcgtacctctactagccttgggctgttatagtcaggtgaatcctctcactttaacggccgcagtcctgatgttggtagctcactatgcaataatcggaccaggacttcaagctaaagcaacaagagaggctcaaaagaggacagcggcgggcataatgaaaaatcctacagtagatgggatagttgccattgatctcgaccctgttgtatacgatgcgaaatttgaaaaacaacttggccagataatgcttctcatactatgcaccagtcaaatattgctgatgcgaactacttgggcattatgtgagtcgataactttagcgaccgggcccttaacaacgctctgggaaggttcaccgggaaaattttggaacacaacaattgcagtatcaatggcaaacatctttaggggtagttatttagcaggagcggggctcgcatttagtttaatgaagtcactaggaggaggtcgcaggggtaccggagcgcaaggagaaacactaggagagaaatggaaaaggcagttaaaccaattgagcaaatcagaatttaatacttacaaaaggtcgggtattatggaagtcgacagatccgaggccaaggagggtcttaagagaggcgagacaaccaaacacgcggtaagcagaggcacagcgaagttgcgctggtttgtggaaagaaatctagtaaagccagagggtaaagttatagatttgggatgtggaagaggaggctggtcgtactactgcgcaggacttaaaaaggttacagaagtgaagggatatactaaaggaggtcctggacatgaggaaccaataccaatggccacctacggatggaacttagtaaagttacacagtggcaaagacgtattctttatcccaccagaaaaatgcgatacgttactgtgtgatattggtgaaagtagtccaaaccctacaatagaagagggtcggacactaagagtactaaaaatggtagaaccttggttgcggggaaatcagttttgtataaaaattcttaatccgtacatgccatctgttgttgaaacgcttgaacaaatgcagagaaagcatgggggcatgttagttaggaatccattatcaagaaattcaactcacgagatgtactgggtgagttgcggtaccggtaacatagtttccgccgtcaacatgacctctcgaatgttattgaaccgatttaccatggcacataggaaaccaacttacgaaagagacgtggatcttggtgctggaacaaggcatgtagcagtcgaacccgaggtagctaacctagacattataggtcagcgcattgaaaatataaaacacgaacacaaaagtacatggcattacgatgaagacaatccgtataagacatgggcctatcacgggtcttacgaagtaaaaccatcaggatctgcatcttccatggtaaacggtgtggtcaaactcttaaccaaaccttgggacgtcattccaatggtaacgcaaatagccatgacagatacaaccccttttggccaacaacgagtgttcaaggaaaaagtagatacgagaacaccaaaagcaaagcggggtactgcacaaataatggaagttacggccaagtggctttggggtttccttagtcgaaataagaaacccaggatttgcacaagagaggagttcactagaaaagtaagatcaaatgccgcaataggggcagtattcgttgatgaaaatcaatggaacagtgcgaaagaagctgtagaggatgaacgattctgggacctcgtacatcgagagcgtgaactacataagcagggtaaatgcgcgacatgcgtatacaacatgatgggtaaaagagagaagaaactaggtgagttcggtaaggctaaagggagtagagcaatctggtacatgtggttaggcgcacgctttttggagttcgaggcattaggctttatgaatgaagatcattggttttcgagagaaaatagcttatccggagtagaaggcgagggcctccataaactaggttatatattacgtgacatttccaaaattcctggagggaatatgtatgctgatgataccgccggatgggacacacgaatcacagaagatgaccttcaaaacgaagccaagataactgacataatggaacctgaacatgctctgttagcgaaatcaatctttaaactcacatatcaaaataaagttgtccgagtgcaacggccagccaagaacggcaccgttatggatgtgattagcaggcgagaccaacggggaagtggccaggtaggaacttatggattaaacacctttacaaatatggaagcccaactaataagacaaatggagagtgagggcatattcagcccgagtgagctcgaaactccgaatttagcagaaagagttcttgattggttagaaaaacatggcgtagagaggttaaaaagaatggcaatatccggagacgattgtgtagtaaaacctatagatgacagatttgctacagcgttaacagcattaaatgatatgggaaaggttagaaaagatattccccaatgggaacctagtaaaggatggaatgactggcaacaagtgccattttgcagtcaccattttcaccagttaattatgaaggacggaagggaaatagtggtgccatgtagaaaccaggacgagctagtaggacgcgcaagggtgtcccaaggagctggatggagcttaagagaaacagcttgtctcggcaaaagttacgcacaaatgtggcagctcatgtatttccatcgtcgcgacttaagactagcagcaaatgcgatatgttcagcggtgccggttgattgggtcccaacaagtcgaactacatggagtattcatgcgcaccaccaatggatgacaacagaagatatgctgtcagtatggaatcgtgtttggatcgaagaaaacccgtggatggaagataaaacccacattagcagttggggagacgtaccatatctaggcaaaagagaagaccaatggtgtggatctttaatcggtttgactgcacgggctacttgggctacaaatatacaagtcgctatcaaccaagttagaagattgattggaaacgagaactatttagattatatgacgagtatgaaaagatttaagaacgaaagcgacccggaaggggcattatggtaa

SEQ ID NO: 21185 - RNA, 9879 nt, synthetic construct
  misc_feature 1..9879: note = derived and/or modified CDS sequence (opt6) from DENV-1__FJ639676__SS-prME
  source 1..9879: mol_type = other RNA
agcgtgactatgcttcttatgttaatgccaacggcacttgcatttcacctaactacccggggtggggaacctcacatgatagtgtccaaacaagaaaggggaaaaagtttacttttcaaaacctcggccggggttaatatgtgcacactaattgcaatggaccttggtgaactctgtgaggacacgatgacatacaaatgtccacgcatcacagaagtggaacctgacgatgtagattgttggtgcaatactacagatacctgggtgacatatggaacttgttcacaaacgggagaacatagaagagacaaaaggtccgtagcattggctccacacgcaggactaggactagaaaccagagctgaaacttggatgtcaagtgaaggtgcttggaaacaaattcaacgagtagaaacatgggcactaagacatcccgggttcacagtgattgcgctgtttttggctcacgttattgggaccagcataacccaaaaaggaattatatttattctcctaatgcttgtgactccttctatggctatgagatgtgttggaatagggtctcgagactttgtagaagggttgagtggagcaacttgggttgatgttgttctagaacatggatcatgtgtaacgacaatggctaaagataaaccaactttagatatagagttattaaaaaccgaagtcactaacccagcagtactacgtaaactatgcattgaagctaaaatttctaacacaaccacggacagtcgctgccctactcaaggtgaagcaactttggtggaagaacaagatgcgaactttgtctgtaggcgtacatttgtggatagaggttggggaaatggatgcggactattcgggaaaggatccctaataacttgtgccaaatttaaatgcgtcacgaaactagaaggaaaaattgtacaatacgaaaacctaaaatactcggttatcgtaacagttcatacgggtgatcaacaccaagtcggtaacgagtctacagagcatggaacgacagccaccatcacaccccaggcaccaacaagtgaaattcaactcacagattacggagccctgacattagactgctcaccaaggacaggacttgatttcaacgaaatggtactacttactatgaaggaaaagagctggcttgttcacaagcaatggtttttagatttaccattaccttggacatcgggcgccagtacgagtcaagagacttggaacagacaagatttattggtaacgtttaaaacagcacatgcgaagaaacaagaggtagtagtattggggagtcaagagggcgcaatgcataccgctctcactggggcaactgagattcagacatctggaaccactacgatattcgcgggccacctgaaatgtaggctgaaaatggataagctgacgcttaagggaatgagttatgtgatgtgtactggaagttttaagctagagaaagaggtcgcagaaactcaacatggaacggtattagttcaaatcaaatacgagggaactgacgccccttgtaagattcctttctcaactcaggacgaaaaaggggttactcaaaatggtagattgatcacagctaatcctatagtaaccgataaagaaaaacccgttaacatagaggcagaaccaccattcggtgaaagttatatagtgattggagctggagaaaaagcgctcaaactgtcctggttcaagaaagggagttctattgggaaaatgtttgaagcaacagctcgtggtgcccgtagaatggccatacttggagatacggcatgggatttcgggtccatcggtggagtgttcaccagtgtaggtaagttagtacatcaaatcttcggaacagcctatggagtactcttctctggagtgagttggaccatgaagataggtatcggagttctattaacctggttaggacttaattcacgatcgacttcattaagtatgacatgtattgccgtaggcctagttacattatacttaggagtaatggtgcaagctgatagtgggtgtgttataaattggaaaggtcgtgaactaaaatgcggttcaggaatcttcgtgacgaacgaagttcacacctggacagagcaatataaatttcaagctgactctccaaaaagattatctgctgcaattgggaaggcttgggaagaaggagtatgcgggatacgatccgcaacccggttagaaaacattatgtggagacaaatcagtaacgaactcaatcatatactattggagaatgacatgaagttcacggtagttgtaggagatgttgtaggtattctagcacaaggcaagaaaatgattagaccccaaccaatggaacacaaatacagctggaaatcctgggggaaagcgaaaataataggcgctgatgtccaaaacacgacattcattattgacggacccaacacaccagagtgtccagatgaccaaagagcatggaatatatgggaagttgaggattacggattcgggatattcactacgaatatatggctgaaattaagagacagttacacccaggtctgcgaccatcgcttaatgagtgctgccataaaagattctaaagcggtccatgcagatatgggttattggattgagagcgagaaaaatgaaacttggaaactggcaagagcgtctttcatagaggttaaaacttgtatttggccaaagagccacacactatggagcaacggagtactagagtctgaaatgatcatccccaagatctacggtgggccaataagtcaacataactaccgacctggatattttacacagacagcgggtccgtggcacctcggaaaactagaattagactttgacttatgcgagggaactacagtagtcgtcgacgagcattgcggcaaccgtgggccatctttgagaacaacaacggttaccggaaaaatcatccatgaatggtgttgcagaagttgcacactaccacccttgcgattcaaaggtgaagatggctgttggtacggaatggagataagaccagtaaaagagaaggaggaaaatctcgtgaaatcaatggtaagcgcaggatccggcgaagtcgattcatttagtctaggattactctgcatcagcataatgatagaggaggtaatgcgctcaagatggtctcggaaaatgcttatgaccgggactctagcggtgttcttcctcttaatagtaggacagttaacgtggaatgacttaatccgattatgcataatggtaggcgcaaacgcgagtgaccgaatggggatgggtacaacatacttagctctaatggcaacttttaagatgagaccaatgttcgcggtgggattattgttccgtagattaacctcacgcgaagtccttttattaacaatcggtttatccttggtcgcttcagttgaattgcccaattccctagaagaactcggagatggtctagcaatgggtatcatgattctaaagttactaacggactttcaatcctatcagttatgggcaactctcttatcactgacttttataaaaaccacgttctcattacattatgcatggaagacgatggccatggttttatctattgtgtcgttgttaccactttgtctatctactacgagtcagaaaactacatggctaccagtcttattgggatctctcggatgtaaacccttaacaatgttctttattgcggaaaataaaatctgggggaggaaatcgtggcccttaaacgaaggaataatggcagtaggaattgtttcgatcctactgagttccctattgaaaaacgatgtaccacttgctggcccccttatagcaggaggcatgttaatagcttgctacgtcataagtggatcttcagctgacctatcattagaaaaagcagcagaggtttcctgggaagaagaagcagaacacagcggagcaagccataatatactggttgaggtgcaggatgatggcacaatgaaaatcaaggacgaagaacgcgatgacacattgacaatcctgctgaaagcaacgttactggcggtcagcggcgtctaccctctttccattcctgcaacattgtttgtctggtatttctggcagaagaagaaacaacgcagcggtgtactatgggatacgccaagtccgcctgaagtcgagagagctgtactagatgacggtatctaccgaatcatgcaacggggattgttgggacgttcccaagtcggagttggggtattccaagagaacgtgttccatacaatgtggcacgtaacaagaggtgctgttttgatgtatcaaggcaaaagactagagccatcttgggcctctgtaaagaaagacctaatcagctatgggggaggttggagattgcaaggtagttggaatacaggagaagaagttcaggtgatagcagtcgaaccagggaaaaatcccaaaaatgtacaaacagccccaggaaccttcaaaacgcctgaaggagaagtaggggcaatagctttagattttaaaccgggaacgagcggtagcccgattgttaatcgagagggaaaaattgtcggcttatatggtaatggagtggttactacatcaggcacgtacgtatcagctatagcacaggcaaaagccagtcaagaaggaccattacctgaaattgaagatgaagtctttcgtaagcgtaatttaacaataatggatttacacccaggatccgggaagacacgcagatacctacctgccatcgtaagggaggcgattaaacgcaagctacgcactcttatccttgctcctacccgagttgtggccagtgagatggctgaagccctgaaaggaatgccaatcagataccaaaccacggctgtgaagtcagaacataccggaagggaaattgtggacctgatgtgccacgctacatttacgatgcgactactatcgccagtgagagttccgaattacaatatgataataatggacgaagcacattttactgacccatcatccatagccgctcgaggctatatcagcacacgagtcggcatgggagaagcggcagccatttttatgactgctacacccccaggcagcgttgaagcatttcctcaatctaacgcggtcatacaggatgaagaacgagacattcctgaacgcagctggaactctggttatgaatggataacagattttccaggtaagacagtatggtttgtcccaagtataaaatctgggaatgacatcgcgaattgcttacgaaagaatggcaaacgtgtaattcaactaagcaggaaaacatttgatactgagtaccagaaaaccaagaataacgactgggattatgtagtaactactgatatatcagaaatgggtgctaacttccgtgctgacagagtgatagatcctagaaggtgtctcaagccagtgattctcaaagatggtccagaaagagttatactcgcagggccaatgccagtaacagtcgcaagcgctgcccagcgacgtggcagaatagggagaaaccacaacaaagaaggagatcaatacatatatatgggacagccactaaataatgatgaggaccacgcacattggaccgaggctaaaatgttactagataatatcaacacacctgaagggattatacctgccctgtttgaaccagaacgcgaaaaatccgccgcaatagacggagagtacagattacgaggtgaagcccgaaaaacattcgtcgagttaatgagaagaggtgatctccctgtttggctatcctataaagtagcgtcagaaggctttcaatacagtgatcgcagatggtgttttgatggcgagcggaacaatcaagtattggaagaaaatatggacgtggaaatctggacgaaggaaggagaaaggaagaaactacgtcctcgttggttagatgcaagaacctattctgaccctcttgccttacgtgagttcaaagaatttgcagccggacgtagaagcataagtggagatttaatactggaaataggtaaactaccacagcatctaacacagcgcgcgcagaatgcactagataacttagtaatgcttcacaattcagaacagggagggagagcatatagacacgcaatggaagaactacctgacacaatagaaacactaatgctgttagccctcatagcagtattaacaggaggcgtaaccctcttctttttgtccgggcgaggattgggtaaaacaagtataggcctactatgtgttatggcgtcttcagccctattatggatggctagcgtggagccgcattggattgctgcgtcgattatacttgaatttttcttaatggtcctattaataccagaacccgaccgacaaagaactccgcaggacaatcagctcgcatatgtggtaatcggattattatttatgattctcactgtggcggcaaatgaaatgggattattagaaaccacaaagaaagacctcggtataggacatgtagccgtagaaaaccatcatcatgcaactatgcttgacgtagacttgcacccagcaagcgcgtggacgttatacgcagttgcaacaacaataataacgcctatgatgcgacacacaatcgaaaacacaactgcaaatatttctttaacagccattgcaaaccaggctgcaatcttaatgggactcgacaaaggctggccaataagtaaaatggatattggtgtaccgttattagctttagggtgttacagccaagtaaatccactaaccctaacagctgcagtcctgatgttggtagcacactacgcaataatagggccaggattacaagctaaagcgaccagagaagctcagaaaagaactgccgctggaataatgaaaaacccaacagtagatggaatagttgcgatagatttggatcctgtggtgtacgatgcaaaattcgaaaaacaacttgggcaaatcatgctcttaattttatgtacttcccaaatcttgctaatgagaaccacctgggccttatgcgaaagcatcactcttgcaacggggccactaactacgttatgggaagggagtccaggaaagttctggaacactacaattgctgtgagtatggcaaacattttccgaggaagttatctcgcgggagcgggtctagcgttttcactcatgaaatcactagggggaggaagaagaggtactggcgcacaaggagaaactctaggcgaaaaatggaaacgacagctgaaccaactctccaaatcagaatttaacacatacaagagatctggcatattagaggttgatcgaagtgaggcaaaagaaggcctaaggcgaggagaaacgacgaaacatgcagtatcaagaggaacggctaagctaaggtggtttgtagaaagaaacctagtaaaaccagaaggaaaagttatagatctaggatgtggtcgagggggctggtcttactattgtgctggtcttaaaaaggtgacagaagtcaagggatataccaaaggtgggcccgggcatgaagaaccaatacctatggcaacctatgggtggaacctcgtgaaactacatagtggaaaagatgtgtttttcataccccctgaaaaatgtgacactctactgtgcgatataggagagtcctctccgaatccaaccattgaagaaggaagaacactacgtgttttaaagatggttgagccttggttacgcggaaatcaattttgtattaaaatattaaatccttatatgcctagtgtggttgaaacactcgagcagatgcaaagaaaacacggaggaatgctagttagaaatccgttgtcaaggaatagcacccatgagatgtattgggtttcatgcggtactggaaacatagtctcagcagtcaatatgacaagtagaatgctcttgaacagattcaccatggcgcatcgaaaaccaacatacgaacgagacgtagacttaggagccggcaccagacacgtagccgtagaaccagaagtagcaaacttagacataataggacagcgcattgaaaacataaaacacgaacacaaatcgacatggcactatgatgaagataatccttataagacatgggcctatcacggtagctatgaggttaagccaagtggatcagcatcaagtatggttaatggtgtagtaaaactactgacaaaaccgtgggatgtaataccgatggttacccagatcgcaatgacggacacgaccccattcggccagcagagagttttcaaagaaaaagttgacaccagaacaccaaaagcaaaaagggggaccgcacaaatcatggaagtaacagctaggtggctatggggctttttaagtagaaacaagaaaccgagaatatgtacgagagaagaatttaccagaaaagtacgaagtaatgccgcaataggtgcggtattcgtggatgaaaatcaatggaactccgcaaaagaagcggtagaggatgaacggttttgggacctagtacaccgtgaaagggagttacacaaacaggggaagtgcgcgacatgtgtttataacatgatgggaaagcgggagaagaaactcggagaatttggaaaagcaaaaggatccagagcaatatggtatatgtggttaggagccagatttcttgagtttgaagctcttggattcatgaatgaagaccactggttcagcagagaaaacagcttaagcggagtggaaggagaaggcttacataaattaggctacatactccgagatattagtaaaatacccggtggaaacatgtacgcagacgacactgccggttgggacacacgaataacagaagacgaccttcagaatgaagcaaaaattacggacatcatggaacccgaacatgcacttctggcgactagcatatttaaattaacgtatcaaaacaaagtggtaagggtccaaaggccagctaaaaatggcacagtaatggatgtaatcagtaggcgcgatcaacggggaagtggtcaagtaggcacatacggcctcaatacctttactaacatggaggcccaactgataagacaaatggagtcagagggaatattttcccctagtgaattagaaaccccaaacctagccgaaagagtgttagactggttagaaaaatacggagttgaacgattgaagcggatggcgatatccggtgatgactgtgtagtaaaaccgatcgatgacagatttgcaacagcgctaactgcactcaacgacatggggaaagttagaaaagacataccgcaatgggaacctagtaaaggatggaatgattggcagcaggtaccattctgtagtcatcacttccatcagttgataatgaaagacgggagagaaattgtcgtaccttgccggaatcaagatgagctagtagggcgtgcacgtgtctcacagggtgcaggttggagcctgagggaaactgcttgtctaggcaaatcatacgcgcaaatgtggcaattaatgtactttcataggcgagacctacgattagcagccaatgctatctgtagcgccgtgccagttgattgggtgcccacctcacgtacaacctggagcatacatgcacatcatcaatggatgactacggaagatatgttatcagtatggaatcgagtatggatagaggagaatccctggatggaagataagactcacatcagctcgtgggaggacgtcccttatctaggcaaaagagaggatcaatggtgtggcagcttgataggcctaacagctcgtgcgacttgggcgaccaacattcaagttgcaatcaaccaggtacgtagactaataggaaatgagaattatctagatttcatgacttccatgaagagatttaagaatgaatctgatactgaaggagccttatggtaa

SEQ ID NO: 21186 - RNA, 9879 nt, synthetic construct
  misc_feature 1..9879: note = derived and/or modified CDS sequence (opt6) from DENV-1__FJ639677__SS-prME
  source 1..9879: mol_type = other RNA
tccgtcactatgctgctaatgctaatgcctacggctttagcttttcacctgaccactagagggggagaacctcacatgattgtttcaaaacaagaacgcggtaaatccttgctgttcaaaacctcggcaggagttaatatgtgtaccctcatcgctatggacttaggtgaactatgcgaagataccatgacttataaatgccctcgggtcactgaagctgaaccagacgatgtagactgttggtgtaatgcgactgacacgtgggttacttatggtacatgttctcaaaccggggagcacagaagagataaaaggagtgttgcgctagcaccacatgtaggtttaggtttggaaactagaactgaaacgtggatgtcatcagaaggagcttggaaacaaatacaacgagtcgaaacgtgggcacttcgccaccctgggtttactgtgatagcattattcttagcccatgctataggaactagcataacccaaaaaggaattatattcatattgctaatgttagtcaccccgagtatggctatgcgatgtgtcgggataggatcccgagactttgtagaaggactatcaggagcaacatgggttgatgtggtcttagaacatggttcctgcgttactacaatggccaaagataaaccgaccctagacatagaactcctaaaaaccgaggtaactaatcccgcagtacttaggaaactttgcatcgaagccaaaatatcaaataccactactgatagccgatgcccaacacaaggagaagctacgttagtggaagaacaagatgctaactttgtgtgtagaaggacgttcgttgacagaggctgggggaatggatgcggattatttggaaaaggaagtttgattacatgcgctaagttcaaatgtgtcactaaattagaaggcaaaatagtgcaatatgaaaatttaaaatattcagtcatagtaactgtccacacaggcgaccaacatcaagtaggaaatgaatctacagaacacggaacaacagctacaataactccacaagcgccaacaaccgagatccaactgacagactatggagcccttaccttagattgctccccacgtacaggattagactttaatgaaatggtactcttaacaatgaaagaaaaatcatggttggttcataagcaatggtttctggacttgccgttaccatggacaagtggagcgtcaacttctcaagaaacctggaatcgacaagaccttttggtcacctttaaaacggcacatgctaaaaagcaagaagtggtcgtacttggaagtcaagagggtgcgatgcacacagcgctaacaggtgcgactgagattcaaactagcgggacaacaaccattttcgctggacatttaaaatgcaggctaaaaatggataaacttactcttaaaggcatgtcttatgtcatgtgtacaggatcattcaagctcgaaaaggaagtagcagaaactcaacacggcaccgtacttgttcaaataaaatatgagggcacagatgcaccatgtaaaatacctttctcaactcaagatgagaaaggtgttacgcaaaatggtagactaataaccgcaaatccaatcgtgactgacaaggaaaaacctgtaaacatagaagcagagccaccatttggtgagagttatattgtaatcggggcgggggaaaaagcattgaaattgagctggtttaagaaaggtagctcaattggtaaaatgtttgaggcaacggccagaggggcccggagaatggcgatacttggcgacactgcatgggactttgggtcaatcggcggagtatttacaagtgttggcaagttggtacatcaaatattcggaactgcgtacggtgtattattttcaggcgtcagttggactatgaaaattggtattggtgtattactcacatggctaggtctgaactcaagaagtacaagcctttccatgacctgtatagcagtcggactggtaactctatacctgggagttatggtccaagctgattcaggatgtgtaatcaactggaaaggtagagaactaaaatgtggctcgggaatatttgtaacaaatgaggtacatacttggacagaacaatacaagttccaagcagatagcccaaaacgcctcagtgctgctataggcaaagcatgggaagaaggtgtttgcggtataagatcggcgactagactagaaaacataatgtggaagcaaataagtaatgaattaaaccatatccttctcgaaaatgatatgaaactaactgtagtagtcggagacgtggcaggaatcttggcccaaggcaaaaagatgataagaccacaaccgatggaatacaaatatagttggaaatcatggggaaaggccaagataatcggtgctgatgcacaaaatacgacatttattatagatggccccaatacgccagagtgcccagacgatcaacgagcttggaatatctgggaagttgaagattatggcttcggaattttcacgactaatatatggttgaagctacgtgactcttatactcaggtatgtgatcatagacttatgtctgccgccataaaagacagtaaagcggtacatgcagacatgggctattggatagaaagtgagaaaaatgagacgtggaaactagcgagagccagcttcatcgaagttaaaacctgcatttggccaaagtctcacaccctttggtcaaacggagtactggaatcagaaatgataatacccaaaatttatggtggacccatttcgcaacacaactatcgtccagggtattttactcagacggcaggaccatggcatctgggaaaactcgaactagacttcgacctatgtgaaggtactacggttgtggttgatgaacattgcggaaacagaggtcccagcttacgtacaacaaccgtcacaggaaaaattatacatgagtggtgttgccgttcctgcacccttccgcctttaagatttagaggcgaggacggatgttggtacggaatggaaataaggcccgtaaaggaaaaagaagagaacctagtgaaatctatggtcagcgccgggagtggcgaagtcgatagtttctctctgggcctgctctgtataagtattatgatagaagaagtcatgagatccagatggtcaagaaaaatgctgatgaccggaaccttagcagtgttcttcttactaatcatgggacaattaacatggaatgacctcattcgactgtgcattatggttggcgcgaacgcatcagaccgaatgggaatgggaacgacttacctcgctctaatggcaacgttcaaaatgagacccatgtttgccatggggcttcttttccgacgccttacttctagagaagttctcctgcttaccatagggttgagtctggtcgcatccgtagagctaccaaatagtctcgaagaattgggagacgggttagctatgggcattatgattttgaaattattaaccgatttccagtcacatcaattatgggctaccctcttatcgctgacgttcataaagaccacatttagtctccattatgcgtggaagacaatggctatggtactatcaattgtatcgctttttcccctatgcctatcaactacaagtcagaaaacgacatggctacccgtactcttgggttcactaggatgtaagccactaaccatgtttctgatagcagaaaataaaatatggggtaggaagtcttggccattaaacgagggaattatggcagtgggaatcgtaagcattctgttatcctctcttctgaaaaacgatgttcctttggcagggccactaatagcaggaggaatgcttatagcatgctacgtaataagcggatcatcagcagacctttcattggagaaagcggctgaagtatcttgggaggaagaagcagaacattcaggtgccagccacaatatactggtggaagtacaggacgatggaaccatgaagataaaagatgaagaacgcgatgacacactaacgatattattgaaagctacactacttgcagtgagtggagtatatccactatctattccggccacactttttgtatggtatttctggcagaagaagaaacagcggagcggcgtactctgggatactccgtcaccaccggaagtggaacgtgctgtgctagatgatgggatctatcgaataatgcagagaggtttactaggtcgatcacaagttggtgtgggtgtgttccaggaaaacgtgtttcacactatgtggcatgttactagaggggctgtactaatgtatcaaggtaaaagattagaaccaagttgggcttccgtaaagaaggatcttataagttacggcggcggctggcgacttaaaggctcatggaatacaggggaagaagttcaagtaattgcagtagaaccaggcaaaaatcctaaaaacgtccaaactgcacctggaacatttaaaacaccggagggagaagttggagccatcgcgctcgatttcaaaccaggtacttcaggtagccctatagtcaaccgagaaggtaaaatagttggcctatacggtaatggtgtggttaccacaagtggtacatacgtttcagcgattgcacaggctaaagcatcccaggaaggacctttgccggaaatagaggatgaggtatttagaaaaagaaacttaacgataatggacctacatcctggatctggaaaaacacgcagatacttaccagctatagtgagggaagcgattaagagaaaacttaggacattaatactggcaccaactcgagtagttgcctcagagatggctgaagcattgaaaggaatgcccataaggtatcaaaccactgccgttaaatctgagcacaccggaaaagagattgtggatctaatgtgccacgctacttttacaatgcgtttactaagccctgtacgagtaccgaactacaacatgattataatggatgaagcccattttacagacccgtcatctatagctgccagggggtatataagtaccagagtaggtatgggtgaagcggccgcaatttttatgactgctacaccacctggctcggtcgaagcatttccccaaagcaacgcagtaatacaagatgaggaaagagacatacctgagcgatcttggaactccggatatgaatggattaccgactttccaggaaagacagtatggtttgttcctagcattaaaagtggaaacgacatagcaaactgtttgcggaaaaatggtaaacgagtcatacaactttctaggaaaacgtttgacactgaatatcagaaaaccaagaataacgactgggattatgtcgttacaactgacattagcgaaatgggagcaaactttagggcagatcgagtaattgacccgaggcgatgtttgaaacctgtcattcttaaagatggccctgagagggtcattcttgcagggcccatgcctgtcacagtggccagtgctgcacaaagacgtggtcgtattggccggaatcacaataaagaaggtgatcaatacatatatatgggacaaccgttaaacaatgatgaagatcacgctcattggacagaagctaaaatgctattagacaatatcaacacacctgagggcataattccagctttatttgaaccggagcgagagaaaagcgcggcaatagatggagaatacagactacgcggagaagcgcggaaaactttcgtagaattaatgcgccgaggtgatctacccgtttggctttcatacaaagtcgctagtgaggggttccaatacagcgatcgaagatggtgctttgatggagaaagaaacaaccaagtactcgaagaaaacatggacgttgaaatttggacaaaagaaggtgaaaggaagaaattacgaccacgttggttagacgcgagaacttactcagatccactcgctctaagagaatttaaagagttcgctgcgggtcggagaagtgtgtctggtgacttgatattagagattggcaaattgccacaacatctaacccagagagcccaaaatgctttggacaaccttgttatgctccataactccgaacagggagggagagcctaccgacatgccatggaggaactaccagacactattgagacgttaatgttgctagcgctcatcgcagtattaactggcggtgtgacactatttttcctaagtggacgaggacttggcaaaacatccattggcttactatgtgtaatggctagttccgtgctgttgtggatggcatcagtggaaccccattggatcgcagccagcattattctagagtttttcctaatggtattactcatccctgaaccggatcggcagagaacaccccaagacaatcaattggcttatgtagttatcggactattgtttatgatattaacagtggcggcaaatgagatgggcctattagaaaccactaaaaaggatctaggtattggacacgtagctgtggaaaatcaccatcacgccgctatgttagacgtcgatcttcatcctgcttcagcttggactctctatgctgtggccaccacaattattactccgatgatgagacatactatagaaaatactacggcaaatatatcgctcacagcaatagccaatcaggccgctattttaatgggtttggacaagggctggcccataagcaagatggacataggagtaccattactggctttggggtgctactctcaggttaacccactaacattgacagctgccgttctaatgttagtggcacactacgcaattataggacctggactgcaggccaaagcgacacgcgaggctcagaagagaactgcagctggaataatgaaaaatccaacagttgatggaatcgtggcaatagatttagatccagtggtttatgatgcaaaattcgaaaaacaactaggacaaataatgttgttaatattatgcacaagtcagattctcttaatgaggacaacatgggccctgtgcgaatctataactcttgcaacaggaccattaacaaccttatgggagggatcacctggtaaattttggaacacgactattgcagtcagcatggctaatatatttaggggatcttaccttgctggggcgggattagcattcagcctaatgaaaagcctagggggtggtagacgcggcacgggggcgcaaggagaaacattaggagaaaaatggaagcgtcaactaaatcaattgtcgaagagtgagttcaatacatataaaaggtcaggtattatggaagtagatagatcagaagcaaaagaaggattaaaacggggcgaaacgaccaaacacgcagtgagtcgaggaacggcaaaattacgatggttcgtcgaaagaaatcttgtcaaaccagaaggtaaagtaatagatctgggttgcggacgaggagggtggagttactattgtgcaggactaaagaaagtaacagaagtcaagggatacactaagggtggaccgggacatgaagaacctattccgatggcaacctatggatggaatctagtaaaattacactctggaaaggatgttttctttattccaccagaaaagtgtgacaccctattgtgcgacataggagaaagtagtcccaatccaacgatcgaagaagggcgaacacttcgtgtattgaaaatggtagaaccgtggttacgtggtaatcaattttgcataaagatactcaatccgtatatgccatcggtagtggaaacgctggaacaaatgcagcgtaaacatggagggatgctagtaaggaatccattatcccgtaactcaactcacgaaatgtactgggtgtcttgcggaacagggaacatagtgtccgcagtcaatatgactagcaggatgctactgaaccgatttacaatggcccacagaaagcctacgtatgagcgagatgtagatctcggcactggaacaagacatgtcgcagtagaacctgaagttgctaatctcgatatcattggtcaaaggatagaaaatataaaacatgaacataaatcaacatggcattatgatgaagacaacccgtataaaacatgggcttatcatggaagctacgaggtgaaaccatcgggaagtgcttcctctatggttaatggagtcgtaaagctgttaactaagccttgggatgtaattccaatggtaacacaaattgcgatgacagatacgactccgttcggtcaacaacgagtgtttaaggagaaagtagatacacgaactcccaaagccaaacgcggaacagctcaaataatggaagttactgctcgatggctatggggtttcctaagcaggtccaagaaacctcgtatttgcaccagagaagaatttatacgtaaggtgcggtcaaacgcagccatcggagcagtattcgtggatgaaaatcaatggaatagtgcaaaagaagcggtagaggatgaacgtttctgggacctagtgcaccgtgagcgagaacttcataagcagggaaaatgcgcgacatgtgtgtacaatatgatgggaaaacgggagaagaaactaggtgagtttggtaaagcaaaaggatctagagccatatggtatatgtggcttggagccagatttttagaatttgaagcattaggttttatgaatgaagatcattggtttagtagagaaaactctttaagtggagttgagggagaggggcttcataaactcggctacatactaagagatatatcaaaaattccgggcggcaacatgtacgcagatgataccgccggctgggatactcggataaccgaggatgacctacaaaatgaagcaaaaattacagatataatggaacctgaacacgctttgctagctaaagcaatctttaaactaacatatcaaaacaaagtagttcgcgttcaaaggccagcgaagaacggaacagtaatggacgtaataagtaggcgagaccagagaggatcgggacaagtaggtacttatggattgaacacattcacgaacatggaagctcaacttataagacaaatggaaagtgagggcatattttcgccgtctgagctagaaacaccgaatctagctgaacgcgcactagattggttagaaaaatatggagttgagcgtttaaaacgtatggctatctctggagatgactgcgtagtcaagccaattgatgacaggttcgcaacggcccttacggctctaaacgacatgggaaaagttagaaaagatattccccaatgggaaccttcaaaaggatggaatgattggcaacaagtcccattttgtagtcatcattttcaccaactgataatgaaggacgggcgtgaaattgtagtcccttgtagaaatcaagatgagttggtagggagggcaagagtatcacagggagccggttggtcattaagagagacagcttgccttggtaagtcgtatgcccaaatgtggcagctaatgtactttcaccggcgcgacctcaggctagccgctaatgcaatatgcagtgcagtacctgtagactgggtccctacaagtaggactacgtggagtattcatgcccaccaccaatggatgacgactgaagatatgttatccgtttggaatagggtctggatcgaagaaaatccatggatggaagacaaaacacacatcagcagttgggaggacgtaccatatcttggaaaaagagaggaccagtggtgcgggtctcttattgggttaactgccagggcaacttgggcaacaaacatacaagtcgcaataaaccaggtaaggcgattaattggtaacgaaaattatctggactatatgacctcgatgaaacggttcaaaaatgagagcgatccagagggcgcattgtggtaa

SEQ ID NO: 21187 - RNA, 9879 nt, synthetic construct
  misc_feature 1..9879: note = derived and/or modified CDS sequence (opt6) from DENV-1__GQ868618__SS-prME
  source 1..9879: mol_type = other RNA
agtgtcacaatgcttttaatgctgatgcccactgcattagcttttcatttaaccacgcgaggaggggaaccacatatgattgtctcaaaacaagaacgtggaaaatctctcctctttaaaacttcagcaggagtaaatatgtgcactttaatcgcaatggaccttggcgagttctgcgaagatacgatgacttacaaatgccccagaataacggaagcggagccagacgacgttgattgttggtgtaatgctaccgatacctgggtcacatacgggacatgttcccaaacaggtgaacatagaagagataaacgatctgtagcactagcacctcacgtgggtttaggacttgagactcgaacagaaacttggatgtcaagcgaaggagcgtggaaacaaatacaacgcgttgaaacttgggcacttagacacccgggattcacggtaatagctctctttctagctcacgccattggaacatctatcacccaaaaaggtattatcttcatccttttaatgctcgtgacaccgagtatggcgatgaggtgtgtaggcataggctctagagatttcgttgaaggattaagcggagctacttgggttgacgttgtcttagagcatggttcatgtgtgaccacaatggcaaaagataagccaactctcgatatagagctcctgaaaacggaagtgacaaatcctgccgtacttcgaaaattatgtattgaagcaaaaatttccaatacaacaacagacagcagatgtcctacacagggagaagccacattagttgaagaacaagacgcgaattttgtatgtcgccgcacctttgtagatagggggtggggaaatggttgtgggttattcgggaaaggtagcctgattacatgtgctaaatttaaatgcgtaacaaaactcgaaggtaaaatagttcaatatgaaaacttgaaatattccgtaattgtaacggtccatactggagatcagcaccaagtaggcaacgagagtacagaacatggcacaactgccaccattactccccaagcacctagtactgaaatacaattgacagactatggagctcttactctcgattgttcaccaagaacaggactcgattttaacgagatggtactacttactatgaaagaaaagagctggttagttcataaacagtggttcttggatctccccctgccctggacatcaggcgcctcaactagccaagagacctggaaccgtcaggatttactggtaacctttaagacggcacatgccaagaaacaagaagtagtcgttcttggctcccaggaaggagcaatgcatacagccctaactggggcaaccgagattcaaacctctggaacaacaacaatttttgcaggccacctaaaatgtaggctaaaaatggataaacttacgttaaaaggaatgagctatgtcatgtgtaccggaagtttcaaactcgaaaaggaagttgctgaaacgcaacatggaacagtattagtccaaatcaaatacgaaggaacagacgcaccatgcaaaataccatttagtacacaagatgaaaaaggggtcacccagaacggcagattgataacagcgaacccaatagtgacggataaagaaaaaccagtgaatatagaagccgaaccaccgtttggagaaagctacatcgtgataggtgccggagaaaaagcattgaaattaagttggtttaaaaagggatcatcaatcggtaaaatgttcgaagctacagccagaggtgcgagacgcatggctatcctcggagacacagcatgggattttggatccatcggtggagtatttacgtcagtaggaaaacttgtacatcaaatattcgggacagcatacggagtattatttagtggtgtatcatggaccatgaagataggtattggagtattgttaacgtggctaggacttaatagtcgttctactagcttaagtatgacatgtattgccgtgggtctagttacattatatctaggggttatggtccaagcagactctgggtgcgtaattaattggaaaggcagagaactgaaatgcggtagcggtatattcgtcaccaatgaagtacatacatggactgaacaatataagtttcaagcagactccccaaaaagactcagtgcggcgataggaaaggcatgggaagagggagtctgtggaataaggtcggctactagattagaaaacataatgtggaaacaaataagtaatgagttgaatcacatcctcttagagaatgacatgaaatttacagtggtggtcggagacgttgcaggtattttagcccaaggtaagaaaatgataaggccacaaccaatggaatacaagtactcttggaaaagctggggaaaggcgaaaatcataggagccgatgtacaaaacactacattcataatagatggtccaaatactcccgaatgtcctgatgatcagcgtgcctggaacatttgggaagtggaagactacggattcggtatattcactacgaatatatggttaaaattaagggattcctatacgcaagtttgcgaccatagactaatgtctgcggctatcaaagatagcaaagcagtacatgcggatatgggttattggatagaatctgagaaaaatgaaacatggaaattagcacgagcgagctttattgaggtgaaaacttgtatttggccgaaatcacacacgttgtggagtaatggggtattggaatcagagatgatcatacccaaaatatacggaggcccgatctcacagcataattatagacctggctactttacccaaacggcaggtccgtggcatttagggaagctagaactagactttgatctctgcgaagggacgacggtggtagtagatgaacattgtggcaacagaggaccctcgttaagaacaacgacagtcactggaaaaataattcatgaatggtgctgcagaagttgtacattaccgccgctaagattcaagggagaagacgggtgttggtacgggatggaaatccggcctgtcaaagagaaagaggagaacttagttaagagcatggtatcagctggaagcggagaagtagatagttttagtttgggcctactctgcataagcatcatgatagaagaagtgatgcggtcgagatggtctcgcaaaatgttgatgacagggacattagcagtattctttctactaatcatgggacagctaacatggaatgatttgatacgcctttgtatcatggtaggagcgaatgcatctgatagaatgggaatgggaacgacttatttggccctaatggccacatttaaaatgcgtccaatgttcgctgtaggactactttttcgcaggctaacgtcgagggaagtactcttgttaaccataggactatcattagtggcttcggtagaactaccaaacagtctcgaagaactgggggacgggctcgcaatgggtataatgattttaaaattacttacggattttcaaagccatcaactttgggcaacattactaagtttaacattcatcaaaactactttttcactgcactacgcctggaaaactatggctatggtattgtccatcgtatcactattcccactttgcttaagtacaacaagccagaaaacaacatggttaccagtgttactgggatccttaggatgtaaaccattgacgatgttcctcattgctgaaaataaaatttggggaagaaagtcatggcctctaaatgagggaataatggcagttggcatagtaagcattctgctgagtagtttactcaaaaatgatgttcctctagcgggcccattaatagcaggaggaatgctaatagcgtgttatgtcataagtggaagttccgcagatttgtcgctcgaaaaagcagcagaagtaagctgggaagaggaagcagaacattcaggtgcaagtcacaatattctggtggaagtacaggatgacggaaccatgaaaataaaagatgaagaaagagatgatactctgacaattttgctaaaggcgacactcttagctgtgagtggggtttaccctctatccatccccgcgacactttttgtgtggtacttttggcagaagaaaaagcaacgttcaggcgttttatgggacacaccatcaccacctgaggtagaacgagcggttcttgacgacgggatatatcgaattatgcaaagaggacttctcgggaggagtcaagtaggtgtcggagtgtttcaagaaaatgtctttcacacaatgtggcacgtaactagaggagcggttctcatgtaccaagggaaacggctagaaccaagttgggccagcgtcaagaaagatttgatatcatatggtggaggttggcggctacaaggaagctggaacacaggagaggaggtacaagttatcgctgtagaacccggcaaaaatccgaagaatgtgcaaacagctcctggcacgttcaaaacatcagaaggggaggtaggcgctattgcgcttgacttcaaaccagggacttcagggtcccccatcgtaaatcgtgaaggtaagatagtgggtctatacggcaacggagtggttaccacatcgggtacatatgtatccgcaatcgcacaagctaaggcctcacaagaaggtccactgcctgaaatagaagacgaagtatttagaaagcgaaacctaactataatggacctacatcctggtagcggcaaaactcggagatatctacctgcaatagtacgggaagcgataaaaaggaaattacgtacactaatactcgcacctactcgagtcgtagcttcagaaatggccgaagccttgaaaggtatgccgattcgttatcaaactacagcagtaaaaagcgaacatactgggaaagaaatcgttgatttaatgtgtcacgcaacgtttactatgagattattaagtcctgttagagtgccaaactataatatgatcattatggacgaagcacattttacggatccctcctctatagcagcaaggggatatattagcacacgggttggtatgggcgaagcagcggctatttttatgacagctacgcctccaggctcggtagaagcatttcctcagagtaatgctgtaatccaggacgaggagcgagacattccagagagatcatggaacagtggatatgagtggatcaccgacttccccggaaaaacagtttggtttgtaccttcgattaaatccggaaatgacattgcaaactgtctacgtaaaaacggcaaaagagtaattcaactatctagaaaaacgttcgatacggaatatcagaaaactaagaacaatgattgggattacgtagtaacaacggatatctcagagatgggagccaattttagggcggatagggtaatagatcctaggagatgcttaaagcccgttatactgaaagacggtcccgaacgcgttatactggcaggacccatgcccgtaacagttgcatcggcagctcagagacgtggtcgaatcggaagaaatcacaataaagagggcgatcaatacatctatatgggacaaccgttaaacaacgacgaagatcacgcccactggacagaagccaaaatgttgctcgataatataaacacgcccgaaggtataattccagcactctttgaacccgaaagggagaaatctgcagcaatagatggagaataccgcctacggggcgaagccaggaaaacattcgtagaattaatgaggcgaggagacttgccggtttggctgagttacaaagttgcttcagaaggattccagtattcggatagacggtggtgttttgatggagaaagaaataaccaagtgctagaagaaaatatggacgtcgaaatttggaccaaagaaggcgaacgaaagaaactgcgtcctagatggttagatgctcgtacatatagtgatcccttagccttacgagaatttaaagaatttgcagcaggtaggcgttcggtatcaggagatctgatattggaaataggcaaactacctcaacatttaacgcaaagagcacaaaacgcgttagataatctagttatgctacacaattcagaacaagggggcagagcgtacagacatgccatggaagaacttccggatacgatagaaacgcttatgcttctagcactaattgcagtgctgacagggggcgtcactctcttctttctatccggtcgtggacttggcaaaacttcaataggtctactgtgcgtaatggcttccagtgttctactatggatggcatcagtagaaccacattggattgccgcaagtataattttagaatttttcctaatggttctgttaatacctgagccagacaggcaaaggacgccacaggataaccaactggcctatgtagtgatcggactactatttatgatactgaccgttgctgccaatgagatgggtttattagaaacaactaagaaagatctagggatcggacacgtggcagtcgaaaatcaccatcatgcggcaatgttggatgttgacctacatccagcttcggcctggacgctatacgccgttgcaaccactatcattacacctatgatgagacacactatcgaaaacacaaccgccaacatttcactaacggccattgctaatcaggccgctatcctcatggggttagacaaaggatggccaataagcaaaatggatataggagtacccctactcgcgttaggttgctacagtcaagtgaatcctctaacattaacagcagcagtattaatgctagtagcacactacgccataatagggcctggtctccaagcaaaagcgacaagagaagcacagaaaaggacagcagctggcataatgaagaaccctacagtagatggcatagtcgccattgatctagatcctgttgtttatgatgcaaaatttgaaaaacaacttggtcaaatcatgctacttatactatgtaccagccagattctgctaatgagaactacgtgggcgctctgcgaatcaattacactagcaacaggacccctaactacgttgtgggagggatcacctggaaaattttggaacactacaatagctgtaagtatggcaaatatatttcgtggaagctatttagccggagcaggtttggcctttagcttaatgaaatcgttaggtgggggacgacgaggaaccggagctcagggagaaacgctaggtgaaaaatggaaaagacaactaaaccaattaagtaagagtgaatttaatacatacaaaaggtcgggaataatggaagtggatcggagtgaagctaaagagggtctaaaacgaggagagacaacgaaacatgcggttagtagaggaacggctaagttacgctggtttgtcgaacgaaatctagttaagcccgaaggtaaggtgatagatctaggctgtgggagaggcggttggtcctattactgcgcagggttaaagaaggttacagaagtaaagggctatactaaaggcgggcccggacacgaagaaccaatcccaatggcaacatatggttggaatttagtcaaacttcacagtggaaaagatgtatttttcatcccaccagaaaagtgcgacactttgttatgtgatattggagaatcatcacctaatcctaccatcgaagaaggccgaactttgagagttctaaaaatggtggaaccatggttacgagggaatcaattttgtataaaaatcctcaacccttatatgccgtctgtagttgaaaccctagaacaaatgcaaaggaagcacggtggaatgctcgtgagaaacccattgtctcggaatagcacgcacgaaatgtattgggtgagttgcggaacaggtaatatagtgagtgccgttaatatgacttcacgtatgttattaaatcgtttcacaatggcgcaccgaaagcccacgtacgaacgggacgtagatcttggcgcgggtactcgacatgtcgcggtcgagccagaagttgccaacctcgatatcattggccaacgtatagaaaatataaaacatgaacataaaagtacatggcattacgatgaagacaacccatacaaaacatgggcataccatggctcttacgaggttaagcctagtggctcagcttccagcatggtaaatggagttgttaaactattaacaaaaccatgggacgtaatccctatggtaacacaaatagctatgacagatactacaccttttggtcagcaaagggtgtttaaagaaaaggtggatacgcgaacgccaaaagcaaaaagaggaacagcacaaattatggaggtgacagcaaaatggctttgggggtttttaagtagaaataagaagccccgtatatgtactagggaagaatttacgcgaaaggtacgcagtaatgcggcaataggagccgtgtttgtagatgaaaaccaatggaactcagctaaggaggctgtagaagatgaacgtttttgggacttagttcatagagagagggaactacataaacaaggaaaatgtgcgacatgcgtgtataatatgatgggaaaacgcgagaagaaactaggtgaatttggcaaagccaagggaagtagagccatatggtacatgtggttgggggcccgatttttagagttcgaagcacttgggtttatgaatgaagatcactggttcagtcgcgaaaactcattgtccggtgtagaaggtgaaggtttacataaattaggctatattttgagggatattagtaaaataccaggtggaaacatgtatgcagatgacaccgcaggatgggacactagaatcaccgaggatgacctacaaaatgaagcgaaaattacggacataatggaacccgaacacgccctcttagcaaagtcaatcttcaaattaacttatcaaaacaaagtggtcagagtacaaagaccggcaaagaatggcaccgttatggacgtaataagtcggcgggatcaacgcggttctggccaagtcggcacatacggtttaaatacatttacgaatatggaagcgcaactaattcgacaaatggaaagcgagggcattttctcaccgtctgaattagaaacacctaacctagcggaaagagtgctagactggctagaaaaacatggagtggaacgattaaagaggatggcaatatcgggagatgactgtgttgtgaagcccattgatgacaggtttgctactgcactaaccgcactcaatgacatgggaaaagtccgtaaagatataccccaatgggaaccaagtaagggttggaatgactggcaacaggtaccattctgcagtcatcattttcaccagttaattatgaaggacggccgtgaaattgttgtaccatgtcgaaaccaggatgaattagttggtcgagcaagggtatcacaaggtgcaggctggagccttagagaaacagcttgtttaggtaagtcctatgcacaaatgtggcagttaatgtatttccatagaagagatctacggttggctgcgaatgctatatgcagtgctgtacctgtagattgggtaccaacatcaagaaccacttggagcatccatgctcatcaccagtggatgacgacagaagacatgttatctgtatggaatagagtgtggatcgaggaaaatccatggatggaagataaaacgcacatttctagctggggagatgtcccatatctagggaaaagagaagatcagtggtgcggatctcttataggtctcacggccagagcaacatgggccacaaatattcaggttgcgattaatcaagtaagacgattaatcggaaatgaaaattatttagattatatgaccagcatgaaaaggtttaaaaatgaaagcgacccagagggcgcgctgtggtaa

SEQ ID NO: 21188 - RNA, 9879 nt, synthetic construct
  misc_feature 1..9879: note = derived and/or modified CDS sequence (opt6) from DENV-1__GQ868619__SS-prME
  source 1..9879: mol_type = other RNA
tctgtgacgatgttattaatgcttatgccaacagcgctagcttttcacttaacaacacgaggaggggaaccacatatgattgtgtctaaacaagaacgagggaaatcacttctcttcaaaacaagcgcaggagtaaacatgtgtacgctaattgcaatggatttaggtgaattatgtgaagatacaatgacctacaaatgtccaaggataacagaagctgagcctgacgatgtcgactgctggtgcaacgcgactgacacatgggttacatatggtacttgctcacaaacaggagagcacaggagagataaacgttctgtagctctggcgccccatgttggactaggattggaaacacgtacagaaacatggatgagttccgagggagcttggaaacaaattcaaagggtagaaacatgggctttaagacatccaggatttacagtcatagcgcttttcctagcacatgcgatcggaacatcaataacacaaaaagggataatcttcatattattaatgctagtaacaccaagtatggcgatgcgatgtgtagggataggtagtagagacttcgttgagggattatccggcgctacgtgggtcgatgtagtgcttgagcacggttcatgcgttactacaatggcaaaagacaaacccactttagatatcgaactactaaaaaccgaagtcacgaacccagcggtcctaagaaaactatgcattgaagcaaaaatatcaaatacaacgactgactctagatgtccaacccagggggaagcaacccttgttgaagaacaagacgcaaatttcgtctgtaggagaacttttgttgacagaggatggggcaacgggtgtgggttattcggtaaaggttcactaataacatgtgcaaaatttaaatgcgttacgaaactagaaggaaaaatagtacaatatgagaacttgaaatactcagttatagtaacagtacatactggagaccaacatcaggtgggaaatgagtcaactgaacatggtaccactgccaccattacaccacaagcaccgactaccgaaattcaattaaccgactatggcgctttaacgcttgattgcagtcctagaacaggtctagactttaatgagatggtattacttactatgaaagaaaaatcctggttagtacacaaacaatggtttttagatttaccactgccatggacatcaggagcgtctaccagccaggagacatggaatagacaagatctcctcgttacattcaaaactgcgcatgccaagaaacaagaggtagttgtcttagggtcacaggaaggagcaatgcacacggcccttacaggagctacagaaatccaaacgagcggaacaacaactatttttgctggacatttgaaatgtcgattgaaaatggataaacttaccttgaaaggtatgtcttacgtgatgtgtacaggtagttttaaattagaaaaagaagtagctgaaactcaacatggcacggtcctggtccagatcaaatatgaaggcaccgatgcgccatgtaaaattccattttctacacaggacgagaaaggcgtaacccaaaatggcagattaattacagccaatccaattgttacagataaagaaaaaccagtaaacattgaagctgaaccaccattcggagaaagctatatagtaattggagcaggggagaaggctctcaaacttagttggttcaagaaagggtcatcaataggtaaaatgtttgaagcaacagcaagaggagcacgtaggatggcgatcctaggtgataccgcgtgggattttggttccatcgggggtgtatttacaagcgtgggcaagctagtacatcagatattcggcactgcttatggagtacttttcagtggagtcagttggacgatgaaaattggaattggggtcctacttacttggctagggttaaattccagatccacttcgctaagtatgacttgcatcgctgtaggattagttacgctatacctcggcgttatggtgcaagcagattcaggctgcgtgataaattggaagggtcgagaactaaaatgtgggtcaggaatctttgtgactaacgaagttcacacttggacagagcaatacaaattccaagctgactctccaaaacgtctcagtgcagcaattggaaaggcttgggaagaaggcgtgtgtgggataagatctgctacaaggctggagaacattatgtggaagcagattagtaacgaactaaatcacatcctactggaaaacgatatgaaattaacagtggttgtaggtgatgtagcaggtatactagcgcaaggcaagaaaatgatccggccgcagcctatggaatataaatactcctggaaaagctggggcaaagctaaaatcattggagcagatgcacaaaacacaacatttatcatagatggcccgaatacacctgaatgtcccgatgatcaaagagcttggaacatatgggaagttgaggattatggatttgggatattcacaactaacatatggttaaagttgagagatagttatacacaagtatgtgaccatagattgatgagcgccgcaataaaagattcaaaggcagtacacgcagatatgggatactggattgaaagcgagaaaaatgagacatggaaactagctcgagcatcattcatagaagtaaaaacttgtatttggcccaaaagccatactctctggagtaatggcgtacttgaaagcgaaatgataattccgaagatatacggaggaccaatttcgcagcataactaccgcccagggtattttacgcaaactgctggtccttggcatctaggcaagctggagttagactttgatttatgtgaggggacaacagtagtagtagatgaacactgcgggaacagggggccctctctgagaactacaacggtcacgggaaaaatcattcatgaatggtgctgcagatcatgcacactgcctccattacgctttaggggagaagacggatgctggtacggaatggaaatacgaccggtaaaggaaaaggaggagaatcttgtaaagagcatggtttctgcaggaagtggcgaagtcgacagtttctcactgggtctattgtgtatcagcataatgatcgaggaagttatgagatctcgatggtcaagaaaaatgctaatgacggggacattagtcgttttcttcttgttaataatggggcaattgacctggaacgatcttatcaggttatgcattatggtaggagcaaacgcctcagatcggatgggcatggggacaacttatttggcattaatggccacattcaaaatgagaccaatgtttgcagtaggcttattatttagacgattgacgtcacgggaagtacttcttttaaccatagggttgagtctagtagctagtgtagagttgcctaatagcttggaagaacttggagatggtttagctatgggaataatgattttaaaattgcttacagactttcaaagtcaccagctttgggccacattactatctttgacgtttataaaaaccactttctctttacactatgcctggaaaactatggcaatggtactttcaatcgtcagcctctttccattatgtctctcgactacttctcaaaagactacatggttaccagtgctcttaggtagcctcggttgcaaacctttgaccatgtttttgatagcggagaacaagatatggggaagaaaatcatggccgttaaacgaaggaattatggcagtgggcatagtaagcatattattatcgagtttattaaagaatgacgtacctttagctggtcctttaatagcaggaggtatgctaattgcatgttatgttatatctggaagtagtgcagacctttctctggaaaaggccgcagaagtcagttgggaagaagaggcggaacatagcggcgcatctcataacattctagtagaggtacaagatgatggtactatgaaaatcaaagatgaagagagagacgacacattgacaatattattaaaagctacgctgctagccgtgtcgggagtctacccattatcaatacccgccacattgttcgtatggtatttctggcagaagaagaaacagagaagcggcgtactatgggacacacctagtccaccagaagtggaaagagctgtactagatgacggaatatatcgaatcatgcaacggggactccttggacgatcacaagtcggcgtgggagtatttcaagaaaatgtattccacaccatgtggcacgtaacccgaggagcagtccttatgtatcagggaaaaagactagaaccttcctgggcaagcgtgaagaaagatttaattagttatggtgggggctggcgcttacaaggcagctggaatacgggagaggaagtacaggtgatagctgtagagccaggcaaaaatcccaaaaatgtacaaacagcaccgggaacattcaagacccccgagggagaagtgggagcaattgctctggattttaaaccaggaacgagtggaagccctatagtgaacagagaaggtaagatagttggcttatatggtaatggagttgttacgacttcggggacatacgtatccgcaatagcacaagccaaagcaagtcaggagggacccttgccagagattgaagatgaagtgtttcgcaaaaggaatctaactataatggatttacatccaggaagtggaaagacgagacgatacttaccagctatcgttagggaagccatcaaacgaaaactaagaactctaatattagcgccaacgcgagtggtagcgagtgagatggcagaagcattaaaaggaatgccaataagataccaaacaacagcagtaaagtctgagcacacgggcaaagagatagtagacttaatgtgtcatgctacatttacaatgcgattattatcaccagtgagagtaccaaattacaacatgataattatggatgaagcacattttacggacccctcatcgatcgcggcaagagggtacatcagtacaagagtcggaatgggagaagcggcagctatctttatgacggctacaccaccggggagtatggaggcctttcctcagtcgaatgctgtcattcaggatgaggaacgcgacatacccgaaagaagttggaatagtggatatgagtggataactgattttcccggcaaaaccgtatggttcgttccatctataaaatcaggcaacgatattgcaaattgtttaaggaagaatgggaagcgagtaatacaactctctaggaaaacatttgatacagaataccagaaaaccaaaaataacgattgggactatgtcgtaaccacagacatctccgaaatgggggctaacttcagagcagatagagtaatagatccccgaaggtgtttgaaacccatcatactaaaggatggacccgaaagagtaatattagcagggcccatgcctgttaccgttgcatccgcagcacagcgaaggggtcgtattgggcggaatcacaataaagaaggcgatcaatatatttatatgggccaacctttaaataacgacgaagatcatgcacactggaccgaagcaaagatgttattggacaatatcaacacaccggaaggcattatccccgccttgtttgaaccagaaagagaaaagtctgcagcaattgacggtgaatatcgcctacgaggagaggctcgaaaaacatttgtagaattaatgaggaggggagatctaccagtttggctcagctataaagtagcgtcggaaggatttcaatactctgataggcgatggtgttttgacggcgaaagaaataaccaggtgttagaagaaaatatggacgtcgaaatatggactaaggaaggggaaagaaagaaattacgaccccgatggttagatgcacgaacgtattcagatcccctagccctaagggagttcaaagagttcgccgccggtagaagatcagtttcaggagatctaattcttgaaataggtaaattaccacagcatttgacgcagcgtgctcagaacgcgctagacaatttagttatgctgcataacagcgaacaaggtggtcgtgcatacagacacgcaatggaagagttacccgataccatagaaaccctaatgctattggccttaattgcggtactgacaggaggggttatgctattctttctaagtggacgaggacttggtaagacatcaattgggttgctatgcgtaatggcttcatccggcctcctgtggatggcatctgtggaaccgcactggatcgcggcatctataatcttagaatttttcctaatggtattgctaataccagagccagatagacaaagaactcctcaagacaaccagttagcatatgttgtaatgggtctgctattcatgatacttaccgtcgctgcaaatgaaatgggactactggaaaccaccaagaaagatttagggattggacacgtggcagttgaaaaccatcaccatgcggcaatgctagatgtcgacttacatcctgcttcggcgtggacattatacgccgttgcaacaacgattataacccctatgatgagacacacaatagaaaatactacagcgaacatctctcttacagcaatagctaaccaagctgcaatcctaatgggcttagataaaggatggcccatctcaaaaatggatataggagtacctttactagctctaggctgttattcccaagtcaaccccttaacgctcactgcagcggttttaatgttggtcgcgcattacgccataattgggccaggtttacaagcgaaggcgacaagggaagctcagaagcgaactgcggccgggattatgaaaaaccccacagtagatggaattgttgcaattgatttggaccccgtagtttatgacgcaaaattcgagaaacaattaggacaaattatgctattaatcttgtgtacaagccaaatattgttaatgcgcactacatgggcactgtgtgaaagcattacattagctaccggaccattgacaaccctatgggaaggatctcctggcaaattttggaatacaacaattgcggttagcatggcgaatatattcagaggatcatatcttgctggagctgggctagctttttcattaatgaaatcgttaggcggaggacgaaggggaactggcgcgcaaggtgaaactttaggagaaaaatggaaaaggcagttaaaccaactatctaaatccgaatttaatacatataaacgctctggtatcatggaagttgatagatcggaagccaaggaagggttgaaaaggggagagacaacgaagcatgcagtttcaagaggcacagcgaaattaagatggtttgtagaacgaaacctcgttaagcctgagggtaaagttattgacttaggatgtggtcgtggtggatggagttattattgtgcaggactaaagaaagtaactgaagtaaaaggttatacaaaaggaggacctgggcatgaggaaccgataccaatggccacttatggctggaacctggttaaactgcatagtggtaaagatgttttctttatacccccagaaaaatgtgatacactgctctgtgacataggtgaatcatccccaaaccctactatagaggaagggcggaccctccgcgtcctaaaaatggtagaaccatggctgcgagggaaccaattttgtattaagattctcaacccctatatgccatccgtggtggaaaccctcgagcaaatgcaacgcaaacatggtggaatgttagtacgtaacccattgtcaaggaatagcacacatgaaatgtattgggtgtcatgcggtacagggaacatagttagtgctgtcaatatgacatcaagaatgttattgaatagattcacgatggcacatcggaaacccacatacgagcgagacgtcgatctcggcacaggaaccagacatgtagcagtggaacccgaggttgcaaacttagatatcattggccaacggatagagaatataaagcacgagcataagtcgacatggcattacgacgaagataatccatacaaaacatgggcatatcacggttcctatgaagtcaaacctagtggatcagcatcatcaatggtcaatggggtagtaaaactactgaccaaaccatgggatgttataccaatggttacgcaaatagcaatgacagatacgactccgtttggacagcaacgtgttttcaaggaaaaggtcgatactcgaacccctaaagcgaagagaggaacagcacaaattatggaggttacagcaagatggctatgggggtttctctcacgcaataaaaagcctcgaatctgtaccagggaagagttcacccgtaaagtacgaagtaacgcagcaataggcgctgtcttcgtagatgaaaaccaatggaactcggcaaaggaagcggtggaagacgaaagattttgggatctggttcaccgggagcgggaattgcacaaacaaggcaagtgcgcaacctgcgtctataacatgatgggaaaacgcgagaagaaactgggcgagttcggtaaagctaagggatctagagcaatttggtacatgtggctaggtgcacgcttcttagagtttgaggcactgggttttatgaacgaagaccattggttttcacgagaaaactcattaagcggagtagagggagaaggactgcataagttaggttacatactacgtgatataagtaaaatcccaggcggtaacatgtacgctgatgacacagcagggtgggacacaaggattacagaagacgatttacagaatgaagcaaagataaccgatatcatggaaccagagcacgcactcttggctaaagcaatttttaagttaacatatcaaaacaaagtagtaagagtgcaacgccctgctaagaacggaacagtaatggatgtaatatcacgtagggaccaaaggggatcaggtcaagtgggtacctacggactaaacacttttacaaatatggaagcgcaacttataagacaaatggaatcggaaggaattttctcccctagcgaactagagacgccaaatctggcggaacgagcgctcgactggttagagaaatacggggtcgagagactcaaaaggatggctataagtggagacgattgtgtggtaaaacctattgacgacagatttgctacagcccttaccgcgcttaacgatatggggaaagtccgaaaggatatacctcagtgggaaccatctaaggggtggaacgactggcagcaggtaccattctgtagtcaccattttcatcaactcattatgaaagatggtcgtgagattgtagtaccttgtaggaatcaggacgagttggtaggacgtgcaagggtaagtcaaggagccggatggagcctaagagaaacagcttgcttaggaaaatcatatgcacaaatgtggcaattgatgtattttcacagacgagatttacgactagcagcaaacgcgatatgttcggcggtaccggttgattgggttcccacctcgagaaccacttggagtatccatgcacatcatcaatggatgacgaccgaggatatgctcagtgtgtggaatcgagtatggattgaagagaatccttggatggaagacaaaacacatatatctagttgggaagacgtcccatatttaggtaaacgagaagaccaatggtgtggaagtctaataggccttactgctagagcaacttgggctactaacatacaagtagctataaatcaagtcagaagattaattgggaacgaaaattatctggattatatgacctcaatgaaacgtttcaagaatgagtcagatccagaaggagccctatggtaa

SEQ ID NO: 21189 - RNA, 9879 nt, synthetic construct
  misc_feature 1..9879: note = derived and/or modified CDS sequence (opt6) from DENV-1__FJ639678__SS-prME
  source 1..9879: mol_type = other RNA
tcggtgacaatgctgcttatgttaatgcccacagctttagcgtttcaccttacgacaagaggaggtgagccccatatgattgtcagtaaacaggaacgtggaaaagcattgctatttaaaactagcgctggagtgaacatgtgtacgcttatagcgatggacctaggagagctgtgcgaggacacaatgacttataaatgtccgcgaataacagaggtagaacctgatgacgtcgattgttggtgcaatgctacagatacatgggtcacctacggcacctgtccacagacgggagaacatcgcagggataggcgctcggtagctcttgctccgcatgtaggactagggttagagacgagagcagaaacgtggatgagttcagaaggtgcttggaaacaaatccagcgagtagaaacatgggcactgcgacacccgggtttcaccgtaattgcattatttcttgcccatgccataggcacgagtataactcaaaagggcatcatattcattcttttaatgttagttacccctagtatggcgatgagatgcgttgggataggtaacagagacttcgtggaaggattaagcggagccacatgggtagatgtagtcctagagcacggctcttgcgtaacaactatggcaaaagacaaacctactctagacattgaattactaaaaacagaagttacaaatccggcggtgctaaggaaattatgtattgaagcaaagatatcaaacacgacaacggactcaagatgccccacccaaggtgaagcaactctagtcgaagaacaagatgccaattttgtatgtagaaggacttttgtggaccgtggttgggggaatggatgcggattgtttggaaagggcagtctgataacatgtgcaaaatttaaatgtgtaacgaaattagagggtaaaattgtgcaatatgaaaacttaaaatacagtgtaatagttactgtacatactggagaccagcaccaggttggaaacgaatctaccgaacacgggactacagctacaataacgccgcaagctccgacgtctgaaatacaactcactgattacggggctttgactcttgattgctcacctcgaacaggattagacttcaatgaaatggtccttctcacgatgaaagaaaagagttggttagtgcacaaacaatggttcttagatcttcctctaccatggaccagtggtgcaagcacaagtcaagaaacttggaaccgccaagatttactagtgactttcaagacagctcacgctaaaaagcaagaagtcgtagtactgggctcacaggaaggagcaatgcatacggcactcaccggggctacagagatacaaacatcgggcactacaacaatattcgctggacacctaaaatgtagactgaaaatggataaactgacccttaaaggaatgtcttacgtaatgtgtactgggtcgtttaagttggaaaaggaagtcgcagaaacgcaacatggaacagtcctggtacaaataaaatatgaaggaactgatgccccatgtaaaatacctttttcaacacaagacgagaaaggagttacgcaaaacggaagattaattacggcgaacccgattgtgacagataaggaaaaaccagtgaatattgaagcagaaccaccttttggtgaatcatatatagttataggtgcgggagaaaaagctctaaaactaagttggtttaagaaaggttcttcgattggtaagatgttcgaagcaactgcaaggggagcccgaagaatggcaatattaggagacacggcgtgggatttcgggtcaataggcggcgtatttacatcagtcgggaagttagtacatcaaatcttcggtactgcatacggcgtgctgttttcaggagtgtcttggacaatgaaaataggtattggggtattgctgacatggttaggattaaacagcagatctacaagtctgtcaatgacgtgtattgctgtagggttagtcacattgtaccttggggtgatggtgcaagctgatagcggctgtgtaattaactggaaaggaagggaattaaaatgcggttcaggaatttttgtgaccaacgaagtccatacttggacagagcaatataaatttcaagcggactctccaaaacgtctaagtgcagcgatcggcaaagcttgggaagaaggagtttgcggtatacggtcggccacgagattggaaaacattatgtggaaacaaattagtaatgagctaaatcatattcttttggaaaacgatatgaagtttacagttgtcgtcggagacgtggtagggatccttgcccaaggaaagaaaatgattagaccgcaacccatggaatacaaatatagttggaagtcttggggtaaagcgaagatcataggtgcagatattcaaaatacaacttttataatcgatgggcctaatactccagaatgtcccgacgaccagcgggcttggaatatctgggaagtggaggattatggttttgggatttttacaacgaatatctggctaaagttaagggacagttatactcaagtatgtgatcacaggttaatgtctgcagcaataaaagattcaaaagcagttcacgccgatatgggatattggattgaatcagaaaaaaatgaaacgtggaaattagccagagcaagtttcatcgaagtaaagacgtgtatatggcctaaaagtcatacgctctggagtaatggagtactagaatctgagatgataattccaaaaatttatggtggacctatatcacaacataactatagaccgggatattttacgcaaactgccggtccatggcatttaggtaaactggaactcgattttgatctatgtgaaggcacaacagtagtagttgatgagcattgcggtaaccgtggtccgtcattaagaacaacaaccgtaaccggtaagataatacacgagtggtgctgtcgaagctgcactctaccgccgctacgatttaagggggaggatggttgctggtacggcatggaaattaggccggtaaaggagaaagaggagaatttagtgaaaagtatggttagtgccggaagcggggaagtggatagcttttcattgggcctgctctgtatctctattatgattgaggaagtgatgagatcaagatggtctcgaaagatgctaatgactggtacattagcggtattttttcttctgataatgggacaactaacctggaacgacctaatacgattatgcataatggtaggcgccaacgcctccgatcgaatggggatgggcactacgtatctagcgttgatggctacatttaagatgcggcccatgttcgcagtaggcttattatttaggcgcttaacatcacgtgaggttctcctgttgaccatcggacttagcctagtagccagtgttgaattgccaaacagcctagaagagctaggtgatgggcttgctatgggaataatgatcctaaaattattaacagacttccaatcgcaccaactatgggcaacattattaagcctcacattcataaaaacaacgttttctttacattatgcttggaagactatggctatggttctaagtattgttagtctgttgccattgtgcttgtcaacaactagccagaaaacgacctggcttcctgtcttgttggggtcattagggtgcaaacctttgactatgttcctaatcgccgaaaataagatttggggtaggaaatcatggccattaaacgaaggcatcatggcagttggaatagtgtcaatactactctcttcactattaaaaaacgatgtaccattagccgggccactcatagcgggaggtatgctaatagcctgttatgtaattagcggcagtagtgctgatctttcactcgaaaaagcagccgaagtaagttgggaggaagaggcagaacattcaggagcatcacacaacattttagtagaggttcaagatgacggaacaatgaaaattaaagacgaggagcgtgatgatactctgacaatactgttaaaagctacactcttagctgtaagtggagtttacccattaagtataccagcgaccttattcttatggtacttttggcaaaaaaagaaacaaagatcaggtgtactgtgggacacaccctccccacctgaagtcgaacgagctgttttagatgatggaatatacagaataatgcaaaggggattactaggtaggtcgcaggtaggtgttggagtttttcaagagaatgtgttccacactatgtggcatgtcacacgcggagcagtcctgatgtaccaaggaaagagacttgaaccaagttgggcatctgtcaaaaaagacctcatatcatacggtggaggctggagattacagggctcatggaacaccggggaagaggtacaggtcatagctgtagaaccagggaaaaacccaaaaaacgtccagactgcgccgggcacatttaagaccccagaaggagaagtaggtgcaatagcgctagattttaaaccggggactagtggttcaccgatagtaaatcgtgaggggaaaatcgtgggactgtatggaaatggggtagtgactactagtggaacatatgtttcagcgatagcacaagctaaagcaagccaagaaggtccactaccggaaatagaagatgaagtattcagaaagagaaacttaactattatggatttacacccagggagcggcaaaacgagaagatacctaccagccatagtgcgagaagcaattaaaagaaaattacgtactttaattttggctcctactcgagtagttgcttctgaaatggccgaggccctaaaaggaatgccaatccgctaccaaacgactgcagtaaagtctgagcatacaggtaaagagatagtggacttaatgtgccatgcaacgtttacaatgcgacttttatccccggtgcgtgttccaaactacaacatgattattatggatgaagctcattttacagatccttcttctattgctgctagagggtatatctcgacccgagtaggtatgggggaagcggcggccatattcatgactgccactcctccagggtctgttgaagcattccctcaaagtaatgcagtaatacaggacgaagaacgagatataccagagagatcttggaatagtggatatgaatggattacggattttcccggcaaaactgtctggttcgtacccagtataaaaagcggaaatgatattgccaactgccttcggaaaaacggtaaaagggttattcaattatcacgcaaaacctttgatactgaataccagaagacgaaaaataatgattgggattacgtggtaacgacagatatatctgaaatgggggctaatttccgagccgaccgagttatagacccacggagatgtttgaaacctgtcatactaaaagatggccaagaaagagttattctagctggaccaatgcctgtaacagtagcaagtgcggctcaaaggcgggggagaataggcagaaaccataataaagaaggcgaccaatatatctacatgggccagcctttaaacaatgatgaggatcatgcccattggacagaagcaaaaatgcttttagacaacatcaacacaccggaaggaataattcctgccttgttcgaacctgaacgagagaaatctgcagctatagatggagaatataggctacgtggtgaggcacgaaaaactttcgtggaattaatgagacgaggagatttaccggtatggttgtcttacaaggtagcttctgaaggcttccaatatagtgataggcgttggtgcttcgatggagaaaggaacaaccaagtcctagaagaaaatatggatgtagaaatatggacgaaggaaggggaacgcaagaaactcaggcctcggtggctagatgcaagaacatatagtgatcctctcgccttgcgcgaatttaaagaatttgcagcaggtcgacgtagtgtttcaggcgatttaattttggagattggtaaattgccgcagcatttaacccaaaaagcgcaaaatgctttggataatcttgttatgttgcacaattctgaacagggtggaagagcgtataggcacgctatggaggagttaccggatacaattgaaacattgatgctacttgcgcttattgccgtattaacaggcggcgttacattattcttcctaagcggaagaggattgggcaagacatcgatcggtttattatgtgtaatggctagcagtgctctattatggatggcatctgtagaaccccactggatagcggcatcaataattttagaatttttcctcatggtgctattgatacccgagcccgatagacaaaggacaccccaagataaccagttagcatacgtggttatcgggttactttttatgattctcactgttgccgccaatgagatgggtttgctagaaacaaccaaaaaagacttgggaattggacatgtggcagtagaaaaccatcaccacgcaactatgctagatgtagatttacatcctgcctcagcatggactctctatgcagtcgccaccaccattataacgcctatgatgagacatacgatagagaatacgacagccaatatatcactaactgccatagcaaatcaggcagcaatattaatggggttggacaaaggatggccaatatccaaaatggatattggtgttcctctattagcccttggctgttattcacaagttaatccgcttaccctaactgcagcagtattaatgctagtggctcattacgctataattgggcctggtttgcaagctaaagcaacacgcgaagcacagaaaagaactgcagctggtatcatgaaaaacccaaccgttgacggtatagtcgcaatagatctggatcccgtagtctatgacgcaaaatttgaaaaacagctcggacaaattatgctacttatactttgcaccagtcaaatacttctaatgaggacaacttgggcgttgtgcgaatcaattactctcgccacaggcccgctaaccaccctatgggaggggtccccaggtaaattttggaatactacaatagcagtgtctatggcaaatatttttcgaggatcttatttagccggagccgggcttgcattctcgttgatgaaatcattagggggtggaaggagaggcacaggggcacaaggagaaacactaggcgaaaagtggaaaagacaactaaatcaattaagtaaaagtgagtttaacacctacaagagaagcgggataatggaagtagatcgttcagaagcaaaagaaggattaaaaagaggtgagacaacacgtcatgccgtaagtaggggaactgctaaactccgctggtttgtagagagaaatctagttaaaccagaaggtaaagtaattgatctcggttgtggaagaggagggtggtcatattattgcgctggtttgaaaaaagtaacggaagttaaaggatatacaaagggtgggcccggccatgaagaaccaatcccaatggcgacgtatggctggaatctagtaaaactacattctgggaaggatgttttctttatacccccagagaaatgtgatactctcttatgtgatattggtgaaagttcgccgaatcctactatagaggaaggtaggaccctaagagtgcttaaaatggtggagccctggctaagaggtaatcaattctgtataaaaattttgaatccgtatatgccctccgttgtggagactctcgagcaaatgcagcgcaaacatggaggtatgctggttagaaacccgttatcgcgcaactctacacacgaaatgtactgggtatcatgtggaaccggtaacatcgtgtcggccgtaaacatgaccagtaggatgctactgaacagatttacgatggcgcataggaaacctacatatgaacgagatgtagatttgggagctggaactaggcatgtggctgtagaacctgaagtcgctaacttggacattataggccaaagaatagaaaatataaaacatgagcataagtcgacgtggcattacgatgaggataacccatacaaaacatgggcttaccacggatcttacgaagtcaaaccttcgggttctgcttcttcgatggtaaatggagtagttaaattactgacaaaaccatgggacgtaataccaatggtgacccaaatagcaatgaccgacaccacaccttttggacaacaacgagtattcaaagaaaaagttgacaccagaacgcccaaagctaaacaaggaactgcacaaattatggaagttacagcacgatggttgtgggggtttctaagcaggaataaaaaacctagaatatgtacaagggaagagttcaccagaaaggtccgttctaacgcagcaataggggcagtatttgtggatgaaaatcaatggaattcggcgaaagaagccgtggaagacgaaagattctgggacttggtccaccgagaacgtgaattacacaaacaagggaagtgtgcgacctgtgtctacaacatgatgggtaagagggaaaagaaattaggcgaatttgggaaggcaaaggggtctcgagctatatggtatatgtggttaggagcgcggtttcttgagtttgaagctttgggttttatgaatgaagatcattggtttagtcgagaaaattctttaagtggtgttgaaggtgaaggattgcataagctaggctatattttgagagatataagcaaaatacccggtggaaacatgtatgccgacgacaccgccggctgggatactcgaattacagaagatgatttaaggaacgaagcgaaaatcacagacattatggaaccagaacatgcattgttagcaactagtatcttcaaattgacgtatcaaaataaagtagtccgagtgcaacggcccgcaaagaacggtacagttatggacgttataagcagaagagaccaacggggatcaggccaagtaggcacgtatggactgaatacttttacaaatatggaagcccagttaataaggcaaatggaaagtgaaggtatcttttcaccttccgaactcgaaactccaaatttggccgaacgcgtattggattggctagaaaagtacggtgtcgaaagactaaaaagaatggcaatatcgggagatgactgtgtagtaaaacccatagatgatagattcgccacagcattaactgctctaaatgatatggggaaagtacggaaagatataccacaatgggaaccttcaaagggttggaatgattggcaacaggttcctttttgtagccatcactttcatcaattaataatgaaagacggtagagaaattgttgtcccatgcaggaatcaggacgaattagttggacgagctagagtttcacaaggtgcgggttggtcactaagagagacggcgtgcttaggcaaaagctatgcacaaatgtggcaactcatgtacttccatagacgcgatctacgattggctgccaatgcaatctgttcagcagtacccgtcgattgggtacccacgagcagaactacgtggtctatccatgcccaccatcaatggatgactacagaagatatgctctcggtttggaatagggtatggatagaggaaaacccatggatggaagacaaaacacacatttcctcgtgggaggatgtcccatatctcggcaaaagagaagatcagtggtgtggttcattgataggtctgacagctagggcgacttgggccactaacatacaagtagcaataaatcaagtaagaaggcttataggaaatgaaaattatctagattatatgacctccatgaagcgctttaaaaatgaatccgatccagaaggcgctttatggtaa

SEQ ID NO: 21190 - RNA, 9879 nt, synthetic construct
  misc_feature 1..9879: note = derived and/or modified CDS sequence (opt6) from DENV-1__FJ639679__SS-prME
  source 1..9879: mol_type = other RNA
tcagtaaccatgttgctcatgctaatgcctactgcgttagccttccatctcacaacacgaggtggagaaccgcacatgatagtttcgaaacaagaaagaggtaagagtttactttttaaaaccagcgctggtgtgaatatgtgcacactgattgcaatggatctgggagaattgtgtgaagatactatgacgtataagtgcccacggattacagaagcggaaccggatgatgtagattgctggtgtaatgccacagacacgtgggtgacttatggtacgtgctcacaaactggcgaacacagaagggacaaaaggagtgtcgcactcgcacctcacgttggtctaggcttagaaacaagaactgaaacctggatgtcgagtgaaggagcatggaaacaaatacaacgagtagaaacctgggcattaagacatcctgggtttaccgttatcgcattattcttagcacatgcaataggcaccagtataacacaaaagggaataatctttatacttctcatgttggtcactccttcgatggctatgcgctgtgttggaatagggtcaagagattttgttgaaggtttatcaggggccacctgggtggacgtagttcttgaacatggtagctgcgtcacaaccatggctaaagacaaaccaaccctagatatagaattacttaaaacggaagttacaaatcctgcaatattacgaaagttgtgtattgaggcaaaaatatctaataccacgacagattcgagatgtccaacccaaggcgaagctaccctcgttgaggaacaagacgcaaacttcgtatgtaggcggacttttgtggatagaggttggggtaatggctgcgggctttttggtaaaggttccttaatcacctgtgcaaagttcaaatgcgtaactaaactagaaggcaaaatagttcaatatgagaacttaaaatactcagtaatagttactgttcatacaggtgatcaacatcaggttgggaatgaaagtactgaacatggaacaacggccaccattacgcctcaagcacctactacggaaatccagttgacagactacggggctttgactttagattgttcgccaagaacaggacttgacttcaatgaaatggtgttattaactatgaaagagaaaagttggcttgtacataagcagtggtttttggacctcccccttccgtggacgtccggcgcatccacatcgcaggaaacatggaataggcaagacctattagtaacgtttaaaaccgcgcacgcgaagaaacaagaagttgtagtattaggttcgcaagaaggtgcaatgcatactgcacttactggggcgacagaaattcaaaccagtggaacaacaacaatcttcgcgggccaccttaaatgtcgattaaaaatggataaattaacattgaaaggaatgagttatgtcatgtgcacaggttccttcaaattagaaaaggaagtcgcagaaactcaacatggtactgtcctagtacagattaaatacgaaggaacagatgcaccttgtaaaatcccattcagtactcaagatgagaaaggagttacccaaaacggccgcttaataacagcaaatccgatagttacggataaagaaaagccagttaatatagaagctgaaccaccatttggcgagtcatatatagtaataggcgcaggcgaaaaggcgctaaaactaagttggttcaagaaaggatcttcaatagggaaaatgtttgaagctacagcaaggggtgctcgtagaatggccattttaggagatacagcttgggactttgggtcgatcggaggggtattcacctcagtaggaaaacttgtgcaccaaatatttggtaccgcatatggagtattattttctggcgtatcttggactatgaaaatcggtatcggggtcctcttaacgtggttgggattaaacagtaggtctacgtctctttctatgacctgcatcgctgtaggtctagttaccctgtatttgggagtaatggtccaagcagacagcggatgcgttataaattggaaaggtagagaacttaaatgcggtagtggaatctttgtaacaaatgaagtacacacttggactgaacaatataagttccaagcggattctccaaaacgattgtcagcagcgataggaaaagcctgggaagaaggagtatgcggtataaggtctgcgacacgcttagaaaatattatgtggaagcaaatttctaatgaactcaatcatatactgttagaaaacgatatgaaattcacagtagtagttggtgacgtcgcaggaatcttagcacagggcaagaaaatgatcagaccccaacccatggaatacaaatattcgtggaaatcgtggggcaaagcaaaaattataggtgcagacgttcaaaataccacatttatcattgatggccctaatacaccggagtgtcctgatgaccaaagggcatggaatatttgggaagtagaagactatggatttggtatatttactacaaacatctggctaaagctaagagactcatacacgcaagtgtgtgaccatagattgatgtctgcggctataaaagactcaaaggctgtccatgcggacatgggatattggatcgaatcggagaaaaatgaaacttggaagttggcaagagcatcttttatcgaggttaaaacctgtatatggcctaaatcgcatacattatggagtaacggtgtattggaatctgaaatgatcataccgaagatttacggagggccaatctcccaacataactatagacctggttactttacacaaacagcaggtccatggcacttaggcaaattagaactagatttcgatctatgtgaaggaacaacagtagtggttgacgagcattgcggcaatagaggaccatctcttaggaccacgaccgttactggtaaaataatacatgaatggtgttgtagaagttgcacccttccacccttacgattcagaggagaagacggttgctggtacggaatggaaattagacccgtcaaagagaaagaggaaaacctggtaaaaagcatggtgtctgcgggcagtggagaagtagatagtttctccttgggcctactctgcatatcgataatgatagaagaagtaatgcgaagtagatggtcacgaaaaatgttaatgaccggaactttagccgtatttctcttattaattatgggccaactcacatggaatgacctcatcagactatgtattatggtaggagccaacgcatcagataggatgggaatgggaacgacatatttagctctaatggcaacattcaaaatgcgacccatgtttgcagtcggcctactatttcgaagactgacatcacgagaggtgttactcttaaccattggactatcgctggtggcatcagtggagctaccaaattcattagaggagctgggtgatggattagcgatgggcattatgatcttaaaactattgactgatttccaaagtcaccaattatgggctacattgttatccctaacttttataaagactaccttcagccttcattatgcatggaagacgatggcaatggtattatccatagtttcgctattcccactttgtttatccactaccagtcaaaagacaacttggttacctgttctgctaggatcactcgggtgtaaaccccttaccatgtttcttatagcagaaaacaagatatggggcagacgttcatggccactcaacgagggcatcatggcagtagggatagtctctatcctgttatcatcgttactgaaaaatgatgtgccattggcgggaccgctaatagcgggagggatgttaattgcatgttatgtaatctccggttcatccgcagacctttctttggaaaaggctgcagaagtttcgtgggaagaagaagctgagcattcaggtgcatcacacaatatacttgtagaagtccaagacgatggaacaatgaagatcaaggatgaagaacgggatgataccctcactattttactaaaagctactttactcgctgtatcaggtgtgtatccgctgagtataccagcgacactattcgtttggtatttttggcagaaaaagaaacagagatctggagtgctttgggataccccatctccgccagaggtggaacgagcggtccttgatgatgggatctatagaattatgcagcggggattattaggacgaagtcaggtaggggttggcgttttccaggagaatgtattccatacgatgtggcatgtaacacgaggagctgtactcatgtatcaaggaaaaagattagaaccatcatgggcaagtgtgaagaaagatctaataagctatgggggaggatggcgccttcagggatcgtggaatacaggcgaagaagtccaagtaattgccgtggaacctggcaaaaatcccaaaaatgtacaaacggcccccggaacttttaagacgccagaaggtgaagtaggtgcaatcgcgcttgatttcaagccgggaacaagtgggtcccctatagttaatagagaaggaaaaatagtaggtttatacggaaatggtgtagttacgacttcaggtacatacgtgtcagcaattgcgcaggcaaaggctagccaagaaggcccactacccgagatagaagacgaagtatttcgaaaacgtaacctcaccattatggatctgcaccctggatcgggtaaaaccagacggtatttaccagctattgttcgtgaagccataaaacgcaagctaagaactttgatattagctcccacaagggtggttgcatcagagatggcagaagcgctaaaggggatgccaataagataccaaacgacagctgtaaagtcagaacacaccgggaaagagattgtagatttgatgtgccacgcgacgtttaccatgcgcctactttcgccggtaagagtccctaattacaacatgattataatggacgaagcacatttcaccgatccgagcagcatcgctgccagaggatatatcagcacaagagtagggatgggagaagccgctgctattttcatgaccgcaactccaccaggtagcgttgaagcgtttccccaatccaatgcagttatacaagacgaggaaagggatattcctgagcgatcctggaactctggttacgaatggataacggatttcccaggtaagacggtatggttcgtaccaagcattaaatcaggaaatgatattgccaattgtctacgcaaaaacggtaaacgagttattcaattgagtcgcaagactttcgatacagaatatcagaaaacgaaaaataacgattgggattatgtagtcacaaccgacatatcagagatgggggctaacttcagagcagatagggtaatcgacccgaggaggtgcctcaagccggttatactaaaagacggaccagaaagagttatactcgctggcccaatgccagttaccgtagcatcagcagctcagcgaaggggcagaattggtcgaaatcataataaagaaggcgatcaatatatctacatgggccaaccgcttaacaacgacgaggatcatgcgcattggacagaagccaagatgttactagataacataaatactccagaaggcattataccagctctatttgaaccagaacgagagaaaagtgcagccattgatggagaataccgcctaagaggtgaagccagaaaaacctttgttgaattaatgcggagaggagacttgcctgtatggttaagttacaaagttgcaagcgaggggttccaatacagcgacaggaggtggtgtttcgatggtgaaaggaacaatcaagtgctcgaagaaaacatggatgtcgagatatggacaaaagagggagaaagaaagaaattacgaccaagatggttagacgcacgcacttattcagatccattagcgctccgagagttcaaagaatttgcagccgggagacgttcagtctcaggcgatttaatacttgaaattggaaaactaccccaacacctcacacagagagcacaaaatgccctcgacaatttagttatgttgcataacagcgagcagggcggacgagcatatagacacgctatggaagaattacccgatactattgaaacactgatgcttttagccctaattgcagtgttaacaggtggggtaactctatttttcttatcgggccgtggtctaggaaagacaagcatcggtttattatgtgttatggccagcagtgtattactatggatggcatcagtagaaccccattggattgcagcaagtataatattggagtttttccttatggttcttttaataccagagccagacagacaaagaacgccacaggacaatcaattagcctacgttgttattggcctgttatttatgatactaacagttgcagctaatgaaatgggtttgttagaaactactaagaaagacttgggtataggacatgtggctgttgggaaccaccaccatgcagcaatgttggacgtagatctccatccggcaagcgcttggacactatatgctgtagcgacaacaattattactccaatgatgcggcatacaatcgagaacacaactgcaaacatttctctaacagcaattgctaaccaagctgctattttgatgggtttggacaaaggctggccaatcagcaaaatggatataggcgttcctcttttagccttaggttgctattcacaagtcaatccactgacgttaacggctgcagttttgatgctggttgcacattacgcaatcataggacctggtcttcaagcaaaagcaactagagaagcacagaaaaggaccgcagcggggataatgaaaaaccctaccgtggatggaatagtcgccattgatctcgatccagtagtatatgatgctaaatttgaaaaacagttagggcaaatcatgttgcttatactatgtacatcacagattttactaatgaggacgacatgggctttgtgtgagtcgattacactagctacaggaccacttacaactttatgggaagggtcaccaggtaaattttggaacacaacaatagctgtatctatggccaatattttccgaggtagttatcttgccggagctggattagccttttcattgatgaaatccttaggtggagggcgacgagggacaggagcccagggggaaaccttaggagaaaaatggaaaaggcaacttaaccaattatccaaaagtgagttcaatacttataaacggtccggtatcatggaggttgatcgaagtgaggcaaaggaaggtctaaaaagaggagaaacaactaaacatgcagtatcacgaggcactgcaaaattacggtggttcgttgaacgaaaccttgtgaagccagaaggcaaagtgatcgatttaggatgtggaaggggaggatggtcatattactgtgccgggttaaagaaagtaaccgaagtaaaaggatacacaaagggtgggcctggccatgaagaaccaattcctatggctacatacggatggaacctagttaaattacattccggaaaagacgttttctttatacctccagaaaaatgtgatacgttattgtgcgacatcggagaatcttcaccgaatcctacaatcgaagaaggaagaactttaagagtacttaaaatggtagaaccatggctaagaggaaatcaattttgtattaaaatattaaatccttatatgccgtcagtagtagagaccctcgagcaaatgcaaaggaaacacggtggcatgctggtaaggaatccactatctaggaatagcactcatgaaatgtactgggtgagctgtggaacaggtaatatagtaagcgccgttaatatgactagcaggatgcttctaaaccggtttaccatggcgcatcggaagccaacatacgaaagggacgtagatctcggtgcaggtacaagacatgttgcagtagaaccggaagtagcgaacctcgacatcatagggcaacgaatcgagaatataaagcatgagcacaaatcaacatggcattatgacgaagataacccctataaaacatgggcttatcatggaagctacgaagtgaaaccttccggtagtgccagttcaatggtcaacggtgtagtaaaactattaactaaaccctgggatgtcatacccatggttacacaaatagcaatgacagacacaactccgtttggacaacagcgtgtgtttaaagagaaagtagatacacgaactcctaaagctaagcgaggaaccgcacaaataatggaagtaacggccaaatggctttggggatttttaagtagaaataagaaacccagaatatgtacacgtgaggaatttacaagaaaagtaagatcaaatgcagcgattggagccgttttcgtcgatgaaaaccagtggaactcagccaaagaagctgttgaagacgaaagattttgggaccttgtacacagagaacgagagcttcacaagcaaggaaaatgtgctacgtgtgtctacaatatgatggggaagcgagagaagaaattaggagagttcggtaaagccaaaggatcaagagcaatatggtatatgtggcttggtgcaaggtttctggagtttgaagcattaggttttatgaatgaggaccattggtttagtagagaaaattccttaagtggagtagaaggagaaggcctccataagctaggatacatattaagggacataagcaaaataccaggtggtaatatgtacgcggatgatacagccggttgggataccaggataaccgaagatgaccttcagaatgaagctagaattacagatataatggaaccggaacatgcgctgctagccaaaagcatatttaaacttacatatcaaaataaagtagtgcgtgttcaaaggccagcaaagaacggtactgtaatggacgtgattagcagaagggatcaaagaggcagcggtcaggtcggcacttacggactgaatacatttaccaatatggaggctcaactaatccggcaaatggaatcagaagggatatttagcccatcggaactcgagactccaaatttagccgctcgtgtattggattggctagagaagtatggagtggaaaggttaaaaagaatggctattagtggagacgattgcgtagtcaagcccattgacgacaggtttgccactgcactaactgctctgaacgatatgggaaaagtaagaaaagatataccgcaatgggaaccatcaaaagggtggaacgactggcaacaggtacctttttgtagtcatcactttcaccaattgataatgaaggacggtcgcgaaatagtagtaccatgccgaaaccaggatgaactcgtaggtagagcaagagtaagtcaaggggctggatggtctttaagagagactgcatgcctaggaaaatcatatgctcagatgtggcaacttatgtattttcatcgtagagatctacgactcgctgctaatgccatctgcagtgcagtaccagtagattggatccccacttcacggacaacgtggagcatacatgcacaccatcagtggatgacaaccgaagatatgctgtctgtatggaatagggtttggatcgaagaaaatccctggatggaggacaagacgcacatttcgagttggggagatgttccgtatttaggaaaacgagaagaccagtggtgtggttccttaatagggctaactgctagggcaacatgggcgaccaacatccaggtcgcaataaatcaagttagaaggctaatcggaaatgaaaattatcttgattatatgacaagtatgaaaagatttaagaacgaaagcgatccagagggcgcgttatggtaa

SEQ ID NO: 21191 - RNA, 9879 nt, synthetic construct
  misc_feature 1..9879: note = derived and/or modified CDS sequence (opt6) from DENV-1__FJ850069__SS-prME
  source 1..9879: mol_type = other RNA
agtgtaaccatgttgttgatgctaatgcctactgcgttggcatttcaccttacgacaagagggggtgaacctcacatgatagtcggcaaacaagaaagaggaaaatcgctcttattcaaaacatctgccggggtaaacatgtgcaccttaattgcaatggatctaggtgaattatgtgaagatacaatgacatataaatgtcccagaataacggaagtagaacccgatgacgtcgattgctggtgcaatacgactgatacttgggtgacctacggcacatgcagccaaacgggagaacatcgccgcgataaaaggagcgtagcactggcaccccatgtgggactaggtctagaaacaagagctgaaacttggatgtcatcagaaggcgcttggaaacaaattcaacgggttgaaacctgggccctaaggcaccccggttttacggtaattgcactttttctagctcacgttattggcaccagcatcacgcaaaaaggcattatatttatacttctaatgttagtaaccccaagtatggcaatgcgctgtgtcggaataggttcacgcgactttgtagagggtttatcaggggcgacttgggttgatgtggtgttagaacacggatcatgcgtcacaacgatggcaaaagacaaacccaccctggatatagaactgttaaaaacggaagttactaatccagcagtacttcgcaaactatgcatagaagcgaaaattagcaacaccacaacggatagtcgatgtccaacgcaaggggaggccacattggtggaagaacaagatgccaatttcgtatgtagaaggacgtttgtggataggggatggggcaacggatgcggacttttcgggaaaggctccttgatcacttgcgctaaattcaaatgcgtcacaaaactcgaaggtaaaattgtccaatacgaaaaccttaaatattccgtcattgtaacagtccatactggagaccagcaccaagtgggaaacgaatcaacagaacatgggactacagccaccataacaccccaagctccaacgtcggagatacagctcacggattatggagctctcacactagattgttcgccaagaaccggactcgacttcaatgagatggtgctattaaccatgaaagagaaaagttggctagtacacaaacaatggtttctagacctcccacttccttggacatcaggagccagtacatcacaagagacgtggaatagacaagatctcttagtgacattcaaaacagcccatgctaagaaacaggaggtagtagtactgggatcacaagaaggtgcaatgcatacagcactaacgggcgcaacagagatacaaacatcaggaacgacaacgatattcgcaggacacctcaagtgtaggttaaaaatggataagttaacactcaagggtatgagttatgttatgtgtactggaagtttcaaattagaaaaggaagtggcagagacacaacacggaaccgttttagtacaaattaaatatgagggaaccgatgccccatgcaagataccgttttcaactcaagatgaaaaaggtgtgacacagaatgggcgcttgataactgcaaaccctatagtcacggataaagagaagcctgtgaatattgaggctgaacctcccttcggtgaaagctatatagttatcggggcaggagaaaaggcactaaaactaagttggtttaagaaaggatcctcaattggaaaaatgtttgaagcgaccgcccggggcgcgagaaggatggcaatactaggagataccgcttgggattttggatcaatagggggagtgtttacatctgtaggaaagctagttcatcaaatatttggaacagcttacggtgtattattctccggagtatcatggacaatgaagataggcattggagttcttctaacctggctaggacttaattctaggagtacgagtttatcaatgacatgtatagccgttgggctggtcacactatatttgggagtaatggtacaagccgattccggatgtgtgataaactggaaagggagagagctaaaatgcggatccggaatatttgtgacgaatgaagttcatacgtggacagagcagtataaatttcaggccgattcacccaaacgactttctgccgcaattgggaaggcttgggaagagggtgtatgtggtatccgtagtgcaacacgactagaaaatataatgtggcgtcaaataagcaacgagttgaatcacattttgctagaaaacgacatgaaatttactgtagttgttggagacgtagtggggatattggcacagggaaagaaaatgataagaccacaacctatggaacataaatacagttggaaaagttggggtaaagccaaaatcatcggtgcggatgttcaaaatacaacatttataatcgatggtcccaacactccagaatgtccagatgatcagagagcatggaatatatgggaggttgaagactatggatttggaatatttacgacgaatatatggctgaaattaagggattcttatactcaagtatgtgatcacagactaatgagtgccgccataaaggacagtaaagcagtacacgccgacatgggatattggattgaatcggagaagaacgaaacatggaagctcgctagagcatcgttcattgaggttaagacatgtatatggcccaaaagccacacgttatggagtaatggtgtcctcgaaagtgagatgataatacccaaaatatatggcggcccaatttctcagcataattaccgtcctggatactttacccaaacagcaggaccatggcatttagggaagttggaactcgatttcgatctttgtgaaggtacaactgtagtcgtcgatgaacactgtggtaacagaggacctagtctacgtaccacaacagtgacaggtaaaattattcatgaatggtgttgtcgatcttgtacgttaccacctttaagattcaaaggtgaagacggttgttggtatggcatggagatcaggccggtaaaagagaaagaagaaaatctggtcaaaagtatggtgagtgctggaagtggggaagtggactctttttccctaggcctgttgtgtatatccataatgatcgaagaggttatgagatcaagatggtccagaaaaatgctaatgacagggactttagctgtgttctttctattaataatggggcagctaacatggaatgatttaatcagactgtgtatcatggtgggcgctaacgcatctgaccgcatgggaatgggtacgacttatctagcgctaatggccacatttaagatgcggcccatgttcgcagtagggttattatttcggagattgacatcaagagaagtattgttattaacaatagggctatctttagttgcgtccgtagagttacctaactcgttagaagaattaggagatggattagctatgggtattatgatattgaaattactcactgattttcaaagttaccaactctgggtgacactattatccctaacttttattaagacaactttttcgcttcattatgcgtggaaaacgatggctatggtcctatctatagtctctctgttacccttgtgtttaagtaccacatctcagaaaacaacctggcttccagtactcttggggtcacttggatgtaaaccacttacgatgttcttcatagccgaaaataaaatatggggacgcaaatcttggccactgaacgagggaattatggccgtagggatcgtcagcatcttgctcagcagtctactgaaaaacgacgttccactagctggtccactcatagccggtggtatgttaatcgcttgctacgtaataagtgggagtagtgcagatctatcactcgagaaggcagctgaggtatcgtgggaagaggaagctgagcactctggggcatcacataatatcctagtagaggttcaggatgacggaacaatgaaaataaaagacgaagagagagacgacactttgacaatattgttaaaagcaactttactagcggtaagcggagtatatccactatctataccggcaacattatttgtgtggtacttttggcagaagaagaaacaaagaagcggcgtcctatgggatacaccatcgcctccagaggtagaacgagcggtattagacgacggcatttatcgtataatgcaaagaggcttgttgggaagatctcaagtgggggtaggagttttccaggaaaacgtattccacacgatgtggcatgtaactcgtggtgccgttctaatgtatcaaggaaaacgtttggagccatcgtgggcaagcgtcaaaaaggacctcatctcatatggaggaggatggaggttacagggttcgtggaataccggagaggaagtgcaagttatagcggtagaacctggtaaaaaccccaaaaacgtccaaacagcaccaggtactttcaagactccagaaggcgaggttggagcaatagcgttagacttcaaaccagggacatccggatcgccaatcgtaaacagagaaggaaagatagtaggattatacgggaatggggtggttacaacatcaggaacgtacgtatcggcaatcgcgcaagcaaaggcttctcaagaaggccctcttccagaaattgaggatgaagtttttaggaaacgcaatttaactataatggatttacatccgggctcaggcaaaaccagaaggtacttaccggccattgtacgtgaggcgatcaagagaaaacttagaactttaatccttgcacctactagggtggtcgcgtcggaaatggccgaggctttaaaggggatgcctatacgttatcagacaacggccgttaagtcggaacatactggaagggaaatagtggatcttatgtgccacgcgacttttactatgcgattgctttcaccggtacgagtaccgaactataacatgataataatggatgaggcacattttacagatccatcctcaatagcagccagaggatatattagcacgcgagtcggtatgggggaagcagcagcaattttcatgacggctacgccaccaggatcggtagaagcattcccacaatccaacgctgtaatccaggacgaggaaagggacataccagaaagaagttggaacagcggttacgaatggataacagactttcccgggaaaacggtctggtttgttccatctatcaagagtggtaatgacattgcaaattgtctcaggaaaaacggaaagcgagtaatacaattgtcgagaaaaacgtttgacactgaataccagaaaaccaaaaataatgactgggactatgtagtcacaaccgatatatctgaaatgggagcaaatttccgagcggatcgcgttattgacccaagacggtgccttaaacccgttattttgaaagatggaccagaacgggtaatattagcaggccctatgccagtgacagttgccagtgccgcgcaacgcagaggcaggataggacgtaatcacaataaagagggcgaccaatatatttatatgggacagccactaaataacgatgaagatcacgcccattggacagaagccaaaatgttgctagataacattaatacaccggagggaataataccggctctatttgaaccagaacgagaaaagagtgctgcgattgatggagaatatcgattgagaggagaagctaggaaaacattcgtggaactaatgagaaggggagaccttccggtgtggttatcctacaaggttgcaagtgaaggattccaatatagtgacaggcgatggtgttttgacggagagcgaaataatcaagttctagaagagaatatggatgtagaaatttggacaaaggaaggagaaaggaagaaactacgaccgagatggttagatgccagaacatatagtgatcccctagcccttcgtgaatttaaagagtttgctgcaggaagaagaagcatctccggggacctaatattggagataggtaaattacctcaacatctaactcaacgtgcgcaaaacgcattagataacttggtaatgttacataattcagaacaaggcggtagagcatatagacatgctatggaggaattaccagatactattgaaactttaatgcttttagcacttattgcagtattaacaggcggtgtcacactattcttccttagcggacgtgggctaggtaaaacatcaataggtttattatgtgtaatggcgagcagtgccctgttatggatggcatcagttgaacctcactggattgctgcatctataatcctagagttcttccttatggtcttattaatacccgaacccgatagacagagaacaccgcaagacaatcaacttgcatacgtggtaataggtctcttattcatgattttaacagtggcagctaatgaaatgggtttattagaaacgactaagaaagatctcggaatagggcatgtggctgtagaaaatcatcatcacgcgaccatgttggacgtagatttacatcccgcatcagcctggactctttacgctgtcgcaactactattataacaccgatgatgagacacacaatagagaatactacagctaatataagtttaacagcaatagcaaaccaggcagcaatattaatgggcctagataaaggatggccaataagtaaaatggatataggtgtacccttattagctctcggatgttacagccaagtcaatccactgaccttgactgctgcggtgttgatgttagtagcacactacgcaatcataggtcctggtctacaagcaaaagccacaagagaggcacagaagcgcacagcagctgggatcatgaaaaatccaacggtagacggaattgttgcaatagacttggacccagtggtatatgatgcgaagtttgaaaagcaactgggacaaatcatgcttctgattctatgcacttcacaaatactcctcatgcgaaccacgtgggcattatgcgaatctatcaccctagcaactgggccgttgacaacattatgggagggaagtccgggaaagttctggaatacaacaatcgccgtgtcgatggctaatatattccgtggaagttacctcgctggcgcaggtttagccttttcattgatgaaaagtctcggaggaggacgtcgtggtacgggagcacaaggcgagacactaggtgaaaagtggaaaaggcaactaaatcaactgtcaaaaagcgaatttaatacgtataaaaggtccggcatactcgaggtggatcgatctgaagctaaagaagggctaagacgaggagaaacaacaaaacatgccgtttcacgtggaacagcaaagctaaggtggtttgtagaacgcaatttggtaaaaccagaagggaaagttatagatcttggttgcgggcgtggcggttggtcatactactgtgctggtttgaagaaagtgacagaagtaaaagggtatacaaagggtggccccggacatgaagaaccaattccaatggccacctatggatggaatttagtcaagttgcacagcggtaaagacgtattctttataccaccagagaagtgcgacaccctattatgtgatattggggaatcatcccctaaccccacaattgaagaaggccgaacgttacgagtcctaaaaatggtagaaccgtggcttagaggtaatcaattttgcatcaagattctaaacccttatatgccatcggtcgtagaaacactggaacagatgcaaagaaaacatggtggaatgttagtacgaaatcccttatcacgaaactccacacacgaaatgtactgggtctcatgcggaacaggaaatatagtgtcggctgtaaatatgacatctcgaatgttactcaaccggtttacaatggcccaccgcaaaccaacgtacgaacgagatgttgatcttggtgcgggcaccaggcacgtggccgtagaaccagaagtagcaaatttagacattattggacagcgtattgaaaatatcaaacacgaacataaaagtacatggcactacgacgaagataatccgtataaaacctgggcttatcatggttcatatgaagtaaaacccagtggtagcgcaagttctatggtgaatggtgtagtgaaactacttacgaaaccctgggatgtcatacccatggtgacacaaatcgctatgacagacacaacaccatttggccaacaaagggtattcaaggaaaaagttgacacgagaacaccgaaagcaaaaagagggaccgctcagataatggaggttacggcaggatggctatggggttttctgtcaagaaataagaaaccacgtatctgtactagagaagaatttacgagaaaagttagaagtaacgcagcaattggtgcagtcttcgtggatgaaaaccaatggaactccgccaaagaagcagtcgaagatgagagattttgggacctcgtgcatcgtgaaagggaattacataaacaggggaaatgcgcaacttgtgtatacaacatgatgggcaagagagagaagaaacttggagaatttggtaaagcaaaagggtcccgtgcaatatggtacatgtggctgggagcaagatttctcgagttcgaggctttggggtttatgaacgaggatcattggtttagccgggaaaattcattaagcggtgtggaaggcgaaggattacacaaacttggctacatactgcgtgatatttccaagattccaggaggtaatatgtacgcagatgacacggctggatgggatacacgaataactgaagacgacttacaaaatgaagctaaaataacggatatcatggaacccgagcacgcactattagccacaagcatatttaaattaacataccaaaataaagtggtcagggtacagaggccagcgaaaaatggaacagtgatggacgtcataagcagaagagatcaaaggggaagtggacaagtaggcacttatggattgaacacatttacgaacatggaagcccaactcatccgacaaatggaaagcgaaggtatatttagtccgtcagagttagaaactcccaatctagcagagcgagtgctggactggttagaaaaatatggcgtagaaagattaaaaaggatggcaatatccggtgatgactgcgtagtaaagcccatagatgatcgatttgctacggcgctgacagcattaaacgacatgggcaaggttcgcaaagatataccacaatgggaacctagtaaagggtggaacgactggcagcaagttccattctgtagtcaccactttcatcaattgataatgaaagacggtcgagaaatagttgtaccatgcagaaatcaagatgaattagtgggcagggccagagtttctcagggagcaggctggtcactaagagagactgcttgcttaggcaagtcatacgcgcagatgtggcagttaatgtacttccacaggcgtgatcttagacttgcagctaatgccatttgctcggcggtaccggtcgactgggtaccaacttcaagaactacatggtcaatacacgcacatcatcaatggatgaccaccgaagatatgctgtcggtgtggaatcgagtttggatagaagaaaatccttggatggaagacaaaacacatatatcctcatgggaggacgtcccctatctagggaaaagagaagaccaatggtgtggaagtctaattggtttaacggcacgggccacatgggcaacaaacatacaagttgcaataaaccaagtacggaggctgatagggaatgaaaattatttagattatatgacgtctatgaaacgttttaagaatgaatcagacacagaaggagctctttggtga

SEQ ID NO: 21192 - RNA, 9879 nt, synthetic construct
  misc_feature 1..9879: note = derived and/or modified CDS sequence (opt6) from DENV-1__FJ639680__SS-prME
  source 1..9879: mol_type = other RNA
tcagtaactatgcttttgatgttaatgccgactgctttagcattccatctcactacgcggggaggtgaaccacacatgatagtttctaaacaagaaagaggaaaatcgttgctttttaaaacttccgcaggagtaaacatgtgtactctaatagcaatggatttgggcgaactttgtgaagatactatgacttacaaatgcccgcgtattaccgaagcagaacccgatgatgtagattgctggtgtaacgcgacggacacatgggtaacctatggcacgtgttcccaaacgggggaacatcgtagagataaaagatccgtggccttagctccacatgttggacttgggctagaaaccagaactgagacgtggatgtcctcggagggcgcttggaaacaaatacaaagggtagaaacctgggctctacgacaccctggatttacagtaattgcattatttttagcgcatgctattggcacatcaatcacccaaaaaggtataatttttatcctgctcatgcttgtaactccctcaatggctatgagatgtgtcggcattggttctagggacttcgttgaaggcctatctggcgcaacgtgggtagacgtggtcctagaacacggttcgtgtgtaacaacaatggctaaagataaaccgactctagacattgaactattaaaaacggaagtaaccaatcccgccgttctaagaaaactttgtattgaggcaaaaatatccaacacaactacggattcaaggtgtcctacacagggagaggcaactctagtagaggagcaagacgctaactttgtctgcaggagaacatttgtagacagaggatggggtaatggttgcggattatttggaaaaggatccctcataacatgtgccaaatttaaatgtgttactaaactagaagggaaaatcgttcaatacgaaaacctaaaatacagcgttattgtaacagtgcataccggtgatcaacaccaagtgggaaacgaaagtactgagcatggaactacggctacaataacgccccaagccccgaccactgaaattcaactaaccgactacggagcccttacattagactgtagccctagaacaggactcgacttcaacgagatggtgctgttgactatgaaggaaaaatcatggttagtgcacaagcaatggtttttggatctaccattaccgtggacttctggtgcgtcaacttctcaagaaacttggaataggcaagatctgctggtcacatttaaaacagctcatgccaagaaacaagaagttgttgtactagggtcccaagaaggagcgatgcacacggcgctcacgggtgccacagagatacaaacaagtggaaccacaacgatcttcgcaggtcacttgaagtgcagattaaagatggataaactaactctgaaaggcatgtcttatgtgatgtgtacaggatccttcaagttggaaaaggaagttgcagagactcaacatggaaccgtcttagtacaaatcaaatatgagggaactgacgctccctgtaaaattccattcagtactcaagatgaaaaaggcgttacacaaaacggacgattaatcacagcaaaccccattgtgacggataaggaaaagccagtaaacatcgaagcagaaccgccctttggtgagagctatatagtaataggtgcgggcgagaaggcattgaagctatcttggtttaaaaagggtagttctattgggaaaatgtttgaagctacggccagaggcgcgcgtcgcatggctatactaggagatacggcttgggatttcggttccataggaggggtatttacatcagtggggaaattggtgcatcaaatattcgggacagcttatggagtcctgttctccggcgtctcatggaccatgaagatcggtataggagtgctgctcacatggctcggattgaactcaagaagtacatcactgtcaatgacttgtatcgcagtgggccttgttacactatatctaggggttatggtgcaggcggattctgggtgcgttattaactggaaaggccgtgaactaaagtgcggtagtggtatttttgtgacgaatgaggtccatacatggaccgaacagtacaaatttcaagctgactcgcctaaaagactgtcagccgcaataggaaaggcttgggaagagggagtttgcgggatacgtagtgccacgaggttggaaaacataatgtggaaacagatatcgaacgaattaaaccatatcttattggaaaacgacatgaagttgactgtcgtagttggtgatgtcgcgggcatactcgcacaaggtaaaaagatgattagaccgcagccaatggaatataaatattcttggaagtcatggggaaaagctaaaataatcggagctgacgcacagaacactacgttcatcatcgatggtccaaacacacctgaatgtccagatgaccaaagagcttggaatatatgggaagtagaggattatggatttggaatttttaccactaacatttggctgaaactaagagactcttacactcaggtttgcgatcaccggttaatgtcagcagccatcaaggattcaaaagcagtccatgctgatatggggtattggatagaaagtgaaaagaatgaaacgtggaagctggccagggcaagttttattgaagtaaaaacatgcatatggcctaaatcccataccctctggagtaatggagtgctcgaatcagaaatgattataccgaaaatatacggcgggccgatttcacaacacaattacagaccaggttactttactcaaactgctggcccctggcacttaggcaaactcgaacttgatttcgatctttgcgaaggtacaactgtggtcgttgacgaacactgcggcaatcggggaccgtctttaagaacgactactgttacgggcaagataattcacgaatggtgttgtagatcatgtacactaccaccattaaggtttagaggagaggatggatgttggtacggaatggaaatccgacctgtcaaagaaaaggaagagaacttagtaaagagcatggtctctgcagggtctggcgaggtagactcattcagcttaggccttctatgtatcagtataatgatagaagaagtaatgaggtctcgctggtcgaggaaaatgctaatgaccggcactctagccgtatttttcttactaataatggggcaattgacatggaatgaccttatcagactttgcataatggttggcgccaatgcatctgatcgcatgggcatgggaacaacataccttgctttgatggcgacatttaaaatgagaccaatgttcgcagtaggcctactatttcgacggttaacaagtcgagaagtactattactaacgataggactcagcctggttgcatcagtagaactacctaactccctggaagaacttggagatggtttggcaatgggaataatgattttgaaattgttaacagactttcagagccatcaattgtgggcaactctactatccctaacatttatcaaaactacattttcactccattatgcatggaaaacgatggctatggtcttatctatagttagtttatttccattatgtctatccaccacttcacaaaagacaacatggcttccagtattgctgggttcattgggttgcaaacctcttacaatgtttttgatagcagagaacaaaatttgggggagaaaaagctggcctcttaacgaaggtataatggcggttggcatcgtatccatacttttatctagtttactaaagaatgatgttccactcgctgggccattaatagctggtggtatgctaatagcatgctacgtaatttccggttcatctgcagacttatcattagaaaaagcagcagaggtaagctgggaggaagaagcggaacactcgggagcgagccataacatattagtagaagtacaagacgatggaactatgaaaataaaagatgaggaaagagatgacaccttaacaatactcctcaaggctactttgctagccgtttctggagtatatccattatcaatccctgccacgttatttgtgtggtacttttggcagaagaagaaacaacgatcgggcgtactatgggatactcccagccctccagaagttgaaagagctgtattagatgatggaatatacagaataatgcaaagaggattattggggagaagtcaagtaggagttggagtatttcaagagaatgtgttccatacaatgtggcatgttacgagaggtgccgtacttatgtaccaaggtaaaaggctagagccaagctgggcaagtgtcaagaaagacttgataagctacggaggaggctggcgactccaaggatcttggaatactggcgaagaagtgcaagtgattgccgttgaacctggcaaaaatccgaaaaatgtccagacagcaccaggaacatttaagacacccgaaggggaagtgggggcaatagcgctggattttaagcccggtacaagcggatcaccaattgtaaatagagaaggcaaaatcgtaggtctttatggaaacggggtagtaactacaagcggaacatatgtgtccgcaatagcgcaagcaaaggcatctcaggaagggccattgccggaaatagaagatgaggtattcaggaagcgaaacttaaccattatggacttacatccgggttcaggaaaaacaagacgttacttgcctgcgatagtgagggaggctataaagcgtaagctacgcacactaatacttgctccaactagggtagttgcctctgagatggccgaagcattaaaaggaatgccgataagataccaaacaacagcggttaaatctgaacacacaggcaaggaaatagtagacctaatgtgtcacgcgacttttacaatgcgcttacttagtccagttcgagtaccaaattataatatgatcataatggacgaagcacattttactgatccttcatccatagcagcccgaggatatatttcaaccagagttggaatgggagaagcagcagcaatatttatgacggcgacccctcctggatccgttgaggcttttccacaatcaaacgcagtgattcaagatgaagaacgtgacataccagaaagatcttggaactctggatatgagtggataactgacttcccgggaaaaaccgtctggtttgtgccatcaattaaatcgggcaatgacatagcaaactgcttaaggaaaaatggtaaaagagtaattcaactatcgaggaaaacattcgacacggagtaccagaaaacgaagaacaatgattgggattacgtagttacaacagatatatccgagatgggggccaacttcagagcagatagggtcatcgatccaagaaggtgtttgaaaccagttatattgaaggacggccctgaacgtgttattctagcgggaccaatgcctgttacggttgcgtcagccgcgcagaggcgtgggaggataggtcgaaatcataacaaagagggagatcaatatatatacatggggcagcctctaaataatgatgaagaccatgcccattggacagaggctaaaatgctattggacaacataaatacacctgaaggcataattccggccttattcgagccagaaagggagaaatcggcagcgatagacggtgagtatcggttgcgtggagaggcacgcaaaactttcgtagaattgatgagacgcggagatctaccagtatggttgagctataaggttgcttctgaaggtttccaatattcagaccgacgttggtgctttgatggagaaagaaataaccaggttttggaagaaaacatggacgtggaaatctggaccaaggaaggtgaaaggaagaaattaagaccgcgttggttagatgcaaggacatattccgaccctttagccctcagagagtttaaggaatttgcagcaggaagaaggagtgtttccggagatctaatcctcgaaatagggaaacttccccaacatttgacacagcgtgcgcaaaatgccttagacaatctagtcatgctacataatagcgagcaaggagggcgtgcctataggcatgccatggaagaactcccggacactattgaaactctcatgttactagcattaatagctgttctgactggaggagtaacactgtttttcctgagcggacgtggtctgggtaagacttcaataggacttttatgcgttatggcatcatcagtgcttctgtggatggcctctgttgaacctcattggatagcagcttcaattatactagaatttttcctaatggtactgctaatacccgaaccagatagacagaggacaccgcaggataatcagttagcatatgtcgtgattggattactatttatgatattaacagtcgcagcaaacgaaatgggtctattagaaacaactaagaaagatctcggaattggacacgtagcagtagaaaatcataatcacgcagctatgttagacgttgatcttcacccagcatccgcctggaccttgtacgctgtcgcaacgactataattacaccaatgatgaggcacactattgaaaacaccacagctaacataagtctcaccgcgatagcaaatcaggcagccatactaatggggctcgacaaaggctggccaatcagtaaaatggacatcggtgtgcccctgctggcacttggatgttattctcaggttaatccgttaaccctcaccgcagcggtattaatgttagttgcccattacgcaattatcggacctggtcttcaagcaaaagctactcgtgaagcgcaaaaacgtacagcagcgggaataatgaaaaatccaacagtagatggaatagtagcaatcgatctagacccagttgtatacgatgcaaagtttgaaaagcaactggggcaaatcatgttactcatattatgtacaagtcaaatattattgatgagaacaacatgggcattatgcgagagcatcaccttagcaactggtcctctaacaaccttatgggaaggttctccaggcaaattctggaatacaacaattgcagtgtccatggctaacatctttcgtggatcgtacctagcgggagcaggattagctttctctttgatgaagtcactaggaggaggtagacgtggtacaggtgcgcaaggagaaaccctgggcgagaaatggaagcgtcaactcaatcaactaagcaaaagtgagtttaatacgtataaacgatcaggcatcatggaggtagatcggagcgaagctaaagaaggcctaaaaaggggtgaaacaactaaacacgcagtaagtcggggtactgcgaagttgcgttggttcgtcgaaagaaatttagttaaaccagagggaaaagtcattgacttggggtgcggccgaggcggttggtcctattattgtgccggattaaagaaagttactgaggtaaaaggatacacaaaaggtgggccgggtcatgaagaaccaattccaatggcaacatacggatggaatctggtaaaattgcattccggtaaagatgtcttcttcataccacctgagaaatgtgacacattattatgcgatataggagaatccagtccaaatcccacaatcgaagagggtagaacgctgagagtattaaagatggtagaaccctggttacgaggaaatcaattttgcataaaaattttaaacccatacatgccttccgtagttgaaactttagagcaaatgcaacggaagcacggaggaatgcttgtacgaaaccctttgagccgaaattcaactcatgaaatgtattgggtgtcgtgcgggactggaaatattgttagcgcggttaacatgacctccagaatgctactaaacaggttcactatggcccatcgtaaacccacatacgaaagagatgtcgaccttggaacaggaacacgacatgtcgcagtcgagccagaagtcgccaatttagatataataggccaaagaatagaaaatataaaacatgaacataaaagtacttggcattacgatgaggacaatccgtacaaaacatgggcatatcacggtagctacgaggttaaaccttcaggatcagcttcgagcatggtaaatggcgttgtaaaactcctgacaaaaccgtgggacgtcatacctatggtgacacagatagcgatgacggacactacgccatttggccaacaaagggtatttaaagaaaaggtcgacacccgaactccaaaagcaaaaagaggaaccgctcaaataatggaagtcacggcaaggtggctgtggggtttcctcagtcgaaacaagaaaccaagaatttgtacacgtgaagagttcacgagaaaagtaaggtccaatgcagcaataggagctgtgttcgtagatgaaaatcaatggaatagtgctaaagaagccgtggaagacgaaagattttgggatttagtacaccgagaaagggaacttcataaacagggaaagtgtgctacatgcgtttataacatgatgggaaaaagggagaagaaattgggtgaatttggcaaagccaaaggatcgagggcgatatggtatatgtggctcggcgccagatttttggaatttgaggcactgggctttatgaacgaagatcactggttttctcgagaaaactctctttcgggtgtagaaggcgaagggctacataaattaggatatatattgagagatatatctaaaatacctggaggtaatatgtatgctgatgatacagcaggatgggatactagaattacagaggatgacctgcagaatgaagctaagataactgatattatggaaccagagcatgcgttacttgctaaagcaatattcaaattgacctaccaaaacaaagttgtaagagtccaaagacccgccaaaaacggcactgtaatggacgtcattagccgaagggatcaacggggttcaggccaagtcggtacttacgggctaaacacgtttacaaacatggaagcccaattgattcgacaaatggaatctgagggtatattttcaccatccgaacttgaaacaccaaacttagcagaaagagcacttgattggttagagaagtatggagtcgaaaggttaaaaagaatggcaatctcaggagatgactgtgtagtaaagccaatagatgatagatttgctacagctttaacggccttaaacgatatgggtaaagtacgcaaagatataccacaatgggagccatcaaagggttggaatgactggcagcaggttccgttctgttcacaccattttcatcaattaataatgaaagatgggcgtgaaatagtcgtcccatgcagaaatcaagacgagcttgtaggcagagcaagagtaagtcaaggtgcgggctggagtctgagagaaaccgcctgtcttgggaaaagctatgcccaaatgtggcaacttatgtatttccatcgaagagacctaaggttagcagcaaatgcgatatgctcggccgtaccagttgactgggtacctacatcacgaacgacatggagcatacatgcacatcatcaatggatgacaactgaagacatgttaagtgtttggaacagagtatggatagaagaaaatccatggatggaagataaaacacacataagctcctgggaagatgtcccttatctaggtaagagggaagatcaatggtgtggatctctaattgggctaacagcgagagcaacttgggcaacaaatatacaagtcgctataaaccaggtgagaagacttatcggaaacgaaaattacctagattatatgaccagcatgaaacgattcaaaaatgaatctgacccagaaggagcactttggtga

SEQ ID NO: 21193 - RNA, 9879 nt, synthetic construct
  misc_feature 1..9879: note = derived and/or modified CDS sequence (opt6) from DENV-1__FJ639682__SS-prME
  source 1..9879: mol_type = other RNA
tcagtgacaatgttactaatgctaatgccaacagcactggctttccatctgacaacacgaggaggggaaccacacatgatagtcagcaaacaagaaagggggaaatctttgttatttaaaacgtcagcaggagtgaatatgtgcacactaatagcaatggatttaggcgaattatgcgaagatacaatgacttataaatgtccaagaataacggaagcagaacccgatgatgtcgactgttggtgcaacgcgactgatacatgggttacatatggtacttgcagtcaaacgggggaacatagaagagacaaaaggagcgtcgcgctagcaccacatgttggactaggattagaaacaagaactgaaacatggatgtcctccgaaggagcctggaaacaaatacagagggtagaaacatgggcactaagacatccaggattcacggtaattgctttattcctggcgcatgccatcgggaccagtataactcaaaaaggaatcatatttatattactaatgctcgtgactccctcaatggcgatgaggtgcgtaggaattgggagcagagattttgttgaaggactaagcggcgcgacgtgggttgatgtagtcctcgaacatgggagttgtgtcacgaccatggcaaaagataaaccaacactagatatcgaacttttgaaaacagaagtaacaaatccagcagttctcaggaaactctgtatcgaagcaaaaattagtaatactaccactgactcccgatgcccaactcaaggagaagcgaccctagttgaagaacaagacgctaatttcgtttgtcgaaggacatttgtggatcgtgggtggggtaacggatgcggattatttggaaaagggagcttaataacctgcgctaaattcaagtgtgtaacaaaacttgaaggaaaaattgtccaatacgaaaacctaaagtacagtgtaattgtaacggtgcacacaggagatcaacatcaggtaggaaacgaatcaacggaacacggaaccacagcgactatcacaccgcaagcaccaaccaccgaaatacaactcacagactatggagctttaacactagattgttcccccagaactggacttgacttcaatgaaatggtactactaacgatgaaagaaaaatcgtggctggtgcataagcaatggtttttggacctaccgctaccgtggacaagcggagcatctacatctcaggaaacttggaatcgacaagatttattggttacttttaaaaccgctcatgcaaagaagcaggaagtcgttgtactagggtcacaagaaggtgcaatgcatactgccttaacgggcgctacagagatacaaaccagtggaacaactacaatatttgcaggtcatctaaaatgtcgcttgaaaatggataaattgacactgaagggtatgagttatgtaatgtgcactggttcctttaaattagagaaggaagtcgccgaaactcagcatggtacagtattggtccaaataaagtatgagggtacagatgcaccctgtaaaataccattttcaactcaagatgagaaaggggtaacgcaaaatggtaggttgataactgccaacccaattgtgaccgacaaagaaaaaccagtcaacattgaagccgaaccaccatttggtgaatcttatatcgtaataggtgccggcgagaaaacattaaaactttcatggtttaagaaaggttcgagcataggaaaaatgttcgaagccacagccagaggagcaaggagaatggccattttgggcgataccgcttgggactttggctcaataggcggggtcttcacatctgtaggaaaattagtacatcaaatatttggcacggcatatggagtcctattctcaggagtatcatggactatgaagattgggatcggcgtgcttttgacgtggctaggtctaaactctcgatcaaccagcttatctatgacatgtatagcagtaggtttagtcacattatacctaggagtaatggtccaggcagattcaggatgtgttataaactggaaaggcagagaattaaaatgcgggtcgggaatctttgtgactaacgaagttcatacatggaccgaacaatataaatttcaagccgactcgcctaaaagactttcggcagcaatcggtaaggcttgggaagagggagtgtgtggaattagaagcgcaacaagactcgaaaatataatgtggaaacaaattagtaacgagttaaaccacatattattagagaacgacatgaaactcacagtagtcgttggagatgtagctgggattcttgctcaaggcaagaaaatgatacgtccccaaccaatggaatataaatatagctggaaatcatggggaaaagcaaaaattataggcgcagacgctcagaataccactttcataatcgacggaccaaatacacctgaatgtccggatgatcaaagagcatggaatatatgggaagtagaagactatgggttcggaatattcactactaacatttggctcaaacttcgtgactcctatacacaagtatgtgatcatcgattaatgtccgccgcaattaaggatagtaaagctgtccacgcagatatgggatattggatagaaagtgagaaaaatgaaacctggaaattggcgagagcttcttttatagaggtaaagacatgtatctggcccaagtctcatactctatggagcaatggggtcctagaaagtgaaatgatcatccccaaaatttatgggggaccaatttcacaacataattataggccaggatatttcacacagacagcgggtccctggcacctaggaaaattagaactggacttcgacttatgtgaaggcacaactgtagtagtagacgaacactgcggaaatagaggtccaagtttacgtactacaacagtcactggaaaaattatacacgaatggtgctgccgatcttgcacattacctcctctacgttttagaggggaggatggatgttggtatggaatggagatacgaccagtaaaagaaaaggaggaaaatttagtgaaatccatggtaagcgcgggaagtggagaggtagacagttttagtcttggattgctgtgcatctcaattatgatagaagaggtcatgagatcacgttggagcagaaaaatgctaatgactgggacattagctgtattctttctgctaatcatgggtcaactaacatggaacgacctgatacgtttatgtataatggtaggtgcaaacgcgtcagacagaatgggaatggggacaacgtatttggcattgatggccacatttaagatgagaccgatgtttgcggtcggtcttctgtttcgaagactcacaagtagggaagtattgcttctgacaatcggcttaagtttagtggcaagtgtagaattaccaaattctctcgaggaattaggtgacggcctagcaatgggaataatgatactaaaactcttaacagacttccagagtcaccaactgtgggccacactattaagtctaacattcataaagaccactttctccctacattatgcatggaaaacaatggcaatggtattgagtatagtgagcctattccccctctgtctctcaacaacttctcagaagaccacctggctaccggtgctcttaggatctttgggatgcaaacccctaacaatgttcctcattgctgaaaataaaatctgggggaggaaatcgtggccattgaatgaaggtataatggcagtaggtatagtgtcaatcttattatcatcattgttaaagaacgatgtgcctttagctggtccactaattgctggtggtatgcttatagcatgttatgtcttaagtggatcatcagcagatctctcacttgagaaagccgctgaggtatcgtgggaagaagaagctgagcattctggtgcaagccacaatatattagtagaagtgcaggacgatggtacaatgaaaatcaaagacgaggagagagacgacacactaacaattcttttaaaagcaacactgttggcagtcagtggagtgtatccattgtccattccggcaacattatttgtttggtatttttggcaaaagaagaaacaaagatcaggggtactttgggacacaccatcgcctcctgaagtggagcgggctgtcttagatgatgggatatatcgcatcatgcaacgaggacttctaggcaggtctcaagtaggagtaggagtattccaagaaaatgtattccacacaatgtggcatgtgactcgaggggcagttttgatgtaccagggcaaaaggttagaaccgagctgggcgtcagtaaagaaggatctaatatcatatggaggcggttggcgcttacaaggaagctggaatacgggagaagaagtccaggttattgcagtagagcccggcaagaacccgaagaatgtacaaactgctccaggtacgttcaaaacaccagaaggtgaggtcggagccatagccttggattttaagccaggaacttcgggatctcccattgttaatcgggagggtaagatcgttgggctatatggtaacggggtagtaacaacatcgggaacgtacgtttcagccattgcacaagctaaggcttcgcaagaaggtccattaccagagattgaagatgaagtatttcggaaacgaaacctcaccattatggatcttcatccgggcagtggaaaaactcgaagatacttacctgctatagtcagagaggcaattaaaagaaaactaagaacattgatacttgctccaacgcgggtagtagcaagcgaaatggcagaagcgttaaagggtataccgataagataccaaacgactgctgtgaaaagcgaacacactggtaaagagatagtagacctaatgtgtcacgctacctttactatgagactcctaagtcccgttcgagtcccaaattataatatgattataatggacgaagcacatttcacagatccaagtagtattgccgcaaggggatatatatctacgagagttggaatgggcgaggcagctgctatttttatgacagcaacgccacctggatctgtcgaggccttcccccaaagcaacgcagtaatacaggacgaggaaagagatatacccgaacgaagttggaactctggctatgagtggataacagatttcccaggaaaaactgtgtggttcgtcccatctataaaaagcggaaatgacatagctaattgtcttcgcaaaaacggtaaacgagtcatacaattaagtcggaagacatttgatacggaataccaaaagacgaaaaataacgactgggattatgtggtgacaacagatatttcggaaatgggtgctaattttcgtgcggatcgagttatcgaccccagacgctgcctgaaaccagttattctaaaagacggaccagaacgagttatactggcaggacccatgcctgtcactgtggcttcggctgcacagcgacgaggacgaattggaagaaaccacaacaaagagggggatcaatacatatatatgggccaaccattaaacaacgatgaagaccatgcacattggacggaagccaaaatgttactggataacattaacacacctgaaggaataatcccggccctttttgagccggaaagagaaaaatctgccgcgatcgacggggaataccgcctaagaggagaagctagaaagacatttgtggaactaatgaggcgtggcgacttgccagtgtggttaagttacaaagtagcttccgaaggatttcaatatagtgatagaagatggtgcttcgatggtgagcgcaataatcaagtgcttgaagagaatatggacgttgagatatggaccaaggaaggagaacgtaaaaagttaagacccagatggttagacgccagaacgtattcagatccacttgcactccgcgagtttaaagaatttgcagctggtagacgatcagtatcaggagatttaattctcgagataggaaaactacctcaacatttgactcagagggcccagaacgctctggataatctagttatgctccacaatagtgaacagggaggcagggcttatcgtcatgcaatggaggagctacctgacacgatagaaacattaatgttactagcactaattgctgtattaacaggaggtgttacactatttttcttatccggtagagggctggggaagacgagtatcggacttctctgtgtcatggcgtcatctgtactattatggatggcatcagtggagccacactggatagccgccagtatcattttagagttcttcctaatggtacttctaattcccgaacctgatagacagaggacaccacaagataatcagctagcttatgtagtgattggtttattatttatgatactgaccgttgcggctaatgaaatgggattattagagactactaagaaagatctaggcattggacatgttgcagttgaaaatcaccaccatgcggcaatgctagacgtagacttgcatccagcatcagcctggacactgtacgctgtagccactacaataattacgcctatgatgaggcatacgatagagaacactacagcaaatatttctcttacagcaatagcaaaccaggcagcaattttaatgggcctcgataaaggatggcctatttctaagatggatataggggtcccattactcgcacttggctgctactcccaagtaaacccattaactcttacagcggccgtattaatgctcgttgcccattatgccatcattggcccgggattgcaagccaaagcaacaagggaagcacagaaaaggactgctgccgggataatgaaaaaccccacggtggatggaatagtagccatagatcttgatccagtagtctatgatgcaaaatttgaaaaacaacttgggcaaataatgttgttgatactttgcacatcccaaatcttattaatgagaactacatgggctttatgcgaatcaatcacattagctactggaccccttacaactttatgggaaggatcacctggaaagttttggaacacaacaatagcagtatccatggcaaatatattccgtggttcctatctcgcaggggcaggtctagccttttctctaatgaaatcactaggagggggacgaagaggaacgggtgcacaaggagaaactctgggggagaaatggaaacgacagctaaaccaattatcaaaatcagagtttaatacatataaacgatcaggtataatggaagttgatcgatctgaagcaaaggaaggattaaaacgaggggaaacgacgaaacacgctgttagcaggggcacggcaaaacttagatggtttgtagagagaaatctagtaaaacctgaaggtaaagtcatagacctggggtgcggaagaggaggttggagttattactgcgcagggcttaagaaagtcaccgaagtaaaaggttacacgaaaggtggtcctggccatgaagaaccgatacctatggccacgtatggctggaatttggttaaattacacagtggaaaagatgtattcttcatcccaccagaaaaatgcgacactctgctctgtgacatcggtgaatcttctccaaatccaacaatagaagaagggcgtacgcttagagttcttaaaatggtcgaaccgtggttacgcggaaatcaattctgtattaaaatacttaatccctatatgccgagcgttgttgaaacactggagcagatgcaacggaaacatggagggatgcttgttagaaacccgttatctagaaattctacgcatgaaatgtattgggtcagctgcgggactggtaatattgtttcagcggtcaatatgacatctcgaatgttactcaatcgctttaccatggcgcacagaaagcctacgtacgaaagagatgtcgacttaggtacaggaacaagacatgttgccgttgagccggaagtggcgaacttagatattatcggacaacgaattgaaaacatcaagcacgagcataaaagtacctggcactacgatgaagacaatccctacaaaacttgggcatatcatgggtcctacgaagtaaaaccctcagggagtgcctcaagtatggtgaatggagtggtcaaattattaactaaaccgtgggacgtaatacccatggtaacacaaatagcaatgacggacactactccctttggacaacagcgagtttttaaagagaaagttgatacccgtacaccaaaagccaaacggggcacagcgcagattatggaagtaacggcaaggtggttgtggggatttttatctagaaataaaaagccgcgaatttgtactcgagaagagttcacacgtaaggttagaagcaatgcggccattggggctgtatttgtcgatgagaatcagtggaactcagctaaagaggcagtggaagacgaaagattctgggatctggtgcaccgtgaaagggaacttcataaacaaggaaaatgtgccacatgtgtatataatatgatgggaaagagagaaaagaagttaggagagttcggcaaagcaaagggatcgagagctatttggtacatgtggttaggcgcccgatttctcgagttcgaggcgttaggatttatgaatgaggatcattggttcagtcgagagaatagtttaagtggtgtggaaggagaaggcttacataaacttggatatatattgcgagacataagcaagataccgggaggaaacatgtatgcagatgatacagctggctgggacacccgaatcaccgaagacgatcttcaaaatgaggccaaaattacggacatcatggaacctgaacacgccttgttagcaaaagcaatcttcaaactgacctatcaaaataaagtcgtaagagtacaacgcccggccaaaaatggaacagtaatggatgttatctcgagacgtgatcaaagaggatctgggcaggtaggcacttacggattaaacacgtttacaaatatggaggcacaattaatacgacaaatggaatctgaaggaatttttagccctagtgaattagaaacacctaatctggcagaaagagctttggattggctcgagaaatacggtgtcgaaagactgaaacgaatggccatcagtggcgacgactgcgtggtgaagcccatcgacgatcgttttgctacagcccttacagcactgaacgatatgggcaaagtgcgtaaagatataccacaatgggaaccatcaaaaggttggaacgactggcagcaagtcccattttgttcccaccatttccaccaacttattatgaaagacggtagagagatagtagtaccatgcagaaatcaagacgaattggttggcagagcgagggtaagccaaggggctgggtggagcctcagggagacagcttgcctaggaaaaagctatgcacagatgtggcaattaatgtactttcatcgaagagatttaagactcgcggcaaacgccatttgctccgctgtcccagtcgactgggtccctaccagtcgaactacctggtctatacacgcgcatcatcagtggatgactacagaagacatgctatcagtttggaacagagtatggattgaagaaaacccatggatggaagataaaacacacatatcatcttgggaagatgtaccttaccttggcaagagagaagatcaatggtgcggatcacttattggtttaacagcacgggcgacttgggctacgaatatacaagtcgccataaatcaagtaaggagactaataggaaatgagaactatttggactacatgacgtcaatgaaacgattcaaaaatgaaagtgatccagagggagccctgtggtaa

SEQ ID NO: 21194 - RNA, 9879 nt, synthetic construct
  misc_feature 1..9879: note = derived and/or modified CDS sequence (opt6) from DENV-1__JQ287664__SS-prME
  source 1..9879: mol_type = other RNA
tctgtgactatgttactaatgcttatgcctacggctttggcattccatttaacaactagagggggagaaccacatatgattgtgagcaaacaagaacgtggaaaatcattattatttaaaaccagtgcaggagttaatatgtgtaccctaatcgcaatggacttaggtgaactttgcgaagacacaatgacgtacaaatgtccgaggataaccgaggtagaaccagatgacgtagactgttggtgtaacaccacagatacatgggttacatatggtacatgtagccaaacgggagagcatcggagagacaaacgatcagttgcattggccccacacgttgggttaggcctagaaacacgtgccgaaacctggatgtcatccgagggagcgtggaaacaaatccaacgagttgaaacttgggctcttaggcacccaggattcacagtaatagccctattcttagctcacgtaatagggacatctatcacacagaaaggaataatcttcattcttttaatgctggttactccatctatggcaatgagatgcgtcggaataggatcacgagactttgttgagggcttaagtggtgccacatgggtagatgtcgtattggaacatggctcatgtgttactacaatggcaaaagataaaccaacattggatatcgagttgttaaaaaccgaagtcacgaatccagccgttctacgaaaattatgtatcgaagcaaaaataagcaatacaactacagactctagatgcccaactcaaggagaggctacattagtagaagaacaagacgcaaatttcgtttgtcgaaggacattcgtcgaccgtggctggggtaacggatgtggtttatttggcaaaggctcattaataacttgtgcgaaattcaaatgcgttacaaaattagaaggcaaaatcgtgcagtacgagaatctgaaatacagtgtaatagtaactgtacacactggcgatcagcatcaggtaggaaatgaaagtaccgagcatggtaccacggcaacaataacccctcaggcacccacgagtgaaatacaacttacagattacggagcgctgacactagactgtagccccagaactggactagatttcaatgagatggtgttactaaccatgaaagagaaatcatggctggttcataaacaatggttcttggatttgcctctaccctggacttcaggagcctcaacaagtcaagaaacttggaataggcaagacttacttgtgacatttaaaactgcccacgcgaagaaacaggaggttgtagttctaggtagtcaagaaggtgccatgcatacggcgttaacaggcgcaacagaaattcaaacatctggcacaacaactatcttcgcgggacatttaaaatgcagactaaagatggacaaattaacactaaaaggtatgagttatgtaatgtgtacgggaagtttcaaattagaaaaggaagttgccgaaactcagcatggaacagttttagtgcagataaagtatgaaggtacggatgctccatgcaagatccctttctccactcaagacgaaaaaggggtaactcaaaatgggagactaatcactgctaatcctattgtaaccgacaaggaaaagccagttaacattgaagcggaacctccattcggagaatcgtatatagtcataggtgccggtgaaaaggccttaaaattgtcctggtttaaaaagggcagcagtataggcaagatgttcgaggctaccgcccgaggtgctaggaggatggccatattgggagatacagcctgggacttcgggagcataggaggggtattcacatctgtagggaagctagtgcatcaaatctttgggacagcttatggtgttctgttctcaggtgttagctggacaatgaaaataggaatcggagtactgttaacatggttgggattaaattcacgctccacgtctcttagtatgacatgcatagcggtagggctagtaaccctgtacttgggagtaatggtacaggcagactccggatgtgtcataaactggaaggggcgtgagctaaaatgtggaagtggaatatttgttaccaacgaagtacatacttggacagaacagtataaattccaagccgactcaccgaagagactaagcgcagctatcggaaaagcgtgggaagaaggagtatgcggaatacgaagcgctacgaggctcgaaaatataatgtggagacaaatatcgaatgaactaaaccatatattgctcgaaaatgacatgaaattcactgttgtagttggcgatgtagtgggaatacttgcacaaggaaagaaaatgataagacctcaaccaatggaacacaaatattcatggaaaagttggggcaaagcaaaaataataggcgcagatgtacagaacactacctttatcattgacggaccaaacacacctgaatgcccagatgaccaacgagcttggaatatttgggaagtagaggactatggatttgggattttcacgacaaatatttggctaaaacttcgagactcttacacacaagtatgtgaccatagactaatgtctgccgcaataaaagatagtaaggctgtacacgcggatatgggctattggatagaatcagagaaaaatgaaacttggaagctggcaagagcatcatttatcgaagtcaaaacatgtatctggcctaaaagccacacattatggagcaatggtgtccttgagagtgagatgatcattcctaaaatatatggcggacccatttcccaacataattatcgcccgggatacttcactcaaacagcgggcccatggcatcttggaaagttagagcttgacttcgatctttgtgaggggacaacggttgtggtagatgagcattgtgggaacagaggcccctcactcagaacaaccacagtaactggtaagattatacacgaatggtgttgtagatcctgtacacttccaccccttaggttcaaaggcgaagacggctgttggtatggtatggaaataagaccggtgaaagagaaagaagaaaacctagtaaaatctatggtatctgccggctccggcgaagtagacagcttttctttgggactactatgtatttctataatgatagaggaggtcatgagatcaagatggagtagaaaaatgttaatgacaggcacactggcagttttctttcttttaataatgggtcagcttacttggaacgatttgataagactatgcataatggtaggagcaaacgcaagcgatcgaatgggaatgggcacaacatatctagcactgatggcgacatttaaaatgcgaccaatgtttgcagttggactcctattccgacggttgacatcgagagaggtcctccttcttacgataggtctcagcttagttgcgtctgtagagctaccaaactcattagaagaattaggagatgggttggcgatggggataatgatactaaaattactaactgattttcaatcatatcagttatgggcgacgttgttatctctaacattcataaaaactacgtttagcctgcactacgcctggaagactatggctatggttttgtccattgtatcactactacccctatgcctaagtactacgagtcagaaaacaacatggttaccagtattattaggatccctaggttgtaaacctcttacaatgttctttatagccgagaacaagatctggggccggaagagttggcccctaaatgaagggatcatggcagtaggcatagttagcatactgcttagtagcctcctaaagaatgatgtacctctcgcagggcccctgatcgccggaggtatgttaatcgcctgttacgtgatttctgggtcatccgctgatctcagcttagaaaaagccgcagaagtcagttgggaagaggaagccgagcattccggcgccagtcataatattttagtggaagttcaagatgacggtacaatgaagattaaggatgaagaacgtgatgatacattaacaattctattaaaagcgactctactcgctgtctctggagtttatccgctatcgattcccgcaaccctttttgtgtggtatttttggcaaaagaagaaacaaagatcaggagtcctttgggatacccctagtcctccagaagttgaaagagcagtattggatgatggtatatacagaattatgcagcgaggtttattaggaagatcgcaagtaggagtgggggtttttcaagaaaatgtattccatacgatgtggcatgtcactcgaggtgcagtcctaatgtatcaaggtaaacgcctagaaccatcatgggcttctgttaagaaagacttaatatcgtacgggggcggatggagattgcaaggttcttggaacacgggagaagaagtacaggtaatagcagtagaaccaggtaaaaaccccaaaaatgtccaaacagcacccggtacgtttaagacaccggaaggtgaagtaggtgccatcgcactggattttaaaccaggaacatccggctcgccaatagtaaatagagaaggaaagattgttggactctacggtaatggtgtggttacaacatccggaacgtacgtcagtgcaatagcacaggcaaaggctagtcaggagggacccctacccgagatcgaagacgaggtatttagaaagagaaacctaacgataatggacctccacccaggttcaggtaagacacggaagtatttgccagcaatagtgcgtgaggctatcaaaagaaagctaaggaccttgattctggcgccaacacgtgtagtggcaagtgagatggcggaagccttaaagggaatgcctataagatatcagacaactgctgtaaaatcagaacacacgggtagagaaatagtagacctcatgtgccacgccacgttcaccatgcgcctactaagcccagtcagggtaccgaactataacatgataatcatggatgaggcgcactttactgatccgtctagtatagcagctagaggatacatatctacgagggttggaatgggtgaagcggctgctatattcatgaccgcaactcctccggggagtgttgaagcattcccccaaagcaatgcagtgattcaagatgaagaaagagacattcctgagaggtcatggaactcaggctatgaatggataaccgattttcctggaaaaactgtatggttcgttccatctataaaatccggaaacgacattgctaactgtctgaggaaaaatggtaaacgcgtaatacagctgtctcgaaaaacatttgatacggaataccaaaagaccaagaacaacgattgggactacgttgtcacaacagacattagtgaaatgggcgccaacttcagagcagacagagtcatcgatccacgcagatgtcttaaaccagtcattttaaaggatggacctgaaagagtaattctagcaggaccaatgcccgttaccgtagcatcagccgcccaaagacgaggaagaataggacgaaatcacaataaagaaggcgatcaatatatttacatggggcaacctctgaataacgacgaagaccatgcacactggaccgaggccaaaatgctgctagataatattaatactcctgaaggcataatccctgcgctatttgaacctgaacgagaaaaatctgctgcaatagatggagaataccgactcagaggagaagcaagaaaaacatttgtcgaattaatgcgacggggtgatctaccagtttggctgtcgtacaaggtggcttcggaaggtttccagtatagtgacagacgctggtgctttgatggtgaaagaaacaatcaagtgttagaagaaaacatggacgtggagatatggactaaggaaggtgagcggaagaaattaagacctcggtggttggatgcaaggacttacagcgatccgctagcgttacgggagttcaaggagttcgccgcagggagaagatcaatatcgggcgatttaattttagaaataggtaaactccctcaacatcttacacagagggcacagaacgcattagacaaccttgttatgctacataactctgagcaaggaggtagggcttacaggcatgcaatggaagaattaccagacactatagaaacacttatgttattagcccttatagcggtcctgactggaggagtgacattattcttcttatcaggtcgtggattagggaaaacaagcatcggccttctatgtgtcatggcttctagcgcattactatggatggcatcagtggaaccacactggatagccgcttcaatcatcttagaatttttcctaatggttttactcattcccgagcccgatagacagaggacaccacaggacaatcaattggcatatgttgtcattggtctactatttatgatattaacggtagcagctaatgagatggggctgctggagactactaagaaagacttaggtataggacacgtagcagtggaaaatcaccatcatgcgacaatgttggatgtggatcttcaccctgcctcagcttggactttatatgctgtagctactactataataacaccaatgatgaggcatactattgaaaacacaacagccaacatttcacttaccgcaattgcaaatcaagcggccatactgatgggtttagataaaggttggccaataagtaaaatggacattggcgtgcccttgcttgccttaggctgctattctcaagttaacccgttaacattaacagctgcagtgctaatgctcgtcgcccactatgccataataggtcccgggctacaagcgaaggcaacacgagaagcccaaaaacggacagctgcaggtatcatgaaaaatcctacagtagacggcatcgtagcaattgatttagatccagttgtttacgacgcaaaatttgaaaaacaattgggacaaatcatgttactcattctatgcacttcacaaattctattaatgcgcacaacatgggcactctgtgaaagtatcacgcttgcgaccggaccgctgactacactatgggaaggaagtccaggaaaattttggaacactacaatagctgtgtcgatggcaaacatcttccgaggatcatacttagctggtgcaggccttgctttctcactgatgaaatcactaggaggtggcaggagaggtacaggtgcccaaggcgaaacattaggagagaaatggaaacgacaattaaatcagttatcaaaaagtgaatttaatacttacaaaagaagtggtattcttgaagtcgatagaagcgaagccaaagaaggattacggcggggagaaactacaaaacacgcggtatctcgtggtacagctaaactccgatggttcgtagaaaggaaccttgtcaaaccagaaggaaaagtaatagatttgggttgcgggagagggggttggtcctactactgtgcaggcctaaagaaagtaactgaagtaaaaggttatacaaaaggcggacccggacacgaggagcccataccgatggcaacttacggttggaatctcgttaaacttcactcaggcaaagatgttttctttataccgcctgagaagtgtgacacgctattatgtgacataggtgagagttcgccgaatcccactatagaggaaggtagaacattgcgtgtactcaaaatggttgaaccttggttacgtggtaaccaattttgtattaaaattttaaacccatatatgccatctgtagtagaaactctagaacaaatgcaacgaaaacacggaggtatgctcgtacgcaatccactatccagaaatagcacgcatgaaatgtattgggtttcatgtggaactggaaacatagtatccgcagtaaacatgacatccaggatgctgctaaataggttcaccatggcacaccgaaagccaacctatgagcgagacgttgatttaggagcgggaacaagacacgttgcggtagaacctgaggtagccaacctggatatcataggtcaacggattgaaaacataaagcatgaacacaaatcaacatggcattatgacgaagacaatccttataaaacatgggcatatcatggttcctatgaagtcaaacctagtggcagtgcttcatcaatggtgaatggtgtggttaaattattaacaaaaccatgggacgttattcccatggtgacgcaaatcgcaatgacagatacgacaccgtttggccaacagcgagtattcaaagaaaaggtagatacacgaacgccaaaagcgaaacgtggaaccgcgcaaataatggaggttacggctaggtggttatggggattcctctctagaaataagaaaccacgtatctgtacaagagaagaatttacacggaaagtaagaagtaatgcagctattggagctgtatttgtagatgaaaaccaatggaacagtgcaaaggaagctgtagaagacgaaagattttgggacctagtacacagagaaagggaactacacaaacaagggaaatgcgctacatgcgtatataacatgatgggtaaaagagagaagaaattaggagaatttggcaaagccaagggttcaagggcaatttggtacatgtggttaggtgcccgattcctagaatttgaagcactgggattcatgaatgaagatcattggtttagtagagaaaactctctaagcggtgtagaaggagaaggcctgcacaaattagggtatatcctacgtgatatttcaaagatacccgggggcaacatgtatgccgacgacacagcaggttgggatactaggataactgaagacgatctacaaaatgaggctaaaataacagatatcatggaaccagaacatgcgttattagccactagcatatttaagctaacttaccagaacaaagttgtcagagttcaaagaccagccaaaaatggcaccgtaatggatgttatctcaaggagagatcagagaggaagcggacaggttggcacatacgggcttaatacgttcacaaacatggaagctcagctaatcagacaaatggaatcggaaggcattttctcaccctccgaattagaaacaccgaatttagccgaaagggtgcttgactggttagagaaatacggagtagaacgtttgaaacgtatggccataagcggggatgactgtgtagttaaacccatagatgatcgattcgcaacagcactgactgctctaaacgacatgggcaaagtaagaaaagatattccccaatgggaacccagtaaaggatggaatgattggcaacaggtacctttttgcagccaccatttccaccaattaatcatgaaagatggacgagaaattgtggtaccatgcagaaatcaggatgaacttgtaggacgggctcgtgtttcacagggcgcaggctggtcactcagagagacagcttgtctagggaaaagctacgctcaaatgtggcaattaatgtattttcataggcgtgacttaagactcgccgccaacgcaatatgttctgcagttcctttcgattgggtccctactagccgtactacgtggagtatacacgcacatcatcaatggatgacaacagaagacatgttaagcgtctggaaccgcgtgtggattgaagaaaacccatggatggaagataaaacacatatatcaagttgggaagacgtaccatacttaggaaagcgtgaggatcaatggtgtggcagcttaattgggttaaccgctcgagcaacatgggccacaaatatacaggtagcaatcaaccaggtgagaagacttatcggtaatgaaaactatctagattatatgacaagcatgaaaagattcaaaaacgaaagcgatactgaaggagcattatggtaa

SEQ ID NO: 21195 - RNA, 9879 nt, synthetic construct
  misc_feature 1..9879: note = derived and/or modified CDS sequence (opt6) from DENV-1__FJ639683__SS-prME
  source 1..9879: mol_type = other RNA
tcagttacaatgctgcttatgttaatgccaactgcactggcatttcatctaacaactagaggaggagagcctcatatgattgtatcaaaacaagaacgtgggaaatccttactttttaaaaccagtgctggagtaaatatgtgtaccttaattgccatggatcttggagaattatgtgaagatacaatgacttataaatgtcctaggataactgaagccgaaccggatgacgttgattgctggtgtaatgcaacagacacatgggtgacatatggtacttgttcacaaactggggaacaccgtagagataaaagatctgtggcgctcgctcctcatgtaggactaggactggagacaagaacagagacctggatgagttcagaaggtgcttggaaacaaatacaaagagtcgaaacatgggcactaagacacccaggattcacggtaatagcattatttttagctcatgcaatagggactagcattacacaaaaaggcataatctttatattattgatgctagtaactccgagcatggctatgcgttgtgtaggaataggatccagggactttgttgaaggcctgtcaggtgccacgtgggtagatgtcgttctggaacatggaagttgtgtaaccactatggcgaaagataaaccgacgctagatattgagcttcttaaaacagaggtaaccaatcctgccatattgagaaaattgtgtattgaggcaaaaatctcaaatacaacgacagactcgagatgccccacgcaaggtgaagcaacgcttgtagaggaacaagatgcgaactttgtatgccgccgcacatttgtagaccgaggatggggaaatggttgtggattatttggcaaaggatcactcataacttgcgctaaatttaaatgcgtaacgaaacttgaaggtaaaattgtgcaatatgagaatctaaaatatagcgtcatagtaactgtgcacactggagatcaacaccaagttgggaacgaaagtactgagcatggaacaactgcaacaataacgccacaagcacctactacagaaatccaattaacagactacggggccttaacactagactgttcaccgaggacaggtttagactttaatgaaatggtcctattgaccatgaaggaaaaatcttggctagttcacaaacagtggtttctagacttgccgttaccatggaccagcggggcaagcacctcacaagagacatggaacagacaggatctactggtaacttttaaaacagcacacgccaagaaacaagaagtcgtcgtattgggttcccaagaaggagcgatgcatactgcgttgacaggagcaacagaaatacaaacatcgggcacaacaactatattcgctgggcacttaaaatgtagactcaaaatggataaactcactttaaaaggcatgagctatgtaatgtgcaccggatcctttaaattggaaaaagaagtcgcagaaacacagcatggaacagtgttagtacaaataaaatacgaaggtacagacgcaccatgcaaaataccattctctacgcaagatgaaaagggtgtaactcagaacggccgtctaattaccgctaatcctatcgttactgataaagaaaaaccagttaatatagaagctgagcctccgtttggcgaatcctatatcgttataggcgccggtgagaaggcattaaaattaagttggtttaagaaaggaagttcaattggcaaaatgtttgaagcgacagcaaggggagcacgacgaatggcgattttgggtgacacagcgtgggacttcgggtcaataggaggggtttttacaagtgtaggtaaattggtgcaccaaatatttggaactgcatacggagtattattctcaggcgtcagctggactatgaaaataggtataggagtcctattgacgtggttaggtctcaacagcaggagtacgagctttagtatgacatgcattgctgttggactggtaactttatacctcggcgtaatggtgcaagctgatagcggttgtgtaataaactggaaaggacgagagcttaagtgtggcagcggcatttttgtgacaaatgaagttcatacttggaccgaacaatataagtttcaagctgatagtccaaaaagactatccgctgcgattggcaaagcatgggaagaaggcgtgtgtggcataagatcagccactagactcgagaatataatgtggaagcagatatcaaatgaactgaatcatatacttctagaaaacgacatgaaatttacagtagttgtaggagacgtagcaggcatacttgctcaaggcaagaaaatgatcaggccgcaaccaatggaatataaatactcttggaaaagttggggtaaagcaaaaattataggagcagatgtacaaaatactacctttattatcgatggaccgaacacgccagaatgccctgatgatcaacgagcctggaacatatgggaagtagaagattatggcttcggaatatttacgacaaatatttggcttaaattaagagactcatatacacaagtgtgtgaccatagacttatgtcagcagcaataaaagatagtaaggcggttcatgccgatatgggatactggatagaatctgagaaaaatgaaacttggaaactggcaagagccagttttattgaagtaaaaacgtgtatatggccaaaatctcacacactatggtcaaatggagtactagaatctgagatgataataccaaaaatttatggcggaccaatatctcaacataattataggcccggttacttcacgcaaacagcaggaccatggcatttaggaaaattggagcttgactttgacttgtgtgagggaacgacagtagttgtcgacgaacattgcggtaatcgcggaccgtcattacgaacaacaacagttacaggaaagattattcacgaatggtgttgtagaagttgcaccctgccgcctctccgttttcgtggcgaagatggttgttggtatggcatggaaatcaggccagtgaaagaaaaagaggaaaacctagtaaaatcgctagtaagtgcaggaagcggcgaagtagattctttttcattagggttactttgcattagcattatgattgaagaagttatgagatcccgttggtctcgtaaaatgttgatgacagggacattggctgtattcctgcttttaataatgggccagttaacttggaacgatctcattagattatgcattatggttggagctaacgctagcgacaggatgggtatggggacgacatatctggcattaatggctacatttaaaatgcgaccaatgtttgcagtcggcttattgtttagacgtttgacaagccgcgaagtattacttctaactattggcttaagcctggtagcttcagttgagctcccaaactcgttagaagaactcggagacggtcttgcaatgggaataatgatactaaaactacttactgattttcaatcgcaccaattgtgggctacgttattaagtctcacctttattaaaactacattctcactacattatgcatggaaaaccatggcaatggtgctatccatagtatcgttatttccattgtgcctttctactacgtcacagaaaacaacctggcttccagtcttgttgggatctcttggatgtaaaccactaacaatgttcctaatagctgaaaataagatatggggtcgtagatcatggcctcttaatgaagggattatggctgtaggtatagtctctatcttattatctagcttattaaagaatgacgtcccactcgctgggccattaatagcgggtggaatgttaatagcgtgttatgtcatttcaggttcatcagcagatttatcgctcgagaaagcggctgaagtttcatgggaagaagaggcagaacatagtggagcatctcacaatatcctagtagaggttcaagatgatgggacaatgaaaataaaagatgaagaaagagacgataccctaacaatacttctcaaggcgaccctcttagcagttagcggagtatatccactatctatacctgcgaccttgtttgtctggtacttctggcagaagaagaaacagagatctggtgtactctgggacactccttcacctccagaagtagaacgcgcagttttagacgatgggatttacaggattatgcaacgaggcctgcttggtcgatctcaagtaggagtaggagtctttcaagaaaacgtcttccacactatgtggcatgttacacggggtgccgtgctgatgtatcaaggcaaaaggttagaacccagttgggcatcggtcaagaaagacttaatttcatacggaggcggatggagactacaagggagctggaatacaggcgaggaggtacaagtaattgccgtcgaacccggcaagaaccccaaaaatgtacaaacagcacctggaaccttcaaaacacctgagggtgaagtgggagctatagcactcgattttaaacccgggacaagtggttcgcccatagtcaaccgtgaaggaaagattgtgggactatatgggaacggtgtcgtaacaacatcaggaacatacgtgtcagcaatagcacaggcgaaggcttcgcaagaggggccactgccggagatcgaagacgaagtatttagaaaaaggaatcttacaatcatggacctacacccaggaagtggaaagacacgtcgatatctaccggccattgttagagaagccataaaacgtaagctaagaacgctcattttagcaccaacaagagtggtggcaagtgaaatggctgaggcccttaaaggtatgcctattcgttaccaaaccactgcagtaaagtctgagcatacaggaaaggaaatagttgatttgatgtgccacgccacatttactatgagactactaagtccagttagagtcccaaattacaacatgataataatggatgaagcccacttcaccgatccgtcatccattgcggcgagaggatacatttccactcgagtaggtatgggcgaagcggccgctatatttatgacggctacacctcccggttcagttgaggctttccctcagtcaaacgccgttatacaagatgaggaaagagacataccagaacgtagttggaactcagggcatgaatggataaccgattttcctggtaaaactgtatggtttgtaccatcgatcaagagtggaaatgatattgctaattgtttgagaaagaatggtaaaagggttatccaattgagccggaaaaccttcgataccgagtatcagaaaaccaaaaataatgactgggactacgtagtaacaacggacatatcggagatgggtgcaaattttagggcagacagagttatcgacccgaggcgatgtctcaagcccgtcattctaaaagatgggcccgaacgcgtcatattggcaggacccatgccagtaacagttgcatccgcagcccaaagaagaggtaggataggacgaaatcataacaaggaaggcgatcaatacatctacatgggccaaccacttaacaatgatgaagatcacgcccattggacggaggcaaagatgctactggataacatcaatacaccggaaggcataattcccgcactgttcgagccagagcgagagaaatcagccgcaattgatggcgaatacagacttaggggcgaagctcgaaaaacttttgtcgagctgatgagaagaggtgatcttcctgtgtggttatcgtataaagtagcctcagaaggctttcagtatagtgacaggagatggtgtttcgatggtgaaagaaacaatcaagtcctagaagaaaatatggacgtagaaatatggacaaaggagggtgagaggaagaaactaagaccacgatggctggacgcaaggacgtattcagatccactggctctcagagagttcaaagaatttgcagcaggacgaagaagtgtttctggggaccttatcctagaaattgggaaactaccgcagcaccttacgcagagagctcaaaacgcattagacaacttagtcatgttacataattcagagcagggagggcgagcatacagacatgctatggaggaactacccgatactatcgaaaccctaatgttactagcattaatagcagtattaacaggaggagtaacgctatttttcctatcaggacggggcttggggaaaacgagtattggattactttgcgtgatggcctcgagtgttctcctttggatggcatcagtagaaccacattggatcgctgccagcataatccttgagttctttttaatggtcctcttaataccagaacccgatagacaaaggacacctcaagacaatcaactggcgtatgtcgtaataggactgctctttatgatattgacagttgcagctaatgaaatgggcttgctggaaacaaccaagaaagacttaggaattggccatgtagcagtcggaaatcatcatcatgcagcgatgttggatgtcgacctccacccggcctccgcctggacactatacgctgtagcaacgacaataataactcccatgatgaggcatacaatcgaaaataccacagctaatataagtcttactgccattgcgaatcaagcggcaatacttatggggttagataaaggatggccaatatcaaaaatggacataggcgtaccactactagcattaggttgttactcccaagtcaacccattaacgctaacggctgctgtacttatgctggtcgcccattacgcaattattggtcctggcctccaggccaaagcaacgagagaggcgcaaaaacgaacggcagctggaataatgaaaaatccgacagttgatgggatagtcgcaatagacctagacccagtagtttatgatgcgaaatttgaaaaacagctaggacagattatgctactcatcctgtgcacaagtcaaattctccttatgcgaactacttgggccctttgtgagtccatcacactagcaacaggcccgctaacaactctttgggaaggtagtcccggtaagttttggaataccacaattgcagtaagcatggccaatatatttagaggctcatatctggccggtgcaggtctagcattctctttaatgaaaagcctaggaggtggaagaagaggaacaggagcacagggcgagacattaggtgaaaaatggaaaaggcaactaaatcagctatcaaaatccgagttcaatacgtacaaacgaagtggcataatggaagttgatcgatccgaggctaaggaagggctcaaaagaggggaaactacaaagcatgccgtatcaagaggaaccgctaaacttcgatggtttgtggagcgcaatttagtaaaacctgagggtaaagtaatcgatttaggttgtggaagaggagggtggtcttattattgtgcaggcttaaagaaagtcactgaagtaaaaggatatacaaaagggggcccaggacatgaagaaccaattcctatggctacatatggatggaatctggtgaaactacacagcggaaaagatgtattctttgttccacctgaaaaatgtgacactctgctatgtgatattggagaaagtagtccaaacccaactatagaagaggggcgaacccttcgagttttaaaaatggttgaaccctggttacggggaaatcaattttgcataaaaatattgaatccatatatgccttcggtagtagagactcttgagcaaatgcaacgcaaacatggaggaatgctcgtaagaaatcccctatcaagaaactcaacacatgagatgtattgggtaagttgcggaacaggtaacatcgtttcagcagtcaatatgacttctcggatgcttctaaatcgcttcacgatggcacataggaaaccgacatacgaaagggacgttgacttgggggcaggaactagacatgtcgctgtcgagccagaagtagccaacctggacattataggacagagaatagaaaacattaagcacgaacataaaagtacttggcactacgacgaagataatccgtataaaacttgggcgtatcatggaagttacgaagtcaagccatcaggatcggcatcctctatggttaatggagtggtcaaattactaactaagccgtgggatgtgattcctatggttacacagatagctatgacagataccaccccgtttggtcagcaaagagtctttaaagaaaaagttgatacgcgaaccccaaaagcaaagcggggaacagcccaaataatggaagttaccgctaaatggctttgggggtttctttcacgaaacaagaaaccccgaatttgcacaagggaagagtttactcgaaaagtacgatcaaacgcagcaataggggcggtctttgtagatgaaaatcaatggaactcagcgaaggaggcagtggaggacgaaagattctgggacttggtgcatcgtgaacgcgaattacataagcaggggaaatgtgctacttgtgtatacaacatgatggggaaaagagagaagaaactaggggaatttggaaaagcaaagggaagcagggcgatatggtatatgtggttaggcgcaagatttttggaatttgaagcgttgggattcatgaatgaggaccattggttttctcgagagaatagtttatcaggcgtagaaggtgaagggttacacaaacttggttatatactcagagatatatcaaaaatacctggcggtaacatgtacgctgacgatacggctggatgggacactagaattactgaggatgatttacaaaatgaagccagaatcacagatataatggaacctgagcatgctttgttagctaagtcgatattcaaattaacgtatcagaataaagtggtaagagtccaaaggcctgccaaaaatggtactgtaatggacgtgatatccagaagggaccaacgaggaagcggacaagtgggtacatatggtttaaatacatttacgaacatggaagcacagctaataagacaaatggaatcggaaggaatattttccccctccgaactagaaacaccaaacttagcagaaagagtcctagattggctggaaaaatatggtgtagagaggctaaaacgtatggctatatcaggcgacgattgtgtagttaaacccatcgacgatcgatttgcgacagcccttacagcccttaacgatatggggaaagtaagaaaagacataccacaatgggaacctagtaaaggctggaatgattggcaacaagtaccgttttgttcacaccatttccaccaactaataatgaaagacggaagagaaattgtagttccatgtcgcaatcaggatgaattagtgggacgtgcgagggtatcacaaggagcgggttggagcttaagagagacagcctgtctaggcaagagctacgctcaaatgtggcagttgatgtatttccataggcgggatctacgactcgcggccaatgcaatatgttcggcggttccagttgattggatacctacctcaaggacaacttggtcaatacatgcgcatcaccagtggatgacaaccgaagatatgctctccgtctggaatagggtatggatcgaagaaaatccctggatggaagataaaacacacattagttcttggggcgatgtaccttatctaggaaagcgtgaagatcaatggtgtggcagtttaatagggctgactgcacgcgctacctgggcaacaaatattcaagttgcaataaatcaagtaagacggttaattggcaacgaaaattaccttgactatatgacttcaatgaaacgttttaagaatgaaagcgatccagagggagcactttggtga

SEQ ID NO: 21196 - RNA, 9879 nt, synthetic construct
  misc_feature 1..9879: note = derived and/or modified CDS sequence (opt6) from DENV-1__FJ639684__SS-prME
  source 1..9879: mol_type = other RNA
agtgtgacgatgttattaatgctaatgcctactgcattagcatttcatcttacgacaagagggggagaaccccacatgatagtttcaaaacaagaaagaggaaaaagcctacttttcaaaacgagcgcgggagtgaatatgtgtacgctaattgccatggatttgggtgagttctgtgaagatacgatgacatacaaatgtccacgaatttcagaagcagaacctgacgacgtcgactgttggtgtaacgccacagatacttgggtaacatatggaacttgttcacaaacaggagaacatagaagagacaaaagaagtgttgcactagcaccccacgttggactcggccttgagacccgcacagaaacatggatgtctagcgaaggtgcctggaaacaaatacaacgagttgaaacgtgggcattacgacacccgggatttacagtaattgcgctatttttagcacacgcaataggaacttcgataacacagaaaggtataatatttatactattaatgttagtgacacccagcatggcaatgagatgtgtcggaataggaagtagagatttcgtagaaggactctctggcgcaacatgggtggatgttgttttggagcatggaagctgcgttaccacaatggcaaaagacaaaccaacgttagatattgaattacttaaaacggaagtaaccaaccctgcggtcttacgcaaactatgcattgaagcgaaaatcagtaacactactactgacagtagatgccccacacaaggggaagctacactggtagaagaacaagacgcaaattttgtttgcagaagaacattcgtagaccgaggatgggggaatggttgcggtttatttggtaaaggatctttaataacatgtgccaaatttaaatgcgtcacaaaactggagggaaaaatcgtccaatacgaaaatctaaaatactctgtcatcgtaaccgttcatacgggcgaccaacatcaagtggggaacgagagtactgaacatggaacaaccgcaacgataacacctcaggccccatcaacagaaatacaacttacagactacggtgccttaacattagactgcagtccacgaacaggactagattttaacgagatggtattgttaacaatgaaagaaaaatcttggttagttcataaacaatggttcttggacctccctcttccatggacaagtggcgcctctacatctcaagagacctggaaccgccaagatctactcgtaacttttaaaacagcacacgcaaagaagcaagaagtcgttgtgttgggatctcaagaaggtgcgatgcacacggcgttaaccggggcaactgagatacaaacgagcggcactacaacaatattcgcaggacaccttaaatgtaggttaaaaatggataaacttacactgaaaggaatgagttatgtaatgtgcactggtagcttcaagctcgaaaaagaagttgcagaaacacaacacggaactgttttggtacaaataaaatacgaaggaaccgacgctccatgcaaaataccattttctactcaggacgaaaagggtgtgactcagaacggaagattaatcacggctaaccccatcgtcacggacaaagaaaagccagttaatatagaggctgagccgccatttggagaaagctatatcgtaataggtgctggagagaaagcgctaaagctctcatggttcaaaaagggtagtagcattggcaaaatgtttgaagcaaccgcccggggagcaagaaggatggcaatattgggcgatacagcgtgggactttggaagtatcgggggagtgtttacctcagtaggaaaactcgttcaccaaatcttcggtaccgcatatggggtcctattttccggagttagctggaccatgaagataggtatcggggttttgcttacatggctaggtcttaacagcagaagtacatctctgtcaatgacttgtatagcagtgggactcgtcacactttatctgggagtcatggtacaagctgacagtgggtgtgtaattaattggaaaggccgtgaacttaaatgcgggtcaggcatctttgtaacgaacgaggttcatacttggactgaacaatataagtttcaagcggacagccctaagagattgagcgcagcaataggtaaagcgtgggaagaaggtgtttgcggaatacgttccgcgacaaggcttgaaaatatcatgtggaagcaaatttctaatgaactgaatcacatactgttggaaaacgatatgaagttcacggtcgtagtaggtgatgttgccggaatcctagcacaaggcaaaaagatgattagacctcaaccaatggaatacaaatattcatggaagagttggggaaaagctaagattattggagctgacgtacaaaatactacctttatcatagacggaccaaatacacctgaatgccccgatgaccaaagagcttggaacatatgggaagtcgaagattacggtttcgggatttttacaactaacatttggctaaagctaagagactcatatactcaagtatgcgatcacagactaatgtcagcagcaattaaagatagcaaagcagttcatgccgatatgggctactggatcgaatccgagaaaaatgaaacatggaagctagcgcgagcatcattcatagaagtaaaaacatgcatctggcccaagagtcatacgctttggtcgaatggcgtattagaaagcgaaatgataatacctaaaatatatggcggaccaataagccaacataattatagaccaggatattttacccaaacggccggtccgtggcatctaggcaaacttgaattagactttgatctatgcgaaggaaccacagtagttgtggatgaacactgtgggaatagaggacctagtttgcgcacgactactgttaccggcaaaataatacatgaatggtgctgtcgtagctgtactttaccacccctcagattcaaaggagaagacggatgttggtacggaatggaaatccggccagtaaaagaaaaagaagaaaatctcgtaaaaagtatggtaagtgccggatctggagaagtagactcgtttagcttagggttactttgcatatctataatgatcgaggaagtgatgagaagtcgctggtctcgaaagatgctgatgacaggcacattggccgtgtttttcttgttaatcatgggacaattaacgtggaatgatttgatcagactatgcattatggtaggagcaaacgctagtgatcgcatgggtatgggaatgacttatctagccctaatggctacattcaaaatgcgtcccatgtttgccgtgggcttgttgtttaggcgtctaactagcagagaagttttgctattaacaataggactgtcccttgttgcttccgttgagctgcctaactccttggaagaactaggagacggtctcgcaatgggaataatgatccttaaactattaactgatttccaaagtcatcaattatgggcaactttattaagcctaacatttatcaaaactacattcagtctccattatgcatggaaaaccatggccatggtacttagtattgtaagtttattccccctttgtctgagtaccacatcgcaaaagaccacatggttgccggtattgttaggttcactgggttgtaagcctcttactatgtttcttatagcggaaaacaaaatatggggaagaaaaagttggcccttgaatgaaggaataatggccgttggcattgtgagcatcctcctctcatctttattaaagaacgatgtcccactagcaggacccctaatagcgggcggcatgttaattgcttgttatgttataagtggctcatcggcagatttatctttagagaaagcggcagaagtgtcttgggaagaagaggctgaacacagtggggctagtcataacatccttgtggaagtccaagacgacggaacaatgaaaattaaggacgaagagagagatgataccttaacaatattactaaaagcgacactattagcagtgagtggggtatacccgttaagtataccagctacgctatttgtttggtatttttggcagaagaagaaacaacgaagtggggtgttatgggacactccttctccgccagaagtagaaagagcagtattagatgatggaatttatcgaataatgcaacgaggcctattaggtcgttctcaagtaggagtaggtgtgttccaagagaacgttttccatacaatgtggcatgttactaggggcgcagtcttaatgtaccaaggaaaaagactcgagccatcatgggcctctgtcaagaaagatttaatttcatatggaggaggttggaggctacaaggtagctggaatacaggggaagaggttcaagtcatcgcagtagagccaggtaagaaccccaaaaatgtacaaacagcacctggaacatttaaaacatccgaaggtgaagtaggtgctatagcactagatttcaagcccggcacatcaggatcaccgatagtaaatagagaaggcaaaatagtaggcttgtatggaaacggagtagttaccacaagtggaacttatgttagtgctattgcacaagcaaaagcaagtcaagaaggccccttacctgaaatcgaggatgaagtattcagaaaaagaaatttgacaataatggatctacacccagggagtggaaaaactagacgttacctacctgctatagtacgggaagcaattaaaaggaagctacgtacactaattttagctccaaccagggtagttgcgtctgaaatggccgaagcgctgaagggtatgcctatcagataccagacaacagcggttaaaagtgaacatacggggaaagaaatagtagatttaatgtgccatgcaacatttaccatgagattgctaagtcctgtgagagtacctaactacaatatgattatcatggatgaagcccattttactgatcctagctcaatagcagcgagaggttacatcagtacacgtgtaggaatgggtgaagctgctgcaatatttatgacggcaacaccaccggggtcagtcgaggcatttccacaaagcaacgcagtaattcaagatgaggagagggacataccggagagaagttggaacagtggctatgaatggattaccgacttcccaggaaaaactgtatggtttgttccgtcaattaaatctggtaatgacattgcgaactgcttgaggaaaaatggtaagcgtgtaatccaactatcaagaaagaccttcgacactgagtatcagaaaactaaaaacaacgactgggactatgtagttactacggacatctctgaaatgggagccaattttagggccgatagagtaatagacccgcgacggtgtttaaaaccagttatattaaaagatggaccagaaagagtaattctcgcagggccaatgcctgtcactgtcgcgagcgctgctcaaagacggggtcgaatcggacgaaatcataataaagaaggagatcaatatatatatatgggccaaccacttaataatgacgaggatcatgcacattggacagaagcaaaaatgcttttggataatattaatacgccagaaggaataataccagcattgtttgaaccggagcgagaaaaatcagcggccatagatggtgagtataggcttaggggagaagcgagaaagaccttcgtagaattaatgcgaaggggtgacctacctgtatggctgagttataaagttgcttcagaaggtttccaatatagcgatagaagatggtgcttcgacggagaaagaaataatcaggtcttagaagagaatatggatgttgaaatctggacaaaggaaggtgaaaggaagaaattgcgaccaagatggcttgatgctagaacgtactccgatcctctggctttaagggaatttaaagaatttgccgcagggcgcaggagcgtttcaggcgatttgatcttagaaatagggaagctaccacaacatttaacccaaagagcccagaacgcgcttgataacctagttatgctacataattcagaacaaggtggccgggcctatcgtcacgcaatggaagaattgccggacactatagaaacactaatgctacttgccctgatcgcggttcttaccggtggtgtcacattgttcttcctttctggaagaggtctaggaaagacatcgattggactattatgtgtaatggcttcatcagtactactttggatggcgtcagtcgagccacactggattgctgcaagcataatcctagaatttttcttgatggtgcttctaattccggaacctgatcgccaacggacacctcaagataaccagctagcatacgtagttatagggcttctttttatgattttgacggtggcagcaaacgagatgggtttattagaaactacaaagaaagacctaggcataggccacgtggccgttgaaaatcatcatcatgcagctatgctagatgtagatcttcaccctgcgtctgcctggacactgtacgctgttgcaacgacaataatcactccaatgatgagacataccatagaaaataccacggcgaacatatctctgaccgcaattgctaatcaagcggctattttaatggggttagacaagggatggcccatttcgaagatggatataggtgttccactactagcactagggtgctattcccaagtgaatcctttgacattaacagcagccgtattaatgttagtagcacattacgcaattataggaccaggactacaagctaaagctacgcgtgaagcacaaaagagaacggcggctgggattatgaaaaatcctacagtggacggaatcgttgctatcgatctggacccagtagtgtacgatgcaaaattcgaaaaacaattgggacagataatgctattaatattatgtacaagtcagatacttcttatgagaacaacttgggctctttgtgaaagcattacacttgcaacgggacccttaacaaccttgtgggaaggttccccaggaaaattctggaatacaacaattgcagtgtcaatggcaaatatttttagaggtagctacttagccggtgcggggctggcgttctctctaatgaaatcactcggtgggggaagacgtggtactggagctcagggagaaactctcggcgaaaaatggaaaagacagcttaaccaacttagcaaatcggaatttaatacatataagcgtagcggaattatggaagtagatagatcagaagcgaaggaaggcttgaaacgcggagaaacgaccaaacatgcggtctcaagggggacagcgaaattaaggtggtttgtagaaaggaatttggtaaagccagaagggaaagtaattgacttgggttgtggtcgtggtggctggagttattactgcgctggactgaagaaggtaacagaagtcaaagggtacactaaaggtggcccaggacacgaagaaccaataccaatggcaacatatggatggaacttagttaaactccattctgggaaagacgtattcttcgttccacccgagaaatgcgatacactcctatgcgatataggggaaagtagcccaaatccaacaattgaggagggcagaacattgcgtgttctaaaaatggtcgaaccctggcttagaggtaaccaattttgcattaaaatactcaatccatacatgccatcagtggtagaaactcttgaacaaatgcagagaaagcatggcggtatgttggtaagaaatccattaagccggaactccacacacgaaatgtattgggttagttgtggtacgggtaacattgttagtgcagttaatatgacgtcacgaatgctgttgaatagatttacaatggcacatagaaaaccaacgtatgaaagggacgtagatttaggagcagggacgagacacgttgcggtagagccagaagtagcaaatttggacataataggtcaacgaatagaaaacatcaagcacgagcacaagagcacttggcattacgatgaagacaacccatacaaaacatgggcatatcatggatcctacgaagtaaagccgtccggctctgcaagcagtatggtaaacggagtcgttaaattgcttacgaagccatgggacgtgatcccaatggtcacacaaattgcaatgaccgataccactcctttcggtcagcaaagggtatttaaagaaaaagtcgacacaagaacacccaaagcaaaaagaggtactgcacaaataatggaggtcactgcaaaatggctatggggattcctatcacgaaataagaaaccaagaatttgcactagagaagagttcacaagaaaggtaagatctaatgcagccataggagctgtattcgtggatgagaatcaatggaactctgctaaagaagccgttgaggacgaaagattttgggatctagtccacagggaacgtgaattacataaacaagggaaatgtgcaacgtgtgtttataatatgatgggaaaaagagagaaaaagctcggggagttcggaaaagcgaagggctctagggccatttggtatatgtggctcggcgcgcgattcttagaatttgaggctttagggtttatgaatgaagatcattggttctcacgggaaaactctttgtctggcgtggaaggtgagggcctacacaagttaggttatatactcagagacataagtaaaatatctggagggaatatgtacgctgacgatacggcgggatgggatacccgcatcacagaagacgatttacaaaatgaagccaaaataaccgacataatggagccggagcacgctttacttgccaagtccatcttcaaactgacttaccagaataaagttgttcgtgtgcaaaggccagctaaaaatggcacagttatggatgttatttctaggagggatcaacgaggatcaggacaagtgggcacttacgggttaaatacgtttacaaacatggaagcccagctcattagacagatggagtcggaggggatattcagtccctctgaattagaaacaccaaacttagcagaacgtgctctagattggttagagaagcatggagttgagagactgaaaaggatggcgatttcgggagacgattgcgtagtaaagccaatagacgatcggttcgctacggcacttactgccctaaacgatatgggaaaggtgagaaaagacattccacaatgggaaccgtcgaagggatggaatgactggcagcaagtcccattctgttcgcaccacttccatcaattaataatgaaagacggcagagagattgttgtaccatgccgaaatcaagatgagttagttggcagggcccgagtttcccaaggagcaggatggtctcttagggagactgcctgtttggggaaaagttatgctcaaatgtggcaactcatgtattttcatcgtcgtgatcttaggttagcagccaatgcgatttgttcagctgttccagtggattgggtcccaacaagtagaactacttggtctatacatgctcatcatcaatggatgacgacagaagatatgcttagtgtttggaatagagtatggatagaagaaaatccttggatggaagacaaaacacacataagcagttgggaagacgtaccttacttaggaaaacgcgaagatcaatggtgtggttctcttatagggctaacggccagagctacatgggctactaatatacaggtcgcaataaatcaggtccgcaggctaattggtaatgaaaactatttagactacatgacaagtatgaaacgatttaaaaatgagtcagtcccagaaggagctctatggtag

SEQ ID NO: 21197 - RNA, 9879 nt, synthetic construct
  misc_feature 1..9879: note = derived and/or modified CDS sequence (opt6) from DENV-1__FJ639685__SS-prME
  source 1..9879: mol_type = other RNA
tctgtgacaatgttactcatgctaatgccaacagcactagcttttcacctaacgactcgagggggagagccacacatgatagtatctaaacaagagaggggtaaatcattgttatttaaaacgtctgcgggagtaaatatgtgcacactaatcgcaatggacttaggggaattatgtgaagacacaatgacttacaaatgccctaggataactgaggccgaaccagatgacgttgactgctggtgtaatgccacagatacttgggtcacctacggaacatgcagtcaaacaggtgaacatcgtagggacaaacgaagtgtagcacttgcacctcatgtagggctgggattagagacacgtacagaaacttggatgagttcagaaggggcatggaaacaaatccaaagggtggaaacatgggcgctaagacatccaggattcactgtaatagctctctttcttgcgcatgcgattggaacttcgattactcaaaaaggtataatattcatactccttatgctagtgactcccagtatggccatgcgctgtgttggaatagggtcgagagacttcgtagaaggacttagcggcgcgacatgggttgatgttgtactcgaacacggttcatgcgtcacgacaatggcaaaagacaaaccaacgcttgacattgaactattaaaaaccgaagtaacaaacccagctatacttagaaaactttgtatagaagctaaaatatccaatacaacgacagacagtagatgtcccactcaaggcgaagctacactcgtcgaggaacaagatgcaaacttcgtatgtcgacgcactttcgtagatcgaggttgggggaacggatgtggactattcggcaaagggtccctaattacctgcgccaaatttaaatgtgtaactaaactggaaggtaaaatagtccagtatgaaaacctcaaatacagtgtcatagtcacagtacacacaggagaccaacaccaagtgggaaatgaatcgacagaacatggaactactgcaaccattactccccaagccccaactactgaaatacagttaactgattatggggctctaacattagactgcagtccgaggacaggtttggattttaacgaaatggtattactgacgatgaaagagaagtcctggttagttcataaacagtggttcttggaccttccactcccatggaccagtggggccagtacaagccaggagacctggaatcgacaggatcttctagtaacttttaaaactgcacatgcgaagaaacaggaagttgtagttttagggagtcaggaaggagcgatgcatacagcgttaaccggtgccacagaaattcagacgagtggaacaacaacaatatttgcaggtcatttgaaatgtcgtttaaagatggataaattgactcttaaaggcatgtcttatgtaatgtgcacaggttcttttaaactggaaaaagaagtggcagaaacacaacatggaaccgtcttagtacaaattaagtacgaaggaacagatgctccttgcaagataccattctcgacacaagatgaaaaaggtgttactcaaaatggaaggttaatcaccgcaaatcctatagttacagacaaggaaaaaccagtcaacattgaagccgaaccaccattcggggaatcctacatcgtaattggggcaggcgagaaagcgttaaaactttcatggtttaagaaaggaagcagtatcggaaaaatgtttgaagctacggctaggggagcgagaagaatggcgatactaggagacacagcatgggattttggttctataggaggagttttcacatctgtcggcaaacttgtacaccaaattttcgggactgcgtatggagtactatttagtggcgtcagttggactatgaagataggaataggcgtgctattaacatggctcgggctcaattcccggtcgacatcattcagtatgacttgtatagccgtgggtctagtgactctgtacctcggagtaatggtacaggcagattcaggatgtgtgattaactggaagggaagagagttaaagtgcggttccggaatttttgtaacaaacgaagtccatacatggacagaacaatacaaattccaagcagattcaccaaaacggctgtcggccgcaattggaaaagcctgggaagagggagtatgcggaatacgatccgcaacgagactcgaaaatataatgtggaaacaaatatcaaacgagctcaatcatattttgttagagaatgatatgaaatttaccgtagtggtaggagacgttgccggtatattagcacagggtaagaaaatgatcaggcctcaaccaatggaatacaagtatagttggaaaagctggggaaaagcgaaaattatcggggcagatgttcaaaacacaaccttcattatagatggcccaaacacacctgaatgccccgacgatcagcgagcctggaacatatgggaggtagaagactatggcttcggcatattcactactaatatttggttaaaactaagagattcatatacacaagtttgcgatcataggttgatgagtgcagccattaaagatagtaaagcagtacacgctgacatggggtattggatcgaatcggagaaaaatgagacttggaaattggcaagagcttcgtttatcgaagtaaagacttgtatatggcccaaatctcatacattatggtctaatggtgtccttgaatctgaaatgatcattcccaaaatctatgggggtcccatcagtcaacataattatagaccaggttattttacacaaacagctggtccctggcatctaggaaagttagaactagattttgacttatgtgaaggtactactgttgttgtagacgaacattgtggcaatagagggccttcgcttcggacaacaaccgtaacaggtaaaataattcatgaatggtgctgtcgatcctgtacactaccgcctttaagattccgcggggaagatgggtgctggtatgggatggaaatcaggccagttaaagaaaaagaagaaaatcttgtgaagtcaatggttagtgccggatcaggtgaggttgattcattttcacttggattactttgtatcagcataatgatagaagaagtcatgaggagtcgttggtcgcgaaaaatgttaatgactgggaccctagcggtgttccttctgctcattatgggtcagcttacatggaatgacctaattcgattatgtatcatggtaggagctaatgcatcagatagaatgggaatgggtacaacttatttagcccttatggcaacttttaaaatgcgtccaatgtttgcagtaggacttcttttccgaagattaacctcgagagaagtgctattgctcacgattggtctctctctagtcgcctcagtagaactaccaaacagtcttgaagaattaggcgatggactagcaatgggaattatgatactgaaattattaactgactttcagtcccaccagctatgggcaactctattatcacttacctttattaagaccacattcagtctccactacgcgtggaaaacaatggcgatggtactgtccatagtcagcttatttccattgtgtttgtctacaacttcacaaaagactacttggttaccggtattattaggctcacttggatgtaaacccctaacaatgtttctcatagcagaaaacaaaatatggggaaggagatcttggccattgaacgagggaatcatggcggttggaattgtgagcatactgttgtcatctctattaaagaacgacgttccgctcgctggaccacttatagcaggcgggatgctaatagcctgctatgtaatctcaggatcgtcagcagacctaagtctcgagaaagctgccgaggtaagctgggaagaagaagcggaacatagtggggcttcacacaatatattagtggaggttcaggacgacggaacaatgaaaataaaggacgaagaacgtgatgatacattaacaattttattgaaggccactctattagcggttagcggagtgtaccccttatcaatacccgcaacactatttgtttggtatttctggcagaagaagaaacagcgatcaggagttctgtgggatacgcccagtccgcctgaggtagaacgcgctgtactggacgacgggatatatcgaattatgcaacggggtttattaggaaggagtcaagttggagtgggtgtattccaagaaaatgttttccacacaatgtggcacgtcactagaggagcagtcctaatgtatcaaggtaagcgtctagagccgtcatgggctagtgtcaagaaagacttaataagctatggaggtgggtggcgattacaaggatcttggaataccggcgaagaagtacaagtcatagctgtagaacccggcaaaaatcccaaaaatgtacagacagccccagggacgttcaaaactcctgaaggtgaagttggggccatagcattagatttcaaacctggaacgtcaggttcccctattgtaaatcgagaaggaaaaatagtcggattatacggtaacggcgtagtcacaacttccggaacgtacgttagtgcgattgcacaggctaaagcgagccaagaaggtcccttgccagaaatagaggacgaggtgttcaggaaacgcaatttaactatcatggacctccacccaggtagtggaaaaacgcgaagatatttaccagcgatagtacgagaagcaatcaaaagaaaactacggacacttatattagccccaaccagagtagtcgcttctgagatggctgaagcattaaagggtatgcctatacgttatcaaactacagccgtgaaatccgagcacactggtaaagagatcgttgatttaatgtgtcatgcaacgtttacaatgagactattgtcaccggtaagagtgccaaactataacatgataataatggacgaagcgcattttactgatccttctagtatagccgcacgtggatatatatccactagagtaggcatgggtgaagcagcggctatatttatgacggcaaccccaccaggaagcgtagaagcattcccacagtcgaatgccgtaattcaagacgaagaacgagatatcccggagaggagttggaactcaggatatgagtggataaccgactttcccggaaaaactgtctggttcgtaccgtctataaaatcaggcaatgatatcgcaaactgcctacgcaagaacgggaaaagggttatacaacttagtagaaaaacttttgacaccgaataccagaaaaccaaaaacaacgactgggactacgtagtaactacagatatttcagaaatgggagctaattttcgtgcagatagagttattgatcctcgtaggtgtcttaagccagtaatcctgaaagacggccccgaaagggtgatattagcaggtcccatgcctgttactgtcgcgtcagccgctcaaaggagaggaaggattggaagaaatcataacaaagaaggcgatcaatatatatatatgggacagccgctcaacaatgacgaagatcacgcgcattggacggaagcgaaaatgcttcttgataacatcaatactcctgaaggaattattcctgctctattcgagccagagagggaaaaatccgccgctatagacggagaatatcgccttcggggagaagcaagaaaaacttttgtagaattaatgagaagaggggatctcccagtatggctatcgtataaagtggcctcagagggattccaatattcagacagaagatggtgcttcgacggcgagagaaacaaccaggttctggaggaaaacatggatgtggaaatatggactaaagaaggggagagaaagaaattacggccgaggtggttagacgcccgaacctactcagatcccttggctttacgtgagttcaaagagttcgccgcaggccgccgttcagtgagtggagacctaattctagagattgggaaacttccacagcatttaacacagcgtgcccaaaatgcattagataatttagtaatgttgcacaatagtgaacaaggtggccgggcatatcgacacgcgatggaagaattaccagatacaatcgaaaccttaatgcttctcgcgttaatcgcagtactgacgggaggtgtcactttgttctttctatctggtaggggattaggaaaaacttcaattggactgctctgcgttatggcgtcaagcgttcttttatggatggcgtcagtagaaccacattggattgctgccagcataatattggagttctttctaatggttctattaataccggaacccgatagacaaagaacacctcaagacaatcaattagcctacgttgtaataggactactgttcatgattctgaccgttgcagcaaacgaaatggggttgctggaaactaccaagaaagatctaggaattggtcatgtggctgccggcaatcatcaccatgcggcaatgttggacgttgacttacatcctgcgtcagcatggacgctttatgcagttgctactactatcattacgccgatgatgagacacacaatcgaaaataccactgctaacatcagcttaactgcaatcgcgaatcaagcggccatactaatgggtcttgacaaaggttggcctataagtaaaatggatattggcgtacctctcctcgcactcgggtgctatagtcaagttaatccgttgactctaactgccgcagttcttatgttagttgcgcattacgcgattattgggccaggtctacaagcgaaagccacgcgagaagcccagaaaagaacagctgcgggtataatgaagaacccgacagtagatggaattgtggcaatagatttagatccagtagtatatgacgctaaattcgaaaaacagctaggccaaatcatgttattaatactatgcacaagccaaattttattaatgagaactacctgggccttatgtgaaagtattacattagcaacaggccccctaacaaccttatgggaggggagcccaggaaagttctggaacactactatcgctgtgtcaatggcgaatatctttcgggggtcgtacctagccggtgccggtctagcctttagcgtcatgaaatccttaggtggaggtcgtcgaggaacgggagctcaaggagagactctaggggaaaagtggaaaagacaattgaatcaattatcaaagagtgaatttaatacatacaaaaggtcaggtatcatggaagtcgataggtcagaggctaaagaaggacttaagagaggagaaacaactaaacatgcagttagtagaggaacagcgaagctgagatggttcgttgaaagaaacttagttaaaccagaaggcaaagtgattgacttaggatgcggacgcggaggatggtcatattattgtgcaggacttaagaaagtaacagaggttaaaggatatacaaaaggtggaccaggccatgaagaaccgattccgatggctacatatggatggaatttagtcaaattacactccggcaaagatgtcttcttcgtaccacccgaaaagtgtgatactcttctatgtgatataggcgaaagttccccaaacccgaccattgaagaaggtaggacgcttagagttttaaaaatggttgaaccatggttgcggggtaatcaattttgtatcaaaatactcaacccatatatgccatctgtggtggagactctcgagcaaatgcagcgaaaacacggaggtatgttagtaagaaatccactgagccgcaattccacacatgaaatgtactgggtttcctgtggtacaggtaatattgtaagtgctgtaaacatgacatcacgaatgctgttaaatcgctttactatggctcatagaaaacccacatacgaaagagatgtagatttgggagcaggaactcgacacgtagcagtagaacccgaagtggctaatctagatataataggtcaacgaattgaaaacataaagcacgaacataaaagtacgtggcattatgatgaagataacccatataaaacatgggcatatcacggttcatatgaggtgaaaccgagcggctctgccagtagtatggtaaatggtgtcgtcaagttattaactaaaccatgggatgtgattcccatggtaacacaaatagctatgactgatactacccctttcggtcaacaacgtgtgtttaaagaaaaagtcgatacacgaacccctaaagcgaaacgaggcaccgcccaaataatggaggtcactgccaaatggctatgggggttcctaagtagaaataaaaagccacgaatatgcactcgagaggagttcactcgcaaagtaagatcaaatgctgcaattggagctgtatttgtggacgaaaatcaatggaactcggctaaagaggcagtagaagatgaaaggttctgggatttagtacacagagaaagggaactccataaacaaggtaaatgtgctacttgcgtatacaatatgatgggaaaaagagagaagaaattaggagaatttggaaaagctaaagggtcgagagcaatatggtacatgtggctaggagcacgctttttggaatttgaagcgcttggttttatgaacgaagaccattggttttccagagaaaactcactttccggagtggagggtgaagggcttcataagctaggttatatacttcgtgatatatccaaaatacctgggggaaacatgtatgcggatgacacagcaggttgggatactagaataaccgaagatgaccttcaaaacgaggctcgtattacagatataatggagcccgaacatgcccttctggcgaaatccatattcaagctaacataccagaacaaagtggttcgggttcaaaggcctgcaaagaacgggaccgtaatggacgtaattagccgcagagatcaaagaggaagcggacaggtcggcacatacggtctaaatacctttacaaatatggaagcccagctgataagacagatggaatctgaagggatttttagcccctctgaattagaaacgccaattttagccgaacgagtattagattggctcgaaaaatacggcgtagagcgattgaagcgaatggccatttcaggtgatgattgcgtagttaaacctattgacgatcgatttgcaacagccttaacggcattaaacgatatgggaaaagtacgaaaggacataccccaatgggaacccagtaaaggatggaacgattggcaacaggttccattttgttctcaccatttccaccaactgataatgaaagatggtcgtgaaatagtagtaccttgtcgtaatcaagatgaacttgttgggcgagcaagggtgtcacagggggccggatggtccctcagagaaacagcgtgtttggggaaatcatacgcccagatgtggcaattgatgtactttcatcgacgtgatcttcgattagcagctaatgccatatgttctgccgtcccagttgactggatacctaccagccgaacaacctggagcatccatgcacatcaccaatggatgacgaccgaagatatgctatcagtatggaacagagtatggatagaggaaaatccttggatggaggataagactcacatatcaagctggggtgatgtaccttacctaggcaagagagaagatcaatggtgcggaagtctaataggactaaccgcccgagctacatgggccacaaacatacaagtcgcaattaatcaggttaggagattaatagggaatgagaattacctagattatatgacttctatgaagaggttcaaaaatgaatcagaccccgaaggtgcgttatggtaa

SEQ ID NO: 21198 - RNA, 9879 nt, synthetic construct
  misc_feature 1..9879: note = derived and/or modified CDS sequence (opt6) from DENV-1__FJ639686__SS-prME
  source 1..9879: mol_type = other RNA
agtgttaccatgcttctaatgctaatgccaaccgctctggcctttcatcttacgactagagggggcgaacctcatatgattgtgtcaaaacaagaacggggaaaatccttgctatttaaaacttcagctggagtaaatatgtgtactctaatcgcgatggatctaggtgaattatgcgaagatacgatgacctataaatgtccccgaataactgaagctgaaccagatgatgttgactgctggtgcaatgcaacggatacttgggttacttatggcacatgctcgcaaacaggagagcataggcgtgacaaacgcagtgtagccttagctccgcatgtaggtctagggctcgaaacaagaacggaaacttggatgtcgtctgaaggagcatggaaacaaattcaaagggtagaaacttgggcattgcgacatccaggattcacagtgatcgcattattcttagcccacgcgataggtacgtccataactcaaaagggaatcatatttattttactcatgctagtaacaccaagtatggcaatgcgatgcgttggaataggttcaagagactttgtcgaaggactatctggagcgacttgggttgatgtagtcctcgaacatggcagttgcgtaactacaatggcaaaagataaacctactcttgacattgaattgttaaaaacggaagtgactaatccagctattcttcgaaaactgtgtattgaagcaaagattagtaataccacaactgactcccgttgtccgacacaaggcgaggcaacattagtagaagaacaagatgcaaattttgtatgtagaagaacatttgtcgatagaggttgggggaacggatgtggtctattcggaaaaggttcattgataacgtgtgctaaattcaagtgcgtaacaaaattggaaggaaagatagttcaatacgagaacttaaaatactcagtaatagttactgtccatactggagatcaacatcaagtgggcaatgaaagtactgaacacgggacaacagctacaatcacacctcaagctccaactacagaaatacaacttactgactatggagccctcacgctggattgttcgccacggacaggcctcgactttaacgaaatggtgttgcttactatgaaggaaaaatcttggttggtccataaacagtggttcctagacttaccgctgccttggacttccggggccagtacatcacaggaaacttggaatagacaagacctattagtaactttcaaaacggctcatgctaagaaacaggaggtcgtggtattaggctcgcaagaaggggcaatgcatacagccttgactggagccacagaaatacaaacatcggggaccacgacgatatttgccgggcatctaaaatgcagactgaagatggataaattgaccttaaagggtatgtcatacgttatgtgtactgggtctttcaaactagaaaaggaggtagcagaaacacaacatggaactgtcttagttcagatcaggtatgagggaacggatgcaccatgcaaaatcccattctccactcaagatgaaagaggggtcactcagaacggtagattgataactgccaatccgatagttactgacaaggaaaagcctgttaatatcgaagcagaaccacccttcggagagtcctatattgttataggtgctggggagaaagcgctaaaattaagctggttcaaaaagggatctagtatcgggaaaatgtttgaagcaacagctcgtggagcgaggagaatggccatactaggagatacagcttgggatttcggatcaattggaggtgtttttacatcagtaggaaaattagtacaccagatattcggtaccgcttatggtgtactattttccggtgtatcttggacaatgaaaataggaataggcgtgctattaacctggctcggattaaattcgagatcgacatctttttcaatgacttgcatagccgttgggctcgtaacactatatctaggagtaatggtgcaagctgattctggctgcgtaataaactggaaaggtagagaactgaaatgtggatcaggaatttttgttacaaacgaagtacacacatggacggagcaatataaatttcaagctgatagcccaaaaagattatccgcagcaataggcaaagcatgggaagaaggagtatgtggtattcgaagcgcaacccgtttggaaaatatcatgtggaaacagatatccaatgaattaaatcatattctcttagagaatgatatgaaattcactgttgtcgtaggagatgtagcaggcatacttgcccaagggaagaagatgatcagaccacaaccaatggaatacaaatactcgtggcgatcatggggtaaagcaaagataataggagcagacgtacagaacacgactttcattatcgacggaccgaacacaccagaatgtccggacgatcaaagagcttggaatatctgggaggtcgaggactatgggttcgggatattcactactaacatatggctgaagttaagggattcatacactcaagtttgtgatcaccgtttaatgtccgctgccattaaagacagcaaagcagttcatgccgatatggggtactggattgagtccgagaaaaatgaaacatggaaacttgcacgggctagctttatagaggttaaaacatgcatatggccaaaatcgcacacactatggtcaaacggtgtactagaatcagaaatgataatcccaaaaatttatggtggcccaatttcccagcataattatcgtccaggctacttcactcaaactgcaggcccctggcatctaggaaaactagaactggacttcgatttatgcgaaggaacgacagtagttgtagacgaacattgcggaaacagaggacctagtctcagaaccacaacagtgactgggaaaataatccatgaatggtgttgtcgctcttgtactcttccccctctgcgctttagaggtgaagatggttgctggtatgggatggaaataagaccggtaaaggaaaaagaagaaaacttagtaaagagcatggtgtctgcaggcagcggagaagtagatagcttctccttaggattgctatgtatttcgattatgatcgaggaggtcatgcgctctaggtggtcgcgaaagatgttaatgacaggtactttggcagtcttcctactcctaatcatgggccaattaacatggaatgatctgatcaggttatgtataatggtaggagccaatgcgagtgatcggatgggaatggggacgacatacttagctttaatggcaacattcaaaatgcgacccatgtttgcagtgggattactatttagaagattaacctctagggaagtgttactactaacaattggccttagcctagtggcgtcggtagagcttcccaactctctcgaagaactaggtgatggtcttgcgatgggaattatgattctgaagttattaacggacttccaatcacatcagttatgggccaccctactgtcgctaacgtttataaagactactttttcactacattacgcatggaaaactatggctatggttctatcaatagtttccctcttcccattgtgtttatctactacaagccagaaaacaacgtggttacctgtcctattggggagtctcggctgtaaaccgttaaccatgttcttaatcgcagaaaataaaatctggggaaggaggtcttggcccttgaacgaagggattatggcagttggaattgtgagcatcctactctcatctcttctgaagaacgacgttccactcgcaggacctcttatagctggaggaatgttaatcgcttgttatgtaataagcggctcatctgccgatttaagccttgaaaaagccgcggaagtgagctgggaggaagaggctgaacactctggcgctagccataatatattggttgaggttcaagacgatggaacgatgaaaattaaggacgaagaaagagatgatacacttactattttactaaaagctacacttttagccgtatcaggagtttaccccttatccattccagccacgttgtttgtatggtacttctggcagaagaagaaacaaagaagtggtgtcttatgggatactccttcaccacctgaagtagaacgcgcggtcctggacgacggcatctataggataatgcaacgtggtctcctaggaagaagtcaggtaggagtaggtgtgtttcaagaaaatgtgttccatactatgtggcacgtaacgcggggagcagttcttatgtaccaaggaaagcgtctcgaaccatcatgggccagtgtcaaaaaggacttaatttcgtacggaggtggttggcgtttgcaaggttcctggaacacaggcgaagaagtgcaagttatagcagtagaaccaggcaaaaatccgaagaacgttcagaccgcaccaggaacattcaaaactcccgaaggcgaagtaggagcgattgcactagattttaaaccaggaacaagtggatctccaattgtcaatcgggaaggcaagatagtaggtctttacggaaatggtgtggtaacaacaagcgggacttacgtgtcggcaatcgctcaggccaaagcatcacaagagggacccttaccagagatcgaagatgaagtatttagaaagagaaatcttaccataatggatttacaccctggatcggggaaaactagaagatatttaccagcgatagtaagagaagccatcaaacgaaaactacgaacgttgattttagcaccgaccagagtagtagcaagtgagatggccgaagcactcaaaggtatgccaatacgttatcagacgactgcagttaaatcagaacataccggaaaagagattgtcgacttaatgtgtcacgcaacttttacaatgcgtttattatctcctgtacgagtaccgaattacaacatgattattatggatgaggcacatttcactgacccatcttctatagcagctagaggatacatatcaacgagggttggaatgggggaagctgcagccatattcatgacggctactcccccaggatcagttgaagcatttccccaatcaaatgcagtcatacaagatgaagaaagggatataccagaaagatcgtggaactcaggctatgagtggataacagattttcctggcaagacagtatggtttgtaccatccataaaaagtggaaatgacatcgctaactgtctaaggaaaaatgggaagcgtgtcatacaactatcaagaaagacgtttgacacagagtatcagaaaaccaagaacaatgattgggattatgttgttacaactgacatctcagaaatgggagcgaacttccgagcagatcgggtaattgacccaagacggtgtctcaaaccagtaatcctaaaagatggacctgaaagagtaatactagcagggccgatgccagtaacggtagcttcagccgcacaacgtcgtggaagaataggtaggaatcacaacaaagaaggagaccaatatatatatatgggccaacctcttaacaatgatgaagaccatgcccattggaccgaagctaaaatgttactagataacataaatacaccagaaggtataattcccgcactatttgaaccagagcgtgagaaatctgcagctattgacggagagtacagacttcgaggagaggctaggaagacattcgttgaacttatgaggcgaggtgatttaccagtttggttaagctataaagtcgcaagcgaaggatttcaatactctgatcgacggtggtgttttgacggagagagaaacaatcaggtccttgaggaaaatatggacgtagaaatttggacaaaagaaggagagaggaaaaagctgcgaccaagatggctggatgcgagaacttactcagatccattggcacttagagaatttaaggagtttgcagccggaagacgatcagtatcgggtgatttaattctcgaaattggaaaactgccccaacaccttactcaacgagcccagaatgcgttagacaacctagtaatgctccataatagcgagcaaggaggacgagcttatagacatgcaatggaagaattaccggataccatagaaaccctaatgttgctagccctaatagcagtattaacaggcggagtcaccttattctttctttccggcaggggattaggaaagacaagtattggactactatgtgtaatggcttcttcagtattattatggatggccagtgtggaacctcactggatcgcagcatcgattatattagagttctttcttatggtgctattaataccagaacctgatagacaacgtacaccgcaagataatcaactagcctacgtggttataggtttattatttatgatacttaccgtcgcggcaaatgaaatggggttacttgaaacaactaaaaaggacctcggtataggtcacgttgcagttggaaatcatcaccatgcagcaatgcttgacgtcgatttacacccagctagcgcgtggactttatatgcagtggcgactacaattattacgcccatgatgagacatacgatagaaaatactactgcgaatatatcactaactgccatagcgaatcaagcagcgatattaatgggtttagacaaaggatggcctatttcaaaaatggacattggtgttccactccttgctttgggatgctattcgcaagtaaacccactaaccttaaccgctgccgtactgatgctagtcgcacactatgccataataggcccgggattacaggcaaaagcgacacgtgaagcacagaaaaggacagcggctggtattatgaagaaccctacagttgatggtatagtagctatcgacctcgacccagttgtatatgatgctaaatttgagaaacaattagggcaaataatgttactaatactctgcacgagccaaatactactaatgaggacgacttgggcattatgtgaaagtatcactttggcaacaggccccctaactacattatgggaaggaagtccgggtaaattctggaacacaacgatagcagtcagtatggctaatatattcagagggtcgtatttagcaggcgcaggtttagctttcagcctaatgaaatctcttggcggaggtagacgaggtaccggtgcacaaggggaaacacttggagagaaatggaaaagacaacttaatcaactatcaaagagcgaatttaacacttataaacgaagtggtataatggaggtagatagaagtgaagcgaaggagggactcaagagaggtgaaattacgaagcatgcagtttcccgaggaactgcaaaactgagatggtttgttgaaagaaatctggttaaacctgagggaaaagttatagatctaggatgtggcaggggaggatggagttactactgcgctggtcttaaaaaggttacagaagtgaaaggatatacaaaagggggtcctggccacgaggaacccatacctatggcaacttacgggtggaatctagtaaaacttcactccggtaaggacgtattctttgttccgcctgaaaaatgtgacacgcttttatgtgacataggagagagttccccaaatcctaccatcgaagagggtcgcacacttcgtgtcctgaaaatggtcgaaccatggttaagagggaaccaattttgtataaaaatattaaatccatatatgccaagtgttgttgaaactttagaacaaatgcaaaggaaacacggtggtatgttagttagaaatccattatccagaaatagcacacacgaaatgtattgggttagttgcggcacaggtaatattgtatctgcagtaaacatgacaagcaggatgctcttgaacaggttcaccatggcacatagaaagcctacttacgaaagagatgtagaccttggagctggaacacgtcacgtagccgtcgaacccgaggtagcaaacctagatattataggacaacgaatagaaaacattaagcatgaacataagtctacatggcattacgatgaggataacccgtacaaaacctgggcttaccacggcagttatgaggtaaaaccatcaggatccgctagtagcatggtcaatggagtagttaaattattaaccaaaccctgggacgtaatacctatggtaacacagatagcaatgactgacaccacgccttttggacaacaacgcgtattcaaagaaaaggtagatacacgtactccaaaagcgaaacggggtacggcccagatcatggaagtaacggcaaaatggctgtggggctttttatccagaaacaaaaagcccaggatatgtacgagagaagagttcacacgtaaagtaaggagtaatgcagcaattggagcagtatttgttgatgaaaatcaatggaactccgcgaaggaggccgtcgaagacgaaaggttttgggatctggtccatagagagcgagaactacacaaacagggaaaatgtgcaacatgtgtatataacatgatgggtaaacgtgagaagaaactaggagaatttggaaaagctaaagggtctagagcaatatggtatatgtggttaggagctcgatttttagaatttgaagccttaggtttcatgaacgaggaccattggttctctagggaaaattcactatcaggtgtcgagggcgaggggttacataaactagggtacatcctacgagacatttctaaaattcctggtggtaacatgtatgcggatgatacggcagggtgggacacacgaatcaccgaagatgatttacaaaacgaggccaggattacagacattatggagccagaacacgcgctgctagccaaatccatatttaaattgacttaccagaataaggttgtccgcgtacaaagaccagccaagaacggcacagttatggacgtaatctcacgacgagatcaaagaggatcaggtcaagttggaacttatggactgaatacattcaccaacatggaggctcaattaattagacaaatggagtccgaaggtattttctcgccaagtgaactggaaactccaaacttagccgagagagttttagactggcttgaaaaatatggtgtagaaaggctgaaacgcatggcaatctcaggcgatgattgtgtagttaaacccatagatgataggtttgcgacagcgcttacagccctaaatgatatgggaaaagtacgcaaagatataccccaatgggaaccctcaaaagggtggaacgactggcaacaggtacctttctgttcgcaccactttcatcaattaattatgaaagacggaagggaaattgtcgtaccatgtagaaatcaagacgaattagtaggacgcgcaagggtatctcaaggggctgggtggagcttaagagaaacagcgtgtctgggtaagagctatgctcaaatgtggcaacttatgtactttcatcggagagatcttcgacttgcagcgaacgcgatttgttccgcagttcccgtagactggattccaacaagtcgtacaacatggtcgatccatgctcaccatcaatggatgaccaccgaggacatgttaagcgtatggaaccgtgtatggattgaggaaaatccctggatggaagataaaactcacataagtagctggggagatgtgccatatttaggaaaaagagaagatcaatggtgtgggtctttaattggattgactgcacgcgctacttgggcgacaaatattcaagttgcaattaaccaggtgaggagacttataggaaatgaaaattatctcgattacatgacaagtatgaaaaggttcaaaaacgagagtgacccggaaggtgcactatggtaa

SEQ ID NO: 21199 - RNA, 9879 nt, synthetic construct
  misc_feature 1..9879: note = derived and/or modified CDS sequence (opt6) from DENV-1__FJ639687__SS-prME
  source 1..9879: mol_type = other RNA
agtgttactatgttactgatgttaatgccaaccgcacttgcctttcatttaaccacacgcggaggtgagccacacatgatcgtatctaaacaagagcgaggaaaatctttactgtttaaaacaagtgctggtgtaaatatgtgcacgttaatagctatggatctaggtgagttttgcgaagacacaatgacttacaaatgtccccgcataagcgaagcggagccggatgatgtagattgttggtgcaatgcaactgacacatgggtgacatacggaacatgtagccaaacaggcgaacatcgcagagataaaagatctgtagccttagctcctcacgttggactaggtctcgaaactcgaaccgaaacctggatgtcgtccgaaggtgcgtggaaacaaatacaaagagttgaaacatgggcccttagacatccaggttttactgtcatcgctttatttttagcgcacgcgatcggaacatccattacacaaaagggaatcattttcatattactcatgctcgttactccctcaatggctatgaggtgcgttggaattggaagtagagattttgtagaaggactatcgggagcaacttgggtggatgtcgttcttgaacacgggtcatgtgtcacaacgatggcaaaggataagcctactctcgacattgagttattaaagactgaagtcactaatcccgctgtgctacggaaactatgtatagaagctaaaatctcaaatactacaactgactcaagatgtccaacacagggtgaagctacgctagtagaagaacaagatgcaaactttgtctgccgaagaacctttgtagatcgagggtggggaaatggatgcggtttattcgggaaaggttcgctcataacttgcgctaaattcaaatgtgtcactaaactagaaggaaagatagtccagtatgaaaatctaaagtattcggtcattgttaccgtacatactggcgatcaacatcaagtcggtaacgaaagtacggagcatggtactactgctacaattactccacaagctccatcaacagaaatacaattgactgattacggagcactgacgctagactgcagtccaagaacaggtcttgattttaacgagatggttttattgacaatgaaagaaaaatcatggttagttcataagcagtggttcctagacctaccattaccctggacaagcggcgcttcaacatctcaagaaacttggaatagacaagaccttttggtaaccttcaaaactgctcatgcgaagaaacaagaggtagttgtcctagggtctcaagaaggtgcaatgcacacagctttaaccggtgcaaccgagatccaaacctcaggtactactacgatattcgccggtcatctaaaatgcagactaaagatggacaagttaaccctaaaaggaatgtcatatgtaatgtgcacagggtctttcaagctggaaaaggaggtagctgagacacaacacggaactgtcctcgtccaaattaagtatgaaggcacagatgcaccttgcaagataccgttctccactcaagacgaaaaaggcgtcacacagaatggtagacttattacagcgaatccgatagtcacggacaaagaaaaaccagtcaatatagaagcagaaccaccgtttggtgaatcatatatagtcataggcgccggggaaaaagcattaaagttatcgtggtttaagaaaggatcttccataggcaagatgttcgaagctacagctagaggagcgagaagaatggcgatcctcggtgacaccgcttgggatttcggaagcatcggaggagtatttacgagcgtaggaaaattagtacaccaaatttttggaactgcatatggcgtcctattctcaggagtatcctggacgatgaaaataggcataggagttcttcttacatggttaggccttaactcacgttcaacaagtttaagcatgacctgcattgctgtcgggctggttacattgtacctaggagtcatggtacaagctgattcaggctgtgtgatcaattggaaaggccgagaacttaaatgtgggtcaggtatatttgtaacaaacgaggttcacacctggacagaacaatacaaattccaagcggacagtccaaaaagactaagcgccgctataggtaaagcatgggaagaaggagtttgtggcataagatccgcaacccgattggagaatattatgtggaaacagatatcaaatgaactcaatcacatactacttgaaaacgacatgaaattcaccgtggtggtaggtgatgttgccggcatactagcgcagggcaagaaaatgataagaccacaaccgatggagtacaaatattcatggaaaagttgggggaaggcaaagattataggagcagatgtgcaaaatactactttcataatcgacgggcctaatacaccagaatgtcccgatgatcaaagagcatggaacatatgggaggtggaagattatgggtttgggatctttacgacgaacatatggttaaaattgagagactcgtatacacaagtatgtgatcatcgtctcatgtctgcggcaattaaagacagtaaagcagtacatgctgacatgggatattggatagaatctgagaaaaacgagacgtggaaacttgcacgtgcctcttttatagaagtaaaaacttgtatatggccaaaatcacacacactatggagcaatggcgtcttggaatcagaaatgatcatacctaaaatatatggcggtccgataagtcaacataattataggcctgggtattttactcaaactgccggtccctggcatttaggaaaactcgaacttgactttgatttatgcgagggcacaacggttgtcgtcgatgaacactgtggtaataggggtccttcattacgcacaacgacagttaccggtaaaataatacacgaatggtgttgtagaagttgcaccttaccacccctaagattcaaaggagaagacggatgttggtacggcatggaaatacgaccagttaaggaaaaagaggaaaacttagttaaatctatggtatcagcaggtagtggagaagtcgattctttttccctaggactattatgtataagcattatgatcgaagaggtcatgaggtcgaggtggtctagaaaaatgcttatgaccggtacattggcagtgtttttcttacttattatgggacagttgacctggaatgatctgataagactttgtataatggtaggcgcgaatgcttcagacagaatgggtatgggtatgacatacctagcactaatggccacctttaaaatgaggcccatgtttgcagtgggtctactctttcgcagattgacatcacgcgaggtactgttgctcacaatcgggctttcattagtggctagtgtagaactcccaaatagtttagaagagttaggagatgggctagcaatgggtataatgattcttaaactcttaacagactttcaaagtcatcagctttgggccacattgcttagcttgactttcattaagacgacattttccctgcattatgcctggaaaacgatggcgatggtccttagcattgtaagcctatttccattatgccttagtaccacgagccagaaaacgacttggctacccgtgctattagggtcattgggatgtaaaccactaactatgtttttgatcgcagaaaataaaatatggggacggaagagttggcctttaaacgaaggtatcatggctgtgggaatagtatccatattactgagcagcctcttgaaaaacgatgtcccactagcaggacctctgatagccggaggaatgctgatcgcatgctacgtaatatcaggatcaagtgcggatctatcactagagaaggcagccgaagtgagctgggaagaagaagcagaacacagtggagcttcacataacatcctagtagaagtgcaagacgacggtacaatgaagataaaggacgaagaacgggatgacacactcactatattattgaaagcgacattacttgcagtaagtggtgtctatccattgagcattcctgctacactgtttgtttggtacttttggcagaaaaagaaacaaagaagcggtgttctatgggacacaccaagtccgcctgaagtcgaaagggctgtgttagacgatggtatatacaggattatgcaacggggacttctcggaagatcacaagtgggagtgggagtgtttcaagaaaacgtatttcacactatgtggcacgttacccgaggagctgtattaatgtatcaaggcaaacgactagaaccatcatgggcaagtgtaaagaaagaccttatatcctatggtggtggctggcgtctacagggatcatggaatactggcgaagaggttcaagtaattgctgtggaaccagggaaaaaccccaaaaacgtacaaaccgctccaggaacgttcaagacttcggaaggtgaagttggcgctattgctctggatttcaaaccaggtacatcgggatctccgatagtaaatcgcgaaggcaaaatagtcggactatacggtaacggtgtcgttacaacatcaggcacttacgtatcagctattgcgcaagccaaagcctcgcaagagggtccattgccggaaatagaggatgaggtctttagaaaaagaaatctgaccataatggatttacatccaggctcgggtaagacacgccgttacctaccggcgattgttcgcgaggcaataaagagaaaattaaggacattgatattagcaccgaccagagttgttgcaagtgagatggcggaggctctcaaaggaatgcccataagatatcaaacaacagccgtaaaaagcgaacatacaggaaaggaaatcgtcgacctgatgtgccacgctacattcacgatgcgacttttatcgcccgtacgagtcccaaattataacatgatcatcatggacgaagctcactttacagatccaagcagtattgcagctcgggggtacatttccacaagagtaggaatgggtgaagcagctgctatatttatgactgcaactccacctggaagtgccgaggcgtttcctcaaagtaacgcagtcatccaagacgaagaacgtgatataccagaacgctcctggaactcaggatatgaatggatcacagattttcccgggaaaacggtctggtttgtaccaagtatcaaatcaggaaatgacattgcaaattgtttaagaaagaatggaaaaagagttatacaactgtcacgtaagacctttgacacagaataccaaaagacgaaaaataatgattgggactacgttgttacgacagacatctctgagatgggagcaaacttcagagcggatagggtgatcgatcctcgtagatgcctaaagccagtcattttgaaagacgggccagaacgagtaatcttagcgggaccaatgccagtcacagtcgctagtgccgcacaaagaagaggtcgtatcgggcggaaccataataaagagggagatcaatatatatatatgggccaacctttaaacaacgacgaagatcacgctcattggacagaggctaagatgctactggataatattaatacaccagaaggaattataccggcactattcgaacccgagagagagaaaagtgcagcgatcgacggagaatatagactacgtggagaagcaaggaaaacattcgtagaactaatgagacgcggggatctccccgtgtggttaagttataaggtagctagtgagggatttcaatacagtgacagaaggtggtgctttgatggagagaggaacaaccaagttcttgaggaaaacatggatgttgagatatggacgaaggaaggcgaaagaaagaaattacgacctaggtggctggatgcaaggacttatagtgacccactagctttaagagaatttaaagagtttgcagccggacgccgaagtgtatcaggagacttgattttagagataggaaaactacctcaacacctaacccaaagagcacaaaacgcattagacaacttagtaatgcttcataactcggaacaaggtgggagagcttacagacacgcaatggaggaattaccagacacaatcgaaactttaatgttacttgccctgattgctgtgctaacgggaggagtgacattgttctttctatcgggtaggggtctcggaaaaacaagcataggactactttgtgtaatggctagtagtgtacttctatggatggccagtgtagagccccattggattgcagcatcaattatattagagttctttctaatggttcttttgataccagaacctgaccgacaacgaacaccccaagataatcaattagcgtacgtggtcatcggactactcttcatgatcttaaccgttgcagcgaatgaaatgggccttctagaaactacgaagaaagacttaggaattggccacgtagcagtcgaaaaccatcatcatgccgcgatgttagacgttgatctccatcctgcaagcgcatggacattatacgctgtagcaacaacaattattactccaatgatgaggcatacaatagagaatacgacagccaacattagcctaacggcaattgccaaccaagcagccatcttgatgggactagataaggggtggcctatatcaaaaatggacataggagtgcctttactggctttaggatgctatagtcaggtgaatcccttaaccttaacagcagctgtgctaatgcttgttgctcattatgccataataggtcctggattacaagcgaaagctactcgtgaagcccaaaaacgaacggcagctggcataatgaaaaatcccacggtagatggaattgtcgcgatagatttagacccagtcgtgtacgacgcaaaatttgaaaaacagttaggacaaattatgttattaatcttgtgcacttcacaaatcctcttgatgagaacaacctgggccctatgtgagtcaataacactggccacgggtcctttaacaaccttatgggaaggtagtcctggtaaattttggaacacaacaattgctgtgtcgatggcaaatatatttagaggtagctacctggctggagcgggtttagcgttcagcttaatgaagtcactgggtggcggccgacgcggaactggtgcacaaggtgagacattaggggaaaaatggaagaggcaattaaatcaattgtcaaaatcggagtttaatacatataagcgatcaggcataatggaagtcgacaggagcgaagctaaggagggtctaaaaagaggggaaacaacaaaacacgcagtgagtcgaggaaccgcgaagctacgttggtttgtagagcgaaacctcgtgaagcctgaggggaaagttatagacctaggctgcggcagaggtggatggtcttattactgtgcaggtcttaaaaaggtaacagaagtaaaaggttatactaagggcggaccaggtcatgaggaacccatcccaatggcaacctacggatggaacttagtcaaattacactcaggcaaagatgtattctttgtacctccagagaaatgtgatacgctactttgtgatataggtgaaagtagtcctaaccctacgatagaagaaggaaggacactgagagtccttaaaatggtagaaccttggttaaggggaaaccaattttgtattaaaattctcaacccatacatgccttcagtagttgagacacttgagcaaatgcaaagaaaacacggaggtatgctagtcagaaacccattaagtcgaaatagcacacacgagatgtattgggttagttgcggcacaggaaacattgtcagtgcagtaaatatgacatcaagaatgctattaaatagatttactatggctcatagaaaaccaacatacgaacgcgacgtagacctaggcgccgggactcgacatgtggccgtagaaccagaggttgccaacctggatataattggccagcgaatcgaaaacataaagcatgaacataagagtacatggcactatgacgaagacaacccttacaagacttgggcgtatcatgggtcctatgaggtaaagccatcaggaagtgcaagtagcatggttaacggagtagtaaaacttttaacaaaaccttgggatgtaataccgatggtaacacagattgcgatgacggacaccacaccattcgggcaacaacgagtttttaaggaaaaggttgatactcgtacaccgaaagctaaacgtggcactgcgcaaattatggaagtaaccgccaaatggttatggggtttcctgtcacggaacaagaaacccagaatttgtaccagggaagagttcactagaaaagtacgttccaacgcagctattggggcagttttcgttgatgaaaatcaatggaactcggcaaaagaagccgtagaagatgaacgattctgggacctcgtccaccgcgaacgtgaacttcacaaacaagggaaatgtgctacatgtgtttacaatatgatgggaaaaagggagaagaaattaggggaatttggaaaagcaaagggctctagagcgatttggtatatgtggttaggagcgagatttctggaatttgaggccttaggttttatgaacgaagaccactggttctcgcgagagaacagcctatcaggagttgaaggagaaggtttacataaactcggatacatcttacgagatatatccaaaatatcaggaggcaacatgtatgctgacgacactgcagggtgggatacaaggataacggaagatgatctacaaaacgaagccaagattaccgacataatggagcctgaacatgcattattagcgaagtctatatttaaattaacataccaaaataaggtagtaagggtacaaagaccggcgaaaaacggaacggtaatggacgttatatcgagaagagatcaacgcggaagcggacaagtcggaacatatggactaaatacattcacaaatatggaagcgcagctaataagacaaatggaatctgaaggtatttttagtccgagtgaattagaaaccccaaatctagcagaaagagcattagattggcttgaaaaacatggtgtagaaagattaaaaagaatggctattagtggcgatgattgtgttgtgaagccaatagacgatcgattcgcgacggcgttaaccgcattgaatgatatgggaaaagtgagaaaggacattccccagtgggaacccagtaaagggtggaacgattggcaacaagtaccgttctgttcccatcattttcaccaattaataatgaaagatgggcgtgaaatagtagtcccatgtcggaatcaagatgaacttgtaggtagggcgcgagtctcacaaggcgcaggttggtccttaaaagaaactgcatgtctgggtaagtcctatgctcagatgtggcaattaatgtacttccaccgacgcgatttacggctagctgctaatgcaatatgttcagcagtaccggtagattgggttccaacaagtcgcacaacgtggtcgatacacgcacatcatcaatggatgacaactgaagacatgctatcagtatggaatcgcgtatggatagaagaaaatccctggatggaagataaaactcacatttcctcgtgggaagacgtgccatatcttgggaagagagaagatcaatggtgtggaagtttaataggactaacagcacgagcgacctgggcaactaatatacaagtagctataaatcaagttagacgacttattggcaacgaaaactacttagactatatgacaagtatgaaaagattcaagaacgaaagcgatccagaaggtgctttgtggtaa

SEQ ID NO: 21200 - RNA, 9879 nt, synthetic construct
  misc_feature 1..9879: note = derived and/or modified CDS sequence (opt6) from DENV-1__FJ639688__SS-prME
  source 1..9879: mol_type = other RNA
tcagtgactatgttactgatgttaatgccaacggcattagcatttcacttaacaactcgaggtggggaacctcatatgattgtatccaaacaagaacgcggtaagagcttgctctttaaaacttccgctggggtaaatatgtgtaccctcattgctatggatttgggagagctctgcgaggacacaatgacatacaaatgccctagaataacggaagcagaaccagacgacgtcgactgttggtgcaacgcaacagacacttgggtaacttatggaacatgttcacaaacgggggagcatagaagagataaaagaagcgtggcactagccccacatgtaggattagggttggagactcgaacggagacttggatgtcaagtgaaggcgcgtggaaacagatacaaagagttgaaacgtgggccttaagacatccaggcttcaccgtgatagcattattcctagcacatgctataggaacatcgatcactcagaaaggcataatctttatccttctaatgttagttactccttcaatggcaatgcggtgcgtagggattgggtcaagagattttgttgaaggactgtcaggcgcaacatgggtagatgttgtactagaacatggctcttgcgtgacaaccatggcaaaagataaaccaactcttgatatagaattattaaaaacagaagtcacaaaccctgcagtactccgcaaattatgcattgaagcgaaaatatccaacactacaactgacagtagatgtcctacacaaggagaggcaacacttgtagaagaacaagatgctaacttcgtatgccgaagaaccttcgtagatcgaggttggggtaatggttgtggtttatttggaaaaggatcattaattacttgcgctaaatttaaatgtgttaccaaattagagggaaaaatagttcagtacgagaatttaaaatactctgtaatcgtcaccgttcatacaggggatcaacatcaagttgggaatgaatcaacagaacatggaaccaccgcaactattacaccacaggccccaaccacagagatccaattaacagattatggggcactaactttggactgcagtccacggaccggcttagacttcaatgaaatggtactgttgaccatgaaagaaaaatcctggttggtgcataaacaatggtttctcgacttaccattaccctggacaagtggcgcttcaacatcgcaagagacatggaaccgacaagatttattagtcacatttaagacagctcatgccaagaaacaagaggtggtagtcctaggatcacaagaaggggcaatgcacactgcccttactggagcaacggaaattcaaacttctggaacgacgacgattttcgccggacatctaaaatgtcgtctcaaaatggacaaattaactttaaaaggaatgtcatacgtaatgtgtaccggtagctttaaactcgagaaggaagtcgcagagacacaacacggtacggtcttagttcaaataaaatacgaaggcacagacgcaccctgtaaaattccatttagcacccaagatgaaaaaggagtaacacaaaacggtagattaataacggctaatcccatagtaactgacaaagaaaaaccggtgaatattgaagcagaacccccatttggcgaatcatatattgttataggagcaggagagaaagcattaaaacttagttggttcaagaaagggtcaagcatcgggaaaatgttcgaagctactgctcgtggtgcaagaagaatggctattttaggagatacagcatgggactttggttcaataggaggggtatttacttcagtaggaaaattagtacatcaaatttttggaaccgcgtatggagtgctattttcaggagtgtcttggacaatgaaaatcggcatcggagtcttgctaacgtggcttggtctaaactctcgatcaaccagtctgagtatgacgtgcattgcagtgggattagtaacactatatctaggagtaatggttcaagccgactcaggttgtgtaattaattggaaaggaagggaattaaaatgtgggtcaggaattttcgtaactaatgaagttcacacatggactgaacaatataagtttcaagccgattcacctaaaagactcagtgccgcaatcgggaaggcgtgggaagaaggtgtgtgtggcatacgctcagcaacccgacttgaaaatataatgtggaaacaaatttcaaacgagctgaatcatatcttattagaaaatgacatgaaatttacagttgtagtaggtgatgttgcaggcatattggcacaaggcaagaaaatgatacgccctcaaccaatggagtacaaatattcgtggaaaagctgggggaaggccaagataataggagccgacgtacaaaataccacattcataatagatggacccaatactccagaatgtcctgacgaccagagagcctggaacgtttgggaagtcgaagattatggatttggaatattcaccactaacatttggctaaagttaagagattcttacacacaagtatgcgaccatcgtttaatgagcgcggctattaaagattcaaaagcagtccacgcggacatgggatattggattgaatctgagaaaaacgagacatggaagctcgccagagctagctttatagaagtcaaaacatgcatttggcccaagagccatacactatggtcaaacggagtactcgaatctgaaatgatcatacccaaaatatacggtggacctattagtcaacataattatagacccggttattttacgcagacagctggcccctggcatttaggtaaacttgaactagactttgatttatgtgaaggtactacagtagtcgtcgatgaacactgtgggaaccgcggaccgagcctccgaacaacaaccgtaaccggcaagataatacatgagtggtgttgtaggtcctgtaccttgcctccattgcgttttcggggtgaagatgggtgctggtatggtatggaaatcaggccagtaaaggagaaagaggagaacctagttaaatccatggtatcagcgggttcaggtgaggtagattcgttttcactcggtttgttatgcatcagcatcatgatagaagaagtcatgagaagccgatggagcagaaaaatgcttatgaccggtaccctggctgtatttttcctactcataatggggcagttaacatggaatgatctgataagactgtgtataatggtaggagcaaatgcatcagaccgtatgggcatgggaactacctacctggcactaatggcaacgtttaaaatgcgacctatgtttgcagtaggactacttttcaggagactaacatctcgtgaggtcttgttactaactattggattaagcctagttgcgtcggtagaactgcctaccagtctcgaagagttaggggatggactcgccatgggtataatgatactgaagctcctcacggactttcaatcgcaccagttatgggctacactgttatcattaacatttatcaaaactactttctcattacattatgcatggaaaaccatggcaatggtcttgtcaattgtctctttattgcctttgtgtctcagtactaccagccagaaaaccacctggctaccggtgcttctgggcagcttaggatgtaagccgttgacaatgttcttaatcgcagagaataaaatatgggggagaagatcttggcctttaaatgagggaataatggcggtaggaattgtttcaattctattaagctccctgcttaaaaatgacgttcccttggccggtcccctgatagcgggtgggatgcttatcgcatgttatgtgattagcggaagctcagcagatctctcattggaaaaagcagcagaagtctcctgggaagaagaagcagaacattcaggagcatcacataacatcctagtagaagtccaggacgatgggacgatgaaaatcaaagacgaagaacgggatgacaccttaactatattgttgaaagccactttattagccgtttcaggagtttatcccttatcgatacccgcaactttatttgtatggtatttctggcagaagaagaaacaacgttcaggagtactttgggatacaccaagtccgcctgaggtagagagagcagttctagacgatggcatatatagaataatgcaaagaggactcctaggccgctctcaagtcggtgttggagtgttccaagagaatgtatttcatacaatgtggcacgttacgagaggcgcagttttaatgtaccaaggaaaacgacttgaacctagctgggctagtgtgaagaaagatttaatctcgtatggaggaggctggcgactgcagggatcatggaacactggagaggaggtacaagtaatagcagtagaaccaggcaaaaatcccaaaaatgtacaaaccgcacctggtacatttaagactcctgagggggaagtaggggcgatagcattagattttaaaccgggaacttcgggatctcccatcgttaatagagagggtaaaatagttggactctatggaaacggcgtagtaacgacctccgggacctacgttagcgctatagcacaggcaaaagccagtcaagaaggtccgctcccagaaatcgaagacgaggtttttagaaaacgaaaccttactattatggatctccatcccggaagtggcaagacaagacgttacttacctgcaatagtgagagaggctattaaaagaaaattaagaacattaattctagcaccaaccagggttgtcgccagcgaaatggcggaggcactcaaggggatgccgataagataccagacaactgcagtaaaaagtgaacatacaggaaaagaaatagtggatcttatgtgccatgcgacattcaccatgagattattatctcccgtacgcgtaccaaattataacatgataatcatggatgaggctcatttcacagatccatcatctatcgctgcaaggggatacatttcaacaagagtgggaatgggagaagcggccgcaatttttatgacagcaacgccgcctggtagtgtagaggcttttcctcaatcaaatgctgtgatacaggacgaagagagagacataccagagcgatcctggaatagcggttatgagtggataactgatttcccaggaaagacagtttggttcgtaccttccattaagtcgggtaatgatatcgcaaactgcttacgtaagaatgggaaaagggttatacaactctcacgtaaaacatttgatacagaataccagaaaactaagaataatgattgggactacgttgttactacagatatatcggaaatgggagccaattttagagcagatcgggtaattgaccctaggcgatgtttaaaaccagtgatactaaaagatgggcctgaacgggtgatattagcaggaccaatgcccgtaacggttgcaagtgcagctcaaagaagaggaagaataggtagaaatcataacaaagagggagatcaatacatatatatgggacaaccgctcaacaacgacgaagatcacgcacattggactgaagcgaaaatgctactggataacattaacactcctgagggaataatacctgctttgtttgaaccggagagagaaaaatcagcggcaattgacggagaataccgcctacggggtgaagcaagaaaaacgttcgtggaactaatgagaagaggagatttaccagtgtggttgtcgtataaagtagcctctgaaggatttcaatattccgataggcgatggtgttttgatggcgaaagaaataatcaagtcctagaggaaaatatggatgtagagatatggacgaaagaaggtgaaaggaagaaacttaggccaagatggttagatgcgcgcacgtatagtgatccgctagcactccgggagtttaaagaatttgcagccggtagacgcagcgtgagtggagacttaattctagaaattgggaaacttcctcaacacttaactcaacgagcacaaaacgcacttgataatttggtcatgttacataatagtgaacaagggggacgcgcttaccgacacgcaatggaggaacttcccgacacgattgaaactcttatgctactcgcactgatagctgttctaacagggggagtaacactcttctttctttcggggagaggcctaggtaagacttccataggtttgttgtgtgtgatggcctcttctgtattattatggatggctagtgttgaaccacactggatcgccgcatccattatactcgaatttttccttatggtactattaataccggaacctgatagacagcgtacaccccaagacaatcaattggcctatgtggtaataggacttctgtttatgatactgacagtagctgcaaacgaaatgggcttactggagaccacaaagaaggatctgggaataggacatgtagccgccgaaaatcatcaccacgctgcaatgttggatgtagatcttcacccagcttctgcttggactttatatgcagttgcaactactataataactcctatgatgagacacacgatagaaaatacaacagcaaatatatctttaactgctattgcgaatcaagcggcaatacttatgggcctggataaaggatggccgatttccaaaatggatattggggttccattattagcattgggatgttatagtcaagtaaatcccttgactttaaccgctgccgtgttgatgctcgtcgctcattatgctataatcggccctgggctccaagctaaagccacaagagaggcgcaaaaacgtactgctgccgggataatgaaaaacccaaccgtcgacggcattgttgctatagatctagacccagtagtatacgacgcaaagtttgaaaagcaacttgggcaaattatgcttttgatactgtgcacaagtcaaatcttactaatgcgaacaacttgggcgctatgtgaaagcattacgcttgcaacaggtccacttacgacactctgggaaggaagtcccggcaagttttggaacactactatcgccgtctccatggcgaatatttttcggggttcttacttagccggagccggattagctttttccttgatgaaatcattaggaggaggacgaagaggcaccggtgctcaaggagagactttaggcgaaaaatggaaaaggcaactcaaccaactaagcaagtccgaatttaatacctataaacgttcaggcataatggaagtcgatagaagtgaagcaaaagagggtcttaaacgtggtgaaacgactaagcatgcagtcagcagaggaacggcgaaactgaggtggtttgtagaacgaaatctagtaaaacccgaaggaaaagtcattgatctaggatgcggtagaggaggatggagttactattgcgctggattgaaaaaggtaacggaagtaaaaggatatacaaaaggtggaccgggacatgaagaaccaattcccatggctacatatgggtggaatctagttaaactccactcaggaaaggatgtgtttttcataccacctgagaagtgcgacactttattatgcgatattggagaatcatccccaaatcccaccattgaggaaggaagaacacttagggtattgaagatggtcgaaccgtggcttcgcgggaatcagttctgtattaagattcttaacccctatatgccttcagtagtagagacacttgaacaaatgcaacgtaagcatgggggtatgttagtcagaaatccattgagtcgaaattctactcacgaaatgtattgggtatcgtgcggtaccggcaatatagtcagtgcagtcaatatgacctcaagaatgcttctaaatagattcacgatggcacacagaaaacccacctatgaacgcgacgtagatttaggtgctggaacacggcatgttgccgtagagccagaagtggcaaacctagatataattgggcagcgaatcgaaaatatcaaacatgagcataaatcaacatggcattatgatgaagacaacccttataaaacatgggcttaccatggaagttatgaagttaaaccaagtggatcggcaagcagtatggtaaatggagtcgtgaaactactgactaaaccttgggatgttattcctatggtcacacaaatggcaatgacagatacgacgccatttgggcagcaaagggtctttaaagaaaaggtagatactcgtacccccaaggctaaacgtggcaccgcacaaataatggaagtcacagcaaaatggctctggggcttcttgtccagaaacaaaaagcctagaatatgtacgagagaagaatttacgcgtaaagtaagatcaaatgcggctataggtgctgtctttgtagacgaaaaccaatggaactctgctaaagaagcagtagaggatgaacgattctgggacctagtccaccgggaaagggaattacacaaacaggggaaatgcgctacatgtgtgtataatatgatgggaaaacgagagaagaaactgggagaatttggaaaggcgaaaggttctcgggcaatttggtacatgtggttaggcgcaaggtttcttgagttcgaagccctcggatttatgaacgaggatcactggtttagtagagaaaattctttatctggtgttgaaggagaaggattacataagctagggtatatactgcgcgatataagcaaaatcccaggtggaaatatgtatgctgatgatacagcaggatgggataccaggattactgaagacgacctacaaaatgaggccaggataacagatataatggagccagaacatgctctcctagcaaaatcaatcttcaagctaacataccaaaacaaagtagtgagagtccaaaggccagccaaaaacgggaccgtaatggatgtaatatctcggagagaccagcggggctcaggacaagttggtacttatggattgaacacattcacaaacatggaggcacaattaattcgtcaaatggagtctgaaggaatcttttcaccctcagagctagaaacgcccaatttggccgaacgtgtactggattggctagaaaaatacggtgtcgaacgacttaaaaggatggccatatctggtgatgattgcgtagttaagccgatcgacgatagattcgctaccgctctgacggccttaaacgacatgggtaaagttcgcaaagatataccccaatgggaacctagcaaaggatggaacgattggcaacaagtaccgttctgtagccatcactttcaccaattaattatgaaagacggaagagaaatagtagtaccttgccgcaatcaagatgaactggtgggccgcgctagggtttcacaaggggctggatggtcactccgggaaactgcttgtctcgggaaatcatatgctcaaatgtggcagctcatgtattttcaccgccgggatttaagattagctgctaatgcaatctgttctgcagtgccagtcgactggatcccaacaagtcgtacgacttggtcgattcatgcacatcaccaatggatgactacagaggatatgttaagtgtatggaatagggtatggatcgaggaaaacccatggatggaagataaaacccacatatcttcatggggcgacgtaccataccttggtaaaagagaagaccaatggtgcgggagtctaatcggcttaacagcacgtgccacttgggcgacaaatatacaagttgccatataccaagtccgtcgactgattggcaatgagaattatctcgattatatgacaagtatgaaacgttttaaaaacgaaagtgacccggagggggccttgtggtag

SEQ ID NO: 21201 - RNA, 9879 nt, synthetic construct
  misc_feature 1..9879: note = derived and/or modified CDS sequence (opt6) from DENV-1__FJ639689__SS-prME
  source 1..9879: mol_type = other RNA
tcagtcacaatgctactaatgttaatgccaacagcattagcattccatttaacaattaggggaggggaacctcatatgatagtaagcaaacaagaaagaggaaaatctctgcttttcaaaacgagcgctggggtgaatatgtgcacactaatcgcaatggatttgggagaactgtgtgaagacacgatgacttataaatgtccgaggattacggaagcagaacccgacgacgtggattgttggtgtaatgctacggatacttgggttacatacggaacatgctctcaaactggtgaacatagaagagataaaagaagtgttgccctagcacctcatgtgggtttagggcttgaaacacgaactgaaacttggatgagctctgaaggagcatggaaacaaattcaaagggtagaaacttgggccttacgacaccccggattcaccgttatagctctttttcttgcccatgctataggcacttcaatcacacaaaaaggaataatttttatcctgttaatgcttgtaacaccatctatggcgatgagatgtgtgggaattgggtcaagggactttgtagagggcctttctggagcgacctgggttgacgtagtcttagaacatggatcgtgcgtaacgacaatggccaaagacaaaccgactttagacatagaacttttgaaaacggaggttactaatccagcgattctaagaaaactatgcatagaagccaaaatttctaacacaactaccgattccaggtgtccaacgcagggcgaagctaccctagtagaagaacaggatgccaacttcgtgtgtcggcgcacttttgtagacagaggatggggtaatggatgtggcttgtttggcaaaggatccctgatcacgtgcgccaaattcaaatgtgttaccaaactggaagggaaaattgtacaatacgagaacctcaaatatagtgtgatagttactgtccatacaggcgaccaacatcaagttggaaatgaatcgacggaacacggcacaacggcaactatcaccccacaagcaccaacgactgaaatacaactcacagattacggagcattaaccctagactgcagccccagaacaggacttgactttaatgaaatggtactactaacaatgaaagaaaaatcttggttagtgcataaacaatggtttctagaccttcctcttccttggacctcaggagcaagcacgtcccaagagacatggaaccgacaagacctcctcgttacattcaaaactgcacatgccaagaaacaagaggttgttgtattaggatcgcaagaaggtgctatgcatactgcactaacaggggcgacagaaattcaaacctcgggaacgactacaatatttgcaggccacctaaaatgtagattaaaaatggacaaattgacacttaaaggaatgagttatgtgatgtgtactggatcgtttaaactcgagaaagaagttgcagaaactcaacacggtactgtcttagtacaaatcaagtacgagggcaccgacgcaccctgcaaaatacctttctcaactcaagatgagaagggtgtcacacaaaacggaagactgatcactgccaacccaatagtgacagacaaagagaagcccgtaaatattgaagcagagccaccattcggggagtcttacatcgtaatcggagcaggcgagaaggccttgaaattatcctggttcaagaaaggctctagtataggaaaaatgttcgaggctacagctcgtggagctaggaggatggcaatattaggggatacagcgtgggactttgggtcaataggaggagtatttactagcgttggaaaacttgtccatcaaatattcggaaccgcgtatggggtacttttcagtggagtatcctggacgatgaaaataggtataggagttttgctaacgtggctaggattgaatagtcgttctacatcgttcagtatgacatgcattgccgttggcttggttacgctctacttaggagttatggtacaagctgattctggctgtgtgataaactggaaaggacgggaacttaaatgtgggtcagggatttttgttactaatgaagtgcacacatggacagaacaatataagttccaggctgactccccaaagcgtttatcagccgcaataggcaaggcttgggaagaaggtgtgtgcggaatacgtagcgccacacgcctagaaaatatcatgtggaaacaaatctccaatgaattgaaccacattcttttagagaacgatatgaaatttacagtcgtagtcggagatgtggcaggaatactagcacaagggaagaaaatgatacgtcctcagcctatggaatataaatattcttggaggagttggggtaaagccaaaataattggagccgacgtacagaatacaaccttcatcatagacgggccaaatacaccagaatgcccagatgatcaacgagcgtggaatatttgggaagttgaagattatggattcggaatatttacaacgaatatatggctaaaactaagagatagttacacacaagtatgcgatcatcgactaatgagcgccgcgatcaaagacagcaaggccgtacatgcagatatgggatattggatcgagagtgagaaaaatgaaacatggaaattagctcgggcttcttttatagaagtaaagacttgtgtatggcccaagtcccacacgttatggtcaaatggagttttagagtcagaaatgatcatacctaaaatttatggaggccctatatcacagcacaattatagacctggatacttcacacagaccgctggtccgtggcatttaggcaaattggagttggattttgatttatgtgaagggacaactgtggtggtcgatgaacactgcggaaatagaggaccctccttaagaactactacagtcacaggaaagatcatccacgaatggtgttgcaggtcatgtaccttaccaccccttcgttttcgtggagaagacgggtgttggtacggaatggaaatacgaccagttaaagaaaaggaggaaaacctcgtaaagtcaatggttagcgcaggaagcggagaagtagatagtttctcacttggtcttctatgtatcagcataatgacagaagaggtaatgcggtccagatggtctcgtaagatgctcatgacgggtacactcgcggtattcttattattgataatgggacaacttacttggaatgaccttattcgactctgtattatggtcggggctaacgcttcagataggatgggaatgggtacaacttacctggctcttatggcaacattcaaaatgaggccaatgttcgccgttggattattatttagacgactaaccagtcgcgaagttttactcctaacagtgggactaagtttagtagcgagtgtggaattacccaattccctggaggaactaggtgacggcttggctatgggaataatgatattaaaattactaacagatttccaacctcatcaactatgggcaaccctcttaagtttaaccttcattaaaaccacatttagcttacattatgcatggaaaacaatggccatggtgttaagtatagtatcactctttccattatgccttagtacaacttcacagaaaactacctggttgccggtcttattaggcagcttggggtgtaaaccactaaccatgttccttatcgcagaaaacaaaatatggggaagaaggagttggccacttaatgaaggaataatggcagtaggtatagtaagcatattactgagttcattacttaaaaatgacgtacctttagctggcccactcatagccggagtgatgctcatcgcatgctacgtaatttctgggagttcagcagatttatcacttgagaaggcagctgaagtctcttgggaagaggaagccgaacatagcggagcaagtcacaacatcttagtagaggttcaagatgatggtacaatgaagataaaagatgaagaacgtgatgatacgctcaccattttgctcaaggcaacattgcttgctgtgtctggagtttatccactttcaataccggcaacattatttgtttggtacttctggcagaagaagaaacaacgatcaggggtactctgggatacgccttcacccccagaagtagagcgagcagtcttagatgatggaatctaccgtataatgcaacggggactattaggaagaagccaagtaggagtaggagtattccaagaaaatgtgttccacactatgtggcacgtaactcgtggtgcagtgttaatgtatcaaggaaaacgacttgagccgtcatgggcttcggttaagaaagatctaataagttatgggggaggctggagattgcagggatcttggaacacaggggaagaggtacaggtaattgcagtggaacctggcaagaaccccaaaaatgtccaaactgctccaggaacgttcaaaactcctgaaggagaagtcggagctatagcgctagattttaaacccggaacgagtggttcaccaatcgtaaacagagaaggaaaaatagtaggcttgtacggtaatggtgtggttactacatcaggcacttatgtttcagccatagcacaggcaaaggcttcgcaagaaggtccgctccctgaaatcgaagacgaggtattcaggaagcgcaatcttactataatggatctgcatcccggaagtggaaaaacccggcggtatctgccagcaattgtaagagaagctattaaacgaaaactccgaaccttaattttagccccaactagggtcgtagcctccgagatggcagaagcattaaagggcatgccaatccggtatcaaacaactgcagtcaagtccgaacacaccggtaaggagatagttgatctaatgtgtcacgcaacgtttacaatgagattactttcaccagtaagagttcctaattataatatgattatcatggatgaagcacacttcacagatccatcaagtatcgcggcacgaggttacatatcgacacgagtaggaatgggggaagcagccgcgattttcatgacagccacgccgccaggctcggtagaggcatttcctcagagcaacgcagttatacaagacgaggaacgagatataccggaacgcagttggaatagcggttacgagtggattaccgactttccaggaaaaaccgtctggtttgtcccaagcataaagagtgggaatgatatagctaattgcttacgtaagaatggaaagcgtgtcatacaattgtctcggaaaacgtttgatacagaataccagaaaactaaaaataacgattgggattatgtagttacaacggatatcagtgaaatgggtgctaactttcgagccgatcgcgtaatcgatccacgaagatgcctaaaaccagttatattaaaagatggacccgaaagagttatattagcaggccctatgccggtcactgtagcctcagcggcacagcgtagagggagaataggccgaaatcataataaagaaggagatcaatatatctacatgggtcaaccattaaataatgacgaagatcacgcacattggacagaagctaaaatgttgttagataatataaataccccagaaggcatcattcctgcactatttgaacccgaacgggaaaagtcagcggctatagatggcgaatatcggttaagaggagaagctagaaaaacattcgtagaactaatgaggagaggagatttgcctgtatggctgtcatataaagtggcaagcgaaggatttcaatacagcgaccgtaggtggtgttttgacggcgaaagaaataatcaagtattagaagaaaatatggatgtagaaatatggacaaaagaaggagaacgtaagaaacttaggccgcgatggttggatgcacgcacatacagcgacccactagctctcagagaatttaaagagttcgctgcaggtagacgttcggtatctggtgatctaattctagagattggaaaattacctcagcatctaactcagcgagcacaaaacgcactcgataacctagttatgttacataactctgaacaagggggacgagcatatcggcacgctatggaagaattgcccgacactatagagaccctcatgttgctcgcacttatcgctgttctaactggtggcgtaacattgttctttctatctgggcggggcttggggaaaacaagtatagggctgctttgtgttatggcatcttcagtattactttggatggcttcggtcgaacctcattggatagctgcgagcataatacttgagttcttcttaatggtactcctaattccagagccagatagacaaagaactccacaagacaaccagttggcatatgttgttatcggattattatttatgatactaactgtcgcagccaacgaaatgggtctgctagaaacaaccaagaaagacttaggcattggacatgtggcggttggaaaccaccatcacgcggcgatgttagacgttgatctacatccagcgtctgcgtggacgctttatgcggttgcaacaacaataataactcctatgatgagacacactatagaaaatactacagctaatatttcactgactgctattgcgaatcaagcggctatactaatggggttagataagggatggccgattagtaaaatggatataggagttccattgttggcactcggttgctattcacaagttaatccgttaactctaacggctgctgtactaatgttggttgctcactatgccataataggtcctggactccaagcaaaggctaccagagaagctcaaaaacgcactgccgcaggaataatgaaaaacccgactgtagacggtatcgtagccatcgacctagacccggtcgtatatgacgcaaaatttgagaaacagttaggtcaaataatgttgttaatattgtgtacctctcaaatccttttaatgagaactacttgggcactatgtgaatcgataacactcgccacgggcccattaacaacgttgtgggaaggttctcctgggaaattttggaatacaacgatagcagtatcaatggcaaacatatttagagggtcctatctagcaggggcaggattagctttctctttaatgaaatcactgggaggaggtagaagggggactggggctcaaggtgaaacgttaggtgagaaatggaagagacaattaaaccagttgagtaaaagtgagttcaatacatataaaaggagcggcattatggaagttgaccggtcggaggcaaaggaagggctaaaaagaggagaaataacgaagcatgccgttagccggggaactgcaaaattaagatggtttgttgaaaggaatttggtaaaaccagaaggaaaagtcattgacttaggatgcggaaggggtggatggtcctactactgtgctgggctcaagaaagtcacggaggtcaaagggtatacaaaaggtgggccaggacacgaagaaccgatccctatggcaacatatgggtggaacttagtaaagctccattctggcaaagatgtgttctttgtgccgcctgaaaaatgtgacacgttgttatgtgatataggtgaatcaagtcccaatcccactatagaggaaggtcgtacattaagagttttgaagatggttgaaccatggttaaggggcaatcaattctgtataaaaatactcaacccgtacatgccaagtgtcgtggaaacgttagaacaaatgcaaaggaaacacgggggcatgttagttcgaaatccgctgtcccgcaattcaacgcatgaaatgtactgggtgtcttgcggaacaggaaatatagtaagcgctgttaatatgacttcacgtatgttactaaatcgttttacaatggcacatcgaaaacctacttatgagcgtgatgtcgacttaggggccggaacgagacacgtagcggtcgaaccagaggtagcaaacttggacatcatagggcaacggatcgaaaacattaaacatgaacataaatcaacgtggcattatgatgaggacaatccatataaaacttgggcataccacgggtcttatgaagtaaaaccctcaggatctgcatcaagtatggttaatggggtagtgaaattactgacaaaaccatgggatgtcatacccatggtgacacagattgcaatgacggatacgactccttttggccagcaaagggtcttcaaggagaaagtggacacacgcacacccaaagcaaaacgcggaacggcccaaataatggaggttacggctaaatggttatggggattcttgagcagaaataagaaacctcgcatttgtacacgggaagagttcaccagaaaagtacgatcaaatgcagctattggggcagtattcgtagacgaaaatcaatggaacagcgccaaagaggccgtagaggacgagagattttgggacctcgtacatagagaaagagaattgcataaacaaggtaaatgtgccacatgtgtctacaatatgatgggaaagagagagaagaaattgggagagttcggaaaagcaaaaggcagcagagcaatatggtatatgtggctaggcgcaagatttttagaatttgaagccttaggatttatgaacgaagaccactggttctcgcgggaaaactcactatctggagtcgaaggtgagggtcttcacaaactagggtatatcttaagagatataagtaaaatcccaggagggaatatgtatgccgacgacactgcgggatgggacactcgaataacggaagacgaccttcaaaatgaggcgaggattacagacataatggaacctgaacatgcgctattggctaaatcgatatttaaactaacatatcaaaataaagtagtcagggtccaaagacccgctaaaaatggcactgtcatggacgtaatttcgagacgggatcagcgaggatcaggtcaagtaggaacatatggattgaacacgtttacgaatatggaagcccagttaattaggcagatggaatcagaaggcatttttagccctagtgaactagaaacaccaaatcttgcagaaagagtactggactggttggaaaagtatggcgttgaaaggttaaagcgaatggcaatttctggagatgactgcgtagtaaagcccattgacgacaggttcgcaacagctctcacagctcttaatgatatgggtaaagtccgtaaagatataccacaatgggaaccatcaaaaggatggaacgattggcagcaggtccccttttgcagtcaccattttcatcaattaataatgaaagacgggagagagattgttgtcccctgcagaaaccaagatgagctagtaggcagagcacgcgtttcacaaggggccgggtggagtctcagagaaaccgcatgcctaggaaagtcctatgcacaaatgtggcaattaatgtattttcacagaagagacctaaggctagcggccaacgcgatatgcagtgccgtccctgtagattggattcctacatctaggactacctggtctatacacgcacatcaccaatggatgacaacagaagatatgttaagtgtttggaatcgagtgtggatagaggagaatccatggatggaggataaaacgcatatttcttcttggggtgacgtcccatatcttggtaagagggaggatcaatggtgcggttctctcattggactcacagcacgagccacctgggcgacgaatatccaagtcgctattaaccaagtaagaaggttaattggaaacgagaattacttagactacatgacaagcatgaagaggtttaaaaacgaaagtgatcctgaaggggctttgtggtag

SEQ ID NO: 21202 - RNA, 9879 nt, synthetic construct
  misc_feature 1..9879: note = derived and/or modified CDS sequence (opt6) from DENV-1__FJ639690__SS-prME
  source 1..9879: mol_type = other RNA
tcagttacaatgttattaatgcttatgcccacagctttagcatttcatttgacaattagaggaggggaaccgcacatgatagtttcaaaacaggaaagaggaaaatcacttttatttaaaacgagtgctggagtaaatatgtgcacgttaatagcaatggatctaggtgaattatgtgaagacacaatgacatataaatgccccagaataacagaagctgaacctgacgatgtcgattgttggtgtaacgcaacagacacttgggttacctatggtacatgttcccagataggagaacaccgccgtgataaacgttcggtcgccctagctccccatgtgggactaggattagaaacgagaacagaaacatggatgtcctcggaaggcgcttggaaacaaatacaacgtgtggaaacttgggcactaaggcaccctggatttacagttatcgcactatttttagcacatgcaataggtacttctataacccaaaaaggtatcatatttatcttactaatgttagtaacaccgtcaatggcgatgagatgtgtggggataggaagtcgcgattttgttgaaggattaagtggtgctacttgggttgatgttgttttagaacatggaagctgtgttaccactatggccaaagacaaacccacattagacattgaattattgaaaactgaagtaaccaatccagccatactaagaaaactctgtattgaagctaaaatttcaaatactactacagacagcagatgtcctactcagggagaagcaaccttagtagaagaacaagacgctaattttgtctgcagacgcacttttgtggatcgtggctggggaaacggatgtggactttttggaaaagggagtctaattacttgtgccaaatttaaatgtgtcacgaaattagaagggaaaatagttcaatacgaaaacttaaaatactccgtaattgtaacggtccacaccggggaccaacatcaagttggaaatgaaagcacagaacatgggactacagcgactatcaccccacaagccccaactacagaaatacaactaactgattatggtgcattaacactagattgctccccgaggactggccttgatttcaacgaaatggtgttattaactatgaaagaaaaatcgtggctggtccataaacaatggtttttggacctacccttaccgtggacaagcggggcaagtacttcccaagaaacctggaacaggcaagatctcttagtaacatttaaaacggcacacgccaagaaacaggaggttgtagttttgggatcacaggaaggggcgatgcacacagcattgactggtgctacagaaatccagactagcggcactacaacgatctttgcaggccatttaaaatgtaggttgaaaatggacaagctgactcttaaaggtatgtcctatgttatgtgtacaggatcatttaagttggaaaaagaggttgcagaaacccaacatggaacagtcttagtgcaaataaagtacgaagggaccgacgccccatgcaaaattccatttagtactcaagacgaaaaaggagttacgcaaaatggacgactaatcacggcaaatccaatcgtgactgacaaagagaaacctgtcaacatagaagcagaaccgcctttcggggagagctatatcgttataggtgctggagaaaaagcgctaaagttgagctggttcaagaaagggtcatcaattggcaaaatgttcgaagctaccgcacggggagctaggagaatggcgatcttgggagatacagcttgggatttcggatcaattggtggggttttcacttctgttggcaaacttgtccatcaaatctttggcacagcatatggtgtgttgttctcaggggtatcatggacaatgaaaataggaataggtgtgttattaacttggttgggcttaaattctcgaagcacctcattcagtatgacatgcatcgcagtgggccttgtaaccctttacttgggagttatggtgcaagcagattcaggttgcgtcataaattggaaagggcgcgaattaaaatgtggaagtggtatatttgtaacaaacgaagttcatacgtggacagaacaatataagtttcaagccgactctccaaaacgattatctgcagcaattggaaaagcctgggaagaaggagtctgtggtatacgatcagcgacacgactggaaaacattatgtggaaacaaatcagcaatgagttgaatcatatactcctcgaaaacgatatgaaatttacagttgtagttggagatgtcgcaggcatactcgctcaaggaaagaaaatgataagaccgcaaccaatggagtacaaatactcgtggcgttcctggggcaaagctaaaattattggtgctgacgttcagaatacaacatttattatagatggaccaaacacccccgagtgtcctgacgatcagagagcatggaatatctgggaagttgaagattatggcttcggtatcttcactacaaacatatggttaaaattacgggattcttacacgcaagtatgcgatcacagactaatgagcgcagcaatcaaagatagtaaggctgtacatgcagatatgggctactggattgagagtgagaaaaatgaaacatggaaattggcaagggctagctttatcgaagttaaaacttgtgtttggccaaagagtcataccttgtggtccaatggtgttttggaaagcgaaatgattatcccgaagatctatggaggaccgatatcacagcataactacagaccaggatacttcacacaaaccgctggcccttggcatctcgggaagctggaattagactttgatctctgcgaaggcactaccgtcgtagttgatgagcactgcggaaaccgtggcccaagccttagaacaacgactgtaacaggaaaaataatccacgagtggtgctgtcggagttgcacattgcctcccctacggtttaggggtgaggatggatgctggtacggaatggaaattagacctgttaaagaaaaggaagaaaatctggtaaaatctatggttagtgctggctcaggagaagtagatagtttctcattagggcttttgtgtattagtataatgacagaagaggtcatgagaagccgatggagtcgcaaaatgctcatgactggaacgttagcagtctttttgctcttaattatgggacaattaacatggaacgatctcataagactttgcatcatggtgggtgccaatgcaagtgaccgaatgggcatgggaacaacctacctagctttaatggccacctttaaaatgaggcccatgtttgctgtcggactgttgtttagaaggttaacgtctagagaagtattgctattaacagtcggcctttcattggtagcttcggttgaacttccaaacagccttgaagaattaggagacggactagcaatgggtataatgattcttaaattgctcacggacttccagccacatcaactttgggcaacgttattatctctcaccttcataaaaacgacttttagtctacattacgcctggaaaaccatggcaatggtattgtcaatcgttagccttttccccttatgtttgtcaacaacgtcgcagaagacaacgtggttaccagttttattaggcagcttggggtgcaaacctctcactatgtttttaatagctgagaacaagatctggggcagaagaagttggcccctaaatgaaggaatcatggcagtcgggattgtctcgatactactgagtagtctattaaagaacgacgtacctctagctggtcctctgatagcaggaggaatgttaatagcttgttatgtgatatctggaagctcagcagatttaagcctagaaaaagcagcggaggtttcttgggaagaagaagccgagcatagtggagcgagccataatattttggttgaagtacaagacgacggtacaatgaaaataaaagatgaagaaagggatgatactctcactattctgctaaaagctactctactagctgtgtccggagtttatcccttaagcatacccgccacactatttgtctggtacttttggcagaagaagaaacagcgaagtggcgttctatgggacacaccatcaccaccggaagtagaacgggccgttctagacgatggcatatacagaataatgcagagaggccttcttggccgaagccaagtcggtgttggtgtattccaggagaatgttttccatacgatgtggcacgttacgagaggggcagttctcatgtatcaaggaaaaaggttagaaccaagctgggcatctgtcaagaaagacttaatctcatatggaggtggatggagattgcagggatcttggaatacaggagaagaagtacaggtaattgcagttgaacctggtaaaaacccgaaaaatgtccagacagcaccgggaaccttcaaaactcctgagggagaagtaggagcaattgcactagattttaaaccaggtacaagcggctccccaatagtaaatagagagggaaaaatagtcggcttgtacggaaatggtgtagtcactacttcagggacatatgtaagtgcgatcgcacaagccaaagcgtcccaagaaggtcccctgccagaaatagaagatgaagtattccggaaacgaaacttaacaatcatggatctgcaccccggttcaggaaaaaccagacgttatttaccagcaatagttagagaagcaataaaacgaaaattgcgaactcttatacttgcaccgactcgcgtagtagctagtgaaatggctgaagccctgaaaggcatgcccatccgatatcaaactacagcagttaagtctgaacatactggaaaagaaatcgttgatctaatgtgtcatgcaacatttacaatgagactcttatctccagtgagagtgcccaattataatatgataattatggatgaagcacatttcactgaccccagcagtattgccgcccgagggtatatcagtacaagagttggaatgggtgaggcagcggctatctttatgacggcaactccaccaggatcagtagaagcatttccacagagcaatgcggtgattcaagatgaggagcgagatatacctgagagatcttggaatagcggatatgaatggataacagacttccctggtaaaacagtttggttcgtcccaagtataaagtctggcaatgatatcgcgaactgtctacgaaagaacggtaaaagagtaattcaactttcacgtaaaacttttgataccgaataccaaaagacgaaaaacaacgactgggactatgtagttacaacagacatatcagaaatgggcgccaacttccgagcagatagagttattgacccaaggagatgccttaaacctgtgatactaaaagacggaccagaacgagtcatactagctggtccaatgccggtaacggtagcttcagcggctcaaagaagagggagaataggacgtaatcacaacaaagaaggggatcaatatatttacatgggacagcccttaaataacgatgaagatcacgcacactggacagaagcaaaaatgcttcttgacaacataaatacaccagaaggcataatccccgctctatttgagcctgaacgagaaaaatctgcagctatagacggagaatatcgccttagaggggaagctcggaaaacctttgtggagttaatgcgacgtggtgatctaccggtgtggctaagttacaaagtggcgtcggaaggctttcaatattcggaccgaaggtggtgttttgatggtgaacgaaacaatcaagttcttgaagaaaacatggatgtagaaatatggacaaaagagggtgaaagaaagaaactgcgtcctagatggctggatgcgagaacttactcagatccgttggcactaagagagttcaaagagtttgcagctggaagaagaagcgtatcaggcgatttaatactggagataggaaaattgccgcaacacttgacacaaagggcacaaaatgctcttgacaatctcgtcatgctacataatagtgagcaaggcggcagagcttatagacatgcaatggaagaattaccggatacaatagaaacactcatgctattggccctgatagctgtattgaccggtggagtcaccttgttctttttgagtggaagagggctggggaagacgtccataggattgttatgtgttatggcatcctcagtacttctgtggatggcatcagtagaaccacattggatagcagcaagtataatactagaatttttcctaatggtcctattgataccggaacccgaccgccaaagaacacctcaagataatcaattagcttacgttgtaattggcctcttatttatgatcttgacagttgcggctaacgaaatgggtcttctcgaaaccactaagaaagatttaggaatcggacatgtggctgttggcaatcatcaccacgcagcgatgctagacgtggatttacaccctgcttcagcttggacattatacgcggtagcgacaaccattatcactccaatgatgagacacaccatagaaaacacaacagctaatatttctctcactgccatagctaatcaagctgcaatacttatggggctcgacaaaggatggcctatctcaaaaatggacataggagtaccattactggcattgggatgttacagccaagtaaatccactaactttaactgccgctgttcttatgctcgttgcacactatgcaattatcggcccaggattacaagctaaggccaccagggaagcccaaaaacgtaccgctgccggtatcatgaaaaatccaaccgtagacggaatcgtcgcgatagatttggacccagtagtatatgatgcaaaatttgaaaagcagttaggtcagataatgctcctgatattatgcacatcgcaaattttactaatgagaacaacgtgggcactatgtgaatcaatcacactagcaacaggtcctttaactacattgtgggaaggcagtccggggaagttttggaatacaaccatcgccgtgtccatggctaatattttccgtggatcgtacctcgctggtgcaggattagctttttcgctcatgaagtcgctaggagggggaagacgaggtacaggggcacaaggagaaacgctaggagagaagtggaaacgtcaattaaatcagctttcaaaatcagagtttaatacatataaaaggtcaggaattatggaagtagaccgaagtgaggccaaagaaggattgaagagaggagaaataacaaaacatgctgtatcaagaggaaccgcaaagttacgttggtttgttgaaagaaatctcgtgaagcccgaaggtaaagttatagacctgggatgtgggcgaggtggatggtcttactattgtgcgggtctaaagaaagttactgaagtaaaaggctatacgaagggcggtccgggtcatgaggagccaattccaatggcaacttatggatggaacttagtaaagttacattctggtaaagacgtatttttcgttccacctgaaaaatgtgacacattactctgtgatatcggtgaaagttcgccgaaccccactattgaggaaggaagaacattgagagtcctgaaaatggtagaaccgtggttgagaggcaaccagttttgtataaagatcttgaacccgtacatgccttctgtcgtagaaaccttagagcaaatgcaacgcaaacatggaggtatgcttgttaggaatccattaagtcgaaactcaacacacgagatgtattgggtttcttgtggaacagggaatattgtttcggctgttaacatgacatcacgcatgttgttgaaccgttttacgatggcgcatagaaagcctacctatgaacgtgacgtagatttaggagctggtactagacacgtagctgtagagcccgaagtcgcaaacttggacataataggacaaagaattgaaaacataaaacatgaacataaaagtacttggcattacgacgaagacaatccatataaaacttgggcttatcatggttcgtacgaggtcaagccaagtggaagtgcgtccagtatggtgaatggagtagtaaaactgctaaccaagccttgggatgtcatccctatggtcacccaaattgctatgacggacaccaccccatttggccaacaaagagtgttcaaagaaaaggtagatacgagaacacccaaagctaaaagaggaactgcccaaataatggaagttacggcaaaatggctttggggcttcttaagtagaaataagaaaccgcgaatatgtactcgtgaagagttcacaagaaaagttcgttctaatgcagctatcggagcagtatttgtggacgaaaatcaatggaactcagcaaaggaggcagttgaggacgaacgattttgggatctagtacatagggaaagagaattacacaaacagggaaagtgcgctacgtgtgtctacaacatgatgggaaagcgcgagaagaaattgggcgagttcggaaaggctaaagggagcagggctatatggtacatgtggttaggtgcacgatttctcgagttcgaggccttaggttttatgaatgaggatcattggttctcacgcgaaaacagcctttctggagtagaaggagagggattacacaaactaggatacattctcagagacatttcaaaaattcctggtggcaacatgtatgccgacgacacagcaggttgggatacaagaataactgaagatgatttgcaaaatgaagcaaggattacagatattatggagccggaacatgcgctgttagcgaaaagtatctttaaattgacttatcaaaataaagtagttagagttcaaagacctgccaaaaatggaacagtaatggatgtgatttcacgacgagatcaacgaggatcaggtcaagtcgggacctatggccttaatacattcactaatatggaggcccaacttattagacaaatggaaagtgaaggtattttctccccatcagaactggaaacccctaacttagctgaacgagtattggactggcttgaaaagtatggggtggaacggcttaaaagaatggcgataagtggcgatgactgcgtcgttaagcccattgatgatcgtttcgctaccgctttaactgcactcaatgatatgggtaaggttaggaaagacataccacaatgggagccctcaaaaggttggaacgactggcagcaagtaccattctgttcgcaccattttcatcaactcattatgaaagatggccgtgagattgtagtcccatgtagaaaccaggatgagctagtgggacgagcaagggtaagtcaaggcgcaggctggagcctacgtgaaacagcgtgtttgggcaaatcatacgctcagatgtggcaattaatgtattttcataggagagatcttcgcctcgcagcaaatgccatctgctccgcggtgccagtcgattggataccaacgagccgtacaacctggtccatccacgcgcaccatcaatggatgacaacagaagatatgctttcagtatggaatagagtttggattgaggaaaatccctggatggaagacaagacacatataagtagttggggtgatgtaccataccttggaaaaagggaagaccaatggtgcggatctcttatcggattgactgcaagagccacttgggcaaccaacatacaagtagccataaatcaagttagaagattaatcggtaatgaaaactacttagattacatgacaagcatgaagagatttaagaacgaatctgacccagaaggggcactctggtaa

SEQ ID NO: 21203 - RNA, 9879 nt, synthetic construct
  misc_feature 1..9879: note = derived and/or modified CDS sequence (opt6) from DENV-1__FJ639691__SS-prME
  source 1..9879: mol_type = other RNA
tctgttactatgctcctaatgttaatgccaacagcattagcatttcatcttactacaaggggaggtgaaccacatatgatagtgagcaaacaagaacgaggaaaatctctattgttcaaaacatcagcgggagttaatatgtgcacacttatagcaatggatctaggtgaattttgtgaagataccatgacatacaaatgtccgaggatttctgaagcagaacctgatgatgtcgactgttggtgcaatgctacagatacatgggtcacgtacggtacgtgtagtcaaacaggtgaacataggagggataaacggtctgttgcactagcacctcatgttggcttggggttagaaacaaggactgaaacatggatgtcgtcagaaggggcctggaagcaaattcaacgtgtggaaacttgggctttgcgacaccccggatttacagtgatagccttgtttcttgcacacgcaattgggacctctataacacaaaagggaattatctttatccttctgatgttagtaacgccgtccatggcgatgcgatgtgttggaatagggtcaagggacttcgttgaagggttgagcggtgcaacctgggtggacgtcgtgcttgaacacggaagttgcgtgacaaccatggctaaagataaacctacgctagacatagaactacttaaaactgaagtgacaaatcccgctgtgttaagaaaactttgcatcgaagcaaagattagcaacactacaacggattcaagatgccccactcagggagaagctacactcgttgaagaacaagatgctaactttgtctgcagacgaacttttgttgatagaggatggggtaatggatgcggtctattcggaaaaggatcattgattacatgtgcaaaattcaaatgcgtgacaaaacttgaagggaaaattgtacagtacgaaaacttgaagtattcagtcatcgtaacagtgcatacgggagaccaacatcaagtgggaaatgaatcgaccgaacatggaactactgctactattaccccacaggcgccctcgacagaaattcaattaacggattacggagcattgaccttggattgcagcccccgaaccggactagatttcaacgaaatggtattattgacaatgaaggagaaaagctggttagtccataaacaatggttcctagacttaccattaccgtggacgagcggggcgtcgacgtcacaggaaacatggaaccgtcaagacttattagtaacatttaagacagcgcatgcgaagaaacaggaagtcgtagtactcggatctcaagaaggagctatgcacacagccttaacgggagctaccgaaatacagacctcaggaacaaccactatatttgcaggccacctaaaatgccgactaaagatggataaactcacgttaaaagggatgtcttatgtcatgtgcacgggatcttttaaattagaaaaagaagttgcggaaactcagcacgggactgttctagtacagataaaatatgaagggactgatgcgccatgcaaaattccgttttcaacacaagatgaaaaaggagtaacgcaaaacggacgactgattacggctaacccaatcgtgacagataaagaaaagccggtgaatatagaagcggagccgccgttcggtgagagttacatagttatcggtgcaggggaaaaggcacttaaactatcctggtttaagaaaggatcaagcattgggaagatgtttgaggcaacagctagaggcgcaaggcgcatggcaatactgggggatacagcttgggatttcgggtcgattggaggtgtctttacatccgtagggaaattggtgcatcaaattttcggaaccgcatatggtgttctattcagtggagtctcctggacaatgaaaattgggatcggagttttacttacttggttgggtctaaatagccgatcaaccagcttgtcaatgacatgtatcgcagtagggctcgtcaccttatatctcggagtgatggtacaagccgactcgggatgcgtaattaattggaaaggcagagagttaaaatgcggctcgggtatcttcgttaccaatgaggtgcatacatggactgaacaatataaatttcaagcagattcaccaaagagattaagtgcagcaataggaaaagcgtgggaagaaggtgtgtgcggaattagatcggccactcgcttagaaaatataatgtggaagcagataagtaatgagctaaaccatatcttactagaaaacgacatgaagttcacggtcgtagtgggggacgttgccggaattttagcgcaaggcaagaaaatgatacgtcctcagcctatggaatacaagtatagttggaagtcatggggaaaagcgaagataattggagcagatgttcaaaatactacattcattatcgatgggccgaatacaccggagtgccctgatgatcaacgggcgtggaatatctgggaagtggaagactatggttttgggatattcacgacgaatatctggttgaagttaagagattcctatactcaagtctgtgatcatagattgatgagcgcggcaataaaagacagtaaagcggtacatgcagatatgggatattggatagaatctgagaaaaatgagacatggaaacttgcgagggccagctttattgaagttaaaacttgcatatggccaaagagtcatacactttggtccaacggcgttctagaatccgagatgatcatcccaaagatctatgggggacccatatcgcaacataattatagacccggatattttactcaaacagcaggaccatggcaccttggtaaactagaactagattttgatttatgtgagggaactacggtagttgtagacgaacactgcgggaatagagggcccagcttaaggacaacaacagttacaggtaagatcatccatgaatggtgttgcagatcctgcacgttgccgccattgcgtttcaaaggagaagatggttgttggtatggtatggaaatacgtccagtaaaagaaaaagaagagaacttagtaaagtccatggtatccgccggttcaggtgaggtcgatagcttttcactggggttactctgtatatcaataatgatagaagaggtgatgaggagtaggtggagccgcaaaatgctaatgactggcacattagctgtattctttttattgataatgggacaactcacatggaatgatcttataaggctttgcataatggtgggcgcgaatgccagtgatcgtatgggaatgggtatgacatacctagctttgatggcaacattcaaaatgagacctatgtttgccgtcggattgttgtttaggcgtcttacatcgcgtgaagtactactccttacaataggtctatccttagttgcgagtgtggaattaccaaacagcctagaagaacttggagacggcttagcgatgggtataatgatattaaaattgttaacagattttcaatcataccagttatgggcaacattactaagtctaacttttataaaaaccacattttcgttacactacgcatggaaaacaatggcaatggtcctgagtatagttagtctatttcctctttgcttaagtacgacaagtcagaaaacaacttggcttccagttttgttaggatcactaggatgcaaaccattaaccatgtttttaatcgctgaaaacaaaatatggggtcggaaatcttggccgctcaatgaaggaataatggcagtaggcatagtttccattctactcagtagtctactaaagaatgatgtgccattagctggaccactaatcgctggcggaatgctaatagcatgttatgtcatatccggaagttctgcagacttatcactagaaaaagctgctgaagtatcttgggaagaagaagcagaacatagtggggcaagtcataatatcttggtagaagtacaagatgacggcactatgaaaataaaagatgaagaacgagatgatacattaacaattttattgaaagcaacactattagccgtatctggtgtgtaccctctctcaattccagcaactctattcgtatggtatttttggcagaaaaagaaacaacgttcaggagttctctgggatactcctagcccacccgaagtggaaagggcagtgttagatgacggaatttatcgaatcatgcaaagaggtttattaggcagatcacaagtaggtgttggagtttttcaagaaaatgtatttcacacaatgtggcatgttacgagaggcgccgtactaatgtatcaagggaaaagacttgaacccagttgggcctctgttaagaaagatctaattagttacggaggaggatggagattacaaggcagttggaacactggagaggaagtgcaagtaatagccgtagaacccggcaaaaatcccaaaaacgtacaaacagcacctgggaccttcaaaacgtcggaaggagaagtgggcgccatagcactcgacttcaaacctggcacttctggatccccaatagttaatcgggagggaaaaattgttggcttgtacggaaacggtgtggttacaacgagcggaacttatgtaagtgcaattgctcaagccaaagcaagtcaagaaggtccactgcctgaaatagaagatgaagtattcagaaaaagaaacttgactatcatggacttgcatccgggaagtggaaaaacacgaagatatttacctgccatagtaagagaggccatcaaacgcaaattaagaacactcattttagcacccacaagagtggttgcgtctgagatggcagaagcgctcaaagggatgcctattcgctaccaaaccaccgcagtaaaatctgaacatacaggcaaagaaatcgttgatttgatgtgccatgcaacattcactatgagactgctatcccctgtaagagtgcccaactataacatgattataatggacgaggcacattttacggatccatcttcgattgctgcaagaggttacatttcaacgcgagttggaatgggtgaagctgccgccatatttatgacagcaaccccacctggcagtgttgaagcgttcccccaaagtaatgcagtcattcaggatgaagaaagggatatacctgaacgtagttggaactctggttatgaatggattaccgactttccaggaaagacagtatggttcgttccaagtatcaaatcaggcaacgatatagccaattgtcttaggaaaaacggaaaaagagtgatccagctaagcaggaaaacatttgacactgagtatcagaagaccaaaaataacgactgggattatgtagtaacaaccgatataagtgagatgggagcaaactttagagctgatagggttatagatccacggcgatgtctaaaacctgttatcctgaaggatggtccagaacgtgtaatactcgcagggcccatgcctgttacagtggcctcagctgcccaaagacgaggtagaattggcagaaatcataataaggaaggagaccaatacatttatatggggcaaccgttgaacaatgacgaagatcacgcccactggactgaagctaagatgttattagacaatataaacacccctgagggcataatcccggccctatttgaacccgaaagagaaaaatctgctgcaattgatggtgaataccgcctgcgaggtgaagctcgtaagacattcgtcgaactgatgagacgaggcgacttgcccgtttggttatcgtataaagtagcatctgagggattccaatattcagacagaagatggtgcttcgacggtgagagaaataatcaggtcctcgaggaaaacatggacgtcgagatctggacgaaagaaggagaaagaaagaaattacgaccacgatggctagacgctaggacctattctgacccgttggcactaagagagtttaaagaatttgcagcaggtagaaggagcgtctcaggggatctaatacttgaaattggaaaattgccacaacacctcacacagcgggcacagaatgctctggacaatttagttatgttgcacaacagtgaacaaggtgggcgagcctatagacatgctatggaagaactgccagatactattgaaactttgatgttgcttgcactcattgcagtccttacaggcggtgttacattatttttcctatcaggtaggggcctaggtaagacaagcataggcttactttgtgttatggcatcatcagtactactgtggatggcaagtgttgaaccccattggatagctgcgagtataatactggagttctttctaatggtgcttttaatacccgagcctgacagacaaagaactccacaagataaccaattagcctatgtagtaataggacttttatttatgatcttgaccgttgcggccaacgagatgggtttgctcgaaactacgaagaaagatctggggataggccatgttgcggttgaaaaccatcatcacgccgcaatgcttgatgtggacttacatccagcctcagcatggacattgtatgccgtagctacaacaataattaccccaatgatgaggcacaccatagaaaacactacggcaaacatttcactgacagctatagcaaaccaggcagccatactaatgggattagataaaggctggccaatcagtaagatggacatcggagtcccattgctagccttgggatgctacagccaagttaacccacttacattaacggccgcagtcttaatgttagtcgcgcactatgcaattattgggcctggcttacaggcaaaagcaacacgagaagctcaaaagagaactgcagctgggattatgaaaaacccaactgttgatggtatcgttgccattgatttagaccccgttgtatacgatgcgaaattcgaaaaacaattaggacaaataatgttactaatactctgtacttcacaaatcctactaatgcgcacaacttgggctttgtgtgaatctataactctagctacgggccctctaacaacgctttgggaaggatcacctggcaaattttggaacacaacaatcgctgtttcaatggctaacatatttagagggagttatcttgcaggagccggtctagcgtttagtttgatgaaaagcctaggcggcggaagacgaggtaccggcgcgcaaggggaaacactaggggagaagtggaaacgacaattaaatcaactttcaaaatccgagtttaacacatacaaaagatcgggaatcatggaagttgacagatcagaagcgaaagaaggactaaaaagaggtgaaacaacaaaacatgctgtaagccgtggcaccgcaaaattacgttggttcgttgaacgaaaccttgttaaacctgaaggaaaagtaatcgacttaggatgtggccgcggtggttggtcttattattgcgcgggtctaaagaaagtaactgaggtaaaaggctacaccaaaggaggtccaggacatgaagaacccatacccatggctacatatggttggaatctagtgaaactacactctggcaaagatgtattctttgtaccgccggaaaaatgtgacacactcctatgtgacattggtgaatctagcccaaatccgacaatagaggagggtaggacgctacgagttttaaagatggtcgaaccatggctaagaggcaatcaattctgtataaagatattaaatccgtatatgccttcggtggttgaaacattagaacagatgcaacgaaagcacggcgggatgttagttcgcaatccgttgagcaggaatagtactcatgaaatgtactgggtttcatgcggtacaggtaatatcgtgtcagctgttaacatgaccagcagaatgctactcaatcgatttaccatggcccacagaaaaccaacttatgaacgtgatgtggatctaggcgcaggaacacggcacgtagcagtagagccggaagtagctaatttagacataataggtcaaaggatcgagaacataaaacacgaacacaaatcaacttggcattatgacgaggataacccgtataaaacctgggcttaccacggctcttatgaagttaaaccgagcggatcagcatcaagcatggttaatggggtagtaaaattactaactaaaccttgggacgtaattccgatggttacccagattgcaatgacagataccacaccattcggacagcaaagagtgttcaaagaaaaggtagacacacggacgccaaaggccaaaaggggtacagcacaaattatggaagtgactgcaaaatggctttggggttttctgtcaagaaataagaaaccacgcatatgtacacgagaagagttcacaagaaaggttagatctaacgcagctattggagcagtgttcgtagacgaaaaccagtggaacagcgctaaagaagcagtagaagacgagagattttgggacttagtacatagagaaagagagctccataaacaaggcaaatgtgcgacttgcgtatataatatgatgggcaaaagagagaagaaactaggcgaatttggcaaagcaaaaggctctagggccatatggtacatgtggttgggagctagatttctcgagttcgaggctttaggattcatgaacgaagatcactggttctcgagagaaaactcattatccggagttgagggcgaaggcttgcacaaattgggttacatactgcgggatatttcgaaaatttccgggggcaacatgtacgccgatgatacagccggatgggacacacggataaccgaagacgacttacagaatgaagcgaaaataacagatataatggaacccgagcatgctttattagctaaatcgatatttaaacttacatatcagaataaagttgtaagggtacaaagacccgccaaaaatggaacagttatggatgttatatcaagacgtgaccaaagggggtctggacaagtaggaacatatggattaaataccttcaccaatatggaagcacaactaatcaggcaaatggaatcagaaggaatatttagccccagtgaactagagactccaaatttagccgaaaggaccttagattggttagaaaaacatggggtcgagcgtttaaaaaggatggctatcagcggtgatgattgtgttgtaaaacctatcgatgaccgctttgccactgctcttacagccttaaatgatatgggaaaggtcagaaaggatataccacaatgggagcctagcaaaggttggaatgattggcaacaggtacccttttgcagtcatcattttcaccaacttatcatgaaagatggtagagaaatcgtagtcccatgtcgtaaccaagatgaactcgtgggtagagctagggtaagccaaggcgctggatggagcttaagagaaaccgcttgtttaggaaaaagctatgcgcaaatgtggcagctcatgtactttcaccgaagagatctgcgattggcagctaacgctatctgttcagctgtcccagtagattgggtacctacgtcacgaaccacttggtcaatacatgcccaccatcaatggatgacaacagaggatatgctatcagtctggaacagggtctggattgaggaaaatccgtggatggaagacaaaacacatatttcttcgtgggaggatgtgccttatttaggcaaacgcgaagaccaatggtgcggatccttgataggtctaacagcgagagcaacatgggcaacaaatatacaggtggcaattaatcaagtgcgtagattaatcgggaatgagaattacctcgattacatgacgagtatgaaaagattcaaaaacgaaagtgaccttgagggagcgttatggtag

SEQ ID NO: 21204 - RNA, 9879 nt, synthetic construct
  misc_feature 1..9879: note = derived and/or modified CDS sequence (opt6) from DENV-1__FJ639692__SS-prME
  source 1..9879: mol_type = other RNA
agtgtaacgatgttattaatgttaatgcctacagctctagcattccacctaactacaagaggtggagaaccgcacatgattgtatcaaaacaagaaaggggaaaatctctcctatttaaaacctctgccggggtaaatatgtgcactttaatagcaatggacttaggtgagctctgtgaagatacaatgacatataaatgccctagaatcacagaagcggaaccagacgatgtagattgttggtgtaacgcaaccgacacatgggttacatatggtacatgttcacaaactggtgaacacaggcgtgataaacggtcagttgctttagcaccgcatgtgggattaggtctagaaactcggacggaaacatggatgagcagcgaaagcgcatggaaacaaattcaaagagttgaaacttgggctttgcgtcatcctggttttaccgttatagcgttatttttggcccacgcaatcggaacttccataactcaaaaaggaattatcttcatattactaatgcttgtcactcccagtatggcaatgcgttgcgtcgggattggatcgagagactttgtagaaggactctcaggtgcgacctgggtagacgttgtattagagcatgggagttgtgtaacaactatggctaaagataaacctacactagatatagaactattaaaaacggaggttaccaaccccgcaatactgagaaaactttgcatagaagctaaaatatcgaatacgactacggactcacgttgcccgacacaaggagaagccacattggttgaagaacaggatgcaaattttgtatgtcgacgaacatttgtagacagaggctggggaaacggctgtggcttatttggaaaaggcagtttaatcacttgtgctaaattcaaatgcgtgactaaactagaaggtaaaatcgttcagtacgaaaatttaaaatattcagtgatagttacagtgcatacgggcgaccaacaccaagttggaaacgagtcaacagagcatggaacgactgcgactattactcctcaggctccaacaactgaaattcaacttacagattatggagctctaactttagattgttcaccaagaaccgggctagatttcaatgagatggtcttattgacgatgaaagagaaaagctggctagttcataaacagtggtttctggacttgccgcttccttggacctccggtgcatcaactagccaagaaacatggaaccggcaagacttactcgtcacgttcaaaacagcgcacgccaagaaacaggaagtcgtagttttaggcagtcaagaaggtgccatgcatacagctctaacaggagcaacagaaatacaaacttcgggcacaacgacgatatttgcagggcacctaaaatgccgattaaaaatggataaattaacactgaagggtatgagttacgttatgtgcacaggcagtttcaaactcgagaaagaagtcgcagaaacgcaacacggaacagttctcgttcaaataaagtacgaaggaacggacgcgccatgtaaaattcctttttcgacacaagatgaaaaaggtgtaacccaaaatggtagactaataaccgcaaacccaatagtcacagataaagaaaaacctgtaaatattgaagcggaacccccatttggagagtcctacattgtgattggtgcaggggagaaggctttaaagttatcatggttcaagaaaggatcaagtataggaaaaatgttcgaagcaacagctcgaggggccagaagaatggcaatattaggagatactgcatgggactttggaagtatagggggagtttttacctcagttggtaaattggtccaccagatatttggaacggcatatggtgtgttgttctccggggtcagttggacaatgaagataggtatcggagtattacttacatggcttggtttaaattccagatcgacatctttatcaatgacatgcatagcagttggtcttgttacactatatctaggtgtaatggtacaagccgactcgggatgcgtaattaattggaaaggacgcgagctcaagtgcggaagtggcatttttgtgacaaatgaagtacacacatggaccgaacaatataagttccaagcggattccccaaaacgactgtccgctgcaatcggcaaggcttgggaagaaggagtttgcggtatacgaagcgctacaagactcgaaaatataatgtggaaacaaatatcaaatgagctaaatcatatactactggagaatgatatgaaatttactgttgtcgtaggcgatgtagccggaatcctggcccaaggcaagaaaatgataagaccacaaccaatggagtataagtatagctggaagagttggggcaaggctaagataattggagctgatgtacaaaatactacatttataatagatggtccaaatactccagagtgccccgatgaccagagggcgtggaacatatgggaagtcgaagactacggttttgggatattcacaacgaatatatggttaaaactcagagacagttacacacaagtctgtgaccatagactaatgtctgccgcgataaaagacagtaaagccgtccatgcagatatgggttattggattgaatcagagaaaaatgaaacttggaagttagcgagagcatcattcatagaagtcaagacgtgtatttggcccaaatcacacacattgtggagtaatggagttctagaaagtgaaatgattataccaaaaatatatggaggaccaattagtcagcataactatagacccgggtatttcactcagactgccggaccatggcacctgggcaaactagaactggacttcgacctatgcgaaggcacaacggttgttgtcgatgaacactgtgggaataggggcccttccctcagaacgacaacagtgacaggtaaaataatacacgagtggtgttgtagaagttgcacacttcctccactaaggttcagaggcgaagatggttgctggtacggaatggaaatccgcccggtaaaagagaaggaagagaatctagtaaaatcaatggtgtctgcgggaagtggagaagtagacagcttttctttgggactattgtgcatcagtataatgatagaggaagtcatgcgcagtagatggagcagaaaaatgctgatgacaggtacattggccgtattcctacttttaattatgggccaattaacatggaacgaccttatacgattatgcataatggtaggagccaacgcatccgatcggatgggaatgggtacaacttacctcgcactaatggctacgttcaagatgagaccaatgtttgccgtgggcttattgttcaggaggcttacaagtcgggaagtattactattaacaatcggtctctctcttgtagcgtcggtagaattaccaaattcgctggaagaattaggcgatggattagcaatgggtattatgatattaaaattattaaccgactttcaaagccatcagttatgggctacattattaagcctaacattcataaaaactacgttttccttacattacgcctggaaaaccatggcaatggtgttatctatcgtttctttatttccactatgtttaagcactacgtctcagaaaacaacatggctacctgtactattagggtcactaggatgtaaaccactaacaatgtttctgattgcggaaaacaaaatatggggacgcagatcttggccgttaaacgagggcattatggctgtcggaatagtaagcatactcctaagctcattactcaaaaatgacgtccccctcgcagggccactcatagcaggcggcatgttaattgcgtgttacgtaataagcggttctagtgcagacctaagtctcgaaaaagccgcagaagtgagttgggaagaagaagcggaacattccggcgcaagccataatatattggtggaagtgcaagacgacggaaccatgaagattaaggacgaggaaagagacgacaccctaacaatacttcttaaggctaccttgttagcagtttcaggtgtgtatcctctttcaattccggccactctattcgtatggtacttttggcagaaaaagaaacaaagatcaggagtattatgggatacaccgtccccaccagaagtagaacgagcggtacttgacgatggaatttaccgcataatgcagcgcggccttttaggcagatcccaagttggagtcggagtctttcaggagaatgtgtttcatactatgtggcatgtgacacgaggtgcagttcttatgtatcaaggtaaacggctggaaccaagctgggcgagcgtcaagaaagacctaattagttatggaggaggatggcgactgcaaggatcctggaataccggcgaagaagtacaagtaatagctgtagaacctgggaaaaatcctaagaatgtgcaaacagctccggggacctttaaaacgccagaaggagaggtaggggccatagccttagattttaaacccggaacttcaggtagcccgatagtcaaccgagaggggaagatcgtcggactgtatggaaatggagtggttactaccagtggtacgtatgtatcagccatcgcacaagctaaagcatctcaagagggccccttaccagaaatagaagacgaggtatttcgcaaaagaaatttaactataatggacttgcaccctggatcaggaaaaacaaggagatatctgcccgctatagtcagggaagcgataaaaagaaaattaagaaccttaattctagcccctaccagagtagtagcgtcagaaatggcagaggcactgaagggaatgccaattagataccaaactacggcagttaaatcggaacacacaggtaaggaaattgtagacttaatgtgccacgctacgttcacaatgagactactttctcccgttcgagtacctaattataacatgataataatggatgaggcgcatttcacagacccgtcatcaatcgcagcaagaggatatatatcaactagagtcgggatgggtgaagcggcggctatattcatgactgcaacaccacctgggtcagtagaagcatttccgcaatccaacgcactgatccaagatgaggagcgtgatataccagaaagatcatggaacagcggctatgagtggattacagacttcccagggaagaccgtttggtttgtgccatcaattaaatcaggaaatgacatagcaaattgcttacgcaaaaatggtaaaagagtaattcaactaagccgaaaaacctttgacactgaatatcaaaagaccaaaaataatgattgggattacgtagtaacgaccgacatatcggagatgggtgctaattttcgagccgatcgcgtaatagatccaagaagatgtctaaaaccagtgattctcaaagacggacctgaacgtgtcatattagcaggaccaatgcctgtaaccgtggcatcagcggcacaacgacgagggcgtatcggaaggaatcacaataaagagggagatcaatatatatacatgggacagccgctgaataacgatgaagaccacgcccactggactgaggccaaaatgttactcgacaacataaatactccggagggcataattcctgcactgtttgaaccagaacgtgaaaagagcgccgctatagacggcgaatatcgattacgtggtgaagccagaaagacatttgtagaattaatgcgtagaggagatctacccgtatggctctcatacaaagtagcgtccgaaggatttcagtactctgacagaaggtggtgctttgacggggaaaggaacaatcaggtactcgaagaaaatatggacgtagaaatatggaccaaagaaggggagaggaagaaactaagaccaaggtggctagatgcaagaacatacagtgatcctctagcattacgagagtttaaagaatttgctgctggcagacgatccgtaagtggagatctaattctggaaatcggaaagctgccgcaacacctaacgcagagagctcaaaacgccttggataacttagtcatgctacacaacagcgaacaaggtgggcgtgcgtatagacatgcaatggaagaattacccgatacgattgagacgttaatgctcctggccttaattgcagttctgacaggaggagtcacattgttctttttatctggacgtggccttggtaaaacctcaattgggctgttatgtgttatggcaagctctgtacttctttggatggcgagcgtcgaacctcattggattgcagcaagtattatccttgaatttttcttgatggtcttattgatcccagaaccggatagacaacggacgccccaagacaatcagcttgcttatgtcgttatcggactattgtttatgattttaactgttgcagccaatgaaatgggcctactcgagactacaaagaaagatttagggataggacacgttgctgtaggtaatcaccaccatgcggcaatgttagatgtcgacctacatccagcaagtgcttggacactatatgccgtagcgaccactattattactcccatgatgaggcacactatagaaaacaccacggcaaatatatctttaactgcgatagcgaaccaggcagcaatattgatgggccttgataaaggctggccaattagtaaaatggatatcggtgtcccactgcttgcattaggttgttacagccaagtcaatccattaacgttaacagccgccgtactaatgctagtcgcacactacgccattataggccccgggttacaagcaaaagcaactagggaggcacagaaaaggaccgccgcggggataatgaaaaatccaacggtagatggaatcgtggcaatagacctagatccggtagtatacgatgcgaaatttgagaaacaactaggacagatcatgttgcttatactttgtacaagccagattctactcatgagaacaacctgggcgctatgcgaatccattactcttgcgaccggccctttaacgacgctatgggagggaagtccaggaaaattttggaacacaacaatagcagtatctatggcaaatatatttagaggatcatacttggctggtgctggattagcatttagcttgatgaaatctttaggagggggacgtaggggcacaggggcacagggagagacccttggtgagaaatggaagagacaactaaatcagctatccaaaagtgaatttaatacttataaaagaagcggaatcacagaagtagataggtctgaagcaaaggaaggcctgaaacgaggagaaactaccaaacatgctgtaagccggggaacagccaaactaaggtggtttgtagaaagaaatttggtaaaaccagaagggaaagtaatagacctcggatgtggcagaggcggatggtcatactattgtgcaggccttaagaaagttactgaggtaaaaggatatactaaaggcggtcctggtcacgaggagccaataccgatggccacgtatggatggaacttggtcaaactgcattctggtaaggacgtgttctttatacctccagagaaatgtgatacccttttgtgtgatattggagaaagttcaccaaacccaactattgaagaaggacgtaccttaagagtattaaaaatggtagaaccgtggttacggggaaatcagttttgcattaaaattttaaacccttacatgccgtcggtggtagagaccttagaacaaatgcaacgaaaacatggcggaatgttggtaagaaatccactatctagaaactctactcacgaaatgtattgggtgtcgtgcggtactgggaatatagtcagcgctgtaaatatgaccagtagaatgcttcttaaccgttttacaatggcacacaggaaacctacatacgaaagggatgtagatcttggcgccggtacgagacatgtagcggtagaaccagaagttgctaacttagatataatcggccagagaatcgagaacataaaacacgagcacaaatcgacttggcactacgatgaagataatccatacaagacctgggcatatcacggatcatatgaagtcaaaccttcaggctcagcaagtagcatggttaatggagttgtcaaactcttgaccaaaccgtgggatgtcatcccaatggttacccaaatagccatgacagacacaactccgtttggtcaacaaagagtatttaaggagaaagtagacactagaacaccaaaagccaaaagagggacagcccagataatggaagttacagctaaatggttatggggatttctctcaaggaacaagaaaccaagaatatgcacgagagaagagtttacgcggaaagtacgttccaatgcagcaatcggtgctgtctttgtcgatgagaaccaatggaatagtgcgaaagaagccgttgaagatgagagattctgggacctagtccatcgggagagagaattacacaaacaagggaagtgtgccacatgtgtctataacatgatgggaaagagggagaagaaacttggagagttcggcaaggcaaagggatcaagagctatatggtatatgtggttgggggcaagattccttgagttcgaggctttaggctttatgaatgaagatcattggtttagtcgggaaaactccctatctggggtggaaggcgaagggctgcataaattgggttacatcttgagagacatctcaaagataccaggaggaaatatgtatgcagatgacactgcgggctgggacacaagaatcacagaagatgacttgcagaatgaggcccgaattacggatataatggaaccggagcatgctcttttagccaaaagtatattcaaacttacttaccaaaacaaagtagtaagagttcaacgcccagccaaaaacggaaccgtgatggacgtaatcagtagacgagatcaaagagggagcggtcaagttgggacatatggacttaacacatttactaatatggaagcacaactaattcgccagatggagtctgaaggtatcttcagtccctcagaattagaaaccccaaacttagcagaacgcgttctcgactggctggaaaaatatggcgtcgaacgcctaaagcgaatggcaataagcggggatgattgtgttgtcaagcctattgatgatagattcgctacagcgttgacagcattaaacgacatgggaaaagtgagaaaagatatcccacaatgggaaccatccaaagggtggaatgattggcaacaagtcccattttgctctcatcactttcatcaacttataatgaaagacgggagagagatagttgtaccctgtagaaaccaggatgaattagtaggccgcgctagggtctctcaaggtgcgggatggagcctaagagaaactgcttgcttgggaaaaagctatgcacaaatgtggcagttgatgtacttccatagacgagatttaagactcgctgcgaatgccatttgtagcgcagtacctgtcgattggattcccacaagcagaactacttggagtattcatgcgcaccaccaatggatgacgacagaagacatgctaagtgtgtggaatagagtgtggatcgaagaaaatccctggatggaagataaaactcatataagcagttggggagatgtgccgtatcttggaaagcgagaagatcaatggtgcggttctctcatcggacttacagcaagagctacttgggccacaaacatacaagtggctatcaaccaagtacgacgccttataggtaatgagaactacttggactatatgaccagtatgaaacgcttcaaaaatgaatcagatcctgagggagcattatggtag

SEQ ID NO: 21205 - RNA, 9879 nt, synthetic construct
  misc_feature 1..9879: note = derived and/or modified CDS sequence (opt6) from DENV-1__FJ639693__SS-prME
  source 1..9879: mol_type = other RNA
agcgttactatgctgctaatgctaatgcctacggcactggcatttcatttgacgactagaggtggtgaaccacacatgatagtaagcaaacaggaaagagggaaaagtttattattcaaaaccagtgccggggttaatatgtgtacactaattgctatggatcttggggagttttgtgaagacacaatgacatataaatgtccaagaatcagcgaagcagaacctgatgacgtcgactgctggtgtaacgcaaccgatacgtgggtaacatacggtacctgtagccagacaggagagcaccgtcgcgataaacgatcagtagcacttgcccctcatgtcggtttgggattagaaacacgcactgaaacatggatgtccagcgaaggtgcatggaaacaaatccaacgagtagaaacgtgggcattacgccatcctggtttcacagttatagctttattccttgcacatgcaatcggtacgagtataacgcagaaagggattatatttatcctattaatgctcgtaactccttctatggctatgcgatgtgtaggaatcggatcaagagattttgttgaaggattatcaggcgcaacttgggtagatgtggtgctcgaacacggcagttgcgtaaccactatggcaaaagacaaacctactcttgacatagaactactaaaaacagaagtaacgaatccagcagtgttaaggaaattatgcatagaagccaaaatttccaataccacaaccgactctagatgtccaacccaaggagaagctaccttagtagaggaacaagatgcgaattttgtttgccgacgtacgtttgtcgacagaggatggggcaatgggtgcggattattcggtaaaggcagtcttataacatgcgctaaatttaaatgcgtaactaaattggaagggaaaattgttcaatacgagaatctcaaatattcggtcatagttaccgtacataccggtgaccagcatcaagtaggtaacgaaagcacagaacatggaacaacggccactataacaccacaagctcctagtacggaaatccaattaacagattatggtgctctaacattagattgctccccgagaacaggactagattttaatgaaatggtcttactaaccatgaaggaaaagtcttggttagtacacaaacaatggtttttagatttacctctaccttggacctctggcgcatcaacctcgcaggaaacttggaaccgtcaagatttacttgttacattcaaaacagcacatgcaaagaaacaggaagttgtagtcctggggtcacaagaaggtgcaatgcatacagcactgactggagccacagaaatacaaacatctggtacgaccacaattttcgcaggccacctgaaatgcagattgaagatggataaactaacacttaagggaatgagttatgtcatgtgcacagggagtttcaaactcgagaaagaagtagcagaaactcaacacggtactgttttagttcaaattaaatacgagggaacggacgcaccctgtaagatacctttttctactcaagacgaaaagggcgttacccaaaacggaagactcattactgcaaacccaatagtgacagataaggaaaaaccagtgaatatagaagcagaacctccctttggggaatcgtacatcgtaataggggctggagaaaaagccctaaaattatcatggtttaagaagggttcaagtatcggaaaaatgttcgaggccactgcacgaggagcacgaagaatggctatattaggagacacggcttgggattttggaagcattggcggggtattcacgtcagtgggaaaattggttcaccagatatttggaactgcttacggtgtactatttagcggtgtaagttggaccatgaaaatagggataggtgtccttttgacctggctcggacttaacagtagaagtacatcgcttagtatgacatgcatagcggttggattagtaactctgtatcttggggtaatggttcaagctgatagtggttgcgtaatcaattggaaaggaagagagttaaagtgcggtagcgggatttttgtaaccaatgaagtccatacttggaccgaacaatataaatttcaagcagactccccgaaacgattgagtgctgctatcggcaaagcatgggaggagggtgtatgtggtataaggtcagcaactcgattggaaaatataatgtggaaacaaatctcaaacgaattaaaccatatactccttgaaaatgatatgaaatttaccgttgttgttggcgatgtcgccggcatattagcgcaaggcaagaaaatgataagaccacaaccgatggaatacaaatactcctggaaaagttggggcaaggcaaaaatcataggagctgatgtccagaatacaacatttatcatcgatggaccaaatactccagagtgtccggatgaccaaagggcgtggaatatatgggaggtggaagattatggttttggcatctttaccacgaatatatggttaaaactccgtgactcctacacacaggtttgcgaccatcggcttatgagtgctgctatcaaggattctaaagcagttcatgcagatatgggttattggatagagagtgagaaaaatgaaacatggaaactcgctcgagcctcctttatcgaagttaagacttgtatatggccgaaatcccacacattgtggtcaaatggtgtactagaatcagaaatgataattccgaaaatctacggcggaccgattagccaacataattacagaccaggatacttcactcaaaccgctggaccttggcatttgggaaagttggaacttgactttgacctttgtgaagggactacagttgtcgtagacgaacactgtggcaatagaggcccttccttaaggactaccacagtaacaggaaaaatcatacatgaatggtgttgtcggtcttgtacattaccaccattacgtttcaaaggcgaagatggttgctggtacggtatggagataagacctgttaaagaaaaagaagaaaacttagtaaaaagcatggtgagcgctgggtcaggcgaagtggatagtttttcattaggacttctatgtatttccataatgattgaagaagtcatgcgatctaggtggagtagaaaaatgcttatgacaggaaccctagctgtgtttttcttattgatcatgggtcagctgacatggaatgatcttatacgtctttgtataatggtaggggcaaatgcatcagacaggatgggcatgggtatgacctacttagcattgatggcaacattcaagatgagaccaatgttcgcagtggggctattgtttcgacgcctaacaagtagagaggttttattacttactattgggttatccttagtagcaagcgtcgaattaccaaactcactcgaggaattaggagatggactagcaatgggaattatgatactaaaactacttactgatttccagtcgcatcaattatgggcaacactactgtcactaaccttcattaaaaccaccttttctcttcattatgcctggaaaactatggcgatggttttatcaatcgtaagcctatttcccctgtgcttaagtacgacatcccagaaaaccacttggctacccgttttacttgggagtttaggatgcaaacctttaaccatgttcttaattgcggaaaacaaaatatggggacgcaaatcttggccgcttaacgaagggataatggcggtaggtatagtgtccatattattatcgagtctactcaaaaatgacgtaccactggcaggtccgttgatagccggtggcatgttaatcgcctgttacgtcatatcaggatcatcagccgacttatccctagaaaaagcagcagaagtttcatgggaagaggaagcagaacactctggagctagtcataacattctggttgaagtccaagacgatgggacaatgaaaataaaagatgaagaacgcgatgacacattgacgatactgttaaaggcaacattactagctgtatcgggagtttatcccttaagcatccccgctacattgttcgtttggtatttctggcagaagaagaaacaacgatccggcgtattgtgggataccccgtcgccacctgaagtagagagagccgtactagatgacggaatttatcgaattatgcaaagaggactattgggtaggtcacaggtaggagttggcgtgtttcaagaaaatgtttttcacacaatgtggcatgttacacgaggggccgtattaatgtatcaaggaaaaagactagagccctcatgggcaagtgtcaagaaagacttaatatcatatggcggaggctggagacttcaaggcagttggaatacaggggaagaagtccaggttattgcggtagaaccgggtaaaaaccccaaaaatgtacagacagcaccgggtacatttaagactagcgaaggggaagtaggtgcaatagccttagatttcaaaccaggcacgtctgggagtccaatagttaatcgtgaaggaaaaatagtagggctttatgggaatggagtagtaacgacaagtggtacatatgtttcagcaatcgcccaagcaaaggcaagtcaagagggacctctccccgagatagaagacgaagttttcagaaaaagaaatctgacaataatggatctccacccaggctcaggaaagactcgacgatacttgcccgctattgtaagagaggcaataaaacgaaaattgcgaacattaatattagcgcccacaagagtagtagcgtctgagatggcggaggctttaaagggaatgccaataagatatcaaaccacagccgttaaaagtgagcacactggaaaagagatcgttgatttgatgtgtcatgccactttcacaatgaggctgctatcacctgtacgagttcccaactataatatgattatcatggatgaggcacacttcacagatcccagttcaattgctgcaagaggatatattagcactagggttggcatgggtgaagcagccgcaatttttatgacagcaaccccgcccgggtcagccgaagcatttcctcagagtaatgcagttattcaagacgaagagagagacattcctgagagatcgtggaactctggctatgaatggataaccgactttccgggaaaaacagtatggtttgtacctagtataaaatccggtaacgatatagcgaattgtttaaggaaaaatgggaaacgagtaatccagctaagtcgaaaaacgttcgatacagaatatcagaaaactaaaaacaacgattgggactatgtagtgaccacagacatttccgaaatgggggctaattttagggcagacagggtcatagacccccgaagatgccttaaaccagtaattctcaaagatggccctgagcgagtaatcttagctggacctatgccagtaacggtcgcatcagcggctcaaaggcgtggtcgaatcggacggaatcacaacaaggaaggagaccagtatatatatatggggcagccattgaacaatgatgaggaccacgcgcattggactgaagcaaagatgctactagataatataaacactccagaagggataataccagcgctatttgaaccagagcgtgagaaatcagccgctatagatggagagtaccgcctcagaggagaggcaagaaaaacatttgtggaactaatgagacgaggggacctaccagtatggctcagttataaagtagcgagtgaaggattccagtattcggatagacgatggtgctttgatggtgaacggaataaccaagtgttagaggaaaacatggatgtagaaatttggaccaaagaaggcgagagaaagaaactccgaccacggtggctagacgcacgaacctacagcgacccgttagcattgcgcgaatttaaagagttcgcagcaggaaggagatctgtgagtggtgacctaatcttagagataggtaaactcccgcagcatttaacccagcgcgcacaaaatgctttagataacctagtaatgctacataactctgaacaaggcggtagagcctatagacacgcgatggaagaattgccagataccatagaaacgctaatgttgttggcactgatagcagttttaacaggaggggtaacactgttctttctaagcggaaggggtttgggtaagacaagtattggtctactatgcgtcatggcctcaagcgtactcttgtggatggcgagcgtggaaccacattggattgcagctagtataatattagaatttttccttatggtcttgttaattccagagcctgacaggcaacgaacacctcaagataaccaattagcatatgtggtcataggcctccttttcatgatactaacagtggcagctaatgaaatggggctccttgaaaccacgaagaaagacttaggaatcggccacgtagccgtcgagaaccatcaccatgcggctatgttggatgtggatctacaccctgctagtgcatggaccctttatgcagttgctacaacaataattacacctatgatgcgtcatactattgaaaacacaactgcaaatatcagtttaaccgctattgctaatcaagctgcaattttaatgggattagataagggctggccaatatcgaaaatggacataggggtcccattgctagcgttaggctgttatagtcaggtaaatccgctcacattaacggctgcagtgctgatgcttgtagcccattatgcaataataggaccaggtttacaggctaaagctacgcgcgaagcacaaaaacgaaccgcggcaggaatcatgaagaatcctacagttgacggcattgtggcaattgatctagacccagttgtatatgatgcaaaatttgagaaacaattaggacaaattatgttacttatactttgcacctctcaaatattgctaatgagaacgacctgggccttgtgtgaaagtatcactttagccgttggattccaaactaccctatgggaagggtcacccgggaagttttggaatacaactatagccgtttctatggcaaatatatttcggggcagttatcttgcaggggcaggactcgcatttagcttgatgaaatcgttgggaggaggccgacgaggaaccggagcacagggagaaacactgggtgaaaagtggaaacggcaattaaaccaactatctaaatccgaatttaatacatataaaagaagtggaatcatggaggtggaccgatccgaggcaaaagaagggcttaaaagaggtgaaactaccaaacatgcagtcagcagaggtactgcgaaactgcgctggtttgttgagagaaacctagttaagccagaagggaaagttatagacctcggatgtggcagaggcggttggtcttactactgtgcaggtctcaagaaagtcactgaagtaaaaggctatactaaaggagggccagggcatgaggaaccaataccaatggcgacgtatggatggaatcttgtaaagctacactcaggcaaagatgtattctttgtcccgccagagaaatgtgacacattactgtgcgatataggagaatcatctcctaacccaaccatagaagaaggcagaacattgagagtgttgaagatggttgagccatggctgaggggtaaccagttctgtatcaagatcctgaacccatatatgccgagtgtagttgaaacattggaacaaatgcagcgaaagcatggaggaatgctagtacgaaacccactttctagaaattcaacccatgaaatgtattgggtatcttgtggaactggaaatattgtatcagcagtaaatatgacaagccgaatgttactcaatcggtttaccatggcacaccgaaaacccacatacgaacgagacgttgacctaggagcaggcacccgacacgttgccgtagagcctgaagtagccaaccttgatataataggtcaacgtattgagaatataaaacatgaacacaagagcacatggcattatgacgaagataatccatataagacttgggcgtatcacggtagttatgaagtgaaaccaagtggttcggccagtagtatggttaacggagttgtcaaattactaactaaaccttgggatgttatacctatggtaacacaaatcgccatgacagatacaacaccttttggccaacaacgggtcttcaaagaaaaggtagatacaagaacacccaaggctaaacgaggaacagcccaaataatggaagtgactgctaaatggttatggggattcctttcacgaaataagaaaccgcgaatatgtactagagaagaatttacacgaaaagtaagaagcaatgccgctataggtgccgtgttcgtagacgaaaatcaatggaactccgcaaaggaagctgttgaggatgaacgtttctgggacttagttcatagagaaagagaattacacaaacaaggaaagtgcgcaacgtgtgtatataacatgatgggaaaacgtgagaaaaagctaggagaatttggtaaagcaaaaggaagcagggctatatggtatatgtggttaggggcgaggtttcttgaatttgaagcccttggatttatgaacgaggatcattggttttcgcgcgaaaattccttaagtggggtagagggtgaaggcctacacaagttgggatatatattacgagatatttctaagataagtggaggaaacatgtacgcagatgatacggctggctgggatacacggatcacagaagacgatcttcaaaatgaagcaaaaataactgatattatggaacctgaacatgccttgttagctaagagtatttttaaactgacttaccaaaataaagtcgttagagttcagcgtccagctaaaaatgggacagtcatggatgtaatttcaaggagagatcaacgcggatctggtcaagtaggcacatatgggctaaatacgtttactaatatggaagcccaactaattcgacaaatggaaagtgaaggcatattctcaccatcggaactcgaaactccaaatttagcagaaagggcattggattggttagagaaacatggagttgaaagacttaaaaggatggcaataagcggtgacgactgcgttgttaaaccaatagacgatcggttcgcaactgctttaacagcactcaatgatatgggaaaagtacgcaaggatataccacagtgggagccttcaaaaggatggaacgattggcaacaagtacctttctgcagtcaccatttccatcagctgataatgaaagatggaagggagattgtagttccatgcagaaatcaagacgaattagtaggacgagccagagtatcccaaggagcaggatggtcgttgcgggaaactgcttgtcttggaaaatcttatgcccagatgtggcaattaatgtactttcaccggagagatcttcgactcgctgccaatgcaatttgttctgccggcccagtagattgggttcctaccagtaggacaacttggagtattcacgcacatcatcaatggatgacaacagaagatatgttatcagtatggaatcgggtttggatagaagaaaatccctggatggaagataaaacacacataagctcgtgggaagacgtaccatacttaggaaaaagggaggatcagtggtgtgggagccttatagggctcactgctagggcgacgtgggcaaccaatatacaagtagcaataaaccaagttcgtcgactgataggaaatgaaaactatttggattatatgacttctatgaagaggtttaaaaacgaatcagaccctgaaggcgcgctctggtga

SEQ ID NO: 21206 - RNA, 9879 nt, synthetic construct
  misc_feature 1..9879: note = derived and/or modified CDS sequence (opt6) from DENV-1__FJ639694__SS-prME
  source 1..9879: mol_type = other RNA
tctgtcacaatgttgctcatgttgatgccgaccgcactagcgtttcatctaactacacgtggaggagaaccccatatgatagtaagtaaacaagaaagaggaaaaagtttattgtttaaaacatcagccggtgtcaatatgtgcacactaatagctatggacctaggagaattgtgtgaagatacgatgacctacaaatgtccgcgaataactgaagcagaaccagatgacgttgattgttggtgcaacgcaactgatacatgggtaacatatggtacatgctctcagactggcgaacaccgacgagataaacggagcgtggcattagcaccccacgttggtctcggcctggaaacaaggactgaaacatggatgtcttctgaaggagcgtggaaacaaatccaacgtgtggaaacatgggcactcagacatcctggtttcacggttatcgcactatttcttgcacacgccattggaacaagcatcacacagaaaggaataatatttattctacttatgttagtaacaccgtcaatggcgatgagatgcgtaggaattggtagtagagattttgtcgaaggcttatctggtgctacgtgggttgatgtagtgctagaacacggctcatgcgttactacaatggcaaaagataaacctaccctcgatattgaactattaaaaacagaagtcacaaatcctgcaattttacgcaaattatgcatagaagctaaaattagtaatacgacaacagatagccgctgtcccacccaaggtgaagctacgttagttgaagaacaagacgccaacttcgtgtgcagacgtacttttgtagataggggatggggtaacggttgtggactgtttggaaaaggatcactcataacttgtgctaaatttaaatgcgtcacaaaattagaaggtaaaatagttcaatatgaaaacttaaaatacagcgtgatcgtcactgtgcatacaggggatcagcaccaggtaggcaacgaatcaactgaacatggaacaacagcaacaattacaccacaggctcctacaacagaaatccaattaacagactacggagcacttacattagattgcagcccacgaacaggactcgactttaacgaaatggtattattaactatgaaagagaaaagttggttggtccataaacaatggttcttagacttaccattaccatggactagcggcgcaagtacctctcaggaaacctggaatcgacaggatttgctagtcacctttaaaacggctcatgccaagaaacaagaagtcgtggtacttggtagtcaagaaggtgctatgcacacagcgctcactggcgctaccgaaattcagacaagcggaacgactactatctttgccggacatttgaaatgcagattaaagatggataaacttacacttaaaggcatgtcatatgtaatgtgcactggttcatttaaattagaaaaggaagtggctgaaacacaacacgggactgtgcttgttcaaataaaatatgaaggcactgatgccccatgtaaaataccattcagtacacaagatgaaaaaggcgtgacccaaaacggacgattaatcaccgctaacccaatcgtcactgacaaggaaaaaccagttaacattgaagcagaacctccgtttggagaaagttatatcgtcattggtgcgggcgaaaaagcgttaaaattaagctggttcaagaagggctcatctattggaaaaatgttcgaagccactgcacgaggcgctcgtcgaatggcgatactaggagatacagcctgggacttcggaagtattggaggagtatttacatcagtagggaaattagttcatcagatatttggcacggcatatggggtactattctctggtgttagctggaccatgaaaattggtatcggagtattactaacatggttagggctaaatagccgttcaacaagtttttctatgacgtgtatcgcagtaggtttagtaacgttatatcttggtgtaatggtacaagcagattctggttgcgtaattaattggaaagggagagaacttaagtgtgggtccggcattttcgtaacgaatgaagtccacacatggaccgagcaatataaatttcaagcagactccccaaaaaggctctcagccgcaataggaaaggcttgggaagaaggagtgtgcggtatacgcagtgcaactagattagagaacataatgtggaaacaaataagtaacgaactcaatcatatactactagaaaatgacatgaaattcacagtagttgtcggtgatgtagcagggattctggcccaaggtaagaaaatgatcagaccgcagcctatggaatacaagtactcatggcgatcttggggtaaagccaaaattataggggcggacgtgcaaaatacgactttcattatcgatggaccaaatacaccggagtgtccagatgatcaaagggcttggaacatatgggaggtggaagattacggatttgggatatttacaacaaacatttggctgaaactgcgtgacagttacactcaagtttgtgaccatagactcatgtcagctgctattaaagactccaaagcagttcacgcggatatgggatattggatagaatcagagaaaaatgaaacttggaagttagctagggcctctttcatagaagtaaaaacctgtatatggccaaaatcccatactctgtggagtaacggtgtgttggaatccgaaatgataataccaaaaatatacggaggacccatatcgcagcataattatagaccaggctacttcacacaaacagctgggccatggcatttaggaaaattagaattagactttgatctgtgtgaaggaacaacagtcgttgtagatgaacattgtggaaaccggggcccgtcgttacgtacaactacagtaactggcaagattatacacgaatggtgttgtcgttcatgcacactacctccactccgattcagaggagaagatggctgctggtacggaatggagatcaggcccgtgaaagaaaaagaagaaaatttggttaagagtatggtttcagcgggctctggagaagtcgatagctttagcttaggactactatgcataagcattatgattgaagaagtcatgcgaagcagatggagtaggaaaatgctgatgaccggaactctcgcagtatttctattattaattatgggacaactaacttggaatgatttaattagactatgcataatggtaggcgcaaatgcgagcgacagaatgggaatgggcaccacttatctcgcactaatggcgacttttaaaatgcgtccaatgttcgccgtagggttgttatttcgaaggctcacctcaagagaagtattgttattaactataggcctcagcttagtcgcgtcagttgaattacctaacagcttggaagaattaggtgatggtttagctatggggatcatgatccttaagctattaacagacttccaaagtcaccaactttgggcgacacttctcagtttaacgtttattaaaacaaccttttccttacactatgcatggaaaactatggcaatggtattatctattgtatcactctttcccttatgtttatcgacaacgagccagaaaactacctggctaccagtgttactcggaagtttgggctgtaaacctctaacaatgtttctgatcgctgaaaacaaaatttggggtagacgatcttggcccttaaatgaaggaatcatggctgtcgggatcgtgagtatattactaagctctctcttgaaaaacgatgtaccccttgcagggcccctgattgcgggcggaatgttaatagcatgttatgttatatcaggatcatcagcagacctatctttggaaaaggcagcagaggtgtcttgggaagaggaagcggaacattccggcgcctcacataatattctggttgaagtacaagacgacggaacaatgaaaattaaagatgaggaaagggacgatacattgacaatactattaaaagcaacgctccttgcagtctccggcgtgtaccctctatctataccagccaccctttttgtatggtatttttggcaaaagaagaaacaacgaagtggggttctttgggatacgcctagtccaccagaggttgagagggctgtattagacgacggcatataccgcataatgcaaagagggctactaggaaggtcgcaggtaggggtcggagttttccaagaaaatgtctttcacactatgtggcatgttacacgtggcgcagtactaatgtatcaggggaaacgcttagaaccttcttgggcaagtgtgaagaaagacttaatttcgtatggaggtggatggagattacagggaagttggaacaccggtgaggaggttcaagtaattgcagtcgaacctggcaaaaaccctaaaaatgttcaaactgccccgggtacatttaaaacacctgaaggtgaggtcggtgctatcgctctagattttaaacctggcacttcaggtagcccaatagtcaacagagaaggtaaaatagtagggctctacggaaatggagtcgtcactacaagcggaacgtatgtttctgccattgcacaggctaaagccagccaagaaggtcccctaccagaaattgaagatgaagtatttcgtaagcggaatctcactattatggatctacacccaggatcaggtaaaaccagaaggtacttgcccgcaattgtgcgggaagcaataaaacgtaaacttagaaccctaatacttgcaccaacacgtgtcgttgcctcagaaatggctgaagctctaaaaggaatgcctataaggtatcaaacaactgctgtgaaaagcgagcatactggaaaggaaattgtagatcttatgtgtcacgcgacattcacaatgagactgttaagtcctgttagagtcccaaattacaatatgataattatggacgaggcccactttacggatccaagttcaatagctgctcgaggttacatttcgaccagagtaggcatgggtgaagcggcggcaatatttatgactgccacgccgccagggtccgttgaagcatttccacaatcaaacgctgtgatccaagatgaggaaagagacattcccgaaagatcctggaactctggctatgagtggataactgacttcccaggaaaaactgtctggttcgttccgtcaattaagagtggaaacgacattgccaactgtttgaggaagaatggcaagcgagttatccaattatcaagaaagacctttgacacagagtaccagaaaaccaaaaataacgattgggactatgtagtaaccacagatataagtgaaatgggagcaaactttagggctgaccgtgtaatagaccctcgaaggtgtctaaaaccagtcatactaaaagacggaccggaacgagtgatattagcaggtccaatgccagtaacagttgcttcagccgcgcaaagacgaggccgtataggcagaaatcataataaagaaggtgatcaatatatctacatggggcaacccttaaataacgatgaagaccatgcgcattggacagaggcaaaaatgctactagacaatataaacactccagagggcataatccctgcgctgtttgaaccagaaagagagaaaagtgcggcaattgacggcgaatatcggctgagaggagaggctcgtaaaacatttgtagaactaatgagaagaggggatctaccagtatggcttagttacaaagtggcaagcgaagggtttcaatacagtgaccgaaggtggtgctttgacggcgagagaaataatcaagtcctggaggaaaatatggatgtagaaatatggacgaaggaaggagaacgtaagaaattaagaccacgttggcttgacgctcgtacatatagtgacccgctcgcattgcgggaatttaaagagttcgcagctggcaggagaagtgtctccggggatttaatattggaaatcggcaaattgcctcagcatctcacacagagagcacagaacgcattggacaatctagttatgctacacaacagcgagcaaggagggcgggcataccgtcatgcaatggaagagttacctgatacgatagagactctaatgctactcgctttaattgctgtattgactggtggcgtcacgctattctttcttagcgggcgaggtctcggcaaaacgtcgataggattactatgtgttatggcatcaagcgttctcctctggatggcaagtgtcgagccacactggatcgcagcatctataattctggaatttttcctaatggtattgctgataccggaaccagacagacaacggacgcctcaggacaatcaacttgcttacgtagtaataggactacttttcatgatactaacagtggcggccaatgaaatggggttattagaaacaaccaagaaagacttagggattggtcatgttgcagtgggcaaccaccaccatgccgccatgttagatgtagacttacacccagcctcggcatggactctatatgctgtggcgaccaccataattacaccgatgatgagacatacaatcgagaatacaaccgccaatatatctctaactgctatagcgaaccaagccgcgatattaatggggctagacaaaggatggccgataagtaaaatggacattggagtgcctttactagcgttaggatgctactcacaggtaaaccctctaacgttaacggcagctgtcttaatgttagtagcccattatgcaataataggaccagggctccaggcaaaagcgacaagagaagcacaaaagcgaactgctgcaggaataatgaagaatccaacagtagacggcatagtagccatagatcttgacccagtggtatacgatgccaaattcgaaaaacaacttggacaaatcatgcttctaattctttgtacctcacaaatcctattaatgcgtacaacatgggcattatgtgaatcaatcacattggcaacaggacctctgaccacactctgggagggctcaccgggcaaattctggaacacaaccatagcagtcagtatggctaatattttcagggggagttatttagcaggagcaggactagcgtttagtctgatgaaaagtttaggaggaggaaggcgtggcacgggcgctcaaggcgaaacacttggtgaaaaatggaaacgtcaactaaatcaactatccaagagcgaatttaatacatataaacgaagcggcataatggaagttgataggtcagaagcgaaagaaggactaaaaagaggagaaataaccaaacacgcagtttcacgagggaccgcgaaacttaggtggtttgttgaacgtaacttagtaaaacctgaagggaaagtaatagacctaggatgtgggagaggaggctggtcatattactgtgcaggtctaaagaaagtcactgaagtaaaaggatatacaaaaggtggaccgggtcacgaagaaccgattcctatggcaacttacggatggaatcttgttaagctacattctggtaaggatgtattctttgtgccaccagagaaatgcgatacactactttgtgatatcggggaatcgagtccaaacccgacgatagaagaaggtcgcacactccgtgttttgaaaatggtagaaccatggttacgcggaaaccaattctgcataaagatcttaaacccatatatgccttcagtagttgagactttagaacaaatgcaacggaaacatggaggtatgcttgtacgaaatccactatctcgtaatagtacccacgagatgtattgggtaagttgtggaactggtaacatcgtttcagcagtgaacatgacatcccgcatgcttttgaatcgatttactatggctcacaggaagcctacgtacgaaagagacgttgatttaggtgcggggacacggcatgtagctgtagaacctgaagtagctaacttagacatcattggacagcgaattgaaaatataaaacatgaacacaaatcaacatggcactatgacgaggataacccatataaaacgtgggcataccacggatcttatgaagtaaaacctagcggttcggcgtctagcatggtaaatggagtagtaaaactactcacaaagccatgggacgtgatacccatggtgacccagattgcgatgaccgacactacgccgtttggtcagcaaagagtattcaaagaaaaggtggacacaagaacaccaaaggccaagcgcggtacagcacagataatggaagtaacggccaaatggctatggggatttttatcacgaaacaaaaagcctaggatttgtacacgagaagaatttacccgcaaagttaggagtaacgcagctataggtgctgtttttgtagatgaaaaccaatggaactcagctaaagaagctgtcgaagatgagcgattttgggatctggttcatcgagaaagagaactgcacaagcaaggtaaatgcgccacatgcgtatacaatatgatgggaaagagggagaagaaattaggtgagttcggcaaagcaaagggaagtagagccatatggtatatgtggttgggagcaagattcttagagttcgaagcattaggttttatgaatgaagaccactggttttctagagaaaactcattatctggtgtagaaggagaagggctacataagttaggatacatattgcgtgacatatccaaaataccgggtggtaacatgtatgcagatgataccgcagggtgggatactagaattacggaagacgacttgcaaaacgaagccagaattacagacataatggaaccagaacatgctctgttagcgaagtcaatttttaaattaacttatcaaaataaagtggtaagagtgcaaagaccagctaagaacgggacagtcatggatgtaatatcaagaagagaccaacgtggttccggacaagtcggaacatacggcttaaatacattcacaaacatggaggcgcaactcatccgtcaaatggagagcgaaggaatcttctcaccttcagaactagaaactccgaatctagcggaaagagtgttagattggctcgaaaaatacggtgtagaacgactaaaaagaatggccataagtggagacgactgtgtagtaaaaccaatagatgatcgatttgctacagcacttacggcgctaaatgatatgggtaaagtgaggaaggatatacctcaatgggaaccctcaaagggatggaacgattggcagcaagtaccattttgttctcaccattttcatcaactgatcatgaaggacggtcgggaaatcgtggttccttgtcgtaatcaagatgagcttgttggtagggctcgtgtcagtcaaggtgccgggtggagcctaagagagactgcatgtctaggaaaaagttatgcacaaatgtggcagttgatgtatttccatagacgagatctacgtttagctgcgaatgcaatctgttccgctgtgccagtagactggattcccacctctagaaccacatggtcaatacatgctcatcaccaatggatgacaacagaagacatgttgagtgtctggaatagggtttggatagaagaaaacccttggatggaggacaaaacacatatttcaaactggggagatgtgccttatctaggaaaaagagaggaccagtggtgtggttccctgattggactaactgctcgagccacatgggctacgaatatacaagttgcaataaatcaggtgaggcgcttaattggtaacgaaaactacctcgattacatgacgtcgatgaagcggttcaaaaatgaatcagatccagagggtgctttatggtaa

SEQ ID NO: 21207 - RNA, 9879 nt, synthetic construct
  misc_feature 1..9879: note = derived and/or modified CDS sequence (opt6) from DENV-1__FJ639695__SS-prME
  source 1..9879: mol_type = other RNA
tccgttacaatgctattgatgctaatgccaacggctctagcatttcatctgactacacgagggggtgaaccacacatgatcgtaagcaaacaagaacgtgggaaaagtttactatttaaaacaagtgcaggggtaaatatgtgtacgttaatagcaatggacttaggagaactatgcgaagacacaatgacgtacaaatgccccaggataacagaagctgaaccagatgacgtagactgttggtgcaatgctacagacacatgggtaacatacggtacttgcagccaaacgggagaacatagaagagataaaagatcagtagctctcgcaccacatgttgggttaggactggaaactcgcacggaaacgtggatgagtagtgaaggggcgtggaaacaaattcaacgggtagaaacatgggcactaaggcaccccggttttacggtaattgctctttttctagcacatgcaatcggaacatctattacccaaaaaggcataatttttatattgttaatgcttgttacgccgtctatggcaatgagatgtgtaggaatcggttcacgagattttgtggaagggttgagtggagccacatgggtggatgttgttttagaacatggaagctgtgtaacaacaatggctaaagataaaccaaccttagatatagaattattaaaaacggaagtaacgaatccagcgatactccgtaaactctgcatagaggcgaaaataagtaacacaactacagatagcagatgcccgacccaaggagaggcaactttagtagaggaacaagacgctaattttgtgtgccgaaggacttttgtagatagaggatggggtaatggttgtggcctctttggcaaaggctcattgatgacgtgcgcaaaatttaaatgcgtaactaaactagaaggtaaaatagtgcagtatgaaaatttgaaatatagtgtcattgttacggttcatacgggtgatcaacatcaagttgggaatgagagcactgaacatgggactaccgctacaattactccacaagctcctacaacagaaattcaactcactgattacggagcgctaaccctagattgctccccaagaactggactagattttaacgaaatggtattgttaaccatgaaagaaaaatcttggctcgtacacaagcagtggtttttagatttaccgcttccttggacctccggggccagtactagccaagaaacatggaatagacaagacctactcgtcacgtttaaaacagcacatgcaaagaaacaggaagtcgtagtgttagggagccaggagggtgctatgcacaccgctttgacgggtgcaacggaaatacagacgtcaggtacaacaacaatatttgctggccatttaaaatgccgacttaaaatggacaaattaacattaaaagggatgtcatatgtcatgtgtacgggatctttcaaactagaaaaagaagtagccgaaacacaacatggaacagtcctagtacaaataaagtatgagggaaccgacgcaccgtgcaaaatccctttttcaacgcaggacgaaaagggagtaacacaaaatggaagacttataacagcaaatccgattgtgactgataaagaaaaacctgtaaacattgaggcagagcctccgttcggtgaatcttatatcgtgataggcgcaggagaaaaggctttaaaactaagctggtttaagaaaggatcgagcataggaaaaatgtttgaagcgaccgcacgaggcgcgcgtcggatggcaattttaggtgatacggcttgggatttcggttcaattggtggagtcttcacttcagtaggaaaattagttcatcaaatattcggtacagcttatggagttttgttctcaggtgtatcatggacaatgaaaattggtctcggagtactccttacatggctaggtctaaactcaagatctaccagtctaagcatgacatgtattgcagtgggcctagtaacactttacttgggtgttatggtacaggctgacagcggatgtgttatcaattggaaaggaagagagctaaagtgtggatcgggaatatttgtcacaaatgaggtacatacatggacagaacaatacaaattccaggcagactcaccaaaacgtttgtctgcggctattggtaaagcgtgggaagaaggcgtgtgcggcataaggtccgcaacacgtcttgaaaatatcatgtggaagcaaataagcaacgaattgaatcacatactactcgaaaacgacatgaagttcactgtcgtcgtcggtgatgttgccggtatactcgcacagggcaagaaaatgataagaccccaacctatggaatataaatattcatggaagtcttggggaaaggcaaagatcataggagcagacgtacaaaacacaacgtttataattgatggaccaaacacaccggaatgccccgatgatcagcgagcttggaacatatgggaggtcgaagactacggctttggaattttcacaactaacatctggttaaaactccgggactcatacacacaagtatgcgaccatcgactgatgagcgcagccatcaaagatagtaaggccgtacatgcagatatggggtactggattgaaagcgagaagaatgaaacatggaaattggctagagcttctttcatagaagtaaaaacatgcatctggccaaaatctcatacactatggtcaaatggggttctggagtctgagatgataatcccaaaaatctacgggggtccgattagccaacacaattatcgaccgggctattttacacaaactgctggaccatggcacttggggaaattagaactcgactttgatctgtgtgagggaacaacagttgtagtcgatgaacattgcggaaacaggggcccctcattaagaacaaccacagttaccggaaaaataatacatgaatggtgctgtaggagttgtacactacctccattacgctttcgaggcgaagacggatgctggtatggaatggaaataagacccgtgaaagagaaagaagaaaatttagtgaaaagtatggtaagcgcaggttcaggagaagtcgactcatttagcctaggtctattatgcattagtatcatgattgaagaggttatgagaagtaggtggagtagaaaaatgttgatgacagggacgctagcagtcttcttattactaattatgggtcagctaacatggaatgatttgattcgactatgcatcatggtgggtgctaatgcgagtgatcgaatgggaatgggcactacataccttgcgttaatggcgacattcaaaatgagaccaatgtttgctgttggtttgctctttaggaggcttacaagtcgagaagtgctattgctaaccattggactcagtctagtcgcctctgtcgaactccccaattcattggaagaactaggcgatggactagcaatggggatcatgatattaaaattactaacggattttcaatcacatcaactctgggccaccttgttatcactaacgttcataaaaacaacattttctttacactatgcatggaaaacaatggcaatggtcttgtctattgtcagtttattcccactatgcctctctacaacaagtcagaagactacctggttaccggttttattagggtcattggggtgtaagccattaacaatgtttcttattgccgagaataaaatctggggaaggcgctcttggcccttaaacgaaggaattatggctgtaggaatagtgtctattctattgtctagtctgctcaaaaacgatgttccgctggcaggaccacttattgctggcggtatgctcatagcgtgttatgtaatctcgggcagcagtgctgatctcagtttagagaaagcagcagaagtgtcctgggaagaagaggccgaacatagcggggcatcgcacaatattttagtagaagtccaagatgacggtacaatgaagatcaaagatgaagaaagggacgatacattaacaatattattaaaagcgacattgctggcggtttcaggtgtttaccccctcagtataccagctacactattcgtttggtatttttggcaaaagaagaaacagcgaagtggagttttgtgggacactccgagccctcctgaggttgagcgcgccgttcttgacgatggcatatatcgcataatgcaacgaggattgcttggtagatcacaagtcggagttggggtcttccaagaaaacgtattccatacaatgtggcacgtaactcgtggagcagtcctgatgtatcaaggtaaaaggttagaaccgtcatgggcttcagtgaaaaaggatctaatcagttacggtgggggatggcgacttcaaggttcatggaacacaggtgaagaagttcaagtaatagctgtagaacctggcaaaaatccaaagaacgtacaaacagcacctgggactttcaaaacacctgagggagaagtcggcgcaatcgcgttggattttaaacctggaacatcaggcagtccaattgtaaacagggaaggaaagatagtaggtttatatggaaacggtgtagtaacaacgagtggaacatacgtttctgcaatagcgcaagcaaaggctagccaggaaggaccgttaccagaaattgaagacgaagtatttagaaaacgtaatctgaccatcatggacctgcaccctgggtccggaaaaacacgtcgctacttaccggcaattgttcgggaagctatcaaaagaaagttgaggacccttatattagctccaacaagggtggttgcatcagaaatggcagaggctttgaagggaatgcctattcgttaccaaaccaccgctgttaaaagcgaacacacaggtaaggaaattgtcgatcttatgtgccacgccaccttcacaatgcgcttgctcagtcctgtaagagttcccaactataatatgataataatggatgaagcccactttacagatccctcatctatagccgcaagaggatatatatctacccgagtcggaatgggagaagccgcagcaatcttcatgactgcaaccccaccaggatctgtcgaggctttcccccaaagcaatgcagtaattcaagatgaagaacgagatattccagaacggtcatggaactcaggatatgaatggataaccgatttcccgggaaaaacagtttggttcgtaccaagcataaagtctgggaatgacattgcaaattgtttaaggaaaaatggaaaaagagtcatacagttgagcagaaaaacttttgacacagaataccagaaaactaaaaacaacgattgggactacgtggtgaccacagatatttcagaaatgggggccaactttagggcggatagagtaatagatcctcgtcgctgtctaaaacccgtaatattaaaagatggtcccgaaagagtgatattggcgggaccgatgccggtcacggtagcctcagctgcccaaagaagagggagaattggacgaagccataacaaagagggtgaccagtacatatatatgggacagcccttaaataatgacgaggaccatgcacattggacagaagctaaaatgcttttagataacataaacacacctgagggcattataccagctctattcgagccagaaagagagaaaagtgccgctattgacggcgaatatagattaagaggcgaagcaagaaaaacatttgtagaattaatgagaaggggtgatctaccagtctggttatcatataaggtcgcatcggaagggtttcaatacagcgatcgtaggtggtgtttcgatggggaacgtaataatcaggttctagaagagaacatggatgtcgaaatttggacaaaagaaggagaaagaaagaaattacgaccaaggtggctggacgccaggacttatagcgaccccctagcattaagagaatttaaagaatttgctgcaggtagacgatcagtatcaggtgatttaatcctagaaataggcaaactaccacaacatctaacacaaagggctcaaaatgccctagacaacttagtaatgcttcataattcagagcagggaggcagggcttatagacatgcaatggaagaactacccgatactattgaaaccttaatgttattggccttaattgcggtgttaactggcggagttactctatttttcctgtcgggtagagggctgggcaaaaccagtatcgggttactatgtgtcatggcgtcctcggtactcttatggatggctagtgtagagccacattggatcgcagccagcattattctggagttctttctaatggtattactcatacctgaaccagacagacaacgaacaccccaagataatcagttagcatacgttgtaattggtctattatttatgatattaacagtcgctgctaacgagatgggtttgctagaaacaaccaagaaagatttggggatcggacatgtagctgtcggaaaccaccatcatgctgctatgctagacgtggacttgcatcctgcctcagcttggacattatacgcagtagccactacaattattactccaatgatgaggcacactatagaaaacacaacggcaaatatcagtttaactgctatcgccaatcaagctgcaattctcatgggattagacaagggctggcctataagtaaaatggatatcggagtacctctgctagctttaggatgctacagccaagtgaaccctctcacactaacagcagctgtactaatgcttgtggcacactatgcaataattggtccaggccttcaagcaaaggccaccagggaggctcaaaagcgaacggcagcgggaataatgaaaaaccctacagttgacggtatagttgccatagatctggaccctgtagtgtatgatgccaaattcgagaagcaacttggtcaaatcatgttacttatactctgtacttcacagatcttattgatgcgaacaacatgggcactttgtgagtcaattacactagctaccggccctttaacaacattatgggaaggaagtcctggcaagttttggaacacaaccatagcagtatccatggcaaatatctttagagggtcctacctcgcaggggcaggccttgctttcagtctaatgaaaagtctcggcggtggacgcagaggaactggcgctcagggggaaacgttaggtgaaaaatggaaaagacaattaaaccaattatctaaatcagaatttaatacatataaacgttctgggatcatggaagtagatagatcagaagctaaagagggcttaaagagaggggaaacaaccaaacatgcagtcagtagaggaacagcgaagctaagatggttcgtagagcgcaaccttgtgaaaccagaaggtaaggttatagatttaggatgcggccgaggtggctggagttattattgtgcgggactcaaaaaggtaacagaagtgaaaggatacacaaaaggagggcccggccatgaagaacctattccgatggctacgtatggatggaatttagttaaacttcattctggcaaagatgtcttctttattccgccagagaaatgtgatacgttattatgcgacataggtgaaagctctccgaatcccacaattgaagagggccgtactttacgtgttctcaaaatggttgaaccttggttaagaggtaaccagttctgcattaagatcttaaatccatatatgccctcagtcgtagagaccctcgaacagatgcaaagaaaacatggtggaatgttagtaagaaatccactctctagaaattccacacatgaaatgtattgggttagttgtggcacaggcaatatagtgagtgctgtaaatatgacttcgagaatgctcttgaatagatttacaatggctcatagaaaaccgacctatgaaagggacgttgatctaggagccggaacaagacacgtcgccgtagaaccagaagtagcaaatctcgatatcattggtcaacgaatagaaaatattaaacacgaacataaatcaacatggcattacgatgaagacaatccctataagacctgggcataccatggttcatatgaagtaaaaccgagtggatctgcgagttccatggtaaatggcgttgtcaaactattaacgaaaccatgggatgtcataccaatggtgactcaaatcgcgatgacagatacgactcccttcggacaacagagagtattcaaagaaaaagtagacacaaggacacctaaggcaaaacgcggtactgcgcagattatggaggttacggcaaaatggctatggggttttctaagtcgaaataagaaaccaaggatatgtacaagagaagagttcacaagaaaagtacgttctaatgcggcgattggagccgttttcgttgacgaaaaccaatggaactcagccaaagaagcagtcgaagatgaaagattctgggatttagtacaccgtgaaagggagcttcataaacaggggaagtgtgcaacttgcgtatacaacatgatgggtaagagggagaagaaattaggcgagttcggaaaagctaaagggtcacgagcgatctggtacatgtggctgggggcaagatttcttgagttcgaggcactaggatttatgaacgaggaccactggtttagtcgggaaaattcactttcgggagtagaaggtgaagggctacacaaactcggatacatcttacgtgatatctcaaaaattccaggagggaacatgtacgcagatgatacagccggatgggacactcgaattacagaagacgatcttcagaatgaagccagaatcacagatatcatggagccagaacacgcattattagctaaatcaatcttcaaactcacatatcaaaataaagtagtaagagtacagagaccggctaaaaatggaacagtaatggacgttatctcacggcgagaccagaggggaagtggtcaagtcggtacttacggtctaaatacgttcacgaatatggaagcccaattaataaggcaaatggaaagtgaagggatcttcagcccgtcggaattggaaactcccaatttagcagaacgagtgttggtatggctggaaaaatacggagttgaaagattaaagcgtatggccatatcaggagatgactgcgtcgttaaacctatcgacgataggttcgcaacagcactcacagcccttaatgatatgggcaaagtacgcaaggatatacctcaatgggagccatctaaaggatggaacgactggcaacaggtaccattttgctcgcatcacttccatcaactcataatgaaagacggaagagaaattgtggtaccgtgcagaaatcaagacgaattagtcgggcgtgccagagtgagtcagggagcagggtggagcttaagggaaacagcttgtttaggtaaaagctatgcacagatgtggcaattaatgtattttcatcgtcgagatctcagattagcagcaaacgctatatgtagcgccgtaccagtcgattggattcctacatcaaggactacctggagtatacacgctcatcatcagtggatgacgacagaagacatgcttagtgtatggaatagagtgtggattgaagaaaatccttggatggaggataaaacgcatatatcgtcttggggagatgtgccttatctcgggaaaagagaagaccaatggtgtgggtccttaattggacttacagcacgggcaacatgggccaccaatatacaggtagctattaatcaagtaagaaggctaattggcaacgaaaactacctagactacatgacatccatgaaaaggtttaagaatgaaagtgatcctgaaggagcgttatggtag

SEQ ID NO: 21208 - RNA, 9879 nt, synthetic construct
  misc_feature 1..9879: note = derived and/or modified CDS sequence (opt6) from DENV-1__FJ639696__SS-prME
  source 1..9879: mol_type = other RNA
agtgttacaatgcttcttatgctgatgcccacagcacttgcatttcatcttacgacaagagggggagaaccccacatgatagtttcaaaacaagaaagaggtaaaagtttattgttcaaaacaagtgcgggagtaaatatgtgcacacttatagctatggatttaggggaattttgtgaagacaccatgacttacaaatgtcctagaatcagtgaagcagaaccggacgatgttgattgctggtgtaacgccacggatacttgggtgacttatggaacatgtagtcaaaccggagaacacaggcgagataaacggtcggttgcacttgctccccatgtggggcttggtcttgaaacaaggaccgaaacatggatgagttcagaaggtgcgtggaaacaaattcaaagagtagaaacatgggctttaagacatccaggatttacagtaatagcccttttcttggcccacgctattggaacatcaataactcagaaaggtataatatttatcttgttaatgctagtaacacctagtatggctatgagatgtgttggaataggtagtcgagattttgtagaagggctttcaggtgcaacatgggtcgatgtagttttggaacatggcagttgcgtaactactatggcaaaagataaaccaaccttagacatcgaattacttaaaacagaagttacgaatccagcggtactgaggaaactatgtatcgaagcaaaaataagcaatacaactacagacagcagatgtccaactcaaggcgaagcaaccttagtagaagaacaggacgctaatttcgtttgtagacgaactttcgtagatcgcggttggggcaacggttgtggactgttcgggaaaggaagtttaataacgtgtgcaaaattcaaatgcgtcacgaaattagaggggaaaatagtgcaatatgaaaacctcaaatactcagtaatagtaactgtacatacgggtgaccagcaccaggtcggcaacgaatcaacagaacacgggaccacagcgacaatcactccccaggcgccatcaacggaaatacagctcacggattatggcgcgctaacgttagactgctcgcccagaacgggacttgatttcaacgaaatggtattgttgactatgaaagaaaaatcatggctagttcacaaacaatggttcttggatttacccctaccatggacgtccggagcatctacttcgcaagaaacctggaataggcaagatttactcgtaacatttaagactgctcacgccaagaaacaggaagtagtagtactcgggtcacaagagggagcaatgcacacagccctgacgggcgcaactgaaatacaaacatctggaactaccactattttcgcggggcacttgaagtgtagactgaaaatggacaaacttacccttaaaggcatgagttatgtaatgtgtactggcagctttaaacttgaaaaagaggtagctgaaactcaacatggtactgtactcgtccaaataaaatatgagggaacagatgcaccttgcaaaatacctttcagcacgcaagatgaaaagggtgtgacacaaaatggtagacttataacagctaaccctatagtaacagataaagaaaaaccggtaaacattgaggcagaacctcctttcggcgaaagctacatagtaattggtgctggtgagaaagccctaaaattatcttggttcaagaaagggagttctatagggaaaatgtttgaagcaactgcacgaggagcacggcggatggctattttaggggacacagcatgggactttggatcgataggaggagtatttacatcagtgggcaagctagttcaccaaatctttggcacggcatatggtgtcctattctcaggcgtgagttggactatgaaaatagggatcggagtattactcacctggttaggactaaattcccgatcaacctccctatcaatgacttgtatcgcagtaggattggtaacattgtatttaggggtcatggtccaagccgacagtggatgtgtgattaactggaaagggcgcgaactgaaatgtggaagtggcatatttgtcacgaacgaggtacatacttggacagaacagtacaaattccaagctgactcacctaagcggttaagtgctgctattggtaaagcatgggaggagggtgtttgtgggatcaggtcagcgactcgactagaaaatatcatgtggaaacagatctcaaacgagcttaaccatattctgttggagaacgacatgaaatttacggttgtcgttggagacgtcgcgggcatcttagcacagggcaagaaaatgatccgcccgcagcctatggaatataaatattcatggaaatcctgggggaaagctaaaatcattggagccgacgtccaaaatacgacatttattattgatggaccgaacaccccagaatgcccagatgatcaacgggcatggaatatttgggaggtagaagactatggattcggaatatttacaacgaatatttggttaaagttaagggatagttatacacaagtctgtgatcatagactaatgtctgcagctattaaagattccaaagctgtgcatgcagatatgggatattggatagagtccgagaaaaatgaaacgtggaaattagcgagggcatcgtttatcgaagtaaaaacatgtatatggccaaaaagccacacgctatggagtaatggtgttcttgaatccgaaatgatcatacctaaaatatatggtgggccgatatctcaacataattatagacctggatattttactcaaacagcgggaccatggcacttaggtaaactggaactagattttgacttgtgtgaagggacaacagtcgttgtggatgagcattgcggaaatagaggccccagcttaaggacaacaacggtgactggtaaaataatacatgagtggtgctgtcgttcttgcacgctaccacccctgcgttttaaaggagaggatggctgctggtatggaatggagatacgaccagtaaaagaaaaggaagaaaatctagtcaaaagtatggtctctgcaggcagtggtgaggtcgattcgtttagtctaggccttttgtgtatctcgataatgatagaagaagtaatgcgatcacgctggagcagaaagatgctaatgacaggcactcttgcggtattctttcttctaattatgggacaactcacctggaatgacttaatcagattatgtataatggttggggcaaacgcatccgacaggatgggaatgggcatgacgtatttggctttgatggcgacattcaagatgagaccaatgtttgcagtggggcttctcttcagacgattaactagcagggaagtacttttgttaaccataggtctatcattagtggcttctgtggaacttccaaacagtttggaagaactcggggacggattagccatgggaattatgatattaaaacttttaacagattttcaaagtcatcaattatgggcaacacttttatctctcacattcataaaaaccacattttcgttacattacgcatggaagacgatggcaatggtgctatctattgtcagtctgttcccgttgtgcttaagcactacgtcacaaaagacaacctggcttcctgtacttttaggcagtttaggctgcaaacctttaacaatgttccttattgccgaaaataaaatatggggaagaaagtcgtggccactcaatgaaggaataatggccgttggcatagtttctatattactgtcatcattattgaaaaacgatgttccactagctggacctttaattgcgggaggtatgctaatagcctgctacgtgatcagcggttccagcgctgatctcagcttggagaaagctgcggaagtgtcctgggaagaagaggcagaacattccggagcaagccacaatattctagtcgaagtccaagatgatgggacaatgaagataaaagacgaggaaagagacgatactttgacgatactattaaaagccacactcttagctgtatcaggagtatatccattgtcaatacctgccactctcttcgtatggtatttttggcaaaagaagaaacagcgatccggggttctttgggacacacctagtccaccggaagtggaacgagccgtactcgatgacggaatataccgaatcatgcagcgtggccttcttggtagaagccaagtaggcgtcggggtgtttcaagaaaacgtttttcacacgatgtggcatgtcacgagaggtgcagtcttaatgtatcagggtaaacggcttgagccctcatgggcgtctgtgaaaaaggatttaatttcttacggtggtggttggcgtctccaaggatcttggaacacgggtgaagaagtacaggttattgccgtggagcctggcaaaaaccccaaaaatgtccaaacagctccgggaactttcaagacatcggaaggcgaagtgggagcgattgctctagactttaaacctggcacttctggaagtcctattgttaatagagaaggtaagatagttggtctatatgggaacggagtagtcacaacatcaggaacatatgtatcagctattgcacaggcaaaagcaagtcaggaaggaccactacctgagattgaagatgaagtatttaggaaaagaaatctgacaataatggacttacatcccggctcgggcaagacaagacgttatcttccagcaatcgttagggaagcaataaaaagaaagctccgaactctaatacttgcaccaacaagagtagtagcgagtgaaatggcggaggcacttaaaggaatgccaatacgctatcaaactacagcggtaaaatctgagcacacggggaaagagatagtggatctgatgtgtcatgctacttttacaatgaggctattatctccagtgcgtgtcccaaattataacatgatcataatggacgaagcacattttactgacccttcctcgatagcagcacgaggatacatttctacaagggtaggcatgggcgaagcagcagccatcttcatgaccgccactcctcctggaagtgttgaggcatttcctcagtcaaatgcagtaattcaggacgaagaacgagatattccagaaagaagttggaatagcgggtacgaatggatcacagactttccaggtaaaactgtttggtttgtaccgtccattaaaagtggcaacgacatcgcaaactgccttaggaaaaacggcaaacgcgttatacagctgtccagaaagacattcgacactgagtaccagaaaacaaagaacaatgattgggactacgtagtcactactgacatttctgagatgggtgcgaactttagggccgatagagtcattgacccccgaagatgcctcaaaccagttatcttaaaggatggacctgaaagggtgatacttgcaggaccaatgcctgtaaccgtagcgtcggcggcacagagacgaggaaggataggaaggaatcacaataaagaaggagaccaatatatttatatgggacaaccactaaacaacgacgaagatcatgcacactggactgaggcgaaaatgttactagataacattaatactcccgaaggaataatacctgcgctgttcgagccggaacgggagaaaagtgcggctatagatggagaatataggcttcgaggagaggcgcgtaaaacatttgttgaacttatgagaagaggcgatctaccagtgtggctgagttacaaggtagcatctgaaggtttccagtattccgaccgacgatggtgttttgacggtgaaaggaataatcaagtattagaagaaaacatggacgtagaaatatggacaaaagaaggagaacgaaagaaactcagaccaagatggttggacgcaagaacctattctgatccattagccctacgagaatttaaagaatttgctgcaggacggagatccgtcagcggagatcttatacttgagataggaaaacttccgcaacatcttacgcaaagagcacaaaacgcacttgataacttagtaatgctacataactcagaacaagggggaagggcttaccgacatgcaatggaagaattacctgatactattgaaacactaatgttgctggcgctcatcgcggtgctgacgggtggggttacgctattctttctttcaggccggggacttggaaaaacttcaattggacttctatgtgttatggccagtagtgtattattgtggatggcatctgtggaaccacattggatagcagcttcgattattctggagttctttctgatggtcctactaattccagaaccagatagacaaagaacaccccaagacaaccaacttgcctatgtggtgattggcttattgttcatgattttgacagtcgctgcgaacgaaatgggtctattggagactaccaagaaagacctaggtataggtcatgtggcggtagagaaccaccaccatgcagctatgcttgatgtagatcttcatcctgctagcgcatggacgctgtacgcggttgcaacaacaattataacacctatgatgcgccatacgatagagaacaccacggcaaacatatctctcaccgcaatagcaaaccaagcggctatactaatgggactagataaaggatggccaatatcaaaaatggatataggcgtacctctattagctctagggtgttattctcaggtaaatccattgaccctgacagcggctgtactaatgttagttgcccactatgcaataattggtccaggccttcaagcaaaggccactcgggaggcccagaagagaacagcagctggaataatgaaaaacccaacagtcgacgggattgtagccatagatctcgatcctgtagtttacgatgccaaattcgaaaaacaactcggacaaattatgctgctaatcctttgtacatcccagattctgctaatgcgaactacttgggcgttatgcgaaagtataaccctcgctaccggaccattaactaccttatgggagggatcaccaggtaaattttggaatacaactatagcagtatcaatggctaacattttcagaggatcatatctcgcgggtgcaggattagcgttctcacttatgaagagtttaggtggtggcagaagagggaccggtgcacaaggcgagacattaggcgagaagtggaaaagacaattaaaccaactttcaaaaagtgaatttaacacctacaaaagatcaggaataatggaggtagatcgaagtgaggcgaaagaaggtcttaaaagaggggaaaccactaaacatgccgtcagcaggggcacggcaaaactccggtggtttgttgaaagaaatctagttaaaccagaagggaaagtaatagatttaggctgcggtcgtggaggatggtcatactactgcgccggtttgaaaaaggtaacagaggtaaagggttatacgaaagggggaccggggcatgaagaacctatcccaatggcaacatatggctggaatctagttaaattgcactctggaaaggatgtattctttgtaccgccggaaaaatgcgatacgctactatgcgacatcggtgaatctagcccgaatccgacaatagaagagggcagaactttaagggtactaaagatggtcgaaccgtggttacgaggaaatcagttttgcataaagatacttaacccttatatgccgtcagtagtagagacattggagcaaatgcagagaaaacacggaggtatgctggtgcgcaaccctctttcgagaaattctacacacgaaatgtactgggtgtcgtgtgggacaggaaatatcgtgtctgctgttaacatgaccagcagaatgttactgaatagatttacaatggcacaccgcaaaccaacttatgaaagggacgtagatttaggtgctggaacccgccacgtagcagttgagcctgaagtagcaaatctagatattattggtcaaagaatagaaaacataaaacacgagcataaaagcacatggcactatgatgaagacaacccttacaaaacatgggcgtatcacggatcatatgaagttaaacccagtgggagtgcatccagcatggtaaacggggttgtaaagctgttaacaaaaccgtgggatgtcattccaatggtaacacaaattgctatgacagacacgacgccatttggacagcaaagagtattcaaagagaaggtcgatacacgcaccccaaaagctaaaaggggaacagcacagattatggaagtaactgctaagtggttatgggggttccttagtagaaataagaaacccagaatatgcactagagaagaatttaccagaaaagttaggtctaacgcagcgattggagcagtgtttgttgatgaaaaccaatggaacagcgcgaaagaagctgttgaggacgagcgattttgggacctagtacatagagagcgagaattacacaaacaaggaaagtgcgcaacttgtgtatacaatatgatgggaaaaagggaaaagaaattgggtgagttcggaaaggccaagggatcaagagccatatggtacatgtggttaggcgcaaggttcttagagttcgaagcattaggattcatgaatgaagatcattggttcagtagagagaacagcctaagtggcgtagaaggagaaggattacataaattaggctatatcttgagagatattagcaaaattagtggaggaaatatgtacgccgacgacactgcgggatgggataccagaatcaccgaagacgatctccaaaatgaggctaaaataacagacataatggaaccagagcatgctctattagccaaatcaatatttaagctaacttatcagaacaaagtcgtgagagttcaaagaccagccaaaaacggtactgttatggatgtcatatcgcgcagagatcagcgaggctcgggacaagttggtacatacggacttaatacgtttacgaatatggaggcccaattaataagacaaatggaaagcgaaggaatattttccccatcggagcttgaaacaccaaatttagcggagcgggcgcttgactggcttgagaagcatggcgtcgaaagactaaagagaatggcaatttcaggagatgattgtgtcgttaagccaatagatgatcgatttgctactgcgctgacagctttgaatgacatgggaaaagtcaggaaagacattcctcagtgggaacctagtaagggctggaatgattggcagcaggtacctttctgctcacaccactttcatcaacttataatgaaagatggtcgggaaattgtagtcccttgtcgaaatcaagacgaattagtaggtagagctcgagtaagtcaaggggcaggatggagtttgagagaaaccgcttgtttaggaaaatcatatgcgcagatgtggcaactaatgtattttcaccgaagagatttgaggttagcagcaaatgctatttgttcagctgtcccagtggattgggtaccaacatcacgtacaacttggtcgatacatgctcatcatcagtggatgacaaccgaagatatgttgtcagtctggaatagagtatggattgaagagaatccatggatggaagataaaacgcacatcagctcatgggaagatgtcccctatctagggaaaagagaagatcaatggtgtggatctctcataggcctaaccgctagagccacttgggcaacaaatatacaggttgccattaatcaagtacgtagattgattgggaatgaaaattatctagactatatgacgagtatgaaaaggtttaaaaatgaaagcgatctggagggagctctatggtag

SEQ ID NO: 21209 - RNA, 9879 nt, synthetic construct
  misc_feature 1..9879: note = derived and/or modified CDS sequence (opt6) from DENV-1__HM181937__SS-prME
  source 1..9879: mol_type = other RNA
agtgtaacaatgttgctcatgctaatgccaactgcactggcatttcatcttacaacaagaggaggagaacctcatatgattgtatcgaaacaagaaagagggaaatccttattattcaaaacatccgcgggtgtgaacatgtgtacattaattgctatggaccttggagaactctgcgaagatacaatgacctataaatgtcccagaattacagaagctgaacctgatgatgttgattgctggtgtaatgccacagacacatgggtgacttatggaacatgttcacaaacgggggaacacagaagagataaaagaagtgttgccctagcacctcacgttgggcttgggttggaaacgagaacagaaacatggatgtcttcagaaggagcatggaaacaaattcaacgcgttgagacttgggcactcagacatcccgggtttacagtgattgcactgttcctagcgcatgccatagggacaagcataacacaaaaaggaattatctttatactactaatgctagtcacaccaagcatggccatgcgatgcgtaggcattgggtcaagagatttcgtggagggactgagcggagcgacctgggtagatgtagtactagaacatggttcctgcgtaaccactatggcaaaagacaaacccactttagacatagaactattaaaaaccgaagtcacaaatcctgctattctacgaaaactttgtattgaagcaaaaatttccaatacaacaactgattcacgatgcccgacacaaggtgaagctacacttgtcgaagaacaggatgcaaatttcgtatgccggcgcacttttgtggacaggggatggggcaatgggtgtggtctttttgggaaaggttccctgattacatgtgccaaattcaaatgcgttacgaaattagaaggtaaaatagtgcaatatgaaaatctaaaatatagcgttattgttacagtacatacaggagatcaacatcaagtcggtaatgaatcaacagaacatggcactacggcgacgataacaccacaagcaccaacaactgaaatacaactgacagattatggcgcactgactctagactgctcaccacgcacggggttggacttcaatgagatggtactactaacaatgaaagagaaaagctggttggtacataaacaatggtttctcgatttaccattaccctggacaagcggagcttcgacaagccaagagacatggaatagacaagatttactcgtgacattcaaaacggcacatgctaagaaacaggaagtagtggtgttaggtagccaagaaggagcaatgcacacagccttaaccggagcaacagaaatccaaacgtcaggaacaactaccatattcgcgggtcatctcaaatgtagactcaaaatggataaattaactctaaaagggatgtcatatgtaatgtgtacagggtcgttcaaattagaaaaagaagtggctgaaacacaacacggcacggttcttgtccaaataaaatatgaaggcacggacgcgccctgcaaaattccctttagtacccaagatgagaaaggggttacccaaaacggtaggttaattacagcaaaccctatcgtcaccgataaagaaaaaccagtaaatatagaagcagaaccaccttttggagagagttacatagttatcggagcaggagaaaaagcactgaaacttagttggttcaagaaaggatcatccataggaaaaatgtttgaagctacggctcgtggtgccaggcgaatggccatactaggtgatacagcatgggactttgggagcattggtggagtgttcaccagtgttggtaaattagttcaccaaatattcggcactgcttatggtgtgttgttttctggcgttagctggactatgaaaataggtataggagtattactaacatggctgggcttaaattcaagaagcacttctctatcaatgacatgtattgcagtcggcttggtaacgttatacttaggtgttatggtacaggcagactccggatgtgtaataaattggaaaggtagagaacttaaatgtggtagtggaatctttgtaactaatgaggtacatacatggactgagcaatataaatttcaagcagacagtcctaaaagattaagtgctgcaattgggaaggcgtgggaagaaggcgtatgcggaataaggtcggctacaagattagagaatataatgtggaaacaaatctccaatgaactgaatcatatcctattggaaaacgatatgaaatttacggtcgtcgtaggcgacgtcgctggcattcttgctcagggcaagaaaatgatacgaccgcaacccatggagtataaatatagctggaaatcatgggggaaagctaaaatcattggtgcagatgttcagaataccaccttcataatcgacggacctaacactccagagtgcccagacgatcagcgtgcgtggaacatatgggaagtagaagactatggtttcggcatattcacaaccaatatctggctgaagttaagagactcctatactcaggtttgtgatcatagactgatgtcagctgcgattaaagactctaaggcagtacatgcagatatgggttattggatagaatccgaaaagaatgaaacatggaaactagctcgagccagctttattgaagtaaaaacttgtatttggcctaagagccacaccttatggtcgaatggagtattggaaagtgaaatgataatacctaaaatatacgggggtccaataagccagcataattatagacccggttacttcacacaaaccgctggcccttggcacttaggcaaactcgagttagacttcgacctgtgtgaggggacaactgtagttgtagatgaacattgcgggaatcggggaccaagtttaagaacaaccacagttactggcaaaataatacatgaatggtgttgtcgatcttgtactctaccccctcttagattcaggggtgaagatggttgctggtatggtatggaaattagaccagttaaagaaaaagaagaaaatcttgttaaaagcatggtgagtgctgggagcggcgaagtggactcttttagtcttggattactctgtatttctatcatgattgaagaagtaatgagaagtagatggagtcgaaagatgctaatgacaggaactttagctgtttttctattattgataatgggccaattaacttggaacgatctcatacgcctttgcataatggtcggtgctaatgcttctgatagaatggggatgggaactacttatctagcactgatggctacattcaagatgcgcccaatgttcgcagttggacttttgttccgcagattgacgagtcgagaagtgctgttgctcactatcggactgtcacttgttgcatctgtagaattgccaaattcactagaggaactaggtgacggattagctatgggtattatgattttaaagctactaactgattttcaatcccatcaattgtgggcaacacttctaagtttaacatttataaagactactttctcactacattatgcatggaaaacaatggccatggttcttagcatagtcagcttattcccattgtgtcttagcacaacgtcacagaaaactacctggttgccagtactactcggctcattaggttgcaaacctttaacgatgttcttgatagcggaaaataaaatatggggaaggcgttcctggccgttaaatgaagggataatggctgtaggcatcgtatcaatcctcttgagttcgttgttaaagaatgatgtcccactggcaggtccattaatagctgggggaatgctgatagcatgctatgtgatctctggttcttctgcagatttatctttggaaaaagccgccgaagtttcctgggaggaggaggctgaacatagcggagctagccacaatatactggtagaggttcaagatgacggcacaatgaaaatcaaggatgaagaaagagacgatacactaactatccttttgaaagcaacgttattggccgtctcaggagtttatccgttatcaataccagcgacacttttcgtatggtatttctggcaaaagaagaaacaacgctcaggagtactctgggacacaccaagtccaccagaggtcgaacgagcagtattagacgacggaatttataggatcatgcagcgtggcttacttggtaggagccaagtcggtgttggtgtctttcaagaaaatgttttccacacaatgtggcatgtaaccagaggtgctgtacttatgtatcagggaaaaagacttgaaccgtcatgggcatcagtaaagaaagatctcatcagttatggaggagggtggagacttcagggaagctggaacaccggagaagaagttcaagttatagcggtcgagcctggtaagaatcccaaaaacgtccaaacagcaccgggaacattcaagacaccggagggagaagtaggtgcgatcgcactagatttcaagccaggaacaagtggttcaccaattgtaaatcgagaaggtaaaatagtaggactctacggaaatggcgtggttacaactagcggtacctatgtatctgcgattgcacaggctaaagcatctcaggaaggtcctttaccggaaatagaggacgaagtgttcagaaaaagaaacttaacaattatggatctacaccctggttcagggaaaacaagacgttacctgccagcgattgtcagagaggctataaaaaggaagctacgtaccctcatcctagcaccaacacgtgttgtagccagcgagatggctgaggccctaaagggtatgcctattcgttatcaaacaacagccgtcaaatcggaacacacaggaaaagaaatagttgatttgatgtgccatgcaacattcacaatgaggctattgtcaccagtaagagtaccgaattataacatgatcataatggatgaggcacatttcacagatccatcttcaatagcagctcgtggatacatatcgacaagagtaggaatgggcgaggcagcggcaatttttatgacagccacaccacccggttctgttgaagcctttcctcaaagtaatgcagtgatacaagacgaggaaagagacatacccgaacgtagttggaatagtgggtatgagtggataacagatttcccgggaaagacggtatggttcgttccaagtattaaatcaggcaacgacatcgcaaactgtttaaggaaaaacggaaaaagagtaatacagctttctagaaaaacgtttgataccgaataccagaaaaccaaaaataacgactgggattatgtcgtaactactgatatctcggaaatgggagcaaatttccgagcagacagggtaattgatccaaggagatgtttaaagccggtgatattaaaggatggcccagaaagggtaatattggcaggaccaatgccggtgacagttgcttcagctgcacaacggcggggccgaatcggaaggaatcacaacaaagaaggagaccaatatatctatatgggacaaccactaaacaatgacgaggatcatgcgcattggacagaagcaaagatgcttctagacaatataaataccccggaagggataatacctgctctattcgaaccagaaagagaaaaatcagcggcaattgatggtgaatatagattacggggcgaagccaggaaaacctttgtagaattaatgagacgcggcgatttacccgtatggttatcatacaaagtagcaagtgagggatttcaatactcagaccgccgttggtgtttcgatggggagcgaaacaatcaagttctagaagagaacatggacgtggaaatatggactaaagagggcgaacgaaagaaactgcgaccacggtggcttgatgctcgaacatactccgatccattggctttgcgtgagttcaaagagtttgctgcaggaagaaggtcggtatcgggagatttaatcttggaaatcggaaaacttcctcaacatttaacacaacgcgcacaaaacgcactcgataatctagtaatgctacataactctgaacaaggtggcagggcgtatagacacgctatggaagaattaccggataccatagaaactctgatgttactggcgttaatcgctgtactaaccggaggcgtaactttatttttcctgtcaggaaggggattaggaaagacatcaatcggattgctttgtgtaatggcaagctctgtcctcctatggatggctagcgtcgaacctcattggatagccgcatctatcatattagaatttttcttaatggtgttgctaattccagaaccagacagacaacgaactccgcaagacaaccagctagcgtacgtggtgatagggttactatttatgattttaacggtcgcagccaatgagatgggactgctagaaacaaccaagaaagatctaggtataggacacgtcgcagttggtaatcaccaccatgcggcaatgctagatgtagacctacatccagccagtgcctggactctctatgcagttgccacaacaatcataacccctatgatgcgacataccatagaaaatactaccgcaaatattagcttaaccgcaatcgcaaaccaagctgcaattctcatggggctagacaaaggatggccaattagcaaaatggatataggcgtacctttattggctctcgggtgctattcacaggtgaatcctcttacattgaccgctgcagtattaatgttagtggcccattacgctattattggccccgggctacaagccaaggcaacacgtgaagcacagaagagaactgcagccggaatcatgaaaaacccaacggtagacggtatcgtagcgattgacttagatcctgtcgtgtatgatgctaaatttgaaaaacaattagggcaaataatgctcctaatattatgcacgagtcaaattcttctgatgcggactacatgggcattgtgcgaaagcataacactcgcaacgggtccattaacaacgctttgggaaggaagcccgggaaaattttggaatacaaccatagcagtatcaatggcaaacattttccggggctcatatttagctggagccggtctagcattcagcctaatgaaatctctagggggcggacgcagaggtacgggagcccagggagaaaccctcggggagaaatggaaaagacaactaaatcaactgagtaagagcgagttcaacacttacaaacgttctggaataatggaagtcgatcggtctgaggcgaaagaaggattgaaaagaggcgagaccacgaaacacgctgtaagcagaggaacagcaaaattgcggtggtttgtagagagaaatttagtaaaacctgaaggaaaagtaatagacttaggctgtggtcgagggggctggagctactactgtgcaggtctcaagaaagtaactgaggtcaaagggtatactaagggaggccctggacatgaagaacccataccgatggcaacatacggttggaatctcgtaaaattacactcgggaaaagatgtattctttataccacctgaaaaatgcgatacgttgctttgtgatataggagagagttcgcccaatccaacaattgaagaaggtagaacattaagggtactcaaaatggttgaaccatggttgagaggtaatcaattttgtataaaaatattaaacccgtatatgcctagtgtagttgaaacgctagaacaaatgcaaaggaagcatggaggaatgctcgtacgaaaccccctttctagaaacagtacccacgaaatgtattgggtttcttgcggtacaggtaatatcgtgtctgcagtaaacatgacctcaaggatgctccttaacaggtttacaatggcacacagaaaacctacatatgaaagagatgtagatttgggtgcgggtactagacatgtcgcagtagaaccagaagtagcgaatctagacataataggacaaaggatagaaaatattaaacacgagcacaaatcaacgtggcactatgatgaagacaatccctacaagacttgggcttatcatggctcctatgaagtaaagccgagtgggtcggcctcatctatggtaaacggtgtagtaaagctactcaccaagccttgggacgtaatccccatggtaacacaaatagcaatgacggataccaccccctttggtcagcagagggtctttaaagaaaaagtcgatactcggaccccaaaagccaagcgtggaactgcccaaataatggaggtaacagctaaatggctctggggcttcctatcaagaaataaaaagccaagaatatgtacgagagaagagttcacgcgcaaagttcgtagcaacgctgctataggagcagtattcgttgacgaaaaccaatggaactctgcaaaagaagcagtagaagatgaaagattctgggatctggtgcacaaagaaagggagctacacaagcaaggaaaatgcgctacatgtgtttacaatatgatggggaaaagagagaagaaactgggcgaatttggcaaagcaaaagggtctagggctatctggtatatgtggctaggtgccagattcttagagttcgaagcactgggattcatgaatgaagaccattggtttagtagagaaaattccttatcgggtgtagagggtgaaggattgcacaaactcggctacattctgcgggacatatcaaaaattccgggcggcaatatgtatgcagacgacacagcaggatgggataccagaataacggaagatgacttgcaaaacgaagcccgtattaccgatataatggaaccggaacatgctctcttagcaaaaagtatttttaaactaacctaccaaaataaagttgtcagagtgcaacgtccagctaaaaacggcaccgtaatggatgttatatcaaggcgagaccaaagaggaagcggtcaggtaggaacatacggcctcaatacatttacgaacattgaagctcagcttattcgtcaaatggaatcagaaggtatattttcgccatctgaattagaaacacccaaccttgcggagcgtgtacttgactggctagaaaaatacggagttgagcgattaaagaggatggcgatttcgggtgatgactgtgtcgtaaaaccgatagatgatcgattcgccacggcgttaaccgcattaaatgacatgggaaaagtaagaaaagacatcccacagtgggaaccatctaaaggctggaacgactggcaacaagtgcctttctgttcacatcacttccaccaactcataatgaaagacggaagagagatcgtggtgccttgtagaaatcaagacgagttggtgggcagagcacgtgtcagtcaaggagctgggtggagcctccgcgaaacagcatgtttgggaaagagttatgcacaaatgtggcagctaatgtactttcacaggagagatcttaggctagcagcaaacgctatttgctcagccgtcccggtagactggatcccaacatctcgaacaacctggtctatccacgctcaccatcaatggatgacaacagaagacatgttatcagtctggaatagagtttggatagaagagaatccgtggatggaagataagacgcatatatcatcttggggcgatgtaccttatcttggcaaacgtgaagatcaatggtgtgggtctctgatcggcttaacagcaagagctacttgggcaacaaacatacaagtcgctataaaccaagtaagaagattgattggtaatgaaaactacttagattatatgaccagtatgaaacgattcaagaacgagtcagatcccgagggtgccttatggtaa

SEQ ID NO: 21210 - RNA, 9879 nt, synthetic construct
  misc_feature 1..9879: note = derived and/or modified CDS sequence (opt6) from DENV-1__HM181939__SS-prME
  source 1..9879: mol_type = other RNA
tcagtaacaatgctactaatgttaatgccgacggcgcttgcatttcatttaacaactcggggtggggaaccgcatatgattgtgtctaaacaagaacgtggaaaatctcttttatttaaaacgtccgctggagttaatatgtgcacactaatagcgatggatcttggcgaattttgcgaagatacaatgacttataaatgtcctaggatcagtgaggccgaaccagatgacgttgattgttggtgcaatgcaacagacacatgggtaacctacggaacttgctcacagactggagaacaccgacgagataaaaggtcagttgcactagccccacatgttggattaggactagaaacgagaacagagacatggatgtcctcagaaggcgcttggaaacaaattcaaagagttgaaacatgggcacttagacatccaggattcaccgtaattgcgttgtttttggcacatgcaattggaacctcaataacgcagaaagggataatatttatattactaatgctcgttactccctccatggctatgcgttgcgtaggcataggatcccgcgactttgtggagggactaagtggggctacttgggttgacgttgtacttgagcatggtagttgtgtgaccactatggcaaaagataaaccaactttagatatagaattactaaaaacggaagtaaccaatcctgccgtcttacgaaaactatgcatcgaggcaaaaataagcaatactacaacagattccagatgccctacccaaggagaggcgacattggtggaggagcaggacgccaattttgtatgtagaaggacgtttgtagatagaggctggggaaatggatgcggactttttggaaaaggaagtttgataacatgcgcaaaattcaaatgcgtcaccaaactggaaggcaaaattgtacaatatgaaaacctaaaatattcagtgatagtaactgtacatactggcgaccaacaccaagtggggaacgagtcgacggaacacggaacaactgcaacgatcacaccccaagcaccaagtacagaaattcagttgaccgactacggagcacttactctagattgtagtcctcgcaccgggcttgacttcaatgaaatggttttactgaccatgaaagaaaaatcatggctagttcacaaacagtggttcttagatttgccactcccatggacaagcggtgccagtacatcgcaagaaacctggaacagacaggatttattggtaacatttaaaactgcacatgccaagaaacaagaggtagttgtcctaggatcccaagaaggcgccatgcatactgctctcactggagctacagagatacaaacaagtggtactactacaatttttgcaggtcacctaaaatgtcgactaaaaatggataagttaaccctaaagggtatgtcatacgttatgtgcaccggaagttttaagttggagaaagaagtggcggaaacgcaacatgggactgtcctagttcaaattaaatacgaaggaaccgatgcaccgtgtaagatccctttctccactcaagatgagaagggagtgacgcaaaacggaagactcatcacagctaatcctatagtaacagacaaagaaaagccagttaacatagaagccgagccgccttttggagaaagctacatagttataggcgccggtgaaaaagcattaaaattatcttggtttaagaaaggatcttccataggaaagatgtttgaggcaactgcaagaggagcgcgaagaatggcgattttaggtgataccgcttgggatttcggatcaataggtggagtattcacctcggtcggcaaattggtacaccagattttcggaactgcctatggagtattattttctggcgtcagctggactatgaagattgggatcggagtattgttgacatggttaggacttaacagtagatcaacatctctgtctatgacctgcattgctgtaggcctagtgacgttatatttaggagtcatggttcaggctgattcgggatgtgtcattaattggaaaggtagagaactaaaatgtggttctggaatatttgtaaccaatgaagttcatacatggacagaacaatataagtttcaagctgacagtccaaaaagactatcagcagccattggaaaggcttgggaagaaggagtttgtgggattagatctgctacaagacttgaaaatatcatgtggaagcagatatcaaatgaactaaatcatattttgcttgaaaatgatatgaaattcactgttgttgtcggtgatgttgctggcattttagctcaggggaagaaaatgatccgtccgcaaccaatggagtataaatattcttggaaatcctggggtaaagccaagataataggcgccgatgttcagaatactaccttcatcatagatgggccgaacaccccagagtgtccagacgaccaaagagcatggaatatatgggaagtcgaagattacggattcggaatcttcacaacgaacatatggctgaaactaagagacagttatacccaagtatgtgaccacaggttgatgtcagcggcgattaaggatagtaaagcagtacacgctgatatgggatactggatagaatcagaaaagaatgaaacatggaagctagcgagagcatccttcatagaagttaaaacatgtatatggccaaaatcacacactctatggtctaatggagtactggaatccgaaatgattattccaaaaatttatggagggccaattagtcaacataactatagacctggctatttcacccagaccgcggggccatggcatcttggaaagttagaactggacttcgatttatgcgagggtaccactgtagtagtagacgagcactgcgggaaccggggtccatcattacgtacaacgacagttacaggaaagatcatacacgaatggtgctgcagaagctgtactttaccaccactgaggtttaaaggggaggatggttgttggtatggaatggaaatacgtccagttaaggaaaaagaagaaaacttagttaaatccatggtctcagctggttcgggagaagtagatagcttcagtctaggactgctatgcataagcataatgattgaagaagttatgagatcgaggtggagcagaaaaatgttaatgactggaacgcttgcggttttctttttgttgattatgggtcagctaacatggaatgatctaatacgtctgtgtataatggtaggtgcaaatgcgtcagatcgaatgggtatgggtatgacatatctagccttaatggccacttttaagatgagacctatgtttgctgtcggattattgttcagaagactcacttctcgtgaagtacttttattgacgattggtttatcattagtggcgtcagtagaactgccaaacagcttggaagaacttggagatggattggccatgggaattatgatcctaaaacttttgacagactttcaaagtcatcaattatgggcaaccttgttgagcctcacctttataaaaacaaccttctcacttcactatgcttggaaaacgatggcaatggtgttatcgatagtttcccttttcccgctatgcctatctacaacgagtcagaaaacgacctggttaccagttcttttgggttctttgggctgtaaaccattaacaatgtttttaatcgcagaaaacaaaatctggggacgaaagtcgtggcctctcaacgaaggcattatggctgtcggtatagttagcatcttattatccagtctattgaaaaacgatgtgccgctcgcaggaccactaatagctggaggaatgctaatagcgtgttatgtcataagtggcagtagtgcggatctaagcctcgaaaaagccgccgaggtctcgtgggaagaggaagcagagcatagcggcgcctcccataacatcctcgtcgaagttcaggatgacggcacaatgaaaatcaaagacgaagaaagagatgatacgctaactatcctcctgaaggccaccttactggcggtatccggagtttatcctctctcaatcccagcaacattatttgtatggtatttctggcagaaaaagaaacaacgatcaggggtgttgtgggatactccatcaccccctgaggttgaaagagcagtgttggacgatggtatctatcgtattatgcagagaggattattaggtcggagccaagtcggtgtaggtgtttttcaagaaaatgtattccatacaatgtggcatgtcacaaggggagcggtgctaatgtatcaagggaaaagattggaaccttcgtgggcgtccgtcaagaaagacttaatttcatacgggggaggttggcgtcttcaaggatcctggaataccggggaagaagtccaagtcatagcagtagagccaggcaaaaatcctaagaatgtccaaacagcgccaggtaccttcaagacatcggaaggcgaagttggagctatagcactagatttcaaacccgggacttctggaagcccaatagtcaatcgggaaggaaaaatcgtaggactctatggaaatggcgttgttacaacctctggtacatacgtatctgccattgcacaagcaaaagcatctcaagagggaccattaccagagatagaggatgaagtattcaggaaacgaaatcttactataatggatttacatccaggaagtggcaaaactagacgatacttaccagcaatagtaagagaggctattaagcgaaaacttcgaactttaatactagctccaacccgcgtagtagcatccgagatggcggaggccttgaaagggatgcctattcggtatcagacgactgctgtaaaatctgaacatacaggcaaagaaatagttgatttaatgtgtcacgcaactttcactatgcgattattatcaccggtccgggttcctaattacaacatgatcataatggatgaagcacactttacagacccatcgagtattgcagcaaggggatatatatctacaagagtcggtatgggtgaagccgccgcgattttcatgactgctacacctcctggctcagtagaagcctttccccaatctaacgctgtaatccaggatgaggaaagagatatacctgaaaggtcctggaatagcggttatgaatggataacagatttcccggggaagaccgtctggtttgttcccagcattaagagtggtaatgatatagcaaactgtttgagaaagaatggaaaaagagtaatacaactttccagaaaaacctttgatacagaataccagaaaactaagaacaatgactgggattatgtagtcacgacagacatctctgaaatgggagcaaacttccgagctgaccgtgtaattgaccctcgacgctgtttaaaaccagtaatactaaaggatggacctgaacgtgtcatcctcgctggaccgatgcccgtaaccgtcgcatcagctgctcaacgtcgcgggcgaattgggagaaatcacaataaggaaggagatcaatacatatatatgggacaacccttaaacaatgacgaagatcacgctcattggaccgaagcaaaaatgctacttgacaatataaacacacctgaaggaattataccagcgttgtttgaaccggaacgcgaaaaatctgctgcaatagacggggaatatcgattacgtggtgaagcacgtaaaaccttcgtagaacttatgagacgaggcgatctccctgtttggttatcatataaagttgcgtccgaaggttttcagtatagtgacaggcgatggtgcttcgatggcgagcgtaacaaccaagtattggaagagaacatggacgtggaaatatggactaaagaaggagaaagaaagaaactgagaccacgttggctcgatgcaagaacgtattcagatccgcttgctttaagagaatttaaggagttcgccgcgggaaggagatccgtgtccggagatctcattcttgaaattggaaagttgccccagcatttaactcaacgagctcaaaacgcccttgacaatttagttatgctacacaacagtgaacaagggggtagagcatatcgacatgcgatggaagaactaccagacacaatagagacattaatgttactggctctcatcgcagtgcttacgggaggagtaacactattctttctttccgggcgtgggttaggcaaaacgtcaataggattactatgcgtaatggcgtcgagtgtcttgttatggatggctagtgtagaacctcactggatagctgcttcgataatattagaatttttcctaatggtcctccttattcccgaaccagatagacagcggacgccccaggataatcaactggcttacgtagttattggcttactattcatgattttgaccgtagctgctaacgaaatgggcttattagaaacaaccaagaaagacttggggatcggtcacgtcgctgtagaaaatcatcatcacgctgccatgctagacgttgatttacatcctgcttctgcatggacgttgtacgctgtcgcaaccacgataattacgcctatgatgagacatacaatagaaaatactacagctaatatatcgctcactgctatcgctaaccaagcagcaattttaatgggacttgataagggttggcctatctcaaagatggatataggggtgcccttactggctctaggttgctatagtcaggttaaccccctaacactcacagcagcggtcctgatgctggtagcccattacgcaatcataggacccggtttacaggccaaagcaactagagaagctcaaaagcgcacggcggccgggataatgaagaacccgactgttgacggaatagttgcgatagacctcgatcccgtagtctatgacgcgaaattcgagaaacagctcggacaaatcatgctgcttattttatgtacatcacaaatactcctaatgaggactacatgggctctatgcgaatctatcactctagcaactggtccactaacaactttatgggaaggctctccaggaaaattctggaacacaacgattgcagtatctatggctaacatattccgaggtagttatcttgctggagcaggtctagcattcagtctaatgaaatcattaggtggaggccgaagaggaacaggggctcaaggagaaacattaggtgaaaaatggaaaagacaattaaaccagctaagcaaaagcgagttcaatacctacaaaagatcagggattatggaggtagatcgtagcgaagcaaaagagggattaaagagaggtgagacaacgaagcatgccgtatctaggggcacagctaaactcaggtggtttgtagagagaaatctggtaaaaccagaagggaaagtgatagaccttgggtgtggaagaggtggctggagctactattgtgccggactcaagaaagtgaccgaagtaaagggttatacaaaaggtggtcccggccacgaagaacccatccctatggctacctacgggtggaatttagttaaattgcatagcggcaaagacgtcttcttcgttccgccagaaaaatgtgataccttattgtgtgacataggtgaaagttcgccaaacccgacaatagaagaagggagaactcttcgtgtactaaagatggtcgaaccctggttacggggcaaccaattctgtattaaaatcttaaacccatatatgccatcagtagtggagacactagaacagatgcaacgtaagcatggtggaatgttagtacgtaatcctctgagtagaaattccactcacgagatgtattgggtgagctgcggaacgggaaacatagtatctgctataaacatgacaagcagaatgctattaaacagattcactatggcacatagaaaacctacgtacgagcgagacgtagacctcggagcaggaacaaggcatgtagctgtggaaccagaagttgcaaacctagatattatcggacaacgaatcgaaaatattaaacatgaacacaaatctacatggcactatgatgaagataatccgtataaaacatgggcataccatggtagttacgaggtaaagccaagtgggtcagcaagttctatggtgaacggtgtcgtgaaactacttacaaaaccctgggatgttatacccatggtcacacagattgctatgactgacaccacaccttttggacagcagagagtttttaaggaaaaagtcgatacacgaacccccaaagcaaaacgaggcacagcacagataatggaagtcacggctaaatggttatgggggttcctaagtaggaataagaaaccgagaatctgcactagagaggaatttacaagaaaggtaagatctaatgcggcgatcggggccgtatttgtcgatgaaaaccagtggaactccgcaaaagaagcggttgaagatgaaaggttttgggatctagtgcaccgagaacgcgaactacacaagcaagggaaatgcgcaacatgcgtttacaatatgatgggaaaaagagagaagaaacttggagagtttggaaaggccaagggctcacgtgcgatatggtacatgtggttaggcgcaagatttttagaatttgaggctttaggttttatgaatgaagatcattggttctccagggagaatagtttatccggtgtagaaggcgaaggtctacataaactgggatatatattgcgcgatataagcaaaatttcaggagggaatatgtacgcagatgatacagccggttgggacacacgtatcaccgaagacgacctacagaatgaggcaaagataacagacatcatggaacctgagcatgcgttactagccaattcgatatttaagctaacataccaaaataaagtcgtcagagtccaaaggccagctaaaaacggtacagttatggacgtaatcagtagaagagaccagagaggttcaggacaagtaggcacctacggtttaaacaccttcacaaacatggaagcgcagctaatccgacaaatggagtctgaaggtatattctccccctcagaattagaaacgccaaacctagcagaacgtgtacttgattggctagaaaaacatggggttgagagattaaaacgcatggctatttcgggtgacgattgcgttgttaaacctattgacgataggtttgcaacagccttaacagcgttgaatgacatggggaaggtccgcaaagacatcccgcaatgggaaccgagtaagggttggaatgattggcaacaagtaccattttgctctcatcattttcatcaacttatcatgaaagacggcagagagatagttgtaccatgtcggaatcaagacgagctcgtagggcgtgcaagagtttcacaaggtgcaggttggtcgttacgcgagactgcttgtctgggaaaatcgtacgctcagatgtggcaactaatgtatttccaccgtcgagatttacgtttagctgcgaacgcgatttgctcagcagtaccagttgattgggtacctacatcaagaacgacttggtccatacacgcacatcaccaatggatgacaacagaagatatgttaagtgtttggaatagagtgtggatcgaagagaatccatggatggaggacaaaacgcatatttctagctgggaggacgtaccctaccttggcaagcgcgaagaccaatggtgcggatcactaataggattaactgcaagagctacctgggcaacaaacatccaagttgccattaatcaggttagacgacttattggaaacgagaattatcttgattatatgacttcaatgaaacgatttaaaaatgaatcggacccagaaggggccctttggtga

SEQ ID NO: 21211 - RNA, 9879 nt, synthetic construct
  misc_feature 1..9879: note = derived and/or modified CDS sequence (opt6) from DENV-1__HM181942__SS-prME
  source 1..9879: mol_type = other RNA
agtgtaaccatgctgttgatgttaatgccaacagcgttagcttttcatttgacgacgcgaggcggtgaaccacatatgatcgtaagcaaacaagaacgaggtaaaagtttactctttaaaactagcgcgggcgtcaatatgtgtacactaatcgccatggacctaggagaattttgtgaagatactatgacatataaatgtcccagaatttccgaggccgaaccagatgatgttgactgctggtgtaacgctacagatacatgggtcacatatggtacttgttcacaaactggcgaacatagacgcgataaacgtagtgtagcactagcaccccatgtcggacttggattagaaacgcgtaccgagacctggatgagctctgaaggggcctggaaacaaatacaacgagttgaaacatgggcattaaggcatccaggttttacagtaattgcactattcctggcccatgcaattggaactagcataacacaaaaaggaataatttttatattattaatgttagtaactccatccatggccatgagatgcgttggcattggttcccgagactttgtcgagggccttagtggcgctacttgggtagacgtggtgttggaacacggaagctgtgtgactacaatggcgaaagataaaccaaccttagatatagaactactaaaaacggaagttacaaatcctgctgttctaagaaaattatgtatcgaagccaaaatcagcaatactactacggattcacgttgcccaacccaaggtgaagctactctagtagaagaacaagacgctaacttcgtctgccgaagaacattcgttgatagaggttggggtaatggttgtggacttttcggcaaaggcagcttgattacctgtgctaaattcaaatgtgtgaccaaactagaaggaaaaatagttcagtacgagaacctaaagtattccgtaatagttactgttcatacgggagatcaacaccaagtaggcaacgaatcaacagaacatggaacaactgcgacaataaccccacaagcgccttctacggagatacaactaactgactacggtgcattgacattagactgtagccctcgaacgggactagattttaatgaaatggtactgttaacaatgaaagaaaaatcatggcttgttcataagcaatggtttcttgatttacctttgccatggacaagtggtgcatctacttctcaagagacatggaatcgacaagatctcttggttaccttcaaaacagctcatgcaaagaaacaggaagtggttgtactagggagtcaagagggcgcaatgcataccgctcttactggggccacggaaatacaaacaagtggaaccacgacaatttttgccggacatttaaagtgccggttgaaaatggataagttaaccttaaaaggaatgtcatatgttatgtgcacagggagctttaagctagaaaaagaagttgctgaaacgcaacatgggactgttcttgtccaaataaaatatgaaggaactgacgcaccttgtaaaattccattttcaacccaagatgaaaaaggggtgacccaaaatggtaggttaataacggcaaaccccatcgtgacagataaagaaaagcccgtgaatattgaggctgaacctccctttggagaaagttacatagtgataggggccggtgaaaaagccctcaaattgagctggtttaagaaaggcagctcgataggcaaaatgttcgaagcgacggcacgaggagcaaggagaatggcaatattgggagatacagcatgggactttggtagtatcggaggggtttttacctctgtcggaaaactcgtccatcaaatatttggaacggcatacggcgttttatttagtggtgtatcatggactatgaagataggcatcggcgtactgctcacatggctaggattgaacagcaggagcacttccctctcaatgacatgtatcgctgtaggtctcgttaccttatacttaggtgtaatggttcaggctgatagtggttgtgtaataaattggaaaggtcgggaattgaagtgcggtagcggaattttcgtgacaaacgaggtacacacgtggacagagcaatacaaatttcaagctgacagcccaaaaagactatcagcagctatcggtaaggcttgggaagagggtgtttgcggcatacgaagtgcaactcgattggagaatattatgtggaaacaaattagtaatgagctaaaccatatcctgctcgaaaacgatatgaaatttaccgtagtcgttggggatgtggccggaatattagcacaggggaagaaaatgattcgaccacaaccgatggaatacaaatattcttggaagtcatggggaaaagcaaaaatcataggtgctgatgtacagaatacaacgtttattatcgatggcccaaatacgccggaatgtcctgacgatcaacgtgcatggaacatttgggaagtggaagattatgggtttggcatatttactacaaatatttggctaaaattacgggatagctacacgcaggtatgtgatcatcgcttaatgagcgctgccattaaggactctaaagcagtccacgcagatatgggatactggattgaatccgaaaagaatgaaacatggaaactggcgcgcgcatcgtttatagaagtaaaaacctgcatatggccgaaatcacataccttatggtcgaacggcgttttggagtcagaaatgatcataccaaaaatctacggcgggccaattagtcaacataattacagaccaggttatttcacccaaacagcgggaccttggcacctaggaaaactcgagctggattttgatctttgtgaggggactaccgtagtagttgacgaacattgtggaaatagaggcccgagcctaaggacaacgacagtcactggtaagattatacatgagtggtgctgtcgatcatgtacattaccacccctacgattcaaaggtgaagatggttgttggtacggaatggaaatacgacccgtcaaagaaaaagaggagaatctcgtaaaaagcatggttagtgcaggaagtggagaagtagactcctttagcttgggcttattgtgcatatcaattatgatcgaagaagtgatgagaagccgctggtcaagaaaaatgttaatgaccggaaccttagcagtattcttccttctaatcatgggacaattgacatggaacgatctaattcgcttatgcataatggtaggcgcaaacgcatcggatagaatgggaatgggaatgacatatctagccttaatggctacatttaagatgaggccaatgttcgcagtcgggctattattccgtagactaacaagtcgagaggttttattattaactataggattgtcattagtcgcatctgtggagctacctaattcactagaggaacttggtgatggattagcgatgggaatcatgatcttaaaattacttactgatttccaaagccatcaattatgggcaactttactttcattgaccttcataaaaactacattcagcctgcattacgcatggaaaactatggcaatggttttatcaatagtctctttgtttcctctatgcctatctactacgagtcagaaaacaacttggttacccgtcttattaggatcattgggatgcaagccacttacaatgtttctaatagcggaaaacaaaatctggggtcgaaagtcatggcccctcaacgaaggtattatggctgtaggcattgtttcaatacttttaagtagtttactcaaaaatgatgtacccctagcaggcccattaatagcagggggaatgcttatagcttgttacgtcatttccggaagtagtgcagatctctcgctggaaaaagctgctgaagtaagctgggaagaagaagccgagcactcgggagcaagtcacaatatcctggtagaagttcaagacgatggtactatgaaaatcaaagacgaagaaagagatgatacactcacaattctgctcaaagcaactctcttagccgtctcaggagtatatcctctcagtataccagctaccctgtttgtatggtatttttggcagaagaagaaacaaaggtctggagtattatgggacaccccaagcccacccgaagtggagagagcagtactcgatgacggaatttaccgaataatgcaacgtgggttactaggtagaagtcaagttggagttggtgtttttcaagagaacgtattccatacgatgtggcatgtaacacgaggagccgttcttatgtaccaaggaaaaagattggaaccatcatgggcaagtgttaagaaagatctgatatcttatggaggaggatggaggctacaaggctcgtggaatacaggagaagaggtccaagtgatagcagtagagcccggtaaaaatcccaaaaatgtgcagacagccccaggaacattcaaaaccagtgagggcgaagttggtgctatagcgctagatttcaaacctggcacctcagggtcgcctatcgtaaatagagaagggaaaatcgtaggattatacggaaatggggtagttacaacctctggtacatacgtctccgcgatagcacaagcaaaggcatcgcaagaaggaccactgcctgagatagaagacgaggtcttcagaaaacgaaacttaacgatcatggatcttcatccaggcagtgggaagacacgaagatacttgccagccatagtcagagaagctattaaaaggaaattaagaactctaattctcgcgccaacacgtgttgtcgccagtgaaatggccgaggcactgaaaggcatgccgatcaggtatcagactaccgctgtcaagtcggaacacacaggaaaagaaattgttgatctaatgtgtcacgcaacattcacaatgcggttactttctcccgttagggttccaaattataatatgataatcatggacgaagcacattttacagatccctcttctatagccgcaagaggttatataagtacacgagtaggtatgggggaagccgctgcaatcttcatgactgctacacctccgggtagtgttgaggcctttcctcaatcgaacgccgtgatacaagacgaagagagggatatacctgaacgatcgtggaatagcggctacgaatggattacagatttcccaggcaaaactgtatggtttgttcccagtataaaaagtggaaacgacatcgcgaactgtttacgaaagaatggaaagcgagttatacaactaagtagaaaaactttcgatacagaatatcagaaaacgaaaaataatgattgggattatgtggtcacaacggatatatccgagatgggagcgaatttcagggccgacagagtaatagatccgcggagatgcctaaaaccagttatacttaaagatggaccagaaagggtgattttggcaggaccaatgcccgtcactgttgcatcggctgcacaacgaagaggtagaatcggcagaaatcataacaaggaaggagaccagtacatttatatgggtcaaccgctaaacaatgatgaagatcacgcacattggacagaagcgaagatgcttcttgacaatataaacacccccgaaggtatcattccagctctatttgagcctgagcgtgaaaaatcggccgcaattgacggcgaatatcgcctcagaggtgaagcgagaaaaacatttgtagaactaatgcggaggggcgatcttcctgtctggctttcatataaagtagcgagtgagggatttcaatatagcgacagaagatggtgctttgatggagaacgaaacaaccaggtgttagaagagaacatggatgttgagatatggacgaaagagggagaacgtaagaaactaagaccgagatggttagacgcacgaacgtacagtgatccgctggccctacgggaatttaaagaatttgcagcaggacgtagaagtgtatctggagacctaatactagaaataggcaaattacctcagcacttaactcagcgcgcacaaaatgctctagataatctagttatgctccacaattcggagcaaggtggtagagcatatcgacacgccatggaagaattaccagatacaattgaaaccttaatgcttttggcactaatagctgttctcactggcggagtaacgctattctttttaagtgggagaggactagggaaaaccagtatcggcttgctatgcgtaatggcaagtagcgttttattatggatggcatcggttgaaccccattggatagccgcatccatcatacttgaatttttcttaatggtactactaataccagaacctgaccgccaacggacaccccaagataatcaactggcttatgtggtcataggacttctttttatgatcttaactgtagcagccaacgaaatgggactactagaaacaactaagaaagacctaggaataggacacgtagcagtcgaaaaccatcatcatgcagcaatgttggatgtagacttacaccccgcatctgcctggacgctgtatgcagttgcaacaacaataatcacacctatgatgagacacacgatagaaaacacaaccgctaatatatcattaacagccatcgcaaaccaagctgctatattgatgggtctagacaaaggttggcctatttcaaagatggatatcggtgtccccttgctcgccctaggatgttattcccaagtaaatccactaacgcttactgcggctgttttaatgttggtagcacactacgctataatcggacccggacttcaagccaaagcgacccgagaagcgcaaaagaggacagctgctggtataatgaaaaatccgacagtagacggtatagtcgcaattgaccttgaccccgtcgtatacgacgccaaatttgaaaaacaattgggccaaatcatgttgttaatactatgtacttcacaaatcttattaatgagaactacatgggctctttgtgagagtattacactagctacgggtcctttgacgaccttatgggagggaagtcccggtaaattctggaacacaactattgctgtttccatggctaatatatttagagggtcttatttagcaggagcaggcctggcattttcattgatgaaatcgttaggaggaggtcgacgtgggactggcgcacaaggggaaactctaggagaaaaatggaaaagacaactaaaccaattatcaaaaagcgagttcaatacatacaaaagaagtggtattatggaagttgacaggtcagaagctaaagaaggactaaaaagaggtgaaacaacgaaacatgcagtatcacgcggaacggcgaaactccggtggtttgttgagagaaacctggtgaaacctgaaggaaaagtaatagatttaggatgtgggcggggagggtggagttactactgcgcaggattaaagaaagtcactgaagtgaaaggatacaccaaaggcggcccaggacatgaagaaccaatacccatggctacgtacggatggaacttagtcaaattacactctgggaaagacgtgtttttcgttcccccagaaaaatgtgatactctactttgtgatataggcgaatcatcgccaaacccgacaatagaagaaggcaggaccctaagggttctaaaaatggttgaaccgtggttaagaggcaatcaattttgcataaagatactaaatccctatatgccttcagttgtagagactcttgagcaaatgcaacggaaacacggcggtatgctggttcgcaatcctctaagcagaaattcaacccatgaaatgtattgggtttcatgtggcacaggaaatatagtgtctgcagttaacatgacaagtcggatgcttcttaacagatttacaatggcacatcgcaaacctacatacgaacgtgatgttgatttaggagcaggtactagacacgtcgctgtagagccagaagtagcaaatttagatattataggtcaacgaatcgaaaatattaaacatgaacacaaaagcacgtggcactatgatgaagataacccatataaaacttgggcgtatcatggatcgtacgaggtgaaaccttctggctctgctagttccatggtcaacggtgttgtaaagttgctaacgaaaccatgggatgttataccaatggtaactcaaatagctatgacggatacaacacccttcggtcaacagagggtctttaaagaaaaagtagatacccggactccgaaagcaaaacgggggacagcgcaaatcatggaagttacagcgaaatggctctggggctttttatcacgaaataagaagcctagaatatgcactcgagaggagtttaccagaaaggttagaagtaatgcagcaataggtgcagtgtttgtggacgagaatcagtggaatagtgccaaagaagcagtagaagacgagagattttgggacctggtgcacagggaacgagagttacataaacaagggaaatgcgcaacatgtgtctacaacatgatgggcaaaagggagaagaaattaggcgaatttggtaaagcaaagggatcaagagctatatggtatatgtggctgggggccagatttcttgaatttgaagccctggggttcatgaatgaagatcattggttcagtcgtgaaaacagcctatcaggagttgaaggagaaggattgcacaaattaggttatatattaagagacatctctaaaattagtggaggtaacatgtatgcggatgataccgccgggtgggacacaagaataactgaagatgatttgcagaacgaggcaaagataactgatataatggaaccagaacatgcccttctagcaaacagtatctttaaattaacttaccaaaataaagtagtaagagttcagaggcctgcaaagaacggtaccgttatggatgtaataagtcgtcgggaccagagaggctctggtcaggttggaacatatggcctcaatacgttcaccaatatggaagcacaattgattcgacagatggaatcagaggggattttctctccgagcgaattggagacaccaaatctcgctgaaagagtactagattggttagaaaagcatggtgttgaacgactgaaaagaatggccatatcaggagacgattgtgtagtaaagccaatagacgaccgctttgcaaccgctctaactgcactcaatgatatggggaaagtaagaaaagatataccacagtgggagccctcaaagggatggaatgactggcaacaagttcctttttgttctcatcattttcatcaactcataatgaaggacggtcgtgaaatagtagttccctgtagaaaccaggatgaattggtagggagagcacgtgtcagccagggcgcaggatggagtctcagagagactgcgtgtctcggaaagagttatgcgcaaatgtggcaattaatgtacttccataggcgagatttaagactcgcagcaaatgcaatttgttcggcggttccagtcgactgggttcctaccagcagaaccacttggagtattcatgcccatcatcagtggatgactaccgaagatatgctatcagtttggaatagggtatggattgaagaaaacccgtggatggaagataaaacccacatttcatcttgggaagatgttccttatttagggaaacgtgaagaccaatggtgtggatcccttataggtttaactgcacgtgcgacctgggctactaacatacaagtggcgataaatcaagtaagaaggctaatcggaaatgaaaattatcttgactacatgacatctatgaaaagattcaaaaacgagtctgatccagaaggggcactatggtaa

SEQ ID NO: 21212 - RNA, 9879 nt, synthetic construct
  misc_feature 1..9879: note = derived and/or modified CDS sequence (opt6) from DENV-1__HM488255__SS-prME
  source 1..9879: mol_type = other RNA
agtgtaactatgttactaatgttaatgccaactgctcttgcttttcatctgactactagagggggagaacctcatatgatagtatcgaaacaagaaaggggaaaaagtctgttatttaaaacatccgcgggagtaaatatgtgtaccctaattgcaatggacctaggagaactatgcgaggatactatgacctataagtgtcctcgaataactgaagcggaaccagatgatgtagattgctggtgtaatgcaacggacacatgggttacatatggtacttgctcacaaactggagaacacagacgagacaaaagatcagtcgctcttgctccccatgtaggactaggtttagaaacacgtacagaaacttggatgtcatcagaatcagcatggaaacagatacaacgagtagagacatgggcactcagacatcctggatttacggtcatcgcactatttttagcacacgcaattgggacatccataacccaaaaaggtatcatttttatcctgttaatgctggtaacaccttcgatggctatgagatgcgtgggaatcggttcgagagattttgttgagggtttaagtggagctacctgggtagacgtcgtcttagaacatggttcttgcgttaccaccatggcaaaagataaaccaaccttagatatagaattattaaaaaccgaagtaaccaatccagcaatacttagaaaactgtgcattgaagcaaaaatttcaaatacaacgaccgatagtagatgccccacgcaaggtgaagcgacattagtagaagaacaagatgccaattttgtatgtagaagaacattcgtagatagaggttggggaaatggatgcggattatttggaaaaggttcattaataacttgtgccaaattcaaatgcgtcacaaaactggagggtaaaattgtacaatatgaaaatttaaaatatagcgtaatagttactgtacatactggagaccaacaccaagtaggcaatgaatcaactgaacatggaaccaccgcaactatcactccgcaggcgcctacaacagaaattcaacttacggactatggcgctttaacattagattgcagcccaagaactgggctagacttcaacgaaatggttcttctcactatgaaagaaaagtcatggctggttcacaaacaatggtttcttgatttaccattgccgtggacttcgggagcatctacttctcaagagacttggaatcggcaagatcttttagtcacattcaaaactgctcatgccaagaaacaagaggtagtcgtacttggatctcaagagggagcaatgcacacagcactcaccggcgccacggaaatacaaacaagtggaacaacaacgatttttgctggacatctgaaatgtagattaaaaatggacaaattgactttgaaaggcatgtcctacgtcatgtgtacaggttccttcaagttggagaaagaagtcgcagaaactcaacacgggacagtcctggtacaaatcaaatatgaaggcactgacgcaccatgtaaaatacctttctctacacaagacgaaaaaggagtaacgcaaaacgggagattaattacagcaaatccgatcgtaactgacaaagaaaaaccggttaatatagaggccgaaccaccctttggtgaatcatatattgtaatcggggctggggagaaagcattgaaattaagttggtttaagaaaggatcgagtataggcaaaatgtttgaagccaccgcccggggcgcaaggagaatggcaattctaggcgatactgcctgggacttcggtagcataggaggggtttttacatctgtgggaaaacttgtccaccaaatattcggaacagcttacggggttctttttagcggggtaagctggacaatgaagattgggatcggtgtgctattgacctggttaggtctaaattcgagatccaccagtcttagtatgacttgtatagcagtagggttggtaacgttgtacttaggagtaatggtccaagctgattcagggtgcgtaataaattggaaaggaagagaactgaaatgtggatcaggaatattcgtaacaaatgaggtacatacatggacagagcagtataagtttcaggcagattcacctaagcgtctgtctgccgccatagggaaagcctgggaagagggagtatgtggcataagatcggcaacaagattagaaaatatcatgtggaaacagataagtaacgaacttaatcatatactcctcgaaaacgacatgaaattcacagtcgtcgttggcgacgtagcgggcattcttgcacaaggtaagaaaatgataagaccccaaccaatggaatataaatatagctggaaaagttggggaaaggctaaaattatcggagccgacgtacagaatacaacatttattatagacggacctaacaccccagaatgccctgacgatcaacgagcttggaatatttgggaagtggaagattacgggttcggaatctttacaacaaatatctggttaaaacttcgagactcatacacgcaagtgtgtgatcacagactgatgtcagccgcgattaaagactcaaaggcagtacatgctgatatggggtactggattgaatctgaaaagaacgagacatggaaattagctcgagcttcattcattgaggtaaaaacttgcatctggcctaagtcacatacactttggtcaaatggagtactagagtccgaaatgataataccaaaaatatatgggggcccaatatcccaacataattatagacctggatactttacgcaaactgctgggccatggcaccttggaaaattagaacttgactttgatctttgtgaaggaacaacggtggtagttgatgagcattgcggaaataggggcccttcactacgaactacgacagttactggtaaaataattcatgaatggtgctgccgttcgtgtacattacctcctctacgattcagaggagaagatggatgttggtacggaatggaaattaggccagttaaagagaaggaagaaaacttagtgaagtcgatggtttcggctggcagtggagaagtagatagttttagtttgggactcctatgcatatcgatcatgattgaggaagttatgaggagtaggtggagtcggaaaatgctaatgacaggtacattagcagtttttctcctattgataatgggtcaactaacatggaacgatcttatacgactatgcattatggtaggcgctaatgcatctgaccgaatgggaatggggacaacttatctggcactgatggctacatttaaaatgcggcccatgttcgctgtaggccttctctttagaaggttaacgtcacgggaggttttactattgacaataggcttatctttggtcgcttcagtagaactaccaaacagcttggaagaattaggagatggtttagctatggggattatgatactgaaattgctcactgactttcaaagccaccagttatgggcaactttactctccttaacattcattaaaacaacatttagcttacattacgcctggaagacgatggctatggtgctaagtatagtatcgctatttcccctttgtctgagtaccacgagtcagaaaacaacttggctgcctgttctcttaggatctttgggatgtaaacctctgacaatgtttttaattgctgaaaataaaatttggggaagacgatcgtggccattaaacgaaggtatcatggcagtgggcatagtaagcatcttactgtcatcacttctgaaaaatgatgtaccattagcaggtccactgatcgcaggaggaatgcttatagcatgctatgtaatatctggttcaagcgcagacttatctctcgagaaagctgcggaagtttcatgggaagaggaagcagaacacagcggtgcgtcacacaacatcttagtagaagtccaagatgacggaactatgaagataaaagacgaagaacgagatgatactctaaccatactgttaaaagcaactttattggcagtctctggtgtgtatccactctcaatacccgccacattgtttgtttggtacttttggcagaagaagaaacagcggtctggagtactgtgggacactccatctcctccggaagtagaaagagccgtactggacgatgggatttatcgtatcatgcaaaggggacttctaggtagaagccaagttggtgttggcgtatttcaagaaaacgtatttcatacaatgtggcatgtcactagaggagcagtactaatgtaccagggaaaaagactggaaccctcttgggcaagcgttaaaaaggatctgatttcttatggtgggggatggaggctccagggatcttggaatacaggtgaagaagtacaggtaatagcggtagaacctggcaaaaatcctaagaatgtacaaacggctcccgggacctttaagacccctgagggggaggtcggtgctatagcactagatttcaaaccgggtacaagtggttctccaattgtcaacagagaaggaaaaatagttggtctgtacggtaatggcgtggtaactactagcggtacctatgtctcagcaatagcacaggccaaagcaagtcaagagggtccactgcccgaaattgaagacgaagtcttcagaaaacgcaatttaaccataatggatctccatccgggttcgggaaaaaccagaagataccttccggcgatagttagagaagctataaagcgtaaacttaggacgttaatactagcaccaacccgtgttgttgcgtcagagatggcagaagcacttaaaggaatgccaattagataccaaactacggcggtaaaatcggaacatactggaaaggaaatagttgacttaatgtgccatgccacttttaccatgcgactgttatcacctgttcgagtccctaattacaatatgattataatggatgaagcgcacttcacagacccatcaagtattgcggcaaggggatatatatcgactcgtgttggaatgggagaggccgcagcaatatttatgaccgctactccgcctggctcagttgaagcattcccccaatcaaatgcagtaattcaagatgaagaaagggatattccagagcgctcttggaactccggttacgaatggataaccgatttccctgggaaaacggtctggtttgtaccatcaataaaaagtgggaacgatattgcaaattgcttacgaaagaatggaaaaagggtcatacaattgagtcgtaaaactttcgataccgaatatcaaaagacgaagaataatgattgggactatgtggttacgacggacatctctgaaatgggggcaaattttcgagccgatagggtaatagatccacgacgttgtctaaaaccagtcatactcaaggacggacctgaacgggtcatcttagctggccctatgcccgttacggtagcatctgctgcgcaacgacgtggacgaatcggtcgaaaccacaacaaagaaggggatcaatatatatatatgggtcaacctttgaataatgacgaggatcacgcacactggactgaagcaaaaatgctgttagacaatatcaatacaccagaaggaataatacctgcactattcgaaccagagcgcgagaaaagtgcagctatcgatggcgaataccgtttgcgaggagaagctagaaagacttttgtggaattaatgcggcgtggagatctaccagtatggttgagttataaagtagcttcagaaggatttcagtatagtgacaggcggtggtgtttcgacggagaaagaaataatcaggttctagaagaaaacatggatgtggaaatttggacaaaagagggagagaggaagaaactacgtccaaggtggcttgacgcgcgcacgtattctgatcccctggctcttagggaatttaaagagtttgcggcaggtaggagatccgtttcgggcgatttgatactagagataggtaaactaccccaacatttgacacaaagggcacaaaatgcactcgacaatttggtgatgttacataatagtgagcagggaggaagggcgtatagacacgcaatggaagaattgcctgatactattgagaccctgatgctattagctctaatagcagtattgacagggggtgtgactttattctttcttagtggtagaggattgggtaaaacttctattggattactatgtgttatggctagtagtgttttactatggatggcgtcagtagaaccgcactggatagcagcaagcattattctcgaatttttcttaatggttcttctaatacccgaacctgacagacagagaacgccccaggacaatcaacttgcatatgtagtaataggcctgctttttatgatattaacggtcgcagcaaacgaaatggggttactcgaaaccacgaagaaagacctaggcatagggcacgtagcagtcggtaaccatcatcacgccgctatgttggacgtagatttacatccggcatccgcctggacactctacgccgtagccacaaccataatcacgccaatgatgaggcataccatagaaaataccaccgctaatatatcattgacggcgatcgcaaatcaagccgccatcctaatgggacttgataagggttggccgataagtaagatggatatcggagtcccgcttttagctttaggctgttactctcaagtaaacccattaacactcaccgctgcagtcctaatgctagtagcacattacgcgattataggacctggattacaggctaaagctactcgtgaggcacagaaacgaactgcggccggtataatgaaaaaccccacggtagacgggatagtagcaatagacctggatccagtagtgtacgatgccaaattcgagaaacagctcggtcaaataatgttattaatactttgtacaagccaaattctgctaatgcgaactacttgggctctctgtgagagcataacattagcaacaggcccactaacgacattatgggaaggatcaccaggtaaattttggaatacaacaattgcagttagtatggccaatatatttagaggaagctatcttgccggtgcaggtctagcattttctttaatgaagtccctaggtcgaggacgaagaggaacaggagcgcaaggtgaaacactaggtgaaaaatggaagcgtcaacttaatcaacttagtaaatcggaatttaatacttacaagcggtccggcatcatggaggtcgacaggtcagaagcaaaagaaggcttaaaaaggggtgaaacaacaaaacatgctgtatcccgtggcaccgcgaaattacgatggttcgtagaaaggaatttagtaaaacctgagggtaaagtcatcgatctgggttgtgggaggggcggttggtcatattactgtgcgggactaaagaaggtaacggaggtgaaggggtacacaaaaggcggccctggacatgaagaaccaatacctatggccacatacggatggaacttagttaaactgcactctgggaaagacgtatttttcatcccacccgagaaatgtgatacgttattatgcgacatcggagaaagttctcccaatcccactattgaggaaggacgcacgctcagggtccttaagatggtcgaaccatggcttcgaggaaatcaattttgtattaaaatccttaatccttatatgccatctgtagtagaaacgttagaacaaatgcaacgtaaacacggtgggatgctcgtcagaaatccattaagtaggaactcaactcatgaaatgtactgggtttcctgcggtaccggcaacatagtaagtgctgtcaatatgacaagtagaatgttattaaacagattcacgatggcccatcgaaaaccgacttacgaaagagatgtagatcttggagccggcactcgtcacgttgcagtagagccggaagtagccaacctagatataatagggcaacggatagagaacattaaacatgaacacaaatccacatggcattatgacgaagacaatccatataaaacatgggcatatcacggatcgtatgaagtaaaacctagtggatctgcatcgtcaatggtaaatggagtagtaaaacttttaacaaaaccctgggacgtcataccaatggtaacgcagatcgcaatgacggatacaacgccattcggtcaacaacgagtattcaaagagaaggtagatactagaaccccaaaggctaagagggggacagctcaaattatggaagtaacagctaaatggctttggggatttcttagtagaaacaagaaaccgcgcatttgtaccagggaggagttcactcgtaaagttcgttcaaatgctgctataggagctgtctttgttgacgagaatcagtggaacagcgcaaaagaggcagtcgaagatgaaagattttgggacttagtgcatagggaacgagaattacacaaacaagggaagtgcgcgacatgtgtgtataacatgatgggaaaaagagagaagaaactaggagaatttggcaaagcaaaaggttccagagctatatggtacatgtggttaggagcgagatttttagaatttgaggctttaggattcatgaatgaagaccattggttttcaagagaaaactcactaagtggtgtagaaggtgaaggacttcacaaacttggttatatattaagggacatttcgaaaataccaggcgggaatatgtacgctgatgatacggcaggatgggacacaagaattactgaagatgatttacaaaatgaagcaagaatcacagatataatggaacctgaacatgcacttcttgcaaaaagcatcttcaagctaacatatcaaaacaaagtagtccgtgtccaaagaccagctaagaacggtaccgttatggacgtaatctcaaggagagaccaaagaggttcaggtcaagtaggcacctacggccttaatacatttacgaacatggaagcacaattaatccgacaaatggagtcagaagggatcttttctccttcagaattagaaacgccaaacctagcggaacgggtactagattggttagaaaaatacggtgtagaacgcttaaaaagaatggccatatcaggagatgactgtgtagttaagccaatagacgatcgctttgcaactgctcttacagcacttaatgatatgggcaaagtacgcaaagacattccacagtgggaaccttcaaaaggatggaatgactggcaacaagttccattttgttcgcaccattttcaccaattaataatgaaagacggaagagaaatagtcgtaccatgccgcaatcaggacgagctcgttgggagagcccgagtctcacaaggtgcagggtggagtttaagagagactgcctgtttaggtaagagctatgcacaaatgtggcagttgatgtactttcatagaagagatctgagacttgcggcaaatgcaatctgttccgcagtacctgttgattggattcccacaagcagaacaacatggtcaatacacgcacatcaccaatggatgactacggaagacatgcttagtgtgtggaacagagtttggatagaggagaatccatggatggaggacaagacacatataagtagttggggtgatgtaccctatctgggcaaacgtgaggatcagtggtgtggatctctgatagggctgacagcaagggcaacctgggcaacaaacattcaagtagccatcaaccaagtacgtagattgatcggaaacgagaattacttagactacatgacttcaatgaaaaggtttaaaaatgaatctgatccagaaggagctctatggtaa

SEQ ID NO: 21213 - RNA, 9879 nt, synthetic construct
  misc_feature 1..9879: note = derived and/or modified CDS sequence (opt6) from DENV-1__HM181944__SS-prME
  source 1..9879: mol_type = other RNA
tcggttacaatgttgctaatgcttatgcccactgctcttgcatttcatctaaccacacgcggtggagaaccacatatgattgtttcaaaacaagaacgaggtaaatcccttttatttaaaacgtcagctggtgtcaacatgtgcacactaatagctatggacctcggggaattatgcgaagataccatgacatataaatgccctaggatttcagaagctgaaccagacgacgttgattgttggtgtaacgcgacagatacctgggtaacatatgggacatgtagtcagacaggagaacacaggcgagataaacggtcagttgcactggctcctcatgtcgggctaggattagaaactcgcacagaaacatggatgtcttctgaaggagcgtggaaacaaattcaaagggtagaaacctgggcactgcgacatccgggctttactgtcatagcattattcttagcacacgcaataggcacgagtattacccaaaaaggcataattttcattcttcttatgctagtgactcccagcatggcaatgaggtgcgtaggcattgggagtcgcgatttcgtagaaggactcagcggagcaacgtgggtagatgtcgtattagaacatggatcatgtgttactactatggcgaaagataaacccacacttgatattgaattactaaaaacagaagtaacgaatccagcagtgctccgcaaattgtgtattgaagcgaaaatttcaaatacaaccaccgacagtaggtgtcctacgcaaggggaagccacacttgtagaagaacaagacgctaattttgtgtgccgacgaacattcgtagatcgaggttggggtaatgggtgtgggctatttggaaaaggctccctaataacgtgtgcaaaatttaaatgcgtcacaaaattagaaggtaaaatagttcaatacgaaaatttaaaatatagtgttattgtaacagttcatacaggtgaccaacatcaagtcggtaatgaaagtactgaacatggaacaacggcaacaattacgccacaagcaccgtcaacagaaatacaactcaccgactacggagccttaacgttggactgctctccaaggacgggcttagatttcaatgaaatggtattactgaccatgaaagaaaaatcatggttagtacacaaacaatggtttctagatttaccactaccctggaccagcggagcaagtacaagtcaagaaacgtggaatcgtcaggatctcttagtgacatttaaaaccgcccatgccaagaaacaagaagtggtcgttttaggctcacaggaaggtgcaatgcataccgcactaactggcgcaacagagattcaaacttcgggtacaactaccatcttcgcaggacatttaaaatgccgattaaaaatggacaaactcacacttaagggaatgtcatacgtaatgtgcactggctcattcaaattagaaaaagaagtagctgaaacacaacatggaacggtactggtgcagattaagtatgaaggaacggatgccccatgtaagatccctttttcaactcaagatgaaaaaggagtaactcaaaatggtcgactgataacagctaacccaatagtaacagataaggaaaaacccgtaaatatcgaagctgagccaccattcggtgagtcgtatatagtaataggagcgggggaaaaagctctaaaactgtcttggttcaagaaaggaagcagcataggaaaaatgttcgaagctactgctaggggagcgaggagaatggcaatattaggggatactgcatgggactttggctccattggaggggtctttacatcagtcggaaaacttgtgcaccagatttttggcaccgcgtacggcgtactattcagtggcgtttcatggacgatgaaaatcggaataggggtactcttaacatggttgggcctaaattcccgtagcacctcactgtcgatgacctgtatagcagtcgggctggttactctttacctgggagtcatggttcaagcggatagtggttgtgtaattaactggaaaggtcgggaactaaaatgtggaagcggtatttttgtaacaaacgaagtccacacttggactgaacaatacaagtttcaagctgattctccgaaaaggctatcagccgctataggtaaggcttgggaagaaggcgtctgtggcattcggtctgctacacgcctagaaaacataatgtggaaacaaataagtaatgaattgaaccacattttattggaaaacgacatgaaatttactgttgttgtgggagatgtcgcaggaattttagcgcaaggtaaaaagatgatcagaccgcagccaatggaatataaatactcatggaagagttggggaaaagcaaaaatcataggtgcagacgtacaaaatacaactttcataattgatggaccaaacacacccgaatgtccagacgaccagcgagcatggaatatttgggaagtagaagattacggtttcggcatatttactactaatatttggctaaaacttcgcgattcgtatactcaagtttgtgatcatagactaatgtccgctgcaataaaagattcaaaggcagtgcacgcggacatgggatattggatagagtccgagaaaaatgaaacgtggaaattagcgcgtgctagttttatcgaagtgaaaacctgtatatggcccaaatcacacacattatggtcaaacggcgtattagagtcagaaatgataattccgaaaatctatggaggaccaatcagtcaacacaattacagacccggatatttcacccagaccgctggaccttggcacttaggtaaactggaattagatttcgacctatgtgaaggtactacggtagtagtagacgagcactgtggaaatagaggaccaagtttacggactaccacggttacaggcaagattattcatgagtggtgttgcagatcctgcacactgccacccctacgtttcaaaggagaagatggttgctggtatgggatggaaatccgtccagtaaaggagaaggaagaaaatctcgtcaagagtatggtctcggcgggatctggggaagtcgattcgttttcactaggtttactgtgcattagtataatgatcgaagaagtaatgcgatctagatggtccagaaaaatgctaatgacaggtacactggcagtattctttctcttaataatgggccagctaacatggaacgatctaatacgcttatgcataatggtgggcgcaaatgcgagcgacagaatgggaatgggaatgacctacttggcattgatggctacctttaaaatgcgaccaatgtttgcagttggcctactatttagaagacttaccagccgagaagtccttcttctaactataggtcttagccttgtcgcctccgtagaactacctaacagccttgaagaactcggagatggcttagcgatgggcataatgatattgaaactattgactgattttcagtcccaccaactctgggcgacactcctctctcttacatttattaaaactacattctccctacattacgcctggaaaacaatggcaatggtcctaagcatagtttcattgtttcctctttgtctatcaaccacttcacagaaaacgacttggctaccggtactcttaggttctttaggctgtaaacccttaacaatgttcctgattgccgaaaataagatatggggacgtaagagttggccactaaacgaaggcatcatggcggtaggaatcgttagtatcttattatcttcattacttaaaaatgatgtaccattggcaggtccgctaattgcgggtggcatgctgattgcttgttatgtaatatcaggatccagtgccgatctgtctttagaaaaagctgctgaagtaagttgggaagaagaagccgagcatagtggggctagccataacatcctagtcgaagttcaagatgatgggaccatgaagataaaagacgaggagagagatgatacgctaacaatattgctaaaggcaacactgctagctgtatcaggtgtatacccactctccatcccggctacactttttgtatggtatttctggcaaaagaagaaacaaagaagcggagtgttatgggacacaccaagtccaccagaagtagagagggcagtactagacgacggaatataccgaattatgcaaaggggcttactgggtcgaagtcaagtgggcgtaggggtttttcaagaaaacgtttttcatacaatgtggcacgttacgcgtggagcggtacttatgtaccaaggaaaacggttagaaccctcttgggcaagcgtcaaaaaggatttaatatcatacggtggtgggtggagattacagggatcatggaatacaggggaggaagtacaagtaattgccgttgagccaggcaaaaaccccaaaaacgtccaaactgcccctggaacctttaaaacttccgaaggcgaagtaggtgcaatagcactagactttaaaccaggtacatctggctcacctatagtaaacagggaaggaaaaatagttggactctatggcaacggtgtggtgacgacatcagggacgtatgtttccgcaatagcccaagcaaaagctagtcaagaaggcccactgccggagattgaagacgaggtgttcagaaaacggaatctaacaattatggatttgcaccctggaagtggtaaaacacgcagatatctacccgcaattgtacgtgaggctataaagagaaaattaagaactttaatcttagctccgacgcgcgttgtagcctccgaaatggcagaggctttgaaaggtatgccaatacgttatcagaccacagcagtgaagtcagagcacacgggaaaagaaatagtcgatttaatgtgccatgctacttttacaatgagacttctatcacctgtaagagttcccaattacaatatgatcattatggacgaagcacattttaccgacccatcatcaatcgctgcaagagggtacatttcaactcgagtcggaatgggtgaggctgccgcaatattcatgacggcgacaccgccaggatccgtcgaggcatttccgcagagcaatgcggttatacaagatgaagaacgagatataccggaacggtcatggaactcaggatacgaatggattaccgactttccagggaaaaccgtttggtttgttccatccattaagagcggtaacgatattgcaaattgcctacgtaaaaacggtaagagagtaattcaactgtctaggaaaacattcgataccgaataccagaaaaccaaaaataacgattgggactatgtagtaactactgatatatctgaaatgggtgccaacttcagagcagaccgggtcattgatccgagaaggtgtttgaagcctgttattcttaaggacggaccagagagagtgatcttagcaggaccaatgcccgtcacagttgcctctgcggctcaacgcagggggaggattggacgaaatcacaataaagaaggagatcaatacatctatatgggacaaccacttaacaacgacgaagaccacgctcactggacggaagctaaaatgctactcgataatataaatacgcccgaaggaatcatacctgcattgtttgagcctgaaagagagaaaagcgcagcgatagatggcgaatatagattaagaggtgaagcaaggaaaaccttcgttgaactcatgagaagaggtgacttacctgtctggttatcgtacaaagtcgctagtgaaggattccaatattctgacaggcgttggtgctttgatggcgagcgaaacaatcaagtgctggaagaaaacatggatgtcgagatctggactaaggagggagaacggaagaaactaagacccagatggctagacgctcgcacttactcggatccacttgcacttagagagttcaaagagttcgcagctggcagaagatcagtcagtggtgacctgatcttagagataggaaaacttccccaacatctaacccagagggcacagaatgctctagacaacctggtgatgctgcacaactcagaacaaggcggacgtgcgtataggcatgctatggaggagctacccgacactatagagactctgatgttattggcattaatagctgttcttaccggaggagttaccctattctttctatcaggcagaggtctaggaaaaacaagtattgggcttctttgtgtcatggcaagttctgtcttgttatggatggcatcagtagagccgcactggatagcagcctctataatactagagttctttctaatggtgttactaatacctgaacctgatagacaaagaactccccaagacaatcagttagcatacgttgtaataggcctactattcatgatattaaccgtcgcagccaatgaaatgggattacttgaaacgactaagaaagatctaggtattggtcacgtggctgttgaaaatcatcaccatgctgcaatgctagacgtagacctgcatcccgcaagtgcatggaccctgtacgccgtggcaactactattattaccccaatgatgaggcacaccatagaaaataccacggctaacattagtctaacggctattgcgaatcaagcggctatactaatgggcttagacaagggttggcctatatcgaagatggatatcggcgttccactgttagcattaggctgttattcccaagtcaatcctcttactctaacggcagcagtgctaatgttagtagcgcattatgcgattataggaccaggtctccaagcaaaagcaacgagagaagcacaaaaacgtactgcagcgggaataatgaaaaacccgacagtagatgggatcgttgcaattgatttagaccctgttgtttatgatgcaaagtttgaaaaacagctaggtcaaataatgttactgatactttgtacctcacaaatattgttaatgagaacaacatgggccctatgcgaaagtataacattagcgactggtcccctgacgaccctatgggaagggagcccgggcaaattttggaacacaaccatagcagttagtatggctaacattttccgaggtagttatcttgcaggagcggggctagcattttctcttatgaagagtttaggtggcgggcgcaggggaactggagcccagggtgagactctcggagagaagtggaaacggcaactaaatcaactctcgaagtcagagtttaatacctacaaaagaagcggcattatggaagtagatagatcagaagcgaaggaaggcctaaagagaggggaaacaacaaagcacgccgtgtcaagaggaacggcgaaattaaggtggtttgtcgaacgaaaccttgtcaaacctgaagggaaggtcattgacctcggatgtgggagaggaggatggagttactactgtgcaggactaaagaaagtgacagaagtaaaagggtataccaaaggaggaccaggacatgaagaacctatcccaatggcaacatacggttggaacttggtgaaactacattccggcaaggatgtatttttcgtaccacctgagaaatgcgacacattgctatgcgatataggagaaagttctccaaaccctactatagaagaagggagaacattacgggtactcaaaatggtagagccgtggttaagaggaaatcaattttgtattaaaattttaaacccttacatgccaagcgtcgtcgagactctagaacagatgcaacggaaacatggaggcatgcttgtgcgaaatcccttgtctaggaactccacacacgagatgtattgggtatcttgcggtaccggaaatatcgtaagtgctgtgaacatgacatcaagaatgcttttaaatagatttaccatggcacatcgtaaaccaacatatgaacgggatgttgatctaggtgccggtacaagacatgttgctgtcgaacctgaagtagcaaatttagacataattggacaaaggattgaaaatataaaacacgaacataagtctacttggcactacgatgaagataacccttacaaaacatgggcataccatggaagttatgaagtaaaaccgtcaggaagcgcttcatccatggtaaacggcgtagttaaacttcttacgaaaccgtgggatgttataccaatggtaactcaaatcgcaatgaccgatacaactccttttggtcaacaacgagtattcaaagaaaaggtggatacaagaacccctaaggcaaaacggggtactgcacaaatcatggaagtgaccgcaaaatggctgtggggctttcttagtagaaacaagaaaccccgaatctgtacccgcgaagagttcactaggaaagtaaggagtaatgccgcaataggagccgtttttgtcgacgaaaatcagtggaactccgcaaaggaagcagtcgaagacgaaaggttctgggacttagttcatcgagaaagggaattacataaacaaggaaagtgtgccacatgtgtctataacatgatgggaaaacgagagaagaaattaggtgagtttggcaaagctaaaggttcgagagcaatatggtacatgtggctgggggcaagattcttggagttcgaagcgttgggttttatgaatgaagatcattggttttccagagaaaatagcctatctggagtagaaggggaaggtctgcataaactaggctatatattaagagatataagcaaaataagcgggggaaatatgtacgcagatgataccgccggctgggacactagaataacagaagacgatttacaaaatgaagccaaaataactgatattatggaaccagaacacgcacttctcgcaaatagcatctttaaactaacctatcaaaacaaagttgtaagagtgcaaagaccagctaaaaacggtactgttatggacgttataagtcgaagggaccaaagaggatctggccaagtgggaacctatggacttaacacttttacaaatatggaagctcaactaataagacaaatggaatccgaaggtatatttagtccaagtgaactcgaaactccaaatcttgcagaaagagtcttagattggctagagaaacacggagttgaacgattaaaaagaatggccatatcaggggatgactgcgtagtaaaaccaattgacgaccgatttgcaacagcattaacagctcttaatgatatgggcaaagtacgtaaagacatcccgcaatgggagccatctaaagggtggaacgattggcaacaagtcccattttgttcacaccactttcatcaattgattatgaaggatggcagagagattgtagttccatgtagaaatcaagacgaattggtgggccgggctagggtgtctcaaggcgctggttggtctctaagggagacagcttgcctaggtaaatcatacgctcaaatgtggcaattaatgtactttcacagacgtgatctcagattagcagcaaacgcgatatgttcggcggtacccgtagactgggtacccacctctcgaacaacgtggagtatacatgcacatcatcagtggatgaccaccgaagacatgctatcagtctggaaccgtgtatggatagaggaaaatccctggatggaagataaaactcacataagtagctgggaggacgttccttatctgggcaagcgagaggaccaatggtgcggttctctcatcggtttaacagctcgagcaacgtgggcgacaaacatacaagtggctataaaccaagttagaagactcataggcaatgaaaactacttagactacatgacctctatgaagagatttaaaaacgaaagcgatccagagggagcactgtggtaa

SEQ ID NO: 21214 - RNA, 9879 nt, synthetic construct
  misc_feature 1..9879: note = derived and/or modified CDS sequence (opt6) from DENV-1__HM181946__SS-prME
  source 1..9879: mol_type = other RNA
agtgttacaatgctgctaatgctaatgccgactgcactcgcattccatttaacaacaaggggtggagaaccacacatgatagtaagcaaacaggaaagggggaaatctctactttttaaaacaagtgcaggcgtgaatatgtgcaccctgatcgcgatggatttaggcgaactatgcgaagacacaatgacttataaatgcccgcgaataacggaagcagaaccagatgacgtagattgttggtgtaacgctacggatacatgggttacatatgggacttgttcacagacaggcgaacaccgaagagataaacgaagtgttgcactggccccacacgtaggactaggattagaaacaagaactgaaacatggatgagtagtgaaggcgcctggaaacaaattcaacgtgtggaaacatgggcacttcgacatccaggctttactgtgatagcactctttttagcccatgcaattggtacgagtataacacaaaaaggaatcatctttattttgttaatgttggtaactccttctatggcaatgcgatgcgtcgggatcggttcaagagattttgttgaaggactgagcggcgctacatgggttgatgtagtgctagaacatggaagctgcgtaacaacaatggctaaagataaaccaaccctagacattgaattattgaaaactgaagttacgaacccggccattctgagaaaattgtgcatagaagctaaaatctcaaatacaacaacagattcgaggtgtcctacccaaggagaggcaaccctggtggaggaacaagatgctaactttgtctgtaggaggacatttgtggacagagggtggggcaacgggtgtggactttttggaaaaggaagtctaatcacatgtgctaaattcaaatgcgttactaaactcgaaggaaaaatcgtacaatatgaaaatctcaaatatagcgtgatagtaacagttcataccggagaccagcatcaagtgggaaacgaaagtacggagcatggtacaacggctacaatcaccccacaagctccaacaacggaaatacagctgactgattacggagccttaacattggattgctcaccaaggacgggactagacttcaacgagatggtcttgttgaccatgaaagaaaaatcctggttggttcataaacagtggtttctagacttacccctaccatggacaagtggagccagcacaagtcaggaaacatggaaccgacaggatctcttggtaacttttaaaactgcacatgccaaaaagcaagaagttgtagtactcggatcgcaagaaggagcgatgcatacggcactgacgggtgcaactgagatacaaacaagtggaacaacaaccatatttgcgggtcatcttaaatgtaggttaaaaatggacaaactaacattaaagggtatgtcttatgtcatgtgcactgggagcttcaaactggaaaaagaagtagctgaaacccagcatggtacagtcttagtacaaatacgatatgagggaactgatgccccatgcaagataccattctcaactcaggacgaaagaggagtcacacagaacggcagactaataacggcaaaccctatagtaacagataaagagaaaccagtgaatatagaggcagagccaccgttcggggaaagttatattgtaataggcgcgggagagaaagcacttaaactaagttggtttaagaaaggatcttcgataggaaaaatgtttgaagcgacagctagaggagctcgacggatggcaatattaggtgatacggcgtgggattttggtagtataggaggcgtatttacaagcgtaggaaagctagtacatcaaattttcgggactgcctacggggtcttattctctggtgtaagctggaccatgaaaattggtattggggtactcctaacttggttaggtcttaatagcagatccacatcatttagtatgacgtgcatcgcagtaggcctagtaacgttatacttaggcgtcatggtacaggctgactccgggtgcgttattaactggaaggggagagaattaaaatgcggaagcgggatatttgtcactaatgaagtgcatacatggactgagcaatataaatttcaagctgactccccaaaaagactgagcgcagcaattggtaaggcttgggaagaaggagtctgcggaataagatcagcaacacgattggaaaacattatgtggaagcaaatctcgaacgaattgaaccacattttgctagaaaatgatatgaaatttactgtagttgtcggagacgtcgcgggtatattagcacagggcaagaaaatgattagaccccaacccatggaatacaaatatagctggcgcagctggggcaaagcaaaaataataggggccgacgtacaaaacaccacctttataatcgacggtccaaatacacctgaatgtcccgacgatcaacgagcatggaatatttgggaagtggaagactatggatttggaatattcacaacaaatatctggttaaaactaagagatagctatacccaagtatgcgatcatcgtttaatgtctgccgcaataaaagattctaaagctgttcatgcggatatgggttattggatcgaatctgaaaagaatgaaacttggaaattggccagagcatcctttatcgaggtgaaaacatgtatttggccgaaatcccatacgctatggagtaatggtgtccttgagtcagagatgataataccaaagatttatggtggaccaattagtcaacataactataggccggggtactttacccaaacagcagggccttggcatctaggaaaactagaactagacttcgacctttgtgaaggcaccacagtagtagtagacgagcactgtggaaacagagggccatcattaaggactacaacggtaactggaaaaataatccacgaatggtgctgtaggagctgtacgctacctccccttcgattcagaggggaagatgggtgctggtatggtatggaaataagacccgttaaggaaaaagaagagaatttggtaaaaagcatggtaagcgcgggaagtggcgaagtcgattcattttccctggggttactatgcatcagtatcatgatagaagaagttatgagatcaaggtggtcaaggaaaatgttgatgactgggaccctagctgtgttccttctgctcatcatggggcaactaacttggaatgacctaatccggctatgcataatggttggcgccaacgcaagtgatagaatgggtatgggaacaacatacttagcactcatggcaactttcaaaatgaggcctatgtttgcagtaggattactttttagaaggttaacatcaagggaagtacttttactcacaataggtctcagtttggtagctagcgtagagctacctaacagcttagaggaactgggtgacggtctagcaatgggaatcatgatccttaaactcctaacggattttcaatcacatcaattatgggctacattactttctctaacattcataaaaacaacctttagcctacactatgcatggaaaaccatggcaatggtgttaagtatagtgtctttattcccgctttgcttatctactacaagtcagaaaactacatggctgcccgtacttcttggttcgttaggatgtaagcctctgacgatgtttctaatagccgaaaacaagatatggggtagaagatcgtggccgttaaacgaaggaatcatggctgttggcattgtaagtatattattgagttcattactcaaaaacgatgtacctttagcaggtccactaatcgcaggaggcatgttaatcgcatgttacgttatatctgggagctctgcagatctttcattggagaaagctgcggaggtaagctgggaggaagaggcagaacattccggagcctcgcataacatcctagttgaagttcaagatgacggaacaatgaagataaaggatgaagagagagatgacacattaacaatcttactaaaggctacactcctcgcagtatctggtgtatatcctctgtctatccccgctacattatttgtatggtatttttggcaaaagaaaaagcaacggagtggggtattatgggatacacctagtccacctgaagtggaaagagcggtattggatgatggaatctacagaataatgcagagagggttgctggggagaagtcaagttggagtaggggtattccaggaaaacgtatttcacacgatgtggcacgttacccgaggcgcagttttgatgtaccagggaaagcgattagagccgtcctgggcgtcagttaagaaagacttaatatcctacggtggaggttggagactacagggaagttggaatactggagaagaagttcaagtgatagctgtagagccaggtaaaaacccaaagaacgttcagacggctccaggaacgttcaagacaccagagggggaggtaggagccattgcattagattttaaacccggcacttcaggcagcccaattgtcaaccgggaaggcaaaattgttgggctttatggtaacggagtagttactacctctggaacatatgtgtctgcaatagcgcaagcaaaagcatctcaggaaggccctttacctgaaatagaagatgaagtttttaggaaacgcaacctaactataatggatttacatccaggaagcggaaaaacaaggaggtatttgcctgcgatagtaagagaagcaataaaacgaaaattacgaactctcatattagcgcctacccgggttgtagcatccgaaatggcggaggctttaaagggaatgcctatacgctaccaaacaaccgcggtgaagtcagaacacactggtaaagaaatagtagatttaatgtgtcacgcaacatttactatgagattactttcaccagtccgagtccccaattataacatgataattatggacgaagcgcattttactgatcctagttcgatagctgccaggggatatatttcgacccgagtgggcatgggagaagctgctgcaatatttatgacagctacaccgcctggatccgtagaagcgttcccacaatccaatgcagtaatacaagatgaggaaagagatattcccgaaaggtcttggaactctgggtacgagtggattacagatttcccaggaaaaacagtttggtttgttccgtcaatcaaaagtggtaatgacatcgctaactgtttacgcaagaacgggaaacgggtaatacagctctcgagaaagaccttcgatacggaataccagaaaactaaaaataatgattgggattacgtcgttacgacagacatcagcgaaatgggtgcgaactttagggcagatagggtcattgatcccagaaggtgtctaaaaccagttatattaaaagatggaccagaaagggttattctggcaggtcctatgccagtcacagtggcatcagcagcccaaaggaggggaagaatagggagaaatcacaataaagaaggggatcaatacatttacatgggacagcctctaaacaacgacgaggatcatgcacactggacggaagccaagatgttgctggataatataaatacccccgaaggaataatacccgcgctatttgagccagaaagggaaaagagtgcagcgatcgatggtgagtacaggcttcggggcgaagctcgcaaaacatttgtagaattaatgaggcgaggcgatcttccagtctggttgtcttacaaggtagcgagtgagggattccagtatagtgatcgaagatggtgttttgatggagaacgaaataatcaggtcttagaagaaaatatggatgtggaaatctggacaaaagaaggcgaaagaaagaaattacgcccgagatggttagatgcccgaacctatagcgacccccttgcactccgcgaatttaaagagtttgcggctggaaggagaagcgtttccggggatctgatcttagaaataggaaaattaccgcagcatctcacacagagagcgcaaaacgcgcttgataatcttgtaatgttacacaattcagaacaagggggaagggcctatagacatgctatggaagagttgccggatacaatagaaacgttgatgttgctggcattaatagctgtgctcacaggtggtgttactttatttttcctttccggaaggggtttaggaaagacatcgataggtttattgtgtgtaatggcatcttcagtgctattgtggatggccagcgtggaaccacactggatcgctgcgtctatcattttagagttctttctgatggtattattaatacctgaaccagatcgacaaagaacgccccaagataaccaattagcttacgtggtcatcggcttgttatttatgatactaacagtagcagcaaatgaaatggggctactcgaaactaccaagaaagacctcggtattggtcacgtcgcagttggtaaccaccaccacgcagccatgctagatgtggatctacatccagcttcggcatggaccctttatgccgttgcaactactattataacccccatgatgcgacatacgatcgaaaacactacagctaacatcagcttaacagcaattgcaaatcaagcagcaattttaatggggttggataagggatggccgataagcaagatggatataggtgtacctttgctcgcactcggatgctactctcaagtaaacccgctgacacttactgcagctgtgcttatgctagtagcgcactacgcaattatagggcctggacttcaagcaaaagcgactcgagaagcacagaaaagaacagccgctgggataatgaaaaatccgacagtcgacggaatagtagctatcgatcttgatccagttgtatacgatgctaaattcgaaaaacaattaggacagattatgttgttgatactgtgtacatcgcagatattacttatgagaacaacttgggcgctttgcgaatctatcacactcgcgacgggtccattaactactttgtgggaaggttcaccaggaaaattctggaacactacaattgccgtatcaatggcaaacatctttcgtggttcttatttagctggagccggcttagctttttcattaatgaaatcgctcggaggtggacgaagaggaaccggagctcaaggcgaaaccctaggagaaaaatggaaaagacagctaaatcaactttcgaaaagcgaatttaatacatataaacgatcgggcataatggaggtagatagaagcgaagccaaagaggggcttaagcgtggagaaacaacgaagcacgcagtgtcacgtgggacggccaagctacgatggtttgttgaaagaaatttagtcaaaccggagggtaaggtcatagatcttggttgtgggagaggtggatggtcctattactgtgcaggtctaaagaaagtaacagaagtcaaaggatatacaaagggtggacctgggcatgaagaacccattccaatggcgacgtatggatggaatttagttaagctccacagtggaaaggacgtattctttgtgccgcctgaaaagtgtgataccctactgtgcgacatcggcgaatcatctcctaatccaacaatagaagaaggcagaaccttaagagtattaaaaatggtagagccatggttacgaggtaaccagttctgtatcaagatactgaatccatatatgccttcagtagtcgaaacactagaacaaatgcaaaggaaacacggtggcatgctggttcgaaatccattatcaagaaactctacgcacgaaatgtattgggtctcctgtggcactgggaatattgtgagcgcggtaaacatgacatctaggatgttattaaacaggttcacaatggcacatagaaaacccacatatgaaagggacgtggacttaggggcaggaactcgccatgtcgctgtagaaccggaggtagcaaatctcgatattataggacaaagaatcgaaaacataaagcatgaacacaagagcacctggcattatgatgaagataatccatacaaaacttgggcatatcatggaagctatgaagtaaagccatctggatcggcttcaagtatggtcaatggggttgtaaaacttctaacaaaaccatgggacgtaatccccatggtaacacaaattgcaatgacagacacgacaccgtttggtcaacaacgggtcttcaaagagaaagtagatacaagaacaccgaaagctaaaagaggaacggctcaaataatggaagttacagctaaatggctctggggtttcttgtctaggaacaagaaaccgcgtatttgcacacgagaggagttcactagaaaagtccgaagcaacgccgcaataggtgcagtgtttgtagacgaaaaccaatggaatagtgctaaagaggcggtagaagatgaacgattttgggatttagttcatagagaacgtgagttgcataaacagggaaaatgtgccacctgtgtatataatatgatggggaaacgagagaagaaattaggagaatttggtaaagctaaagggtctcgagccatatggtatatgtggcttggagcccgctttctagagttcgaagcattaggcttcatgaacgaggatcattggttctctagagagaatagcctgagtggggtagaaggggagggactacataagctaggatacattttgagagatattagcaaaataccaggaggtaacatgtatgctgatgatacagcgggatgggatacccgtattacggaagacgacctacagaacgaagcccgcatcacagatattatggaacctgaacatgcgttgttggcaaaatcaatttttaaattaacataccaaaataaagttgtcagagttcaaagaccagctaagaacggtaccgtaatggatgtcatttcaagaagagaccaaagaggatctggacaagtaggcacttatggtttaaatacatttacaaacatggaggcacagcttattcggcagatggagtcagaagggatcttcagtcctagcgaactcgagaccccaaatttagcagaaagagtactcgattggttggaaaagtacggcgttgagagactcaagcgtatggcaatctcaggtgatgattgtgtagtaaaacctatagacgatcgctttgcgacggccttgacagcactaaatgatatggggaaagttcgtaaagatatacctcaatgggaaccttcaaaaggatggaatgactggcaacaggtgccattttgtagtcatcactttcatcagctgataatgaaagacggaagggaaatcgtagtaccatgcaggaatcaagatgaattggttggacgagctcgtgtctcgcaaggagcaggatggagtttaagggagacggcttgcctaggaaaaagctacgctcaaatgtggcaattgatgtattttcatagaagagatttaagattggcagctaacgcaatatgtagtgctgttccagtagattggatacctacaagtcgaacgacttggagtattcatgcacatcatcaatggatgacaacagaggatatgctctctgtatggaatcgagtgtggatcgaggaaaatccttggatggaggataaaactcatatttcgagctggggagacgtcccctatctaggaaaacgtgaggaccaatggtgtgggtcgctgatcggacttacagctcgagctacttgggctacgaatatacaagtagcaattaatcaggtgcgaagactcatcggaaatgaaaattatttagactacatgacatcaatgaaaagattcaagaacgaatccgacccagaaggggcattatggtaa

SEQ ID NO: 21215 - RNA, 9879 nt, synthetic construct
  misc_feature 1..9879: note = derived and/or modified CDS sequence (opt6) from DENV-1__HM181948__SS-prME
  source 1..9879: mol_type = other RNA
tcggtaacaatgttattaatgttaatgccaacagcactagcatttcatctaacaacacgagggggagaaccacacatgattgtatcaaaacaagaacgagggaaaagtttactatttaaaacctcggcgggagtaaatatgtgtaccctaatagcaatggatttaggagaattatgcgaggatacaatgacatataagtgcccaagaattactgaagtggaaccagatgatgttgactgctggtgcaatgcaacagatacatgggttacatatggaacttgcagccaaactggggaacacaggagagataaaagatcagtcgcgttagctcctcacgttggattaggtttggagacacgaacggaaacctggatgtctagtgaaggtgcatggaagcaaatacaacgcgtagaaacgtgggcgctacggcatccgggatttacagttatagcattgtttctggctcatgctataggaacttcaatcacacaaaaagggatcatctttatactacttatgttggtcacaccttctatggcgatgcgttgtgtaggtataggatcaagagatttcgtagaaggactaagtggtgcgacgtgggtggatgtagttctagaacatggatcctgcgtgactacaatggcaaaggataaaccaacactagacattgaattactaaagacggaagttacaaatcctgctatactgaggaaattatgtattgaggctaaaatctcaaacactacaaccgatagcagatgtccgacgcaaggagaggctaccttagtagaagaacaagacgctaatttcgtctgtcgtaggacattcgtagatcggggttgggggaatggttgtgggctattcggtaagggatcattaatcacatgcgctaagtttaaatgtgtaacaaaactagaagggaaaatagtgcaatatgaaaacttaaaatacagtgtgatcgttacagtccacaccggagatcaacatcaagtagggaatgagtcaacggaacatggtaccacggcaactataacaccacaagctccaacaaccgaaatacaactaactgattacggtgcgcttacactcgactgtagcccaagaacaggactagattttaatgaaatggttttattaacaatgaaagagaaatcctggttagtgcacaaacaatggttcttggaccttccgttaccttggacaagtggggcaagtaccagtcaagaaacatggaatcgacaagatctccttgtaacattcaaaacagctcatgctaagaaacaagaagtagttgttcttggttcacaagaaggagcgatgcacacggctttaaccggagcaactgagattcagacaagcggaacaaccacgatatttgcaggacacttaaaatgtagactaaagatggacaagctcactttaaaagggatgagttacgttatgtgcactggttcattcaagttagaaaaagaagtggcggaaacgcaacatggtacggtcttagtacaaataaaatatgagggtacggatgcaccgtgtaagatccccttttcgacccaagacgaaaaaggcgtaactcaaaatgggagacttataacggccaaccctattgtcacagataaggaaaaacccgtaaatatcgaagctgaaccaccgtttggagaaagctatatagtgataggagctggagagaaagcactaaagttaagctggttcaagaaagggtcctcgataggaaaaatgtttgaagcaaccgccagaggagcgagaagaatggctattcttggggataccgcatgggattttggcagcattggaggggtctttacaagcgtaggtaagctcgtacatcaaattttcggaacagcgtatggggttttgttctctggggtttcctggacaatgaagataggaataggtgtattgttgacatggctaggattaaattcgcgctctaccagtcttagtatgacctgtattgctgttggattagttactctttatttgggcgtgatggtacaagcggattcaggctgtgttatcaactggaaggggagagaattaaagtgtggctcaggaatattcgtgactaacgaagtacacacttggaccgaacaatacaaatttcaggctgactctccaaaacgactatcggcagcaatcggcaaggcatgggaagaaggagtttgcggaataaggtctgcaacacgcctcgagaacataatgtggaaacaaatttcaaacgaattaaaccacattttactagaaaatgacatgaagtttacagttgtagtaggggatgtagcaggcatactcgcccaaggcaagaaaatgatacgtcctcagccaatggagtataaatacagttggaaaagctggggcaaagccaaaattatcggtgcggatgtccaaaacacgacttttattattgacggcccaaacacaccggagtgtccagatgatcaaagggcatggaatatatgggaagtggaagactacggttttgggatatttacaacgaatatttggctaaaactgcgggactcttacacacaagtctgtgatcatcgactaatgtcggctgctataaaagattccaaggcagttcacgctgacatgggttactggatagaatccgagaagaacgaaacgtggaagctggcgagagcctcttttatagaagtaaaaacctgtatctggccaaaatcacacacattatggagtaacggagtattggaaagtgaaatgataatacctaaaatttacggaggcccaatttcgcaacataattaccggccgggatattttacgcaaactgcagggccttggcacttaggcaagttagaacttgattttgacttatgtgaggggacaactgtggttgtagacgagcactgtggcaatagaggccctagtttaaggactaccactgtgacagggaaaattatccacgaatggtgctgtcgtagttgcactctgccaccgctgagattcaggggagaagatggatgttggtacggcatggaaattcgtcctgtaaaagaaaaagaagaaaatctagtaaaaagtatggtatcagccggaagtggagaagtagattcatttagtctagggctattatgcatatctataatgattgaagaagttatgcgtagtcgctggtcccgaaaaatgcttatgaccgggacgcttgccgtatttctgttgttaattatgggacaacttacttggaatgatctaattaggctatgtattatggtgggcgcaaacgctagtgaccgtatgggaatgggcacaacatacctagcgttgatggctacctttaaaatgaggcctatgtttgcggtcggattgctatttcgacgattgacatcacgtgaagtattactattaaccattggactgagtttagtggcaagtgtagaactgccgaacagtctagaggaactcggggacgggctagcgatgggaataatgattttgaagctcctgacagactttcagtcacaccaattatgggccacactactcagcttaacattcatcaaaacaactttctcattgcactacgcttggaagacgatggcaatggtattatcaatagtttcgttatttccattgtgcttgagcaccacaagtcagaaaacaacttggctacccgttctactgggttcgctaggttgcaagccgctgactatgtttctaatcgcggaaaataaaatttggggaagaaggagttggcctttaaacgaaggtattatggcagtgggaattgtgtcaatacttcttagtagtctcctcaaaaatgatgtacctctagctggtccactaatcgccggtggaatgctaatagcgtgctatgttatctccggaagcagtgctgacctcagcttagaaaaagcagccgaagtctcctgggaagaggaagcagaacattctggagctagtcacaatattctagtagaggtccaggatgacggtacaatgaagattaaagatgaagaacgagatgacacgttaaccatcctcttgaaagcaacactcctcgctgtatcaggcgtatatccattatcaatacctgcaacgttattcgtatggtatttttggcagaagaagaaacagagaagcggtgtattatgggatacaccctctccaccagaggtagagagagccgtactagatgatggaatctatcggatcatgcaaagaggactgttggggagaagtcaagttggtgttggggtctttcaagagaatgtttttcatacgatgtggcatgtgactaggggagcagtgttaatgtaccaaggtaaaagattagaaccaagttgggcaagcgtcaagaaagatttaattagttatgggggaggatggaggttacaaggaagctggaatacgggggaagaagtccaggtcattgcggtcgaaccaggcaaaaatcctaaaaatgtccaaactgcgccaggaacatttaaaacacctgaaggcgaggttggagcgatagcactggactttaaacccggaacaagtggttcgcctatagttaatcgagaaggcaaaattgtaggcctctatggaaacggtgttgtcactacatcagggacttatgtgtctgcaatagcacaggcaaaagcctctcaagaaggtcccttacctgaaatagaagatgaagtatttagaaaacgaaaccttactataatggatcttcacccagggtccggtaagaccaggaggtatttgccagcaattgttcgtgaagcaataaaaagaaaactacgaacactcatactagccccgactcgtgtggtcgcatctgagatggcagaggcattgaagggaatgccaatcagatatcaaactactgcagtaaaaagtgaacatacgggtaaagaaatcgtagatttaatgtgtcacgcaaccttcacaatgaggttacttagtccagttcgtgtacccaattacaatatgattataatggatgaagctcatttcacggatccatcatcgattgcagctagaggatacatatcaacaagggttggtatgggggaggctgccgctatctttatgactgcgacaccacctggctccgtggaagcatttcctcaatctaatgcagtgatccaagacgaagaaagggatattccagaacgttcatggaacagtggctatgaatggattactgacttcccaggaaaaacagtatggtttgtcccatcaataaaatctggaaacgatattgctaattgtttacgtaaaaacggaaagagagtcatccagctatcacgcaaaacattcgatactgaatatcagaaaaccaaaaacaacgattgggattatgtagtaactacggatataagcgagatgggagcaaattttagggcagatagagtaattgaccccagacgttgtcttaagccggtaattctgaaagatggcccagaaagggtaatactagctgggcctatgcctgttacagtcgcctcagcagctcaaagaaggggtagaatcggaagaaaccacaataaagagggggaccaatatatctacatgggccagcctttaaacaatgacgaggatcatgcacattggaccgaagctaaaatgctactagataacataaataccccagagggaattatccctgcgttattcgagccagaacgtgaaaaatctgcagcaatcgacggcgaatatcgtctaaggggagaagcaagaaaaaccttcgtggaattaatgcgtcgaggcgatctcccggtgtggctatcatacaaagtggctagcgaaggctttcaatacagtgacagacgctggtgttttgacggtgaacgcaataatcaagtgctggaggaaaacatggatgttgaaatatggacaaaagagggcgaacgaaagaaattgagaccccgatggctggatgcgagaacgtatagtgatcctttagcgctccgtgaatttaaagaatttgcagcaggtagacggtcagtttcaggagatttaatactagaaattggaaaattacctcagcacttaacacaaagagcacaaaatgccttagataacttggttatgcttcataactccgaacaaggagggagagcctaccgtcacgctatggaggaactgccagatactatagaaacactaatgcttttagctctgatagcagtcttgacaggcggagtaactctcttcttcctctcggggaggggattaggaaaaacaagtattggactattatgcgtaatggcatcctcggtgctgctatggatggcatcagtagaaccgcactggatagccgcaagtatcatactagagttctttttaatggttttgttgattcctgaacccgatcgtcaacgtacccctcaagacaatcaacttgcatatgtagtgatagggctattattcatgattctcaccgtcgctgccaacgaaatgggtttactcgaaaccacaaagaaagacttgggaatagggcatgtagcagtgggaaatcatcatcacgctgcaatgttagacgtggatttacatcctgcgtcagcttggacgctatatgcagtggcaacaactataattacccctatgatgagacacacaatagagaacacaaccgcaaatatttccttaaccgcaatagcaaatcaggcagcaatcttaatggggcttgataaaggttggccaattagcaaaatggatataggggtaccattgttagccttgggatgctatagccaagtaaaccccttgacgttaaccgctgcagtgttaatgcttgtagctcattatgcgatcataggtccaggtctacaggcaaaagcgactagagaggcccaaaaacgaacagcagccggaattatgaaaaatcctactgttgacggcattgttgccattgatttggacccagtggtctatgatgctaaattcgaaaaacaacttggacaaataatgctcttaatcttatgtacgagtcaaattttattaatgaggacaacgtgggccttatgcgaaagtataacacttgccacaggccccttaacgaccctgtgggaaggaagtccggggaaattttggaacacaactattgcggtatctatggcgaatatattcaggggttcttatctagccggagcaggattagccttctctctcatgaaatcacttgggggaggtagacgaggtacgggtgcacagggcgaaaccctcggtgaaaaatggaaacggcaattaaaccaattatcaaaatcagaatttaacacatacaaacgatctggcataatggaagtagaccgaagtgaagccaaagaaggccttaaaaggggtgaaaccacgaaacatgcagttagtcgaggtacggccaagctaagatggttcgtcgaaagaaacctcgtaaaacccgaaggtaaagtaatcgacctagggtgtggtagaggtggatggagctattactgcgctggcctaaagaaagtcacagaggtaaaaggttacacgaaagggggtccagggcatgaagaaccaattccaatggccacctacggttggaatttagttaaattacacagcgggaaagacgttttcttcataccacctgaaaaatgtgataccttgttatgtgatattggtgagagttcaccgaatccgacaattgaagaaggaagaacattacgggtcttaaaaatggtggagccgtggttacgggggaatcaattctgcataaaaatactaaatccatatatgccatcagtagttgagactcttgaacagatgcaacggaagcatggagggatgttggttagaaacccactatcaagaaacagcacgcatgagatgtactgggtatcatgcggaaccggcaacattgtcagtgcagtaaatatgacaagtagaatgctactaaaccgttttacgatggcacacagaaagccgacatatgaaagagatgttgatttaggagcgggcactagacatgttgcggtggaacctgaagttgcaaacttagatataattggacaacgaattgaaaatataaaacatgagcataaaagcacatggcattacgatgaagataacccttataaaacgtgggcctatcatggttcatatgaagtaaaaccctcaggttcagcatcaagtatggtgaatggggtcgtaaaactattaacaaaaccatgggacgtgatacccatggtaacgcagatagcaatgacagacacgacgcctttcgggcaacagcgcgtatttaaagagaaggtagacacacgtacaccaaaggcaaagcgagggacggctcaaataatggaagttacggcaaaatggttgtggggatttttatcacgcaacaagaaaccaaggatatgtactagagaagagttcacgaggaaagtaagatcaaacgctgcaataggggcagttttcgtagatgaaaatcagtggaactccgctaaagaagctgtggaagacgaaagattttgggatctagttcatcgagaacgcgaattacataaacaaggtaaatgcgctacatgtgtttataacatgatggggaagagggagaagaaactaggcgagtttggaaaagccaaaggatctcgtgctatatggtacatgtggctaggagctagattcttagagttcgaagctctaggattcatgaatgaagaccactggttttcacgggaaaattccctatcaggtgtagaaggtgaaggtctccacaaattagggtatatacttcgtgacatatctaagattcccggagggaatatgtacgcggacgatactgcggggtgggataccaggatcacggaagatgacttacagaatgaggcacgaataactgatataatggaacctgagcatgccttgttagccaaaagcatattcaaactgacttatcagaacaaagttgttagggtacaaagaccagccaaaaacggaactgtaatggacgtaataagtcgacgggaccaacgcggaagcggacaagttggtacctatggtctaaatacctttaccaatatggaagcccaactaatcagacaaatggaatcagagggaatctttagtccatcagaattagaaacaccgaaccttgccgagcgggtacttgattggctggagaaatacggcgtagaacgactaaaaagaatggctatcagtggggacgactgtgtcgtcaagccgatagatgataggtttgctacagcactgacagcactgaatgatatgggaaaagtacgaaaagatattccacaatgggaaccgtcgaagggatggaacgattggcaacaggtgcccttttgctcccatcatttccaccagctaataatgaaggatggacgggaaattgtagtaccttgtaggaaccaagacgaattagttggtagagcgagagtaagccaaggggcaggatggagtttgagggaaacagcttgcctaggaaaatcttatgcccaaatgtggcagttgatgtattttcatcgacgagatctgcggttggcagcgaacgcgatatgcagtgctgtgcctgtggactggattccaacaagtaggacaacatggtctatccatgcacatcaccaatggatgacaactgaagatatgttaagcgtctggaaccgcgtgtggatagaagagaacccgtggatggaagataagacacatatatcatcatggggtgatgtaccttatttaggcaagcgtgaagaccaatggtgtggaagccttatcggactaacggcccgggccacgtgggcaacgaacatacaagttgctattaaccaagtacgaagacttatagggaatgaaaattatctagattatatgactagcatgaaacgttttaaaaatgagtctgatccagaaggcgcgctttggtaa

SEQ ID NO: 21216 - RNA, 9879 nt, synthetic construct
  misc_feature 1..9879: note = derived and/or modified CDS sequence (opt6) from DENV-1__HM181949__SS-prME
  source 1..9879: mol_type = other RNA
tccgtaactatgttactaatgctgatgcccacggcattagcctttcatctaacaactcgaggtggcgaaccacatatgattgtttcaaaacaagaacgtgggaaaagtcttttgttcaaaacttccgcgggagtaaatatgtgtacgctgattgccatggacctaggggaattgtgcgaagacaccatgacttacaaatgtccaaggataactgaagcagaaccagatgatgttgactgttggtgcaatgcaacggatacgtgggttacatatgggacttgctcgcaaacaggtgaacacagaagagataaaagaagcgttgcattagcgccacacgttgggctgggattagaaacgaggacagaaacctggatgtctagcgaaggagcatggaaacaaattcaaagagtagaaacatgggcacttcgacacccgggattcaccgttatagcattgttccttgctcacgctataggaacatcgattacgcaaaaaggtattattttcatcttactcatgttagttacgccgagtatggctatgagatgcgttggtataggaagtagggattttgtagaaggcttatcaggtgcaacttgggttgatgtagttcttgaacacggctcatgtgtgactactatggcgaaagataaacccacgctagatatagaattattgaaaactgaagtaacaaatccagcaatccttcgaaaattatgtatagaagccaaaataagtaatacaaccacagactcaaggtgccccacacaaggcgaagcgacactcgtagaggaacaagacgcaaattttgtatgtcgaagaacatttgtcgatagggggtggggaaatgggtgtggactctttggtaaaggctctttgattacgtgtgctaaattcaaatgtgtcaccaaattggaaggaaaaattgttcagtacgagaatctaaaatattcagtaatagttacagtccacacaggcgatcaacaccaggttggtaatgaatcgaccggccatgggacaacagcaactattacgccacaggctccaactactgaaattcaactaacagattatggcgcattgaccttagattgttcaccacgaacaggtctagactttaatgaaatggtcctactgaccatgaaagagaaaagctggcttgtacacaaacaatggttccttgatttgccactaccatggacaagtggagcatccacatcgcaggagacatggaaccgtcaagatctattagtaacttttaaaacggcgcacgctaagaaacaagaagtggtggtacttggatcccaagaaggggcaatgcatactgcattaacgggtgctaccgagattcaaaccagtggcacgacaactatattcgctggtcaccttaaatgtagactaaaaatggataaactaactttaaaagggatgtcttacgtaatgtgcactggtagctttaaactagaaaaagaagttgcagaaacccagcatggtacagttctcgtgcaaatcaaatatgaaggcacggacgcaccctgtaagattccattcagcactcaagacgagaaaggggtcacacaaaatggacggctaataactgctaatcctatagtgacagataaggaaaaaccagtaaacattgaagcggaacctccttttggtgagagttatattgtaatcggagctggggagaaagctcttaaactaagctggttcaaaaagggatctagcatcggaaaaatgttcgaagcgacagcacgaggagcgagacgaatggcaatacttggagataccgcgtgggattttggttcaataggcggagtatttacatccgtaggtaaactggtacatcaaatttttggaaccgcatatggtgtcctattttctggagtgagctggacaatgaaaattggtatcggcgtgctactcacatggttaggtctaaattctaggtcaaccagcttaagtatgacatgtatagccgtaggtctagtcactctgtaccttggcgttatggttcaagctgatagcggttgtgttatcaattggaaaggtcgtgaactgaaatgcggtagcggaatttttgtaacaaacgaagtacatacgtggacagagcaatataaattccaagccgatagtcccaaaaggctatcagcagcaatagggaaggcatgggaggaaggtgtttgtggaatacgtagtgcgacaagattagaaaatatcatgtggaagcaaatatccaacgaattaaatcatatattactagaaaatgacatgaaattcacagtagtggtaggtgatgtagcaggcatccttgctcaaggaaagaagatgatcagaccgcagccaatggaatataagtattcatggaaatcctggggaaaagctaaaattattggagcggatgtgcaaaatacaacattcatcatagatggtccaaacacaccagagtgtccagatgaccaaagagcttggaatatatgggaagttgaagattacggattcggcatatttaccacaaacatatggttaaaacttagagacagttatacacaggtatgcgatcatcgacttatgagtgctgcaattaaagattcaaaagcggtacatgccgatatgggctactggatcgaaagcgagaaaaatgaaacatggaagctcgctcgagcgagttttattgaagtaaaaacatgtatctggccaaagtcccacacgttatggtcgaatggggtactggagtccgaaatgattattcctaagatctatggaggacctatatcgcagcataactatcgacctgggtatttcacacagactgccggaccctggcacctagggaaattggagctagactttgacctatgcgagggaactacagtggtcgttgatgaacattgcgggaatcgaggaccttcattacgtacaacaacagttacaggaaagataatacacgaatggtgttgcagaagctgtacattaccccctctaagattcaggggcgaggacggttgctggtatggaatggaaattcggccagtgaaagagaaagaagaaaacttagttaaatccatggtaagtgctggatcgggagaagtagatagcttctcactcggtttgctttgtatttccataatgatagaagaagttatgcgttctaggtggtctcgaaaaatgttaatgacaggaactttagctgtgttcttattattaataatgggacaattaacttggaacgatttaataaggttatgtatcatggttggtgcaaatgcatcagatagaatgggaatgggaacaacctatttagcactcatggccaccttcaagatgagacctatgtttgctgtaggactcttgttccgtagattaacatcacgggaggttttacttctaactatcggcctaagtctagtagctagtgtagaattaccaaactcattagaagaactaggtgatgggttagcaatgggaattatgatcctaaaacttttaacagattttcaatcacaccagttgtgggcaaccctcctatcgctaactttcataaaaactacgttctcattgcattacgcatggaagactatggctatggtgctctcgattgtctcgttatttccactatgcctaagcaccacttcccagaaaacaacttggttaccggtactattagggtcgcttggttgtaagccgctgacaatgttcttgatagctgaaaacaagatttggggacgcagatcgtggcccctcaacgaaggcataatggccgttggaatagttagtatattattatcatcgttgttgaaaaacgacgttccattggctggtcccttaatagctggaggtatgttgattgcttgttatgtaatttctggaagtagtgcggacctttcacttgagaaagcagcagaggtaagctgggaagaggaagctgaacattcaggggcatctcataatatcctggtagaagttcaagatgatggaactatgaaaattaaggatgaagaacgtgatgataccttaacaatcctcttaaaagccactttattagccgtaagcggagtctatcctctttcaataccagcaaccctgtttgtttggtacttctggcagaagaagaaacaaagatctggtgttttgtgggatactcctagtcctccagaagtcgaaagagcagtcctggacgatggtatctatcggattatgcaaagaggactattaggaagaagtcaagtaggggtaggagttttccaagaaaacgtctttcatacaatgtggcacgtgactagaggcgccgtgctgatgtaccagggtaaacgactagaaccatcgtgggctagtgtcaagaaagatctcatttcctatggaggaggatggaggttacaaggttcttggaatacaggggaggaagttcaagtaattgctgtcgaaccgggcaaaaatccaaagaatgtccaaacagcccctggcacatttaaaaccccagagggagaagtcggcgccatagcattggattttaaaccgggaaccagtggcagtcctatagtaaatcgggaagggaagatagtgggactatatggtaatggtgtggtaacaacctcgggcacttatgtttcagcaatcgcccaagcaaaagcctcacaagaaggacctttacccgagatagaagatgaagtgttcagaaaaaggaatttaaccataatggatctccaccctgggtcaggtaaaacaagacgctatctcccagctattgtacgagaagcaattaaaagaaagttgagaacgctaattttggccccgacacgtgtagttgcatctgaaatggctgaggcattgaaaggaatgcccataagataccagacgactgcggtaaaatcagagcatactggaaaagagatcgttgacttaatgtgtcacgctacgtttacaatgaggctgttgagccctgttagggtgccaaattacaatatgataattatggatgaagctcattttactgatcctagttctatcgctgctcgaggttacatatccacaagagttggtatgggtgaggccgcagctatctttatgacggcaacacctccaggatcagtcgaagcatttccacaatctaacgccgtaatccaggacgaagaacgggacattccagaacgaagttggaactcgggttacgagtggatcacagattttcctggcaaaacagtctggtttgtccccagtataaaaagtggtaatgatatagcgaactgtttaaggaaaaatggaaagcgtgtaatacagttatcaaggaaaacatttgatacggagtaccagaaaacgaaaaataatgactgggattatgtggttactacagatataagtgaaatgggtgctaattttcgagcagatagggtaatcgatcccaggcgatgcctaaaacccgtaatacttaaagatggtcctgagagagtgattcttgctggacccatgcctgtaactgtagcgagcgcagctcaacgacgcgggaggattggtaggaatcataataaagagggagaccaatacatttacatgggacaacctctaaacaacgacgaagatcacgcgcactggaccgaagcgaaaatgttactagataacataaacactcccgaaggcattataccagcattatttgagcccgagagagaaaaatccgcagcaatcgatggagaatacagattgcggggtgaagcacgaaagacatttgttgaattgatgagacggggagaccttcctgtatggctatcttacaaagttgcctcagaaggatttcagtatagtgaccgaagatggtgctttgatggggagcgtaataaccaggtattggaagaaaacatggacgtagaaatatggaccaaggaaggagaacgaaagaagttaagaccacgttggttagatgctcggacctactcagatcctctagcactccgggaatttaaggagttcgccgcgggaaggagatctgtgagcggtgatttgatccttgaaattggaaaacttccacaacatctcacgcaaagagcgcaaaatgctctggacaacctcgtaatgcttcacaattcggaacaaggaggtagagcttatcgacacgctatggaagagttacctgacactattgaaaccttaatgctacttgcactgattgcagtcctcaccggaggggtgaccttatttttcctatccggaaggggtcttggtaaaacttcgataggtttactatgtgtgatggcttccagtgtgctactatggatggcaagtgtggaaccgcattggatagcagcctcaatcatccttgagttcttccttatggtcttgttgattccggagccagacagacagagaactcctcaagacaaccagttagcatatgttgttatcggtttgctatttatgattctcacagttgctgccaacgagatggggttgcttgagacaacgaagaaagatctaggaattgggcacgtggcggtaggaaatcaccatcatgcagctatgctcgatgtagatttacatccagctagtgcatggacattatatgccgttgcgaccacaattataaccccaatgatgagacacacgattgagaatacaacggcaaatattagtttgacggcgatagccaatcaagcagcgatactgatgggtttggataagggatggcctattagcaaaatggacatcggcgttccgttacttgcacttggttgttattctcaagtcaatccattaactctgactgctgcagtactgatgctcgttgcacactatgcgataataggccctggtctgcaagcgaaggcaactcgagaagcacagaaacggacggcagctggcattatgaaaaacccaaccgtagatggtatagtcgctatcgatctagaccctgttgtatatgatgccaaattcgagaaacagctgggacagataatgttacttatactatgcacaagccaaatcttattgatgagaacaacatgggctttatgcgagagcataactttagcaaccgggccgttgacaacgctatgggaaggatcaccgggtaaattctggaatacaactatagcggtgtccatggctaacattttcagaggatcttacctagccggtgcaggcttggccttcagtttaatgaaaagtttaggaaggggtcgaagaggcactggagcacaaggggaaaccttaggagaaaaatggaaacgacaattaaaccaattatcaaaatctgaatttaatacttataaaaggtcgggtatcatggaagtagacaggtccgaagccaaggaaggactgaaaagaggtgaaactacgaaacatgcggttagtcgaggaacagcaaaattaagatggtttgtagagaggaatcttgtaaaacctgaaggaaaagtaattgatctaggatgtggaagagggggatggagctactactgtgctggactgaagaaagtcacagaagtaaaaggttatacgaaaggaggtccaggacatgaagaaccaataccaatggctacttacggctggaatttagtaaaattacattcaggtaaggatgtatttttcattcccccggaaaaatgtgatacattattgtgtgatatcggagagagttcacccaatcctactattgaagaaggtagaacgctcagagtgcttaagatggtggagccctggcttagagggaaccaattttgtatcaaaattttaaatccatatatgcctagtgtagtagaaacattagaacaaatgcaaaggaagcacggaggtatgttggtgcgaaatccattgagcaggaatagtactcacgaaatgtattgggtgtcctgtggcactgggaatatagtttcggccgttaatatgactagccggatgttactgaacagatttaccatggcacatagaaaacctacatacgaacgtgatgtagatttaggagctggaactaggcatgtagccgtagaaccagaagttgcgaatttagatataataggccagaggatcgaaaatataaagcacgaacacaaatcaacgtggcattacgacgaagacaacccttacaaaacctgggcatatcacggttcctatgaagtaaaaccgagcggatctgcatctagtatggtaaacggagttgttaaacttctcactaaaccctgggatgttattcctatggttactcaaattgcaatgactgacactacgccgtttggtcaacaaagggtcttcaaagaaaaagtggacacgagaacacctaaagcaaaacggggcacagcacagataatggaagttactgcgaaatggctatggggatttctaagcagaaataagaaaccaagaatatgtacgagggaagagtttactcgtaaggtaagaagtaatgcggcaatcggcgcagtgtttgttgacgaaaatcaatggaactctgcgaaagaggcggtagaagacgaaagattttgggatctggtacatagagaaagagaactacataagcaaggaaaatgtgccacatgcgtctataatatgatgggaaaaagagagaagaaattaggtgagttcggcaaagctaagggctcccgcgcaatctggtacatgtggcttggcgcaagattccttgagtttgaggctttagggtttatgaatgaggaccattggttctctcgagagaactcattatctggagttgaaggagaaggcttacataaattaggctacatactacgagacattagcaaaatacctggtggaaatatgtatgcagatgatacagcgggatgggacacaaggatcaccgaagatgatttacagaacgaagcgagaataacggatataatggaaccagaacatgcactactcgctaaatcaattttcaaacttacataccaaaataaggtagtacgtgtacaaaggccggcaaagaatggaacagtgatggatgttatttcgcgtagagatcagcgaggcagtggtcaagtaggtacatatggattaaatacgttcacaaacatggaagctcagctgataaggcaaatggagtcggaaggaatattttctccttcggaattggaaacgcctaatctagcagaacgggtcctagactggcttgaaaaatatggagtggaaagattaaaaagaatggctatctcaggtgacgattgtgtggtaaaacccattgatgatcggtttgcaacagcattgacagcactaaatgacatgggcaaagtgcggaaggatatacctcaatgggagccgtcgaaaggctggaatgattggcaacaagtaccgttctgttctcaccatttccaccaattaattatgaaggatggaagagaaattgtcgttccttgtcgtaatcaagatgaactggtcggtcgcgcaagagtaagtcaaggtgctggttggagtttacgcgaaacagcatgtttagggaaatcctatgcacaaatgtggcagcttatgtattttcacagacgagatctaaggttagccgctaatgctatttgttctgcagtaccagtagattggattccaactagccgcacaacttggagtatacacgcgcaccaccagtggatgacgacagaggacatgctatcagtttggaatcgtgtgtggatagaagaaaacccatggatggaagataagacccacatatcctcatggggagatgtaccatatcttgggaaaagagaggaccaatggtgtggttcattaatagggttgacagcacgtgctacgtgggcaacaaacattcaagtcgctatcaatcaggtgcgtagactaattggaaacgagaactatctagattacatgaccagtatgaaacgcttcaaaaacgaaagtgacccagagggcgctttatggtga

SEQ ID NO: 21217 - RNA, 9879 nt, synthetic construct
  misc_feature 1..9879: note = derived and/or modified CDS sequence (opt6) from DENV-1__HM181950__SS-prME
  source 1..9879: mol_type = other RNA
agcgtaacaatgctactaatgttaatgcccacagcactcgcattccatctaacgactcgaggtggagaaccccatatgattgtgtcaaaacaagaacgtgggaaaagtctactcttcaaaacgtcagctggtgtaaatatgtgcactttaatagcaatggatcttggggaactctgcgaagatacaatgacatataaatgcccacgtataacggaagcagaaccagatgatgtggattgttggtgcaacgcgacggacacgtgggtcacatatggtacttgttcgcaaactggagaacatagaagggataaaagaagcgttgcactcgcaccacacgtagggttgggcttagaaacaagaacagaaacatggatgagttcagaaggagcatggaaacagatacaaagagtagaaacttgggcactgaggcatccaggatttacggtcatcgccttattcctagcgcatgcgatcggaacaagtatcacacaaaaaggaataattttcattctacttatgctagtaacaccgagcatggctatgcgctgtgtaggtataggatcccgagactttgtagaaggcttgtctggagcaacatgggtcgacgtagttttggaacacggatcttgtgtaactacaatggcaaaagataaacccaccctagatatagaactgttaaaaaccgaggtcacaaatccagccatattaaggaaactctgtatagaagcgaaaatttctaatacaacgactgattctcgatgccccactcagggggaagcaactcttgtagaagaacaggatgccaattttgtttgtcgccgtacttttgtggatagaggatggggaaatggatgtggcttgtttggcaaaggctctcttattacatgtgccaaattcaaatgcgtcactaaactagaagggaaaatagttcaatatgaaaatttgaaatatagtgtaatcgttacagtacacactggggatcagcaccaagtagggaacgaaagtacagaacatggaacaacagcaaccattacgccccaggcacctaccactgagatacagctgacagactacggagctctaacactagattgttctccacgcacaggattggatttcaacgaaatggtcctacttacaatgaaggaaaaatcgtggctagtccacaaacaatggtttctggatttgccgttaccatggacatcaggcgcatcaacatcacaggaaacgtggaatagacaagatttattggtgacattcaaaacggcccacgccaagaaacaagaggtggtggtcctagggagccaggaaggagcaatgcataccgcgctaacaggagcaacagaaatacaaacaagtggaacgacaacaatatttgcaggacacttaaaatgtcgtttaaaaatggacaaactaactctgaaagggatgagctatgttatgtgcacaggatctttcaaattagagaaggaagtcgcagagactcagcatggaactgtcttagtacaaataaagtatgaggggaccgacgccccatgcaagatccctttcagtacgcaagatgaaaaaggagtcactcagaacggcagacttataacagccaatccaattgtgacagacaaagaaaagcctgttaatatagaagctgaaccaccctttggcgaaagctatatagttattggagccggagaaaaagccttaaagttgagttggtttaaaaagggcagttcaatcggcaaaatgttcgaggccacggcacgaggagcgagaagaatggctattcttggggatacagcttgggactttggaagtattggaggcgtatttacatctgtcggtaagctagttcatcaaatctttggagctgcatacggagtgctcttttcgggggttagctggactatgaaaattgggattggagttttgcttacttggttaggcttaaactctcgatcaacaagtctaagcatgacgtgtatagctgtcggattggtaaccctgtatttaggcgtaatggttcaggcagattctggttgcgtaattaattggaaggggcgagaattgaaatgcggaagcggaattttcgtaacaaatgaagtacacacatggacagaacaatataaatttcaagcagattcgcctaaaaggttatccgctgcaatagggaaagcgtgggaagaaggagtttgcgggataagatccgcaactagattggaaaacattatgtggaaacaaatcagtaacgaactaaaccacatattacttgagaatgatatgaaatttacagtagtcgtcggtgatgtagcgggaatattggctcaaggcaagaaaatgatccgcccacaacccatggaatacaaatatagctggaagtcatggggtaaagcaaaaataatcggagcagacgtccaaaatacaacattcattatagatggtcccaatactcccgaatgtcccgatgaccaaagggcatggaatatatgggaagtcgaagattatggttttggcatttttaccactaatatctggttaaaattgagggactcgtatacacaagtttgtgaccaccgattaatgtcagcggccattaaggatagtaaagctgtacatgcagatatggggtactggatcgaatccgagaaaaatgaaacttggaaacttgcacgagcatcttttatagaggtaaagacctgcatatggccaaaatcacatacactatggtccaatggcgtattggaatcagaaatgataatacccaagatatatggagggcctattagccaacataactatagaccaggttactttacacaaacagcaggaccttggcatttaggcaagttagaattagatttcgacttatgtgaaggaactacagtggtagtggatgaacattgcggcaaccgggggcctagcctaagaaccacgaccgttacaggtaaaatcatacatgaatggtgttgcaggtcgtgcacattacctccactacgattcagaggcgaagacggatgctggtacggcatggaaataagaccggtgaaagaaaaagaagaaaatctggttaaaagcatggtatctgccgggtccggcgaagttgacagcttcagcttaggactactttgcatatcaattatgatagaagaagttatgagatcaaggtggtcgagaaaaatgttgatgacgggtacgctagcggttttcttattattaatcatgggtcaattaacctggaatgatctgattaggttatgtattatggttggggccaatgcatcagaccggatgggtatgggaactacatatttagccctaatggcaaccttcaaaatgaggcctatgtttgccgtcggtctactcttcaggagattaacttcaagagaagtattactgctcacgattggtctttccttggtagcatcagttgaattgcccaactcattggaagaattgggcgacggtttagctatgggaattatgatactaaagttattgacggactttcagtctcatcagctctgggctacattgttatcgttaactttcataaaaacaacattttcactacattacgcctggaagaccatggcaatggtactaagcattgtcagcttattcccactgtgcttatccactacaagccaaaagacaacctggctaccagtcttattagggagcctgggatgtaagcctttaaccatgtttctaattgccgaaaataagatctggggaaggaggtcatggcctttaaatgaaggaataatggcagtcggaatagtttctatattgttatcatcactgctaaagaacgatgtgcctttagccggtcctctgatagcaggaggtatgctaatagcgtgttacgttatctctgggtcctctgctgacctaagtctagagaaagcagcagaagttagttgggaggaagaagctgaacattcgggtgctagccataacatcctggtggaagtccaagatgacggtacgatgaaaattaaagatgaagaacgagatgacacacttaccatattattaaaagcaactcttcttgcggtttcaggagtctaccctttatcaatccccgctacattatttgtgtggtatttctggcagaagaagaaacaacgtagcggggttctatgggataccccttcaccacccgaagtagagcgagcagttttagacgatggcatttaccgaataatgcaacgaggattactgggtagaagccaagtaggagtaggggtttttcaggaaaatgtgtttcacacaatgtggcacgttactaggggagcagttctaatgtaccaaggtaaaagattagaaccatcctgggcctcagtgaagaaagatctcatatcgtacggtggaggatggaggttacaaggtagctggaacacaggagaagaagttcaggtaatagcggtagaaccaggcaaaaatccaaagaatgtgcaaacagcaccgggtacatttaaaacacctgaaggagaggtgggggctatagcgttagattttaaaccaggtacatcagggagtccaattgttaatagggagggcaagattgttggattatatggcaacggagtggttacaacatcagggacttatgtttcggcgatagcccaagcaaaagctagccaagaaggaccgttaccagaaatagaagatgaagtttttagaaagagaaacctcactattatggacctacatcccggaagcgggaaaactcggaggtacttaccggccattgttagagaagcgatcaaacgaaaactacgtacactgattctggctcccaccagggtggtggcaagcgagatggccgaggcccttaaaggaatgccaatacgttatcaaactactgcagttaagtccgaacatacaggaaaagaaatagttgacttgatgtgccacgccacgtttactatgcgactcttatcaccagttagggttcccaattataacatgataataatggacgaggcccactttactgatccgtcaagcatagctgcaagaggatatatcagcaccagagtaggaatgggtgaagctgcagctatatttatgactgcaacacctcctggttcagttgaagcctttccgcagagtaacgcagttatacaggatgaagaacgtgacatacctgaacgatcatggaactccgggtacgaatggataaccgatttccctggtaagacagtatggtttgtgccctcgataaaaagtggaaatgatatagcaaactgtctgagaaagaatgggaaacgagtcatacagctatccagaaaaacatttgatacggaatatcaaaagaccaaaaacaatgattgggactatgtggtgaccacagacatatcagaaatgggagctaattttcgtgcagacagagtaattgatcccagacgttgtctaaaacctgtgatattaaaggacggccctgaaagagtgatactagctggaccaatgcctgtcacggtggctagtgcagctcaacgccgcggtagaattggaagaaaccataacaaagaaggagatcaatatatatacatgggacagccactcaataacgatgaagaccatgcccattggaccgaagcaaaaatgctacttgacaatataaatacaccggagggtattatcccagcattattcgaaccggaacgagagaaatctgcggcaattgatggagagtatagactgagaggggaagccaggaaaacattcgtcgaattaatgcgtaggggagatttaccagtttggctatcttataaagtggcatctgaaggctttcaatattcggacagacggtggtgcttcgatggagaacgtaataatcaagtattagaggagaatatggacgtagaaatatggactaaggagggggaacgtaagaaactaaggccccgttggctggacgcaaggacttactcagaccctctagctcttagagaatttaaagaatttgcagcaggtcggagatctgtaagtggggaccttattctagaaataggaaagctaccacaacatttgactcaacgtgcacaaaacgcactcgacaatctcgttatgctacataatagtgaacaaggaggccgtgcctatagacacgccatggaggaactaccagacacaattgagaccttaatgctattagctttgatcgcagtcttaactggaggggtaaccctattctttcttagtggacgtgggctaggtaaaacttcaataggactgttatgcgttatggcttctagtgtgttactgtggatggcgtcagtagaaccccattggatcgctgcatcaatcattttagagttcttcttaatggtactgcttataccagaaccagacaggcaaaggacgccccaagataatcaacttgcctatgtcgtaataggtttacttttcatgatccttacagtcgccgcaaacgaaatgggattgctagaaacaaccaagaaagaccttggcataggacatgtggcggtaggtaaccatcatcatgccgccatgctggatgtagatctacaccctgcttccgcatggaccttatatgcggttgcaactacaataataacacctatgatgcgtcatacaattgagaacacgacagcaaatatatctctaacagcgattgcaaaccaagcagcaatcctaatgggtttagacaaaggatggcccattagtaaaatggacatcggtgttccattgttagccttaggatgttactcgcaagttaatcctctgacattaacagcggctgtactcatgttagtcgcacattatgcaataataggaccaggccttcaggcaaaagcgacaagagaggcccaaaaacgcactgcagctggaataatgaagaatcctactgtcgacggaattgtagctatagatctggatccagtcgtgtatgacgctaagtttgaaaaacagttgggccaaattatgcttcttatcctttgcacatcccaaattctacttatgcgtacaacttgggcgttatgtgaatcgattacattagccacgggaccactcaccaccttatgggaaggatctcctgggaaattctggaatacaacaattgcagtaagtatggccaatatatttagaggaagctacctcgcaggcgccggccttgccttctccttaatgaaatcactcggaggcggccgacgcggcacgggcgcacaaggagaaacactaggggaaaaatggaaacgacaattaaatcaactaagcaaatccgaatttaatacctataagagatcaggcattatggaagtggacagatccgaagctaaggaaggtttaaaaagaggtgagactaccaagcatgccgtatcgcggggaacagctaaattaagatggtttgtcgaaagaaacttggttaaacctgagggcaaagttatcgacttaggttgtggacgaggaggatggtcctattattgcgcaggattaaagaaagtaacggaggtgaaaggatatacaaaaggagggcccggacatgaagaacctatacctatggcaacatacggttggaatctagttaaactccattccgggaaagacgtattctttattcctccagaaaaatgcgacacactactatgcgatataggggaatcatctcctaaccctacgatcgaagaaggtagaacactaagagtattaaaaatggtcgaaccctggctgaggggtaatcaattctgtataaaaatactaaacccctacatgccaagtgtcgttgaaacacttgaacaaatgcagagaaaacacggcggaatgttagttcgaaatcctttgagtcgcaacagtacacatgaaatgtattgggtttcatgtggaacaggaaatatagtaagtgcagtgaatatgacgtccaggatgctgctcaataggttcacaatggcacatcgcaaacctacatacgagagagacgtagaccttggagctggtacacgtcatgttgcagttgaacccgaagtggcgaacctagatattatagggcaaaggatcgaaaatatcaaacacgaacacaaatcgacatggcattatgatgaggataacccctacaaaacatgggcatatcatggatcgtatgaagtcaaaccatctggaagtgcatcttcaatggttaacggcgtagttaaattactaacaaaaccgtgggatgtaataccaatggttacacaaatagcgatgactgatactacgccgtttggtcaacaaagagtatttaaagaaaaggtagacacaaggacacctaaagctaaacgtggtactgcgcaaattatggaagtaacagcaaaatggctttggggatttctttcaaggaacaagaagccaagaatatgtactagagaagagttcacgcgcaaagttcgatcaaacgctgcgatcggtgcagtatttgtcgacgaaaaccagtggaacagcgctaaggaggcagtcgaagatgaacgattttgggatctagtgcatagagaaagggaactacataagcaaggaaaatgtgcaacatgcgtatataatatgatgggcaaacgtgagaagaaactaggggagtttggtaaagccaagggaagtcgggcaatatggtatatgtggctcggtgcaaggtttttggaatttgaggctctaggatttatgaatgaagaccattggttttcaagagaaaatagcctatcaggcgtagaaggagaaggactacataaattaggttacattttacgagatatatcaaaaatacctggaggaaacatgtatgcagacgacacagcaggctgggatactagaattaccgaggacgacctacaaaatgaagcacgaatcactgacattatggaaccagaacacgctttacttgctaaatctattttcaagttgacctatcaaaacaaagtcgtccgggtgcaacgccccgccaaaaatggtactgtaatggatgtaataagccgaagggatcagaggggaagcggacaagtaggcacttacagcttaaacacattcactaatatggaagcacaactcatacgacaaatggaaagtgagggaatattcagcccgtccgaattagaaaccccgaatttagcagaacgagtactagattggctagaaaagtacggagttgagagacttaaaaggatggccataagtggtgatgactgcgttgtcaagcctatagatgaccgattcgcaacagcactgaccgccctgaacgatatgggaaaagtaagaaaggatatcccgcaatgggaaccgagtaaaggatggaatgattggcagcaagtacctttctgctcacatcacttccaccagctaattatgaaagacggaagagaaatagtagttccctgtcgtaaccaagatgaacttgtagggagagcacgagtaagtcaaggagcgggatggtctttgagagaaaccgcatgcttaggaaaaagctatgctcagatgtggcagctaatgtactttcacagaagagatttacgactcgctgcaaatgctatctgttcggcagttccagtcgactggatacccacgagtcggacaacttggagcattcatgctcaccaccagtggatgacgaccgaagacatgttgagcgtttggaaccgcgtatggatcgaggaaaacccgtggatggaagacaaaactcatatatcaagttggggtgatgtcccctacttggggaagcgcgaagatcaatggtgtgggtcactgatcggcctcactgcaagggctacatgggcaactaacatacaagtagcaattaaccaggttcgtagactgattggaaacgaaaattacctagattatatgacatcgatgaaacgatttaaaaacgaatctgacccagaaggagccttgtggtaa

SEQ ID NO: 21218 - RNA, 9879 nt, synthetic construct
  misc_feature 1..9879: note = derived and/or modified CDS sequence (opt6) from DENV-1__HM181952__SS-prME
  source 1..9879: mol_type = other RNA
agtgttactatgctacttatgttgatgcccactgcactcgctttccacctaacaacacgaggtggtgaaccacacatgatcgtgagcaaacaagaaagaggcaaaagcctgctctttaaaacatctgctggcgtaaacatgtgtacattgatagctatggatctcggagaattatgtgaagacacaatgacttacaaatgtccacgcattactgaagcagaacccgacgatgtagattgttggtgtaatgcaacagatacatgggttacgtatggaacgtgtagtcaaacaggcgaacatcgtagagagaaaagatcagtggcattggcaccccatgttggtttaggtctagaaactcgaacagaaacgtggatgtcgagtgaaggagcatggaaacagattcaaagagtggaaacatgggcgctaagacatccaggttttaccgttatagctttatttctagcacatgctattgggacaagcataacacaaaaaggaataatttttatactattaatgttagttacaccttctatggcaatgaggtgtgtagggattggctctagagattttgtcgaaggtttgagtggcgcgacttgggttgatgttgtactggaacatggaagttgtgtaaccacaatggcaaaagataaaccaactctagacatcgagctgcttaaaactgaagtaacaaacccagcggtactaagaaaattatgcatcgaggcaaaaatttccaacacaaccaccgatagccgttgtcctacacaaggagaggctacgttagtagaagaacaagacgctaactttgtgtgcaggcgcacatttgtagacagagggtggggaaacggttgtggtctttttggaaaaggcagcttactaacttgcgcaaaatttaaatgtgtaaccaaacttgaaggaaaaatcgtacaatacgaaaacctaaaatatagcgtcattgttacggttcatacaggagaccaacatcaggtaggaaacgaaagtacagagcatggaaccacagctactataactcctcaagcacctacaactgaaatacaattgactgattacggggcccttacactggactgttctcctagaactgggctcgacttcaatgaaatggttcttctgacaatgaaagagaaaagctggctagttcataagcaatggtttctagatctgccactaccttggacttcaggtgcttctacatctcaagaaacttggaatcgacaagatctcttagtgacatttaaaacagcccacgccaagaaacaagaagttgtggtattgggcagccaggaaggcgctatgcatacagcacttactggtgccaccgaaatacaaacatcaggaacaaccaccatatttgcaggccacttgaaatgcagattaaaaatggataaattaacactgaaaggtatgtcgtacgtgatgtgcacaggatcattcaaattagaaaaggaggtagcggaaacccaacatggcactgttctagtacaaattaaatatgagggcacagatgctccatgcaaaataccatttagtactcaggatgaaaagggtgtaacacagaacggtagactgataacagcaaatccaattgtcactgataaagaaaaaccagttaatattgaagcagaacccccttttggcgagtcatacattgtaataggggcaggggaaaaagcgttaaaattaagttggttcaagaaaggctcgtctattggtaaaatgtttgaagctaccgcaagaggggctaggagaatggctatcctaggggataccgcatgggattttgggagtataggcggcgtttttacgtctgtcggcaagttagtacaccaaatatttggtacagcgtatggagtactgttttcaggagtgagctggacaatgaaaattggaataggcgtcctattaacctggttaggattaaattcaagaagtacgtcattaagtatgacctgtattgccgtcggtctcgtgacactttacctaggagtaatggtacaggcggacagtggatgcgtgattaattggaaaggacgagaattaaaatgtggcagtggaatattcgttaccaacgaagtacatacatggacagaacaatataaatttcaagcagactccccaaaaagactgtcagccgcaatagggaaggcatgggaagaaggtgtctgcggcataagaagtgcaacacggcttgagaacataatgtggaaacaaatttcgaatgaattaaaccatatattattggaaaatgatatgaaatttactgttgttgtaggtgatgtagcgggaattttagtacagggaaagaagatgatacgtcctcaaccgatggagtacaaatactcatggaaatcgtggggaaaagcaaagataataggtgctgatgtgcaaaatagcacatttataatagatggtccaaatacacccgaatgtccagacgatcaacgagcgtggaatatttgggaagtcgaagactacgggtttggaatttttacgacaaatatatggttgaaattacgagattcgtatacacaggtatgtgaccataggttaatgagtgctgcaataaaagactcaaaagctgtacacgctgatatgggttactggatcgaatccgagaaaaacgaaacatggaaacttgcaaaggcatcgttcatcgaggtaaaaacatgcatttggccaaaaagccataccctatggtctaatggtgtactagaatcggaaatgattataccaaaaatacacggaggaccaatttcgcagcacaattacagaccaggttactttacccaaaccgcgggaccctggcatttaggaaaactcgagctcgactttgatctttgcgaaggaactactgtcgtagtggacgaacattgcggaaatcgaggaccgagtttgaggacaactaccgtgacgggaaagatcatacacgaatggtgttgcaggtcatgtacactgccaccattaagattccgtggtgaggatggctgttggtatggtatggaaatacgaccagtaaaagaaaaagaagaaaacctggtaaaatctatggtcagcgctggcagtggggaagttgattctttttctttaggattgctttgcatatcaataatgatcgaagaagtcatgaggtctagatggagccgaaagatgttaatgactggaacattagcagtattctttttattaataatgggccaattaacttggaatgacctaatcagattatgtataatggtgggtgcaaacgcttccgatcgaatggggatgggaactacctatttggcactgatggcaacgtttaaaatgcgaccgatgtttgcagtaggcttactatttcgtcgcctaacaagccgcgaggttctattattaactataggactatccttagtcgcatcagtggaacttccgaactccttagaagaactgggtgatggtctagccatgggtatcatgatcctaaagttattaacagactttcaatcatatcagctgtgggccacgcttttgtctctaactttcatcaaaaccacgttttccttacattacgcttggaagacgatggccatggtacttagcattgtatcactctttccgttatgtctaagcacgacttctcagaaaacgacctggcttccagttctgctaggatcgctaggctgcaaaccattaacgatgtttttaatagcagagaacaaaatatggggaaggaaatcctggcctttgaatgagggcattatggctgtaggaatagtaagtattctactttcgtctcttctaaagaacgatgttccattagccggacctctaatcgcgggaggcatgcttatcgcatgctacgttatttccggatcctcagcagacctatccttggaaaaagcagccgaagtatcttgggaagaagaggcagaacatagtggtgcaagccataatatattagtcgaggtacaggatgacggaacgatgaaaataaaagacgaggaaagggatgatactctaaccattttacttaaggcgaccctgctggcagtatcaggggtgtatcctctaagtattccagctacacttttcgtctggcatttttggcagaagaagaaacaaagatcaggggtattgtgggatacacctagtccacctgaggtcgagcgagcggtcttggacgacggaatatatagaattatgcaaaggggactcttagggagaagtcaagttggtgtaggagtattccaggaaaacgtattccacaccatgtggcacgtaactcgtggagctgttcttatgtatcaaggtaaacgcttagaaccgagttgggcatcggtgaaaaaggacctaattagctatggtggagggtggcgcttacaaggaagttggaacactggagaagaagttcaggtcattgcagttgaacctggtaaaaaccctaaaaatgtgcaaacggcgccggggacctttaaaacacccgaaggagaagtaggtgctattgccttagattttaaaccaggtacttccgggagtcctatagtaaatcgagaaggcaaaatagttggactatatggcaacggtgtagtcaccacaagtggaacatacgtctcagcaatcgctcaggccaaggcatcacaagaaggacctctccctgagatagaagacgaggtgttcagaaaacgaaacctaacaataatggaccttcatcctgggagtggaaaaacacgacgttatctaccagccatagttagggaagcaataaaaaggaagctacgtactcttatccttgcaccaacaagagtggtagctagtgaaatggcagaggcgctaaaaggtatgccaattcggtatcaaacaactgcagtcaaatctgagcatacaggaaaggaaattgttgatctaatgtgtcacgcaacgtttaccatgcgtcttctctcaccagtacgagtccctaattacaatatgattattatggatgaagcccatttcaccgacccaagcagcattgcagctcggggttatatctcaactcgagttggtatgggggaagcagcggctatatttatgaccgcaacgcctccagggtcgatggaggcgtttccccaatctaacgcggtaatacaggatgaagaacgcgacattcccgaaagatcgtggaactccggatatgaatggatcacggactttccaggtaaaacagtttggttcgtgccaagtatcaaagccggcaacgatatagcaaattgcctacgcaagaatggaaagagggttatacaattatccagaaagacttttgatacagaataccagaagaccaaaaataacgattgggactatgtcgtaactacagatatatccgagatgggggccaatttcagagcggatagagtaatagaccccaggagatgtttaaaaccagtaatactaaaggatggacctgaacgcgtcatccttgccggacccatgccagtgacggtcgctagtgcggcacaacgcaggggccgcataggaagaaatcacaataaagagggcgatcaatacatatatatgggtcaaccattaaataatgacgaagatcatgcgcattggactgaagctaaaatgcttttagataacattaatacccctgaaggcatcatacctgcactatttgagccggagagggagaaaagcgcagctatcgatggggaatatcgactgagaggtgaagcaaggaaaacatttgttgaattaatgcgacgaggtgatttgccagtatggctgagctataaggtggcttcagagggattccaatatagtgaccgtagatggtgttttgacggagaaagaaataaccaggtattggaagaaaatatggatgtagagatatggacaaaggaaggtgaaaggaagaaattacgaccaagatggttggatgcacgtacctattcagacccccttgctctaagagaatttaaggaatttgctgcaggtcgacgctccgtttctggtgatttaattctagagattggaaagttgccccagcatctgactcaacgcgctcagaacgcattggataatcttgtaatgctacacaattcagagcaaggtgggagagcatatagacatgctatggaggaattgccagacacaatagaaacattaatgcttttagctctcatagcagtattgaccggaggggtaacattatttttcttgtcaggcaagggcttaggcaaaacgtctataggtttattatgtgtgatggccagttctgtactactgtggatggcgtctgtcgaaccgcattggatcgccgctagcataattctcgagttctttctgatggtgctgttaatacctgaacctgatagacagcgcacacctcaagacaaccaacttgcgtacgttgtcataggcctcctttttatgatactaacagtggcggccaatgaaatgggacttttggaaaccacaaagaaagatctgggaataggccatgtagctgttgaaaaccaccatcatgctgcaatgttggatgtagatttacatcctgctagtgcgtggactttatacgccgtggctactaccataataacaccaatgatgagacataccatcgaaaatacaacagctaatatatctttgacggccatagcaaaccaagctgccatacttatgggcctagacaaaggctggccaataagcaaaatggacataggtgtaccattactagctttaggctgttacagtcaggttaaccctctgactttgactgcggctgttttaatgttagtagcacattacgccattgttggacccggcttacaagcaaaagcaactcgagaagctcagaaaagaacagccgcaggcatcatgaagaatccaactatagatggaatagttgccatagacctggatccagtcgtttatgatgcaaaatttgaaaaacagcttggtcagattatgcttttgattctgtgcacaagtcaaatactacttatgaggacaacttgggccttgtgtgaatcaataaccttagcaactggcccattgacgactctttgggaaggcagcccgggaaaattttggaacactacaattgctgtgagcatggcaaatatctttcgtggttcatacttggcaggcgctggactagctttctcgttaatgaaatccctaggcggcggtagaaggggtacaggggcacaaggcgaaacgctaggagaaaaatggaaacgacaactaaaccaattatcaaaaagtgaatttaacacatacaaaaggagcggtataatggaagtagatcgatcggaagccaaagaaggtcttaagcgcggagaaactactaaacatgccgtaagtaggggtactgcgaaactaagatggttcgtagaaagaaatttagttaaaccagagggcaaagttatagatctcggatgtgggcgagggggatggtcctactattgtgcaggtctaaagaaagtcactgaagtcaaaggatatacaaaagggggacctggacacgaggaaccaataccaatggctacatacggttggaatcttgtaaagctccattccgggaaggacgtcttctttataccgccagaaaaatgtgacaccttattgtgtgatataggtgaatcgagtccgaacccaacgatagaagaaggacgaactttgcgtgtacttaagatggtggaaccttggttaagaggaaatcaattctgtataaagatactgaacccatatatgccctctgtagtagaaacattagaacaaatgcaacgcaaacatgggggaatgttggttcgaaatccgctgtctagaaattccacacatgaaatgtattgggtaagttgcgggactggaaacatagtttccgcagtcaatatgacatctagaatgcttttaaatagattcacgatggcccaccgaaagccgacatatgaaagggacgtagatctaggagctggcacgagacacgtcgcagttgaaccggaagttgctaacctagacataattgggcagcgtatcgaaaacattaaacacgaacataaaagtacctggcattatgatgaagacaatccctacaagacatgggcctaccacggaagttatgaagtgaaaccgagcggttcagccagctctatggtaaacggggtagtaaaactgcttactaaaccatgggacgtaatacctatggtaactcaaatcgccatgactgatacgacaccatttggacaacagcgggtatttaaagaaaaagtcgatacaagaactcctaaagcaaaaagaggtaccgcgcaaattatggaggtcacggctcgatggctatggggattcctctctagaaacaagaaaccaagaatatgtacacgtgaagagttcactaggaaagtccgatcaaacgcggccatcggagcggtatttgttgatgaaaatcaatggaatagcgcgaaagaagctgttgaagacgaccgattctgggacctcgttcaccgcgaacgagagttacacaaacaaggcaagtgtgcgacatgtgtgtataacatgatgggaaaaagagagaagaaattgggcgagttcggtaaggctaaaggtagtagagcaatttggtatatgtggcttggtgcaagattcctagaatttgaagcgttgggctttatgaatgaagatcattggtttagtagagagaacagccttagcggggttgaaggagaaggactacacaaattaggatacattctaagagatattagtaagataccaggaggcaacatgtatgcagacgacacagcgggttgggatactcgtattacggaagacgatctccaaaacgaagctaaaataacagacataatggaacccgaacatgctttacttgcaaaatcaatattcaagttaacttaccaaaacaaagtcgtacgcgttcagcgtcctgccaaaaacggaaccgttatggatgtgatcagtcgcagggatcaacgaggtagtggtcaagtcgggacgtacggattaaatacattcaccaatatggaggctcaactaattcgacaaatggagagcgaaggaatatttttaccaaatgagctagaaaccccaaatcttgctgaacgtgttctagattggttagagaagtatggtgttgaaagactaaaaagaatggcaataagcggagatgattgcgtcgttaaaccaattgacgatagattcgctaccgccttaaccgctctaaatgacatggggaaagtgcggaaagacattccacaatgggaaccgtcgaaaggttggaatgattggcaacaagtcccgttttgtagccatcattttcaccaactaatcatgaaagatggccgagaaatagtcgtcccttgcagaaaccaagacgaacttgtcggtagagcgcgcgtctcgcagggagccggatggagtctcagagaaactgcttgtttaggtaaatcgtatgctcaaatgtggcagttgatgtactttcaccgacgcgacttacgtctcgcagccaacgctatttgctccgcagtaccagtagactgggtacctacaagtagaacaacttggagcatacatgcacaccaccaatggatgacaaccgaagacatgttgtcagtttggaacagagtttggattgaggagaatccttggatggaagacaaaacacgaatatcatcctgggaagacgttccgtatctaggaaaaagggaagatcaatggtgcggatcactcataggccttaccgcgcgcgcgacgtgggcaacaaacattcaagtagcaatcaatcaagtaagaagattaataggcaatgagaactatagtgactacatgacttctatgaaacgttttaaaaacgaatcagagccggaaggggcgctatggtaa

SEQ ID NO: 21219 - RNA, 9879 nt, synthetic construct
  misc_feature 1..9879: note = derived and/or modified CDS sequence (opt6) from DENV-1__HM181953__SS-prME
  source 1..9879: mol_type = other RNA
tcagttacaatgttattaatgcttatgcctacggccctggcctttcatttaacaactcggggaggtgaaccacatatgatagtcagcaaacaagaaaggggaaaatcacttttgtttaaaacgtctgcgggggttaacatgtgtacattaatagccatggaccttggtgaattatgtgaagacacgatgacatacaaatgcccgcgaattactgaagctgaaccagatgatgtggattgctggtgtaatgccactgatacttgggtaacatatgggacgtgttcccaaacaggggaacatcgcagagacaaaaggagcgtggcgctagctcctcacgtgggtttaggactagaaactagaacagagacgtggatgtctagcgagggtgcatggaaacaaattcaaagagttgaaacatgggcgttaagacatcctggtttcacagtaattgcactattcttagcacatgcgataggaacaagtataacccaaaaaggaattatatttatccttttgatgctagtgacgccatctatggcaatgagatgtgtaggaataggatcgagagattttgtagaaggtttatcaggtgccacctgggtagatgtggtgttagaacatggctcttgcgttacaacaatggccaaagataaaccaactttggacatagaattattaaaaacagaagtgacaaatccagcgatattaagaaaattatgcattgaagcgaaaatttcaaatactaccacggacagtcgttgtcccacccaaggggaagccactctagtagaggaacaggacgctaactttgtctgtcgacgaacatttgtagatagaggatggggaaacggatgtggtctattcggcaaaggctccttaatcacgtgtgccaaatttaaatgtgtgacaaaattagaagggaaaatagtacaatatgaaaatctaaaatatagtgtaatagttacggttcataccggtgatcaacaccaagtcggaaacgaaagcacggaacacggcacaaccgctactattacccctcaagcaccgactacagagattcaactaacagattatggagctctaacactagattgcagtccgagaacaggtttagattttaacgaaatggtactcctaacaatgaaagagaaatcctggctcgtacacaaacaatggtttctagacctaccactgccgtggaccagcggagctagcacttcacaagaaacatggaataggcaagatctcctagtcacctttaaaactgcacatgcgaagaaacaagaagtcgtggtcctgggcagtcaagaaggagctatgcacacagcactaacaggtgcaaccgaaatacagacaagtggaactaccacaattttcgccggacacctaaaatgtcgtttgaagatggataaactgacgctaaaagggatgagttatgtcatgtgcaccggttcttttaaattagaaaaggaagtagcggaaacccaacatggtacggtcttagttcaaattaaatatgaaggtacagacgctccctgtaaaatccccttttcaactcaggacgaaaagggcgtcacacagaatggccgtctgattacggcaaacccaattgttactgataaagaaaaaccggtgaatattgaagcggaaccgccttttggggaaagctatatagtaattggggcgggagaaaaagcattaaaattatcttggtttaagaaaggtagttcgatcggaaagatgtttgaagcaacagctaggggagccaggcgaatggcgatattgggagatacggcttgggacttcggctcaatcggaggagtgtttacatctgtagggaaattagtccatcaaattttcggaacagcttatggagtactgttctccggcgtctcatggacaatgaaaattggcattggcgtcctactcacatggcttgggttaaatagtagatcaacaagtctatcgatgacctgcatagcagttggactggtaacgctatatctaggagtaatggtccaagcggattctggttgcgtgataaattggaaagggagagaactaaaatgtggttcaggaatctttgtaactaacgaagtacatacatggacagagcaatacaagttccaagcagatagcccaaaaagactttctgccgccataggaaaagcatgggaagagggagtctgcggaatacgaagcgctacaagactggaaaatatcatgtggaaacaaatttctaacgaacttaaccatatcctgttagagaatgacatgaaatttactgtagtagtaggggatgttgcaggaatcctagtacaaggtaagaaaatgatacggccacaaccaatggagtataaatattcgtggaaatcatggggtaaagctaagattataggtgcagatgttcaaaacacaaccttcataattgatggtccaaacacccccgagtgcccggatgatcaaagggcatggaatatatgggaggtggaagactatggttttgggatcttcaccacaaacatctggttgaaattacgagattcttatactcaggtttgtgaccataggttaatgtcggctgcgataaaggattccaaagccgtacacgctgatatgggatattggattgagagtgagaaaaatgagacctggaaacttgcaagagcttcttttatagaagtaaaaacctgcatatggcccaaaagccatactctgtggtcaaacggcgtattagaaagcgaaatgataattccaaaaatatatggtggacccatatctcaacacaattacagaccaggatatttcacccaaacggcaggcccttggcacctgggtaaattagaactagattttgatttgtgcgagggtaccaccgtcgtagtagacgagcactgcgggaacagaggaccatcgttaagaactacaaccgttacaggcaaaatcatacacgaatggtgttgccgatcatgcaccctcccgccactccggttcagaggagaggatggttgttggtatggtatggaaatccgaccagtaaaagaaaaggaagaaaatcttgttaagtcaatggtcagcgccggatcaggcgaagtagactccttcagtttgggacttttatgcatatcaattatgatagaagaagttatgagatcacgttggtcaagaaaaatgttaatgacagggacactcgcagtatttctacttttaattatgggacagttgacttggaacgacttaatcagactatgtataatggtcggtgctaatgctagcgacagaatgggaatgggaacaacatatttagcattaatggctacctttaagatgcgtccaatgttcgcagtaggtcttctcttccgtcgattaacaagccgagaagtgctactgcttacgataggtctaagcctagtcgctagcgttgaacttcccaactcgttagaagaactcggagatgggcttgcaatgggaatcatgatcttgaaattgcttactgactttcaatcacatcaactatgggcaacattattgagtttaactttcattaaaacgacattctccctgcactacgcttggaaaacgatggcgatggtcttaagtatagtatcactgtttccgctttgtctgagcactacctcgcagaaaacgacgtggcttcccgtcttgctcggaagtttgggttgtaaacctctaaccatgtttttaatagcggaaaacaagatctggggtcgacgatcatggccactcaatgagggaatcatggccgttggtatagtcagtattcttctatcatcattgctcaagaacgacgtccccttagcaggaccgttgattgcaggagggatgttgatagcgtgttacgtaatatcgggtagctctgcggacctatcgctggaaaaggctgcagaagtttcatgggaagaagaggctgagcattcgggggctagccacaacatactcgtggaggtacaagatgatggaacaatgaagataaaagacgaggagagagatgatactcttacaatattattaaaagcaactttgttagcagttagtggtgtatatcctctatcgatacccgcgacgctttttgtatggtacttttggcagaagaagaaacaaaggagtggcgttttatgggacacacctagcccaccagaagttgaaagagcagttctggatgacggaatctatcgcataatgcaaagaggtttattaggcagaagccaagtgggagtaggtgtgttccaggagaatgtattccacacgatgtggcatgtaaccagaggggctgttctaatgtatcaaggtaaaaggctagaacctagttgggcatccgttaagaaagatctaatatcatatggcggaggctggcgactccaaggttcctggaatacaggagaagaagtccaagttatagccgtagaaccaggcaaaaatcctaaaaacgtacaaacagccccgggcacgttcaaaactcccgaaggagaagtgggggccatcgctttagatttcaagccaggtacatcggggagtccaatagtaaacagggaaggaaaaattgtcggtttatacggaaatggagtggtaacgacatcaggcacttatgtgtctgcaatagctcaggccaaggcctcacaagaaggaccattaccggagattgaagacgaagtttttagaaaacgaaaccttaccatcatggatctacacccgggaagcggcaaaactcgtaggtacttgccagccatagttagagaagctattaaaagaaaattacgaacgcttatcctcgcccccacacgagtggtggcaagtgagatggccgaagcgcttaaaggcatgccaatccgatatcagacaacagcggttaagtccgaacacacgggaaaagaaatagttgaccttatgtgccatgcaacatttaccatgagactattatctcccgtgcgcgtccctaactataacatgattataatggacgaggcgcattttacagaccccagttcaatcgctgctagaggctacatatcaacaagagtggggatgggagaagcagcagctattttcatgacggctacaccacctggatccgtagaggcttttcctcaatcgaatgcggtaattcaggatgaggaacgagacatcccagaacgttcatggaactcaggatatgaatggattacggattttcccggtaagaccgtctggtttgtgcccagtataaaatcaggtaatgatatcgctaattgccttaggaaaaatggaaagagggtaatacagttatcgagaaagactttcgatacagagtatcagaaaaccaaaaacaatgattgggattatgttgtcactacagatatctcagagatgggggcaaatttcagagcggatagagtaatagatcctcggagatgcttaaaaccggtgatactaaaagacgggcctgaacgggtcatactagcaggcccgatgcctgtaacagtggcgtccgctgcgcaaagaagggggagaatcggaaggaatcacaataaagaaggtgatcaatacatatatatgggccagccactgaataacgatgaggaccatgcgcattggactgaagctaaaatgttattggacaacatcaacacccccgaaggcattataccagccctgttcgaacctgaaagagaaaaatcagccgctatcgacggagaatatagattacggggtgaggctcgcaaaactttcgtagaacttatgcggaggggagacctgcccgtatggttaagctataaagtggcttcggaaggttttcagtacagcgatcgaaggtggtgttttgatggcgaaagaaacaatcaagtactagaagaaaacatggatgtagagatatggacaaaggaaggcgagaggaagaaattaagaccaagatggttagatgctagaacatattcagacccgctagccctaagggagtttaaggagtttgcggctggacgtcgtagtgtatccggcgacttgatattagaaattggaaaacttccccaacacttaacacaacgagcgcaaaatgcattagataatttagtcatgttacacaacagcgagcaaggcggccgagcgtatcggcatgcaatggaggaactgcccgatactattgaaactttaatgcttttagctctaatcgccgtattaacgggcggagttacattattctttttatcgggcagaggtttaggcaaaacaagtataggtctcttgtgtgtaatggcgtcttcagtattattatggatggcttctgttgaaccccactggatagcggctagtattatattggagttctttttgatggtattattaataccggaaccagatagacaacggacacctcaagataatcaattagcctatgtagtaatcggtctcctttttatgatacttacggttgcagcaaacgaaatggggttattagagactaccaagaaagatttaggaattggacacgtggccgtgggaaatcaccatcatgcggcgatgctagatgtcgatctacatcctgcaagtgcgtggacactgtacgcagtagcaaccacaataattaccccgatgatgagacatacaattgagaatacgacagctaatatttcactaactgcgattgccaaccaagctgctatattaatgggactagataaaggctggcccatctctaaaatggacataggtgtaccgctactagctctagggtgctatagtcaagtaaacccgctaacactaactgcagcagtattaatgctcgtcgcccattatgccatcataggtccaggacttcaagctaaggcaacaagagaagcccaaaaacgcactgcagctggcattatgaagaatccgacagtggatggaatcgtcgctattgatcttgatcctgtagtctatgacgccaaattcgaaaaacaactaggacaaataatgctcttgatattatgtacatcgcagatacttctaatgagaacaacatgggccctttgtgagtcaatcacacttgccacaggacccttgacaacgttatgggaaggaagcccaggcaaattctggaacacaactattgcagtaagcatggctaatatattccggggctcatatcttgcgggagcaggacttgccttttctttaatgaaatcactaggcggcggaagaaggggtaccggggctcagggggaaaccttgggagaaaaatggaaaagacaactaaaccaattaagtaaattggaatttaatacatataagcgaagtggaataatggaggtcgataggagtgaagcaaaggagggcctgaaaagaggggaaacaacaaagcacgcagtatccagaggcacggccaaattacgatggtttgttgagcgaaatcttgtaaaaccggagggtaaagttattgatttgggttgcggaagaggaggatggagctattattgcgctggactcaagaaagtaacagaggtaaaaggttatacaaaaggaggaccaggacacgaagaacctatcccaatggcaacctatggatggaacttggttaaactacactctggaaaagatgtcttctttatacccccagaaaaatgtgataccttattatgtgatataggagaatccagtcctaatccaacaatagaagaaggacgtaccctaagagttttgaaaatggtggaaccatggttaagaggtaatcaattttgtataaagatattaaatccttatatgccaagcgttgtagaaacgctggaacaaatgcaaaggaaacacggcggaatgcttgttagaaatccattgtctagaaattccacacatgaaatgtattgggtatcttgtggtacaggaaacatcgtcagcgcggttaacatgacatcgagaatgcttctaaacaggtttacaatggcgcacaggaaacctacttatgaaagagatgttgatctaggagcgggaacgaggcatgtggccgtagagccggaagtggcgaatctagacatcataggacaaagaatagaaaacataaagcacgagcacaaatcaacgtggcattacgacgaggacaatccgtataagacatgggcttaccatggttcatatgaagttaaaccgtcaggaagcgcctctagcatggttaacggtgtagtaaaacttctcaccaaaccctgggatgttattccgatggtcacacaaattgcaatgacagatacaacgccgttcggacagcagagagtatttaaagagaaagtagacacaagaacaccaaaagctaaacgtggtacggcgcaaataatggaagtaactgcaaagtggttatggggatttctatcaagaaacaagaaaccgaggatatgtactcgcgaagaatttaccagaaaagtacgaagcaacgcagcaataggcgccgtttttgttgacgaaaaccaatggaatagtgcaaaagaagccgtagaagatgaaagattctgggatttagttcacagggaaagggagttacataaacaaggaaagtgcgcgacatgtgtatataacatgatgggaaaaagagagaaaaagttgggagaatttggtaaagcaaagggttctagagcaatctggtatatgtggcttggcgcacgattcctagaatttgaagcgcttggttttatgaatgaggatcactggttttcacgagaaaattcactttctggggttgaaggagaaggtcttcataaattaggctatatattaagagatataagtaaaataccagggggaaacatgtatgctgatgacaccgccggatgggacactagaattactgaggatgacctacagaacgaagcaagaataaccgatataatggagccagagcacgctttgttggcaaaaagcatattcaaattaacctaccaaaacaaagtagtaagagtgcagcgtccagctaaaaacggtactgtaatggacgtaatatcaaggagggatcagagaggttccggccaagtcggaacttatggactcaatacttttactaacatggaggcccaactaatccggcagatggaatcagagggaatcttctcaccaagtgagctagaaacacccaatctcgccgaaagagttcttgattggttagaaaaatacggagttgaacgactgaaaagaatggctataagcggcgacgattgtgtagtcaaaccaattgacgatagatttgctaccgcactcactgctttaaacgatatgggtaaggtaagaaaggatataccacaatgggagccctcgaagggctggaatgattggcaacaagtccccttctgttcacatcacttccaccaattaatcatgaaagacggacgcgaaatcgttgtcccatgccgcaatcaagacgaattagttgggcgtgccagggtctcccagggagccgggtggtcgctgcgtgaaacggcatgtttggggaaatcctacgcacaaatgtggcaactgatgtacttccacagacgcgatctaaggttggctgcaaacgccatatgcagtgcagtcccagttgactggattcctaccagcagaactacttggtcaatccacgcccatcaccaatggatgacaacagaggatatgctatcagtatggaatagagtgtggatcgaggagaacccatggatggaggataagacccatatatcttcctggggagacgtgccctatctaggaaagcgtgaagatcaatggtgcggtagcttaatcggattaaccgcacgggctacttgggccacgaacattcaagtagccatcaatcaagttcgcagactaataggcaatgaaaactatttggattacatgacaagcatgaaacgatttaaaaatgagtcagaccctgaaggagctctatggtga

SEQ ID NO: 21220 - RNA, 9879 nt, synthetic construct
  misc_feature 1..9879: note = derived and/or modified CDS sequence (opt6) from DENV-1__KF921933__SS-prME
  source 1..9879: mol_type = other RNA
tctgttactatgttgctgatgttaatgccaactgctctagcattccaccttacaacacgaggaggtgaacctcacatgattgtatcaaaacaagaaagaggcaagagcttacttttcaaaacaagtgccggcgtgaatatgtgtacgctcatagcgatggatttaggcgaactatgcgaagacacaatgacgtacaaatgtccgagaattactgaagcagaaccagacgacgtagattgctggtgtaatgcaacagacacgtgggtaacatatggaacatgcagtcaaacaggtgagcacagaagagataaacgttccgtagcattagcccctcatgtaggcttaggactagaaacgagaactgaaacatggatgagcagcgaaggagcttggaaacaaatacaaagagtagaaacatgggctttgaggcatcccggcttcacagttatagctctatttctcgcacatgcaatagggacttcaataacccaaaaaggtattatattcatactgttaatgcttgttacaccatccatggcgatgaggtgcgtagggatcggcagtcgtgattttgtggaagggttgagtggagcaacatgggtagacgtcgtcttagaacatggatcttgtgtgacaaccatggcgaaagacaaaccgactcttgacatcgaacttctgaaaactgaagtgacaaaccctgcaatcttgagaaaattatgcatagaagcaaaaattagcaacacgacaacagatagtaaatgtccgacacagggagaagcaactttagtagaagaacaagatgctaactttgtgtgtaggagaacttttgttgatcgaggatggggtaatggatgtggtttattcggaaagggatctttgattacgtgtgcaaagttcaaatgtgtgaccaagttagagggcaaaatagttcaatatgaaaatctgaaatacagtgtcatagtcacagttcataccggagatcaacatcaagttgggaatgaatcgacagaacatggaacgacggcaactataacaccacaagcacccaccacagaaatacaattaacagattacggggccctaacgttagactgtagcccaagaacagggttagactttaatgaaatggttctgctaactatgaaggaaaagagttggttagtccacaagcagtggttcctcgatttacccttaccgtggacttctggagctagcactagccaagaaacatggaatcgtcaagatcttttagtgacatttaagacagcacacgccaagaaacaagaagtagtggtcttaggaagtcaagaaggtgctatgcacaccgcgctcacgggggcaaccgaaatacaaactagcggcactactacaatctttgcaggacacctaaaatgcagactaaaaatggacaaacttaccttaaaaggcatgtcttatgtgatgtgcaccgggtcatttaaattagaaaaagaagttgcggagacgcaacatggaacagtcctagtacaaattaaatacgaaggtacagacgcaccgtgtaagataccgtttagtacacaggatgagaaaggagtaacgcaaaatggtagacttataaccgctaacccaatagtgacagataaggaaaaacccgtaaatatagaagcggaacctccatttggggaatcgtatatcgtgataggcgcaggagaaaaagccttaaagttatcttggtttaaaaagggcagttctatcggcaaaatgtttgaggccacggcaaggggtgctcgcaggatggctattttgggggacactgcctgggacttcggttcaataggtggtgttttcacttcggtaggaaagttagtacaccagatatttggcactgcttacggagtactattcagcggtgtatcatggacaatgaagattggtattggagtgctacttacgtggttagggctcaacagtcgatcaacgtcgcttagtatgacatgtattgctgtcggcttagttacgttgtatctaggagtaatggtgcaagccgatagtggatgtgttattaactggaaaggacgcgaattgaaatgtggctcagggatatttgttactaacgaagtacatacttggaccgagcaatataaatttcaagcagattcccctaaaaggttatctgcagcaataggtaaagcctgggaggaaggagtttgcggtataagaagtgctacaaggttagaaaatataatgtggaaacaaatctcaaatgagctaaaccatattttgttagaaaatgatatgaaattcactgtagtcgttggggatgtagccggcatcctagcccaaggcaagaaaatgattcgtccacaacctatggaatataaatacagttggaagtcatgggggaaagcgaaaatcattggggcagacgtacaaaacacgacttttataatagatggtccaaatacaccagaatgtcctgatgatcaaagggcgtggaacatatgggaagtagaagattacggctttgggatattcactactaatatatggctaaaactaagggattcttatactcaggtctgtgaccataggctcatgagcgcagcaatcaaagattcaaaagcagtacatgcagacatgggctattggatcgaatctgaaaagaatgaaacgtggaagctagctagagcgtcttttatcgaagttaaaacttgtatatggcccaaatctcacacactatggtccaacggcgtattagaatcagaaatgataataccaaagatttatggaggaccgatatcacaacataattatcgacttggatatttcacccagacagcggggccatggcacctgggtaaacttgaattagacttcgatctttgcgaaggcacaacagttgtagtagatgaacattgcgggaacagaggtccaagtctaagaacgacaacagtaacaggaaaaatcatacacgagtggtgctgtagatcgtgtactcttccacccttacgcttccgaggtgaagatggatgctggtatggcatggaaatcaggccagtgaaagaaaaggaagaaaatttggtaaagtcaatggtaagcgccggatctggggaagtggatagcttttcactgggactgctgtgcataagtattatgatagaagaggtgatgagatccagatggagtcgaaaaatgttaatgacggggactttggctgttttcctgttactaatcatgggccaactaacttggaatgatttaatacgtttgtgcataatggttggagcaaatgcatctgacaggatggggatgggaactacgtatttagcgctaatggctacatttaaaatgagaccgatgtttgcagtcgggttgctatttagaagactgacaagtcgtgaagtattattactaacaatcggactcagcttagtggcatccgtggaactacccaatagcttagaagaattaggtgacggcctcgctatgggaataatgatactaaaattattaacggatttccaaagccaccaactttgggcgacacttctttcccttacatttattaaaacaacattctcactgcattacgcatggaaaacaatggcgatggtcctatccattgttagcctattccctttatgcttgtctacaacaagtcagaaaacaacctggctaccagtactgctagggtcgttaggctgtaagccattgactatgtttttaatagctgaaaataagatttggggacgaagatcatggcctttaaatgaaggaataatggcagtcggcatcgtaagtatactactgagctcattgctgaaaaacgatgtgccactggcgggcccactgatagcgggtggaatgctgatagcatgttacgttattagcggaagtagcgcggacttatccctggagaaggctgccgaagtcagctgggaagaagaggcagaacattcaggtgccagccataacatcttagttgaagtacaagacgatggaacaatgaaaattaaggacgaagaacgtgacgatactctgacaattcttttaaaggcaacactattagcagtaagtggtgtatatccattaagcataccagcaacactattcgtatggtacttctggcagaagaagaaacaaagatcaggagtcttgtgggatacaccctcacctccagaggtagagagggctgttctagatgacggtatctataggataatgcaaagaggtcttctcggacgatcccaagttggggtaggagtatttcaagaaaacgtctttcatactatgtggcatgtgacacgtggtgcggtactcatgtatcaaggaaaaagacttgaaccttcgtgggcaagcgtgaagaaagatctaatatcgtatggcggagggtggaggctacaaggatcgtggaacacaggagaagaggtacaagtcatagctgtcgaaccgggcaaaaatcccaaaaacgtccaaaccgcgccaggaacttttaagacacctgaaggggaagttggcgcaatagcactagattttaaaccaggaacttctggttcgccgatagtcaatcgagaaggcaagattgttggtctatatgggaacggagttgtaaccacatcgggtacgtacgtttctgcaatcgcacaggcaaaggcatcccaagagggaccattgcccgaaattgaagatgaagtatttaggaaacgtaaccttaccattatggatttgcaccccggaagtgggaagacaagacgatatttaccggcaatagtacgagaagccattaagagaaaactaagaactctaattttagcgccaaccagggtagtagcatcagaaatggcagaagcactcaaaggtatgcctattagataccagacaacagcagtgaaaagcgaacatacgggtaaggaaatagtcgatctcatgtgccatgcaacctttactatgcggttgctgtcacctgtcagagtaccaaattataatatgataattatggatgaagctcattttaccgatcctagctcgatagcagcgcggggatatattagcactagagtcggaatgggggaagcggctgcaatctttatgaccgcaaccccgccaggttcagtagaagcgttcccacaatctaatgcagtaatacaagatgaggaacgtgatattcctgaaagatcgtggaatagtggatatgagtggataacggatttccctggcaaaacagtttggtttgtaccaagtattaaatcagggaatgatatagcaaattgcttaaggaaaaatggaaagagagtaattcaacttagtagaaaaacctttgataccgagtatcagaaaaccaaaaacaatgattgggattacgttgtaacaacggacatatcagaaatgggggcaaattttagagcagatagagtcattgatcccagaagatgtctaaaaccagtaatactaaaagacggtccagaacgtgtaatcctggcagggcctatgcctgtaactgtagcatcagctgcacaacgacgcggtagaatcggccgtaatcacaacaaagaaggagatcaatacatatatatgggacaacctctaaacaacgatgaggaccatgcacactggactgaagcaaagatgctactagacaatataaacacgccagaagggattatacccgcactatttgaacctgagagagaaaaatcagcagctatagatggggaatatagattgagaggagaagctcgtaaaacattcgttgaattaatgcgaagaggagatctgcctgtctggctatcttataaggttgcgtcagaagggtttcaatatagcgatagaagatggtgttttgatggtgaacgcaacaatcaagtcttggaggaaaacatggatgtagaaatatggactaaagaaggagaaaggaagaaactacgtccacgatggctcgatgctagaacatacagtgatccattagctttaagagaatttaaagagttcgcagccggaagaagatccgtgagcggtgatctcatcttagaaataggaaaactgccgcagcatttaactcaacgcgcacaaaatgctctcgataatctcgtgatgcttcataacagtgaacaagggggtcgtgcttacagacatgcaatggaagaattacctgacaccatcgaaactctaatgctattagcgttgattgcggtattgacaggtggcgtgacactcttctttcttagtgggcgaggactcggaaaaaccagcattggactactgtgtgttatggcctcaagtgtattattatggatggcatcagttgaaccgcattggattgcagcaagtatcattctagagttctttttaatggtgcttctgatacccgaaccagacagacaaaggacaccacaagacaaccaattagcatatgttgtaatcggtttattattcatgattctgacagtagcagctaatgaaatggggctactagaaacaacgaagaaggacttaggaataggacacgttgctgtaggaaatcaccatcatgccgcaatgttagatgttgaccttcatcccgcatcagcttggaccctatatgcagtagctacaacaatcataacaccaatgatgcgacatactatcgagaatacaactgcaaatatttcactaaccgccattgccaatcaagctgctatactaatgggtctagacaagggctggcccatatcaaagatggatatcggtgtaccattactagcactcggatgctacagtcaagtaaacccgttaacattaacagcagccgttttgatgctagtagcgcattatgcaatcattggaccgggacttcaagccaaagctacgcgtgaagctcaaaagagaactgcagctggcataatgaaaaatccaactgttgatgggattgtcgccattgatctagaccccgtagtatacgacgctaagttcgaaaagcaactcggacagatcatgttattaatactatgtacatctcaaatcttacttatgcggaccacatgggcactctgcgaatcgatcacgcttgctactggacctcttaccacgttgtgggaaggatctcctgggaaattctggaatactaccattgctgttagcatggcaaacatatttcggggttcatacctagcaggagcaggcttagcatttagtttgatgaagagtctaggaggaggcagaagaggaacaggagcacaaggagaaacactaggtgagaagtggaaaaggcaactaaatcaactgtctaaaagcgaatttaacacctataaacggtctggcattatggaagtcgaccgatcagaagccaaggagggattaaaaagaggggaaacaacaaagcatgcagtgagtcgaggtacagctaaactcagatggtttgtggagcggaacttagtaaaaccagagggtaaagtaatagaccttggatgcgggcgtggtgggtggagttattattgcgcaggtttaaagaaagtcacagaggtaaaggggtataccaaagggggtccaggtcacgaggagccgatacctatggcaacgtatggttggaatctagtgaagttacactcaggcaaagacgtatttttcataccacctgagaaatgtgatacattgctttgtgacataggagagtccagccccaatccaacaatcgaagaaggaaggacacttcgagttttaaaaatggtcgagccatggcttagaggaaatcaattttgcattaaaatacttaatccgtatatgccatcagtggtagagacgttagagcaaatgcaaaggaaacatggaggtatgttagtccgcaaccccctgtctcgaaattccacacatgaaatgtattgggtttcttgtggtacggggaatatcgtaagtgcagtgaatatgacgtccagaatgttacttaataggttcactatggcgcatagaaagccaacttatgagagagacgtggacctgggtgcaggaactaggcatgtcgcagttgaaccagaggtagcaaacctggatataataggacaacgcatagagaacattaagcatgaacataagtcgacatggcattatgatgaagataatccttataaaacgtgggcatatcacggaagttacgaagtcaaaccatcaggaagtgcaagttccatggtaaatggtgtagtgaaattgttaacaaaaccatgggatgtaatccctatggtcacccagatagcaatgactgacacaacaccgtttggccagcagagagtattcaaagaaaaagtcgatacgcgaacaccaaaggctaagagaggtacagcacaaataatggaggtaactgcgaaatggctatggggattcttgagcagaaacaaaaagcctcgaatctgcacgcgcgaagaatttacgagaaaagtaagaagcaacgcagcaattggagcagtattcgttgatgagaatcaatggaatagtgcgaaagaggctgtcgaggacggtagattctgggaccttgtccaccgagaaagagaacttcataaacaaggaaaatgtgcaacctgtgtgtataatatgatggggaaacgtgaaaagaagttaggtgagtttggaaaagcaaaaggttcacgagcaatttggtatatgtggctaggggcacgattcctcgagttcgaagcattaggttttatgaacgaagatcattggttcagcagggagaatagtctctctggtgtcgaaggggagggcttacataaactaggatatatattaagagatatttcaaaaatacctggtgggaatatgtatgctgatgacactgcaggatgggacactcgaataacagaagatgatttgcaaaatgaagcacgaatcactgatattatggaaccggaacatgcgttattagcgaaaagcatatttaagttaacataccagaacaaagtcgtacgagtacaaagacccgctaagaacggtacggtaatggatgtaattagcagacgggaccagcgcggcagtggacaagttggtacatacgggcttaacacgttcacaaatatggaggcacagttaatacgacaaatggaaagcgaaggaatattttcccccagcgaactagagacaccgaacttggcagagagagtactcgattggcttgaaaaatatggtgtcgaaaggctgaaacggatggctatatctggagacgattgtgtagttaaaccgattgatgatcgattcgctacagcactaaccgcactaaacgacatgggaaaagtcaggaaagacatacctcaatgggaaccgtcgaaaggatggaatgattggcagcaagtgccgttctgcagtcaccattttcatcaacttattatgaaggacgggcgtgaaatagtagttccatgcaggaatcaggacgaattggtaggacgcgcgcgggtatcgcaaggagcaggttggtccttgagagagactgcctgtcttggaaaatcctacgctcagatgtggcaactaatgtacttccacaggagagatctaagactagctgcgaatgcgatatgtagtgctgtaccggtggactggattccaacatcccgaaccacatggagtatacatgcgcaccaccaatggatgaccacagaggatatgctatcagtgtggaatcgtgtctggattgaggaaaacccctggatggaagacaagacccatatttcttcttggggcgacgttccatatttgggaaaaagggaagaccaatggtgtgggagtctaataggcttaaccgcaagggctacatgggcaaccaacattcaagtagctatcaatcaagtaagaaggttgatcggcaacgaaaactatctcgactatatgactagcatgaaacgttttaagaatgaatcggatccagagggagcactctggtga

SEQ ID NO: 21221 - RNA, 9879 nt, synthetic construct
  misc_feature 1..9879: note = derived and/or modified CDS sequence (opt6) from DENV-1__HM181954__SS-prME
  source 1..9879: mol_type = other RNA
agtgtaacgatgctgctaatgctaatgcccacggcgcttgcatttcacttaacaacacggggaggtgagcctcacatgatagtctcgaaacaggagagaggtaaatctttgctttttaaaacttcagcaggagtaaatatgtgtactctcatcgccatggatctaggagaactttgtgaagacacaatgacgtacaaatgccctagaataactgaagcggaaccggacgatgtagactgttggtgcaatgctaccgacacttgggtaacatatggcacatgttcacaaaccggagaacacagacgagataaacgatcagttgctctggcgccacatgtaggtctcgggttagaaacgagaaccgaaacctggatgtcttcagaaggtgcttggaaacaaattcaaagagtcgaaacatgggcacttagacatcccgggtttactgttatcgcactattcttagcccatgctataggaacctcaataactcaaaaaggaattatattcatactcttaatgttggtgactccctcaatggcaatgcgatgcgttggtataggaagccgggattttgtagagggtttatctggcgctacatgggttgacgttgtactggaacatggtagttgtgttacgactatggcaaaggacaaaccgacattagacatagaactccttaaaactgaagtaactaatcccgcaatactaagaaaactatgtatagaagctaaaatttcgaatactacgaccgattcacgttgtccaactcagggcgaagctacacttgtggaagagcaagacgcaaactttgtgtgtcgacgaacatttgtagatagaggatggggaaatggatgcggtctgttcggaaaaggatccctgataacttgcgctaaattcaaatgcgtcacgaaacttgaaggtaagatagtccaatatgaaaatctgaagtatagtgtaatagtaacggtacatacaggtgaccaacatcaggtgggaaatgaatctactgaacatggtacaacagctacgattactccccaggcaccgacaactgaaatccaattaaccgactatggtgctttgactctggattgttcacctcgtactgggctagacttcaatgaaatggtattgttaacaatgaaagaaaaatcctggttagtacataaacagtggtttttggatttgccgctgccatggactccaggtgcaagtacatctcaagaaacatggaatcgacaagacctcctcgtcacttttaaaactgcccacgcaaaaaaacaagaagtagttgtattaggatcacaagagggagcaatgcatacagcacttaccggcgctaccgaaatacaaacaagtggaacaaccacgatattcgcaggccacctcaagtgtagactaaaaatggataaactaacattaaaagggatgtcatatgtaatgtgcacagggagcttcaagttggagaaagaggtggctgagacacaacacgggacagtacttgttcaaataaaatatgaaggcacggacgcgccatgcaaaatcccattcagcacacaagacgaaaaaggagttacacagaatggtcggctcataactgcaaatcctatagtaactgacaaggaaaaaccagtaaatatcgaagcggaacccccatttggtgaatcgtacatagtaataggggccggagaaaaagcgctgaaactgtcttggtttaagaaaggttcgagtataggcaaaatgtttgaggccaccgcacgtggagctcgaaggatggcaattttaggggacaccgcatgggactttgggtcaatcggaggagtattcacgtctgtggggaaattggtgcaccaaatctttggagccgcttacggggtacttttcagtggtgtatcttggacaatgaagatagggataggagttttactcacttggttgggacttaattcaagatctacttcactctcaatgacatgcatagccgtgggtctcgtcaccttatatctaggagtaatggttcaagccgacagcgggtgtgtgataaactggaagggtcgcgaattaaaatgcggaagcggaatattcgttacgaatgaagtacacacttggactgagcaatacaaatttcaagctgactctcctaagcgactatccgcagcaataggaaaggcatgggaagaaggggtatgtggaataagatccgctaccagactagaaaacattatgtggaaacaaatatcaaacgaactcaaccatatactactcgagaatgatatgaagttcactgtagtagtcggggatgttgctggaatattagcgcaagggaaaaaaatgattcgaccgcaacccatggaatacaagtattcttggaaaagttgggggaaagcaaagataatcggtgcagacgttcaaaatacaacatttatcattgatggacccaacacacctgaatgtcccgatgaccaacgtgcttggaatatctgggaagttgaggactatggttttgggatttttacaacaaatatctggttgaagcttcgggattcatatacgcaagcttgtgaccatagacttatgtcagcagctatcaaagatagtaaagccgttcacgcagacatgggatattggatagagtcagaaaaaaatgaaacatggaaactagcaagagcctcatttatcgaagtaaaaacgtgtatatggccaaaaagtcacacactgtggagtaatggtgttcttgaatccgagatgatcataccaaaaatatacggtgggccgatcagccaacacaactacagaccggggtactttacacagacggctgggccatggcaccttggcaaattagagcttgacttcgacctctgtgaaggaacaacagtggtggtagatgaacactgtggaaatagaggaccgtcattacgtacaacgacggtaacgggaaaaataatacatgaatggtgttgtagatcgtgcactttaccgccattgcgattcagaggtgaagacgggtgttggtatggaatggaaatacgccctgtcaaagaaaaagaagaaaacctagtaaaatccatggtctccgcgggttccggggaagtagatagcttttccttaggcttattatgtatctccattatgattgaagaagtcatgcgaagtaggtggtcaaggaaaatgcttatgactgggacacttgcagtattcctacttttgattatgggacagctgacgtggaatgatctaattagactctgcataatggtcggcgcaaatgccagtgaccgaatgggaatgggtacaacgtacctcgctttaatggcgacattcaaaatgagaccaatgtttgccgttggactcttatttagaagactaactagcagagaagtgttactgctcaccatagggctctcactcgtagcgtccgttgaacttccaaactcattggaggaactgggagacggcctagccatgggaatcatgatcttaaaattgttgactgattttcaaagtcaccagctatgggccacattattaagtttaacatttatcaagacaactttttctttacactatgcttggaaaaccatggcgatggtgttatcaatcgtatccttattcccattgtgtttatcgacaaccagtcaaaaaactacctggctcccggtacttctcggatcactcggctgcaaacctttaactatgttcctcattgcggaaaacaagatatggggtcggaggtcatggccattgaatgaaggtatcatggccgtaggtatagttagtatactgctatcctccttattaaaaaacgatgttccattagcaggtccactaattgcaggtgggatgttaatcgcgtgctatgtgataagtggctcgtcagcagatttatcactagaaaaagcagcagaagtaagttgggaagaagaagcagaacactcaggagcatcacataatatactagtggaagtacaagatgatggaacaatgaaaataaaagatgaagaaagagatgatactttaaccattctccttaaagcgacccttttagctgtttcaggagtatatcccttaagtataccggctaccttgtttgtatggtacttttggcagaaaaagaaacagaggtctggagtattatgggacactccaagcccaccggaagttgaacgagcagtactcgacgatggcatatatcgcatcatgcagagaggacttctcggacgtagtcaggttggggtaggggtatttcaagagaacgtctttcatactatgtggcatgtaactaggggtgcggtattaatgtaccaaggaaaacgtttagagccatcatgggcaagtgtaaaaaaggatctcatatcatacggaggaggatggagattacaaggatcctggaacactggtgaggaagtacaagttatagctgttgaaccgggcaaaaatcctaaaaacgtccagacggcaccaggaacctttaaaaccccagagggtgaagtaggagcaatagcgttagattttaaacccggtacatcaggatcgccgatagtgaatagagaaggtaagatcgtaggtctttacggtaatggagtggttaccacatccggaacttatgtatcggctatagcgcaggcgaaagccagtcaggaaggcccattaccggagattgaggatgaagtattccggaaaagaaaccttacaataatggacctacatccaggctcaggaaaaacccggcggtacctacctgctattgtacgagaagctatcaaaagaaaactgagaacactaattttagcacctacgagagttgtggcatctgaaatggcagaagctctcaaaggtatgccaattcgatatcaaactactgccgtaaaatcggagcatactgggaaggaaatagtggatttgatgtgtcatgcaacctttactatgaggctacttagccctgtaagagttcctaattacaatatgatcatcatggacgaagcccactttacggacccctcatctatagctgcccgaggttacatttcaactagggtgggtatgggagaagccgccgcaattttcatgacagctacaccgcctggttcagtcgaggcatttccacagtcaaacgcagttatacaagatgaagaaagagatatacctgagcgcagctggaatagtgggtacgaatggattactgactttccaggaaaaactgtttggtttgtaccttcaataaaatctggtaacgacattgccaactgtctacgtaagaatggtaagagagtcatacaacttagtcgaaaaacgttcgacaccgagtaccaaaaaactaaaaataatgactgggactatgttgttacaacagatatatcagaaatgggtgcaaactttagagcagaccgagtaatcgatcctcgaagatgtctaaaaccagttatcttgaaagacggcccagaacgggtgatactagccggtccaatgccagtgacggtggcctccgcagcccagcgaagaggtcgcattggacgaaaccacaacaaggaaggtgatcaatatatttacatgggacaaccactaaacaacgacgaagatcatgcccattggacggaagccaaaatgttactagataatataaacaccccggaagggattatacctgcattatttgagcctgaacgagaaaaatcagcagcaatcgatggtgagtatcgtttacgcggagaagcaagaaagacctttgtcgagttaatgagacgcggcgatctaccggtttggttaagctataaggttgctagcgaaggatttcaatatagtgatagaagatggtgtttcgatggagagcgaaacaaccaagtgctagaggaaaatatggatgttgagatatggaccaaagaaggagaaaggaagaaacttagaccccgttggttggacgccaggacatatagtgatccgctggctctgcgcgaatttaaagaatttgcagcaggtagaagatcagttagcggagatctaatactagagatcgggaaattaccgcaacatcttactcagagagctcaaaacgccctcgataatttagtcatgttgcataattcagaacaaggaggacgagcctataggcatgctatggaagaattacctgatacaatcgaaactcttatgctattagccctcattgcagtactaacaggaggggtaacgttattttttctgagtggccgtggattaggcaaaacatccattggacttttatgtgtaatggcatcatccgttctgctgtggatggcttccgtagaacctcactggatcgctgcaagtataatattagaattctttctaatggtactactaataccagaaccagacaggcagagaacaccacaggataatcaactagcttacgtagtaatcggtttattgtttatgatcctaacggtagctgcaaatgaaatgggactattagagacgacaaaaaaggatttgggtattggacatgtcgcagttggcaatcaccaccatgccgctatgttagacgttgatcttcaccccgcttcagcctggactttatatgccgtggctacaacaataattacgccaatgatgcgacacacaatcgaaaatacaactgctaatatatcactaacagccattgctaatcaagcagcaattcttatgggcttagataaaggctggcctatctcaaaaatggatataggagtaccactattggcgttaggttgttattcccaagtaaaccctttgacgttaacagcggcggtacttatgttagttgcgcactacgcaattattggaccagggttacaagcaaaagccacgagagaagctcaaaaacgcactgccgctggaattatgaaaaatcctacagtggacggcatagtggcaattgacctggacccagtcgtctacgacgcgaaatttgaaaaacaattaggtcagatcatgttattaatactatgtacctcgcaaattttattaatgagaacgacttgggcgttatgtgaatcaataactttagccacgggcccacttacgactctctgggagggaagcccgggtaaattctggaatacgacgattgcggtaagcatggcaaacatctttcgcgggtcatatttagcaggagctggattagcttttagtctgatgaaaagcctgggcggcggaagacgaggaaccggagctcaaggtgaaaccctgggtgaaaagtggaaaagacagttgaaccaactgtctaaatctgaatttaatacttataagcgatcaggtataatggaggtagatcgaagtgaggcaaaagaaggtctcaaaaggggtgagacaactaaacatgcagtttcaagagggacagcgaagttaagatggtttgttgagaggaatttagtaaagccggaaggtaaagtgatcgacctgggctgcggaaggggcggatggagttattattgcgcaggcttaaagaaggttacggaggttaaagggtatactaaaggggggcctggtcatgaagagccgatcccaatggccacatacggatggaatttagttaaattgcattctggaaaggacgtctttttcataccacctgagaagtgcgatacattattatgcgatatcggcgaaagctccccaaacccgacaattgaagaaggacgaacactgagagttcttaaaatggtagaaccttggctacgcggaaatcaattctgcataaaaatcttaaacccatatatgccttccgttgtagaaacactcgaacaaatgcagcgaaaacatggaggaatgctcgtccgcaatccgctttcgagaaatagtacacacgaaatgtactgggtaagttgcggaacaggaaatatagtcagcgctgtgaatatgacgagcaggatgctactcaacagattcactatggcccaccgaaagccaacatatgagagagatgtagacttaggggcaggaaccagacacgttgcagttgaaccagaagtagccaacctggatattataggacagcgcatagaaaatattaagcatgaacataaaagtacatggcattatgacgaggacaacccctataaaacatgggcatatcacgggtcatatgaagtgaaaccgagcggttccgcctcaagtatggtaaacggagtagtgaagttactgacaaaaccgtgggacgttatacccatggtcactcaaattgccatgacagatacaacgccatttggtcaacaaagggtattcaaagaaaaggtagacactcgcacgccaaaggctaagagaggtacagctcaaattatggaagttacagccaaatggttatggggtttcctttctcgtaataaaaaaccacgcatttgcaccagggaagaattcacgaggaaagttagatcgaatgccgctataggtgcagtatttgttgacgaaaatcaatggaattcagcaaaagaagcagtcgaagatgagagattctgggatttagtacacagagaaagggaattacacaaacaaggcaaatgtgcaacttgcgtctacaatatgatgggtaaacgcgaaaaaaagttaggcgaatttggtaaagcaaaaggctcaagagctatctggtacatgtggctaggtgccagatttttagaatttgaggctctaggtttcatgaatgaagaccattggttctctcgggaaaacagcctaagtggagtagagggcgagggacttcacaaactgggatatatactaagagatatatctaagattccaggtggaaatatgtacgcggatgatacagcagggtgggatacaagaatcactgaagatgacttgcaaaacgaggcacgaatcacagatataatggaacctgagcatgccttattagcaaaatcaatattcaaattaacataccaaaataaagtcgtacgtgtgcaaagacccgccaaaaacggaactgtaatggacgttatttcaagacgagaccaaagaggctccggccaggtaggtacatatggactaaatacatttaccaatatggaagctcagttaatacggcaaatggaatctgaaggaattttttccccatctgaactagagaccccgaatttagctgagcgggtcttagactggctagaaaaatacggtgtagagcgcttaaagagaatggctatcagcggggatgactgcgttgtcaaacctatagatgatcgatttgcaacagcattaacagccctcaatgatatgggaaaggtaagaaaagacattccccaatgggaaccatctaaaggttggaacgattggcagcaagtaccattctgcagccaccattttcaccagctgataatgaaggatggtagggagatagtggtaccttgccgaaatcaagacgaactggtaggtcgcgctagagtatcgcaaggtgcgggatggagtttgcgggaaacagcgtgccttggcaaatcatacgcacaaatgtggcaattaatgtattttcacagacgagatcttcgattagctgcaaacgcaatctgttcagctgtaccggtagactggattcccacatcaagaacaacttggtccatccatgcccatcatcagtggatgacaacagaagatatgttatcagtttggaatcgtgtatggattgaagaaaatccgtggatggaagataaaacccacatatcatcatggggtgatgttccgtacttaggaaaaagggaagaccaatggtgtggctcacttattggtttgactgcaagagcaacttgggcgacaaatattcaggtcgctattaaccaagtgagaagactcattgggaatgagaattatttggactatatgacctcaatgaaaagatttaaaaatgaatctgatccagaaggggccctgtggtag

SEQ ID NO: 21222 - RNA, 9879 nt, synthetic construct
  misc_feature 1..9879: note = derived and/or modified CDS sequence (opt6) from DENV-1__HM181955__SS-prME
  source 1..9879: mol_type = other RNA
tcggttaccatgttattaatgttaatgcctactgccctcgcatttcacctaactacaaggggtggagaacctcacatgattgtttctaaacaagaacggggaaaatctctactctttaaaacatcggccggtgtaaacatgtgcacactaattgccatggacctgggtgaactatgtgaagatacgatgacatataaatgccctagaataacagaagctgaacccgatgacgtagactgttggtgtaacgcaactgatacctgggtaacgtacggaacatgtagccagacaggagaacataggagagataaacgatctgtcgctcttgctcctcacgtcggacttgggttggaaaccagaacagagacatggatgtcatctgagagtgcatggaagcagattcaacgggtcgaaacatgggcgttgcgtcatccaggatttacagtaattgcactattccttgcgcatgctattggaacaagtataactcaaaaaggaattatatttatactactaatgctagtaacaccatcaatggcgatgagatgcgtaggtataggatcaagagattttgtggaaggactatcgggagcaacgtgggttgacgtggttctggaacatggcagctgcgttacaacaatggcaaaagataaacccacattagatatagaacttttaaaaacagaagtaactaatccggccatattgcgtaaactatgtattgaagcgaaaataagcaacacaacaacagattcacgttgcccaacccaaggcgaagcaaccttagtagaagaacaagacgcgaatttcgtttgccgccgtacttttgtagatagaggctggggaaatggatgtggcttatttggtaaaggcagcttaattacttgtgcaaaatttaagtgcgttaccaaactcgaaggcaaaatcgtgcaatacgaaaacttgaaatattcggtaattgtaacagtgcatacgggagatcaacaccaagttggcaatgaaagtacggaacacggtacaacagcgacaataaccccacaagcccctacaactgaaatacaactaaccgattatggggctttgactttagactgctcaccacggacagggctcgacttcaatgaaatggtactacttacaatgaaagagaaaagctggttggtacacaagcaatggtttttggatctcccactaccatggacaagcggtgcctcgacctcacaagagacttggaatagacaggatttattagtcacctttaaaacagcacacgcaaagaaacaagaggtagtcgtcttgggttcacaggaaggcgcgatgcataccgcgctgactggggccactgagatacaaacatctggtacaacaactatattcgccggccatctgaagtgtagactaaaaatggacaaattaactttgaaaggaatgtcatatgtaatgtgtacgggatcttttaaactcgagaaagaagtagcggaaacgcaacatggaacagttttagttcagatcaagtacgaaggcacagatgcaccatgtaaaataccctttagtacccaagacgaaaaaggagtaacacaaaacggacggttaatcacagccaacccaattgttacggataaagaaaaaccggtgaacatagaagccgaaccaccctttggcgaatcttatatcgtaattggagctggcgaaaaagcactaaagttgagttggtttaagaaagggagttcaattggtaagatgttcgaagcaactgcaagaggtgcaagaagaatggcaatactaggagatactgcctgggattttgggtctattgggggtgtcttcacatcggtaggaaaacttgttcatcaaatatttgggacggcctatggagtcctattcagcggtgttagctggacaatgaaaattggaataggcgttttattgacatggctgggccttaattcacgatctaccagtcttagtatgacttgtatagctgttggcctcgtgaccctatacctaggtgtaatggttcaagcagactctggatgtgttatcaattggaaagggagagagttaaagtgtggttcgggaatttttgtaacgaatgaagtacacacctggactgaacaatataaatttcaggctgactctcctaaacgcctcagtgcagcgattggaaaagcctgggaggaaggagtttgcggcatccgttcggccacaaggctggaaaatattatgtggaaacaaatatctaatgaactcaatcacatacttttagaaaacgacatgaaattcacagttgttgttggagatgtagcaggaatactagcccaaggcaagaaaatgataagaccacaacctatggaatacaaatattcgtggaaaagctggggcaaagccaaaattatcggagctgacgtccagaatactactttcataattgatggacctaatacaccagaatgtccggatgatcaaagagcatggaacatctgggaagtagaggattatggatttggaatttttacaactaatatctggctaaaactacgtgatagctacacacaggtttgtgaccatcggctaatgtcagctgcaatcaaagattccaaagctgtgcatgctgatatgggatactggattgagagtgagaaaaacgaaacgtggaagctggccagagcgagttttattgaggttaaaacttgtatatggccgaaatcgcatacactttggtcaaacggagtactagagtcggaaatgataatacctaaaatatatggaggaccaattagtcagcacaactatcgacccggatactttacacagacggctgggccctggcacctaggaaagctcgaacttgattttgatctttgtgagggtactacggtagtagttgatgaacactgtggaaatagagggcctagtcttaggaccacaacagttactggtaaaataatacacgagtggtgttgtagatcgtgcacgttaccaccactaaggttccgaggagaagacgggtgttggtacgggatggaaataagacctgtcaaagaaaaagaagagaacttagtcaaaagtatggtatctgcgggatccggagaggttgattctttcagtctaggattactatgcattagtattatgatcgaggaagttatgagatctaggtggtcgagaaaaatgttaatgaccggaacgttggtagtctttttacttctgataatgggacaacttacatggaatgacttgattagactttgtattatggtaggtgcaaacgcctcagaccgcatgggaatgggtacaacctatttagcactaatggcaaccttcaaaatgagacctatgtttgcggtagggttattatttcgcagattgacttcaagagaggttctactattaacaataggtttatcacttgtcgcaagtgtcgaattaccaaactctctggaagaattaggagatggcctcgcaatgggaatcatgatactgaagctattaacggatttccagtctcatcaactatgggcaaccttattgtccttaacattcataaaaacgacattctcattgcactacgcttggaaaacaatggctatggttctatctatcgtaagtctctttcccctctgcctatctaccacttcccagaaaaccacctggctcccagttctccttggatctcttggttgcaaaccacttaccatgttcctaatagcggaaaacaaaatctggggaagaagatcttggcctcttaacgaaggtattatggctgtgggaatagtctcaattttactaagtagtttattaaagaacgatgtacctttagcgggaccgttaatagctggcggaatgcttattgcatgttacgtcatttcaggatcttctgccgacctatctctagaaaaagctgctgaagtcagttgggaagaggaggcagaacattcgggagcgagccacaatatcttagtagaagttcaagacgatggtacaatgaaaataaaagatgaagaaagagatgatacgctaacgatacttctaaaagccacactcttagcggtatcaggagtctatcccttatctattccagcgactctcttcgtatggtatttttggcagaagaagaaacaaagaagcggcgtcctttgggatacaccttccccaccggaggtcgaaagagcagtgctagacgacggcatatatcgaataatgcagagaggtctattaggacgcagtcaggttggggtaggagtttttcaagagaacgtatttcatacaatgtggcatgtaacgagaggagcagtgctaatgtatcaaggaaaaagactcgagccaagctgggcatccgttaagaaagatttaatcagttatggcggcgggtggcgacttcaaggatcatggaacacaggagaggaagtgcaagtcatagcagtagaacccggtaaaaacccaaagaatgtgcaaactgcccctggtacattcaaaacaccagagggagaagttggtgcaatagctctagactttaagccaggtacttcggggtcgcctattgtaaatcgagaaggcaaaatagtagggctatacggaaacggggttgtcacaacgtcaggtacttacgtatctgctatagcacaagccaaagcatctcaagagggtccactcccggaaatagaggatgaagtatttagaaagcggaacctcacgatcatggatttacacccagggagtggaaaaacccgaaggtatctcccagctatagttagggaggccatcaaaagaaaattaagaaccttaatactagcccccactcgtgtcgtggcgtccgagatggcggaagcactgaaaggaatgccgattcgatatcaaaccacggcggtgaaatctgaacacacaggaaaagaaattgtggatctgatgtgtcatgcaacctttaccatgaggctactttctccggtgcgagtcccaaattacaatatgattataatggatgaagcacatttcactgacccatcgtcaatagcggctcgtgggtatatcagcactagagtaggtatgggcgaagcagcagcaatattcatgacggctacacctcctggatcagttgaggcattcccccaatcaaatgcagtaatacaagatgaggagcgggatataccagaaagatcttggaactcaggatatgagtggatcaccgatttccctggaaaaactgtgtggtttgtaccatccatcaaatcaggaaatgacattgcgaattgtttacggaaaaacggaaaaagagtaatacagctaagtagaaaaacattcgacaccgaatatcagaaaaccaagaataacgactgggactatgtagtcacgacagatatcagcgaaatgggagccaactttcgagcagatcgtgtcatagatccacgtagatgtctaaagccagtaatcctaaaagatggccccgaacgcgtcattctagcaggaccaatgcccgtcacagtagcttcagctgcacaaagaaggggaagaatcggaagaaaccataacaaggaaggagaccagtacatatatatggggcaacctctaaataacgatgaggaccatgctcattggacagaagcaaaaatgttactagacaacataaacacgcctgaaggaatcatcccggccctatttgagcctgaaagagaaaagtcagcagcaatagatggagaatatagactaagaggtgaagcaagaaaaacttttgttgaactaatgcggcggggagacctaccagtttggttgagttacaaggtcgcgagtgaaggattccaatatagtgatcgacgatggtgttttgacggtgaacgaaataaccaagtgctagaagagaacatggatgtagaaatatggactaaggaaggggaacgaaagaaactgcgacccaggtggctagacgcaagaacatactcagatccgttggcactgcgcgaatttaaagagttcgccgcaggtcgacgaagtgtctctggagacttaattctagagataggcaaactgccacagcatcttacccagagggctcaaaatgctttagataacctagtgatgttgcacaacagtgagcagggaggcagagcatacaggcacgcgatggaagaactcccagatactattgaaacattaatgttacttgcacttatagcggtactaactgggggagtaaccctattctttttgtcaggtagaggtttgggaaaaacttcaataggacttctttgtgtgatggcatcttcagtcctactctggatggcatctgtcgaaccccattggatagctgcatcaataatactagagttcttcctcatggttttattaataccagagcccgatcgccagagaacaccacaagataatcaactagcttatgttgtgataggattactatttatgattctcaccgtagcagcaaacgagatgggccttctcgaaacgactaagaaagacctaggaatcggacatgtggcagttgggaatcatcatcatgctgctatgttagatgtggacttacacccagccagcgcatggaccctatacgccgttgccactacaataattacccctatgatgcgtcatacgatcgaaaataccacggctaatataagtcttacggcgatagctaaccaggcagcaattctcatgggtctcgataagggttggccaatttccaaaatggatataggtgtcccgttattggcactaggttgctattcacaggtcaatccattaacattaacggcggcagtcttgatgttagtagcccactatgcgataattggaccaggactacaagcaaaagctactagagaagcccaaaaacgcacggcggcaggaataatgaaaaaccctactgtagatggaatcgtcgctatagatttagaccctgtagtgtatgatgccaaattcgaaaaacagctaggacaaattatgctactcatactatgcacttctcaaatactgctaatgcgaaccacatgggcgttgtgcgaatccataactttggcaacaggaccgttgacaacgttatgggaagggagcccgggcaagttttggaatactaccatagctgttagcatggcaaatatctttcgaggatcatacttagcaggcgcaggattagcattctccctcatgaaaagtttaggaggaggacggagaggaactggagcacagggagagacactcggggagaaatggaaacgacagttaaaccagcttagtaaatcagaatttaacacatacaaaagaagtggcatcatggaagttgataggtccgaggcaaaagagggtttgaaaagaggtgaaactactaaacatgctgtaagtagaggaacagcgaaacttcgatggttcgtggaacgaaacttagttaagccagaaggaaaagtaatagatctagggtgtggtcgtggaggttggtcatattattgtgcaggattaaagaaagtaacagaagtgaaaggctacaccaagggtgggccaggtcatgaggaacccattccaatggcaacgtatggttggaatctagtaaagttacattcaggtaaagacgtctttttcataccacccgagaaatgcgatacattgctgtgcgacataggggagtcaagccccaacccgacaatcgaggaaggccgcacattacgcgtattaaaaatggtcgaaccctggctaaggggtaatcaattctgcattaaaatcctaaacccttatatgccgtcagtagttgaaactctcgaacaaatgcagaggaaacatggaggaatgctcgtccggaaccccctcagtagaaatagtacacatgaaatgtactgggtatcctgcggaaccggaaatatagtaagcgctgtaaatatgacctcacgtatgcttttaaatagatttacaatggcccaccggaagccaacttacgagcgtgatgtcgatttaggagcgggaacccgacatgtggcagttgagccggaagttgcaaacctagatatcataggccagcgaatcgagaatataaaacatgaacacaagtccacatggcattacgatgaagataacccctacaaaacgtgggcttatcatggatcctatgaggttaagccgtccggatctgcatctagtatggttaacggagtagttaaactgttaactaaaccttgggatgttattccaatggtgacccaaatagccatgaccgacactactccatttggccaacaaagagtgttcaaggaaaaagtcgatacccgaactccaaaagcaaagagaggaacagcacagatcatggaagtcacggccaaatggctatggggctttttaagtagaaataaaaagccgagaatctgcacgagagaagagttcactcgaaaggttagatcaaacgctgcaataggggcagttttcgtggatgagaaccaatggaactcggcaaaagaagcggttgaagacgaaagattttgggatttagtgcacagagagcgcgaattacataaacagggaaaatgtgcgacctgtgtatacaatatgatgggtaaacgcgagaagaaactaggggagttcggaaaggcaaaaggtagcagagctatatggtatatgtggctaggtgcaagatttttagagttcgaggctttaggatttatgaatgaagatcattggttcagtcgagaaaattcattaagcggagttgaaggagagggtctacataaattaggttatatactacgcgacatttcaaaaatcccagggggcaatatgtacgcggatgacacggccggttgggacacaagaattactgaggacgacttacaaaacgaggcacgaataactgacattatggagccagagcatgctctcttagccaaatccatattcaaactaacatatcagaacaaagtagtacgagtccagagacctgctaaaaatggaaccgtcatggatgttataagccgaagggatcaaagaggaagcggacaagtaggaacttacggattaaacacttttaccaatatggaagcccagctaataagacagatggaatctgaagggattttctccccaagcgaattggaaacgcccaacctagccgaaagggtacttgactggctagagaaatatggggtcgagaggttaaaacgcatggctatatcaggagacgattgtgtagtcaaaccgatagacgacagattcgcgaccgcacttacggctttaaacgacatgggaaaagttagaaaagatatcccacaatgggagccgtccaagggatggaacgattggcagcaagttcccttctgtagccaccattttcaccagctaattatgaaagatgggagagaaatcgttgttccatgtcggaaccaagacgaattggttggcagagccagagtatctcaaggagcagggtggtctctacgagagacagcatgtctagggaagagttatgcacaaatgtggcaactgatgtattttcaccgtcgtgatctacggctagcagctaacgccatttgcagcgcagtgccagtagattggatacctacctctcgcacaacgtggagtatacacgcgcaccaccaatggatgactacagaggatatgttatcagtatggaatagagtgtggattgaggagaatccctggatggaggataaaacgcatataagctcttggggtgacgttccctatctaggtaagagggaggatcaatggtgtggatcgttaataggattgactgccagggcaacatgggctaccaatatacaagttgctatcaaccaagtaaggcgcctaattggtaacgaaaattacctggattatatgacaagtatgaaacgctttaaaaatgaaagtgatcccgaaggcgcattatggtag

SEQ ID NO: 21223 - RNA, 9879 nt, synthetic construct
  misc_feature 1..9879: note = derived and/or modified CDS sequence (opt6) from DENV-1__HM181959__SS-prME
  source 1..9879: mol_type = other RNA
tcagtaacaatgctattgatgttaatgcctacagcactcgcattccacttaacaactagaggaggggaaccacatatgattgttagcaaacaagaaagaggaaaatcattgctgttcaaaacttcagcaggcgtgaatatgtgcactttgatcgcaatggacttaggagaattatgtgaagatactatgacatacaaatgtccaagaataacggaagctgaaccagatgacgtcgattgttggtgtaacgcaactgatacatgggttacttatggcacatgcagtcaaacaggagaacatagacgtgataaaaggtcagtagcactcgcgcctcatgtcggactcggtttggaaacaagaaccgaaacatggatgtcatctgagagcgcttggaaacaaattcagagagtggaaacatgggccttaagacatcctgggttcactgtaatagcattattcctagcccatgccataggaacatcgatcactcaaaaaggaatcatttttatcctcttgatgctagtcacaccaagtatggcgatgagatgtgtagggattggaagtagagacttcgtagagggactatcaggagcaacatgggtagacgtagtcctagaacacgggagttgcgtaaccactatggcgaaagacaaacctacattagatatcgaattattaaaaacggaggtaacaaatcctgctatcctgagaaaattatgtatcgaagcaaaaattagtaataccactactgattcccgatgcccgacgcaaggggaagcaaccttagttgaagaacaagatgccaactttgtatgtaggagaacatttgtagatcgaggttgggggaacggatgtgggctctttggaaaaggtagtttaattacttgcgcgaaatttaaatgtgttacaaaactggaggggaaaattgttcaatacgaaaacttgaaatactcagtaatagtgacagtccataccggggatcaacaccaagttgggaatgaaagtactgaacatggtacaacggctaccataactccgcaagccccaaccacagagatccaattaaccgactatggtgcgttaacactcgactgctccccacgcaccgggctcgactttaacgaaatggttctgcttacgatgaaagaaaaatcatggttggtacataaacaatggtttttagatttgccgctgccttggacttccggcgcgtccacaagtcaagaaacttggaataggcaggacctattagtaacattcaaaaccgcacacgccaagaaacaagaagtcgtggtcttaggatcgcaagaaggagcaatgcatacagccctaaccggagcaacagaaatccagacctcaggaacaaccactatttttgccggtcatcttaaatgccgacttaaaatggataaacttacactcaaaggaatgagctatgtaatgtgcactggttctttcaaattagaaaaagaggtagcggaaacgcaacatggaacggtactcgtacaaatcaaatacgaaggaaccgatgcaccctgtaaaattccattttcaacgcaggatgaaaaaggcgtaactcagaacggtagacttattacagctaaccctatagtaacggacaaagagaaaccagtaaatattgaggcggaacccccattcggagaaagttatattgttataggcgctggagagaaagcacttaaactgagttggtttaagaaagggagtagtatagggaaaatgttcgaagccacagctagaggcgccaggcggatggctatattaggtgataccgcatgggattttgggagtataggaggggtcttcacatcagttggaaagttagtacatcaaatattcggaacagcatatggagtactgttctctggtgtgtcgtggacaatgaaaataggaataggtgttttgcttacatggttgggattgaacagtagatcaacatctttgagtatgacttgtatagccgtaggcctcgtaacactgtatctgggagtaatggtacaagctgactccggatgcgtaattaactggaaaggacgagaattgaaatgcggtagcggaatattcgtcacaaacgaagttcacacctggaccgaacagtacaaatttcaagctgattcaccgaaacgtctcagtgcggctataggaaaagcatgggaagaaggcgtatgtggtataaggtctgcaactagactggaaaatattatgtggaaacaaataagtaatgagttaaaccatatcctattagagaacgacatgaaattcacagttgtagtaggagatgttgcgggaatattagcgcaagggaagaaaatgataaggccacaacctatggaatataaatactcttggaagagttggggaaaagctaaagtaataggagcagatgtccaaaataccacgtttattatcgatgggccaaatacacctgaatgtccggacgatcaaagagcatggaacatctgggaagtagaagattacggattcgggatttttacaacaaacatatggttaaaattaagagattcatacactcaagtatgtgatcatagacttatgagcgctgcaattaaagattcaaaagcagtgcatgcagatatgggatactggatcgaaagcgagaaaaacgaaacatggaaactcgctagggcaagttttatagaggtaaaaacttgtatttggcctaaatctcatacactgtggtcaaatggagtccttgagtcagagatgattatcccaaaaatttatggaggacctataagtcaacataactacaggccgggatatttcactcaaacagctggcccatggcacctcggtaaacttgaacttgatttcgacttatgtgaaggaacaacagtggttgtagatgagcactgcggaaatcgaggtccaagtctacgtacaactactgttacaggtaagataatacatgaatggtgttgcagatcatgtaccctaccaccactgagatttagaggagaggatggatgctggtatggtatggaaatccgacccgttaaagaaaaagaagaaaatctcgtgaaaagtatggtctccgcaggaagtggagaagtagattccttctcactaggcctattgtgtatatcgataatgatagaggaggttatgagatcaagatggtcccgaaagatgttgatgaccggtacgctagtagttttcctattgctgattatggggcaacttacgtggaacgatttaatccgtctttgtatcatggtaggagcaaacgcatccgatagaatgggcatgggaactacgtatctagcactgatggctacatttaaaatgcggccaatgtttgcggtagggttgctatttagacggttaacaagtagggaggtcctcttactaaccataggtctctctctagttgcaagtgttgagttgccaaattcacttgaagagttaggtgacgggttagccatgggtataatgatattaaagctgctaacagactttcagtcacatcaactctgggctaccttactttcattgacatttataaaaacaaccttctccctacactatgcatggaaaactatggcaatggttttaagtatagttagtttattccctttatgcttaagcacaacctcacagaagacgacatggttaccggtgttactcggttctttgggatgtaaaccactgacgatgtttttgattgctgaaaataagatctggggccggaggtcgtggcctttaaacgagggaatcatggctgttggaattgtttctattttactgtcatcactcttaaagaacgatgtcccgctagcgggcccactaattgcaggcgggatgctcatagcctgttatgtaatatctggatcctcagcagatctttcgcttgaaaaagcggcagaagtatcatgggaggaggaagcagagcacagtggcgcgtcacacaacatacttgttgaagtacaagatgatggcactatgaagattaaggacgaagagagagatgatacccttacaatattgctaaaagctacactgttagcggtctcaggcgtttatcctttatcgatccctgctactctgtttgtatggtatttttggcagaagaagaaacaacgatccggcgtcctttgggatactccgtctccaccagaggttgaaagagccgtcttagatgatggtatctacaggattatgcaaagaggattactaggtagaagtcaagtcggcgtaggagtgttccaagaaaatgtgtttcacacaatgtggcatgttactagaggagcagttttaatgtatcaaggtaaaagattggaaccaagttgggcttcagtgaaaaaggacttaatttcctatggcgggggttggagactccaaggaagttggaacactggagaagaagtacaagttattgctgtcgaacctggtaaaaatccgaaaaacgtccaaacagctcccggaacctttaagacacctgaaggtgaggtaggtgcaattgctttagactttaagccaggcacatccggttcgccaattgttaatcgtgagggcaagattgttgggttatatggcaatggagttgtcactacctcagggacatacgtttcagcaattgcacaggcaaaggcttcgcaggagggaccgctacccgaaattgaagatgaagtctttaggaaacgtaacctcacaatcatggacctgcaccccggttccgggaagactaggagataccttccagcgatagtcagagaagcaatcaaaaggaaactacgtacactgatactagctcccactcgagtagttgcatccgaaatggcagaagccctaaaaggaatgccaattagatatcaaacgacagctgtgaagtcagaacataccggcaaagaaatagtcgatctaatgtgtcatgcgacattcacgatgagactacttagtccggtacgagtcccaaactataacatgatcataatggatgaggctcacttcactgacccatctagcatagcggcaagaggttacatctccacaagagttggaatgggggaagcagctgcgatattcatgactgctactccacctggtagtgtggaagcattcccacaatcaaatgcggtaatccaagatgaagaaagggatatacctgaaagaagctggaactctggctacgagtggataactgactttccaggcaagactgtatggtttgtaccctcaataaagtcaggtaatgacatagcgaattgccttaggaaaaacgggaagagggtgatacaactctcaagaaagacttttgacacagaatatcagaaaactaaaaacaacgattgggactatgtcgttaccactgacatctctgaaatgggtgccaatttcagagctgatcgcgtcatcgatccgcggagatgtttaaagccagtcatactaaaagatggaccagaacgagtaatcttagcaggcccaatgccagtgacagtagcaagtgcagctcaacgacgaggacgtataggaagaaaccataacaaagagggagaccaatacatttatatgggccaacctctcaataacgatgaagatcacgcacattggacggaagccaaaatgctgttggataacataaatacaccagaagggataatccctgctctatttgaacccgaaagggagaaaagtgcagcgatagacggagagtatcgattaagaggagaagcaaggaaaacttttgtagagttaatgcgacgaggagaccttccagtgtggctctcatacaaagtagcatcggaaggatttcaatattcggaccgacgatggtgttttgatggcgaacgaaataatcaagttttagaagaaaacatggatgtggagatttggactaaagaaggagagaggaagaagttacgacctcggtggttggacgcaagaacttatagcgaccccctagcattacgtgaatttaaagaatttgctgctggtcgtagaagcgtgtctggtgaccttatattggaaataggtaaacttccgcaacacctgacccaacgggctcagaatgcactagacaatttagtaatgcttcacaactccgaacagggtggacgggcttacagacatgccatggaggaattaccggatacgatagaaactctaatgttattagcgttaattgctgtgctaaccggtggggttactctgttctttctgtcaggaagagggttaggaaaaacatctatagggcttctatgtgtaatggcatcctcagttttactttggatggcatcagtagaaccccactggatcgcagcttcaataattcttgaatttttcttaatggttttattaatccctgaaccagatcggcaaagaacgccacaagataatcaactcgcttacgttgtaatcggtctgttatttatgatacttacagtcgctgccaacgaaatgggtcttctggaaacaaccaagaaagacttaggtatcggtcacgttgctgttggaaatcatcaccatgcagccatgttggatgttgacctacatcctgctagtgcctggaccctatacgcggtagcaacaacaatcataacccccatgatgagacacaccatagaaaatacaaccgcaaatatctctctaacggcaatagcaaatcaggcagcaatactaatgggactcgacaagggatggccaatcagtaaaatggacataggagtaccattgttggcgttaggttgttactcacaagttaatcctttaacccttacagcggctgtattaatgctcgttgcacattacgccataattggcccgggactccaagctaaagcaactcgtgaagctcagaaaaggacagcggcaggtatcatgaaaaacccaacagtagatggaatcgtagctatagacttagatccagtggtctatgatgcgaagtttgaaaagcaattaggacaaatcatgctactgatattatgcacgtcgcaaattcttctaatgagaacaacgtgggccctctgtgagtctattacgttagctacagggccgttaacaacattgtgggagggctcacctggtaaattttggaatacaactatagcagtttctatggcaaatatctttagaggatcgtatttagcgggagctggtctggcattctcactcatgaaaagtctgggaggtggccgaaggggtacaggtgcacagggcgaaacgctgggagaaaaatggaagcgtcagctcaaccaactgagtaaatcggagtttaacacttataaaaggagcggcatcatggaagtcgataggtcagaagccaaggaaggtctgaagagaggggaaactacaaaacatgcggtatctagaggaacagcgaaactacggtggtttgttgagagaaatcttgtgaaacccgaaggaaaagtaatagatttagggtgtgggagaggcggatggtcatactactgtgccggactaaagaaagtaaccgaagtcaaggggtataccaaagggggaccaggacacgaggaacctatcccaatggctacatatggatggaatttagtgaaattgcactctggtaaggacgtatttttcattcctccagagaaatgtgatacattactatgtgatataggagaaagttctccaaatccaacgattgaagaaggacgaacattgcgggtactaaaaatggtagaaccatggctgaggggtaaccaattctgtatcaaaatactaaacccatacatgccaagtgttgtagaaacgctggagcaaatgcaaagaaaacatggcggtatgctagtcagaaatcctctttccaggaatagtactcatgaaatgtattgggtaagctgtggtactggtaacatagtaagtgcagtaaacatgacatctaggatgctactaaataggtttactatggcacatcgaaaaccaacatacgagcgggacgtagatctaggcgctgggactagacatgtcgctgtggaaccagaagttgctaatttggatataataggtcaacgaatagagaacataaaacatgaacataaaagtacatggcactacgatgaagacaatccatataagacgtgggcataccacggctcatacgaagtcaagccgtcaggttctgcaagttccatggttaatggagtcgtaaaattacttacaaagccgtgggatgtaatccctatggttacacagattgctatgactgacacaacgccattcggtcaacaaagagtttttaaagagaaggttgatacaagaacaccgaaggctaagagaggcacagcacaaataatggaagtaaccgctaagtggttatgggggttcttatctcggaataagaaaccccgcatttgcacgagagaagaatttaccagaaaagtgcgatctaacgcggcgattggggctgtttttgtagatgagaatcagtggaacagtgcaaaagaagccgtagaagatgagagattctgggacttggtacacagagaaagggaactacataaacagggcaaatgcgcgacctgcgtctacaacatgatgggaaaaagagagaagaagttaggagaatttggcaaggcaaaaggcagcagagcaatttggtatatgtggctcggagcgagatttctagagttcgaggcactaggttttatgaatgaggaccactggttttctagagaaaattcgctatcaggcgtagagggtgagggattacataaattaggctacatattacgtgacatctcaaagataccaggtggaaacatgtacgcagatgacacagcaggctgggatactagaataacggaagacgatttacaaaatgaagcacgtataactgatattatggaaccagaacatgcactacttgcgaaaagtatcttcaaactaacatatcagaacaaagtagtaagagtccaaagaccagcgaaaaatggtacagtcatggatgttatatcgaggagagatcagagaggaagcggacaggtaggtacgtacggattaaatactttcacaaacatggaggcgcaactaattagacaaatggagtctgagggtatttttagtcctagtgaactagaaactcctaatttagcagaacgagttttagactggctggaaaaatatggagttgaacgcctaaaacgaatggcgatatcgggcgacgactgcgtagtcaagcctatagacgataggtttgcaaccgccctcacggctttgaacgatatgggtaaggtacgcaaagatataccccagtgggaaccttcaaaagggtggaatgattggcaacaagttcctttctgctctcatcattttcaccagttgattatgaaagatggtcgagaaattgtagtcccgtgtcgtaatcaggatgagctagttggcagagcaagagtgtcgcaaggcgcgggatggtcattgcgagaaacagcgtgtctaggaaaatcatacgcacagatgtggcagttaatgtattttcaccgccgtgatcttaggctagcagcaaatgcgatctgttccgctgtgccagtggattggatacccacgtccaggacgacatggtctatccatgctcatcatcaatggatgacaactgaggatatgttatcagtatggaaccgggtttggattgaagaaaatccttggatggaggataaaacacacatatcctcatggggtgatgttccgtatcttggaaagagagaggatcagtggtgcggcagcttgatagggttaaccgctcgagcaacttgggcgacaaatatccaagttgctatcaatcaagtaagacgactcataggaaatgaaaactatctggattacatgacgagtatgaagcgttttaaaaacgaaagtgatcctgagggtgccctttggtga

SEQ ID NO: 21224 - RNA, 9879 nt, synthetic construct
  misc_feature 1..9879: note = derived and/or modified CDS sequence (opt6) from DENV-1__JF937651__SS-prME
  source 1..9879: mol_type = other RNA
agtgtcacaatgcttttgatgttaatgccgacagctctcgcatttcatttaaccacacgtggaggcgaacctcacatgattctaagtaaacaagaacgggggaaaagtttattgtttaaaacatcagcaggagttaacatgtgtaccctgatagcaatggacttaggtgaattatgcgaagacacaatgacctataaatgtccaagaattacagaagcagaacctgatgatgtagattgttggtgcaatgcaactgatacatgggtaacctatggaacatgcagccaaacaggagaacacagacgtgacaaacgttcagtcgcgttagcaccacatgttggacttggtttagaaacacggacagaaacttggatgtccagtgaaggagcctggaaacaaatccaacgcgtagaaacatgggcacttagacatcccggattcaccgttatagcactattcttagcacacgcgattggcacatccatcacgcaaaaaggtataatctttattctgctcatgctggtaacaccttcaatggcgatgcgatgtgttggaataggatctcgagatttcgtggaaggtttgtcaggcgcaacgtgggtcgatgttgttctcgagcacgggtcttgcgtaacgacaatggcaaaagacaaacccacactagacatagaattgctaaaaactgaagtcactaatccagcaatcttaaggaaattatgcatcgaagcaaaaatttccaacacgactactgactcccgttgccctacacaaggcgaagctactttagttgaggaacaagatgcaaattttgtttgtaggcggacttttgtagatagaggttgggggaatggctgtggactattcggcaaaggttctctgataacatgtgctaaattcaaatgtgtaacaaaattggaagggaagatagttcaatacgaaaacttaaagtattcagtaattgtaacagttcatacaggagatcagcaccaggtcgggaatgaatctactgaacatgggaccacagctaccattacgccacaagcaccaaccactgaaattcaattgactgactatggggctttgacccttgattgttcgccacgaaccggtttagatttcaacgaaatggttctacttacgatgaaggaaaagagctggttggttcacaaacagtggttccttgatttaccattaccgtggacttcaggagccagcacatctcaggagacatggaaccgccaagatcttctagtaactttcaagaccgcacatgcaaagaaacaagaagtagtagtactaggtagccaagaaggggctatgcataccgcactaacaggagccaccgaaatacaaacttcgggaacaactactatattcgctggacacctaaaatgccgcttgaaaatggacaaactaaccttaaagggcatgtcatacgtaatgtgtacagggtcttttaaattagagaaagaagtcgcggaaacccaacacggtacagttttggtgcaaataaagtacgaaggaacggatgctccctgtaaaatacctttcagcacacaagatgaaaaaggagtgacacaaaatggccgattaatcacagccaatccaatagtaacagataaagaaaaaccagtaaatatagaagccgaacccccatttggagagtcctatatagtcataggagcgggcgaaaaggcgctaaaactaagctggttcaagaaagggagttcaattggtaaaatgtttgaagcaactgcgagaggcgcacgtcgaatggccatacttggcgatacagcatgggacttcggctccatcggcggagtttttacttcagtcggaaaactaatccatcaaatatttggaactgcttacggagttttatttagcggggtcagttggacaatgaaaataggaataggggtgcttttgacctggttaggattaaattcacgttcaacaagcctgtcaatgacttgtatagcagtgggtttagtaacattatacttaggagttatggttcaagcagactcaggttgtgtaataaactggaagggaagagaactcaaatgtggaagtggcatatttgtaaccaacgaggttcatacctggaccgaacaatacaagtttcaggcagatagccccaaacgattaagtgcagcaattgggaaggcatgggaagaaggggtgtgcggtatacgaagtgcaactcggttagaaaacataatgtggaaacaaataagtaacgagttaaatcatatcttactagagaacgatatgaagtttactgttgtggttggggacgtagcaggcatcttggctcaaggtaagaaaatgataagaccacaaccaatggaatataaatatagctggaaatcttggggaaaagccaagatcatcggtgccgatgtacaaaatacaacatttatcatagatggacctaatacacccgaatgtccggatgatcaacgtgcctggaacatttgggaagttgaagattatggatttgggatatttaccaccaacatatggctaaaattgagagattcctatacacaagtatgcgaccatagactcatgagtgccgcaataaaagactcaaaagcggtccatgcagacatgggatattggattgaatctgagaagaatgaaacatggaaattagcacgggcgagttttatagaagtgaaaacctgtatttggccgaaatcacacacattatggtcaaatggagtgcttgaatccgaaatgattatacccaaaatatatggcggacctatcagtcagcataattataggccaggttatttcactcaaactgcaggcccatggcatttaggaaaattagaacttgatttcgacttatgtgaaggaactacagttgtagtggatgaacattgcggaaacagaggtccatcattacgtacaacaaccgttacggggaagattatacacgaatggtgctgtcgatcgtgtacgctaccgccgttacgattccgaggtgaagacgggtgttggtacggcatggaaattcgaccagtaaaagaaaaagaagagaacttagtaaaatccatggtatcggcgggttctggggaagtagattcgttttcgcttggattattatgtataagcataatgattgaggaagttatgagatctcgatggagcaggaaaatgttgatgacgggaacgttagccgtctttttattgttaatcatgggacaacttacgtggaacgatctaattcgtttgtgtataatggttggagcgaacgcctgtgaccgcatgggcatgggaacaacataccttgctttaatggccacttttaaaatgagacctatgtttgccgtaggcctattatttcgtagattaacgtcaagggaagtactcttgttaactatcggtttatctctagtcgcgagcgttgaacttccgaactctttagaggaattgggcgatggcttagcgatgggtataatgattttaaaattacttacagattttcaatcctaccaactatgggcgacactactttccttaacattcatcaaaactaccttcagtttacactacgcctggaaaaccatggcgatggttctctccatcgtttccttattcccattatgcttaagtaccactagccagaaaaccacatggttaccagttctcctgggttccttgggatgcaaacctctgactatgtttttaattgctgaaaacaaaatatggggacgaagaagttggccactgaacgaaggtattatggccgtcgggatagtcagtatattactatcttcgcttcttaaaaacgatgtccccttggctggccccttaatcgctggtggtatgttaatcgcttgttatgttatatcagggagttctgcagatttatcgcttgagaaggccgcagaagtcagctgggaggaggaagcagagcattcaggcgcttcacataatattttagtagaagtacaggatgacggaactatgaaaataaaagatgaagagagagatgatactttaactatattactaaaagctactctgcttgcagtttcgggggtatacccactcagtattcccgcaaccttatttgtatggtatttctggcagaagaagaaacagcggtctggagttttatgggacaccccgtctccaccagaagttgaaagagccgtcttagatgatggaatctatcgtatcatgcaacggggtcttttaggacgtagccaggtaggagtgggggttttccaagagaacgtattccatacaatgtggcatgtaacacgaggggctgtactaatgtaccaggggaaaagactagaaccttcgtgggcctcagtaaagaaagatttaataagttacggaggtggatggcgcttacaaggatcttggaatacaggcgaagaagtccaggtgatagcagttgagccaggcaaaaatccgaaaaatgtccagacagcgccaggaacttttaaaacccctgagggcgaagtaggagccatcgcacttgatttcaaaccagggacatcggggagtccaatagtaaaccgtgagggaaaaattgtcggcctttatggaaatggggtagtgacaacttcgggtacctacgtcagtgcaattgctcaagcgaaagcaagccaagaaggtcctctaccagagatagaagatgaggtctttagaaagagaaatttgacgattatggatctacatcccgggtcagggaaaacacgaagatatctccccgcaatagtcagagaagctataaaaagaaagttaagaacattaattctcgccccaacaagagttgtagcctccgaaatggcagaagcactgaaaggaatgccaataagatatcaaacgaccgcagttaagagtgaacatactggcaaagaaattgttgatttaatgtgccatgcgacatttacgatgcgattgctatctccagtcagggtacctaattacaatatgatcatcatggatgaagcccattttaccgacccgagtagtatagcagccaggggttatataagtacccgagtaggtatgggtgaagctgctgcaatatttatgactgcaactcccccgggatccgtcgaggcctttccacaatcaaacgctgtaatacaagatgaggaaagagatattccggaacgcagctggaactctggatatgaatggattacggattttcccgggaagactgtgtggttcgttccaagcattaaatctggcaatgacatagctaactgtctaaggaaaaatggaaagagagtaatacagttaagtcgtaaaacttttgatacagaataccagaaaactaagaacaacgattgggactatgttgtgacaacagacatctcggaaatgggtgctaatttcagggcagaccgtgtaatcgacccgcgccgatgtttaaagccagtcatattgaaggatggaccagaaagagtaatcctggctggaccgatgcccgttacagttgctagtgcagcacagagaagaggtagaattggaagaaaccataacaaagaaggagatcaatacatttatatgggacaaccactaaacaatgacgaagatcatgctcattggactgaagcaaaaatgctacttgacaacataaatacaccagagggcataatcccagccctgttcgaaccagaacgtgaaaaatcagctgcaatagatggagaatatcgtttgagaggggaagcaaggaaaactttcgttgaacttatgagacgaggcgacctgccagtatggttgtcctataaagtcgcctcagagggtttccagtacagtgaccgaagatggtgtttcgacggagaaagaaacaaccaagtcttggaagaaaacatggatgtagagatttggacaaaagagggagaacggaaaaagctacgtccgcgttggcttgacgctcgcacatacagtgatccgcttgcgctaagagagttcaaggaatttgcagcaggaagaagatcggtaagtggagatctgatattggaaattggcaaactgccgcaacacttaacccaaagggcgcaaaacgcgctagacaatttagtaatgttacataattctgaacaaggtggccgagcatacaggcatgcaatggaggagttacctgatactatagagacgttgatgctactagcactaattgcagtattaacaggtggtgtgacattgttcttcctatcaggaagaggtttaggtaaaacatcaattgggttgttgtgcgtcatggctagtagcgtattactatggatggcttcagtagaaccacattggatagcagctagcataattctggaatttttcttaatggtcctgttaatccccgagcctgatagacagaggacacctcaggataatcaacttgcatatgtagtcataggattactgttcatgatattaacggtagctgcgaacgaaatgggtttattagaaacaactaagaaagatttggggataggacatgtcgcagtgggaaaccatcatcacgccgccatgttggatgtcgacttacatcctgcatcagcatggacattatatgcggtagcaacaaccatcattacaccaatgatgaaacatactatagaaaatacaacagcaaacatttcgttaacagctatagcaaatcaagcagcaattctaatgggcttggataaaggatggccaatctctaagatggatataggcgtgcctctattagcactaggctgctactcacaggttaatccactaacactaacagcggcagtacttatgttagtggcccattatgctatcattggacccggtttacaagcaaaagctacaagggaagcacaaaagagaactgccgcaggtataatgaaaaatcccaccgtcgacggaattgtcgctattgatttagaccctgttgtttatgatgcaaaatttgaaaaacaactaggtcagatcatgttacttattctatgtacttcacagattcttctaatgagaactacttgggctttatgtgaaagcattacattagcaactggcccattgaccactctatgggagggtagtcctggaaaattttggaataccacaattgcagtatcaatggcaaacatatttagagggtcatatctagcgggagccggactagccttctcactaatgaagtccctaggaggcggtcgtagaggcacaggtgcacaaggagaaactctcggagaaaagtggaaaagacaactaaaccagcttagcaaatctgagttcaacacttataagcgtagtggaattatggaagtcgataggtcagaagcgaaagaaggattaaaacgaggcgaaactactaagcacgctgtatcaagaggtactgcaaaactccgatggttcgtcgaaagaaacttagtaaaacccgaaggaaaggtaattgaccttggatgtgggcgaggtggttggtcctactactgtgcgggattaaagaaagtgacagaagttaaaggttatactaaagggggtcctggacatgaggagcctataccaatggctacatacggatggaatttagttaaactacattccggcaaagacgtattctttataccaccagaaaaatgtgatacattactttgtgacatcggggagagttccccaaatcctactattgaagaaggccgaacacttagagtactaaaaatggtcgaaccttggctccgaggaaatcaattttgtataaaaatattaaatccatatatgccttcagttgtagaaaccctggaacaaatgcaacgaaaacatggaggtatgctagtaagaaatcctctgtctcgaaatagtacccacgaaatgtactgggtatcctgtggaacaggtaacatagtaagtgcagttaacatgacaagtcggatgcttctcaacagattcacgatggctcaccgaaagcccacgtacgagagagatgtcgatttgggcgcaggcacacggcatgtagccgttgagccagaagtagctaacttagatattatcggtcagaggattgaaaacatcaaacatgaacataagtccacgtggcattacgacgaggacaacccatataaaacatgggcataccacgggtcgtatgaagtaaagccatccggtagcgcttctagtatggtcaatggagttgtcaaattgttgactaaaccatgggatgtgataccaatggtcacacaaatagctatgacagataccactccttttgggcagcagcgtgtattcaaggaaaaagttgatacacgtacgcctaaggcaaaacgaggcaccgcacaaataatggaagtgacagctaaatggttatggggctttctcagtagaaacaagaagccaagaatttgtactcgggaagaatttactggaaaagtacgatcgaatgcggcaatcggtgccgtatttgtagatgagaatcagtggaatagtgccaaagaagcagtcgaggatgaaaggttttgggacttagtgcatcgagaacgagagttacataaacaaggaaagtgcgcaacatgtgtatataatatgatgggaaaacgcgagaaaaagttaggagagtttggaaaagcaaaaggttcgagggccatttggtatatgtggctcggggctagatttctcgagttcgaagctctaggtttcatgaatgaggatcactggttctctagagaaaattcattatcaggagtagagggagaaggcttgcataaacttggttacatactccgtgatatctctaaaattcctggaggtaatatgtacgccgatgacaccgctggatgggacaccagaataactgaagacgacctacaaaatgaagcgagaataacagacataatggaaccggagcatgcattgttggcaaaaagcatttttaaactcacctatcagaacaaggtcgtacgtgtccaaaggccagccaaaaacgggacggtaatggatgtgatttcgcgacgtgaccagagaggctcgggacaggtcggtacttatggtctcaacaccttcactaacatggaagcgcagttgataaggcaaatggaatcagaaggaattttctcgccaagcgaattagaaactcccaatttagcggagagagtactagattggttagaaaaatacggagtagaaagattaaaacgaatggcaatctcgggcgacgattgtgtcgtaaaaccaatcgatgacaggtttgcaacggctctaacagcgctaaatgacatggggaaagttagaaaggatatcccccaatgggaaccgagtaaaggctggaacgattggcagcaagtgccgttttgttcacaccatttccaccaattaattatgaaagatggacgagaaattgttgtcccctgccgcaatcaagacgagctagtcggtcgggctcgagtaagtcaaggagcaggctggagtttaagggagacagcctgcctaggtaaaagttacgcgcagatgtggcaacttatgtattttcatagaagagatctcaggctagccgctaatgctatatgttcagctgtcccagttgattggataccaacgagtcggacaacctggtccattcatgcgcatcatcaatggatgacaacagaagatatgctatccgtgtggaatagggtctggatagaggaaaatccatggatggaagataaaacgcacattagttcatggggagatgttccgtatttaggcaagcgtgaagaccaatggtgtggatctctaataggactaacggcaagagcaacttgggctacaaatattcaagttgcaatcaatcaagtgcgaagactgatagggaacgaaaattatctagattacatgacatctatgaagaggtttaagaacgaatcagacccaaagggagcgttgtggtaa

SEQ ID NO: 21225 - RNA, 9879 nt, synthetic construct
  misc_feature 1..9879: note = derived and/or modified CDS sequence (opt6) from DENV-1__GU131956__SS-prME
  source 1..9879: mol_type = other RNA
tcggtcacaatgctactaatgctgctccccacagcgttagcctttcacctaactacaagaggaggggaacctcacatgattgtttcaaaacaagaacgaggaaaatcactgctatttaaaacatcagctggagttaatatgtgtacgttgatagccatggatttaggagaattgtgtgaagataccatgacatataaatgtccccaaataacggaagccgaacccgatgatgtggactgctggtgtaacgcaacagatacatgggttacttacggtacttgctcgcaaacgggtgaacatagacgagataaacgatcggtcgcgctcgcacctcacgtgggattggggttagaaacgcggactgaaacgtggatgtcaagtgaaggagcatggaaacaaattcaacgcgtagaaacttgggctctcagacacccgggatttacagtaatagccctctttttggctcatgcaatcggtacatcgatcactcaaaaagggactatattcatcctgctaatgttagtaacaccaagtatggctatgcgatgtgtaggaataggcaatagagactttgtagaaggtctgagtggtgccacctgggttgatgtcgttttagaacacggctcttgtgtaactactatggccaaaaataaaccaacattagatatagaactgttaaaaaccgaagtaactaatccggccatactaaggaaattatgcatcgaagcaaaaatcagcaacacaaccaccgactcaagatgcccgacgcaaggagaagccactttagttgaggaacaagatgcaaactttgtatgtcgacgaacatttgtagatcgcgggtggggcaacggttgtggattgtttggtaaaggctcattgctaacttgtgcgaaatttaaatgcgtcacaaaacttgaaggaaaaatagtccaatatgagaatttaaagtactccgttatcgtgacggtacacactggtgatcaacaccaagttggtaacgaaactacagaacacggaacaatcgcaacaataacaccgcaagcacctacctcggagatacaactaactgattacggggcactaacgcttgattgctcgcctaggacaggtctagatttcaatgaaatggtcctcctgacaatgaaagaaaaatcttggttagtacataagcaatggtttctagatctcccactaccatggacaagtggtgcatcaacgtcccaagaaacatggaatcgtcaggacctcctagttacctttaagactgcacatgcgaagaagcaggaggtagtagtactaggatcacaggaaggtgcgatgcacaccgcactcactggagccaccgaaattcagacgagtggcactacgacaatttttgccggacatttaaaatgtcgtttaaaaatggataagctaacattaaagggaacgtcgtacgttatgtgtacgggtagttttaagttagagaaagaagtagccgaaacacaacacggcaccgtcctagtacaagtaaagtacgaaggcactgacgctccttgtaaaatacctttttcgactcaagatgaaaaaggagtcacgcaaaatgggaggctaattacagctaatccaattgtcacggataaggaaaaaccagttaacattgaaaccgaaccaccctttggggaatcatatatcgtagtaggagcgggggaaaaagcattaaaactgtcatggttcaagaaagggagttccattggcaaaatgttcgaggccacagcgagaggagccagaagaatggcaatcctcggtgataccgcttgggattttgggtcaataggaggtgtcttcacgtcagtaggaaaactcgtccatcaagtgtttggaacggcatacggtgtacttttctccggagtcagctggaccatgaagataggtatcggcatcctattgacatggctaggattaaactcacgttcaacatccttgtcaatgacatgcatagccgttgggatggttaccttatacctaggagtgatggttcaagccgattcaggctgtgtaattaattggaaggggagagaactaaaatgtggatcaggaatatttgtgactaatgaagtgcatacatggacagaacaatataagttccaagcagactctccaaaacgactttcagcggctataggcaaggcttgggaagaaggggtctgtggcataagaagtgctaccagattagagaatatcatgtggaagcaaataagtaacgaactcaaccatattttacttgaaaatgatatgaaatttacagtagtcgttggtgacgcgaatggaatcctagcacagggaaagaagatgatccgtccccaaccaatggaacataaatattcctggaaatcctggggtaaagctaaaataataggcgcagacatacagaatacaacatttattattgatggtccggatacacccgaatgtcctgataaccaaagagcgtggaatatctgggaagttgaggattatggattcggaatatttacaactaatatatggttaaaacttagagattcgtacacgcaaatgtgtgatcataggttaatgagcgctgctataaaagattcgaaagcagttcacgcagatatgggatattggatagaatcagagaaaaatgaaacatggaaactagcgagagcgtctttcatcgaggtaaaaacctgcacatggcctaagtcgcacacgctatggtcaaatggtgtgttagaaagtgaaatgataatcccaaagatatatggaggcccgatttctcaacacaactatagaccaggttactttacgcaaacagccggcccctggcacctagggaagttagagctagactttgacttatgtgagggcactacagtcgttgtagacgaacattgtggtaacagaggcccatcgctacgtactacaacagtcacaggtaaaatcatccacgaatggtgctgtcgaagctgtacactccctcctcttcggtttcggggagaggatgggtgctggtatggcatggaaatcagacctgtgaaagaaaaagaagaaaatttagtaaggagtatggtaagcgccggaagtggagaggttgatagtttctcgttagggatactttgtgccagtattatgatagaggaagttatgcgtagtagatggtcgcgaaaaatgctaatgacgggaacgcttgcagtatttctattgttagttatggggcagctgacatggaacgatttgattagattatgcataatggttggggcaaatgcgagcgacaggatgggaatgggcaccacctatctggcactaatggcaacgtttaaaatgcggcccatgttcgcggtcggactgttatttcgacgattaacaagtagggaagtcctcctactaactataggattgagtctagtcgccagtgtagaattgccaaatagtttagaagaattaggtgatggactggctatggggataatgatgttgaagctattgacagaatttcaaccacaccaattatggacaacgctattgtcattaacgttcatcaagacaacattaagtttggattacgcatggaaaacaacggcaatggcactatcgattgtatcactgtttccactatgtctatcaacgacatcacagaaaacgacatggttaccagttttacttggatccttcggttgcaagccgttaacaatgtttttaattaccgaaaacaaaatttggggaagaaaatcctggccactaaatgagggaataatggcaatcggaatagtttcaatactattaagcagcttactcaaaaacgacgttccacttgcgggacccctaatcgctggcgggatgttgatcgcttgttatgtaatatcaggttcttcagcagatcttagccttgaaaaagcagctgaagtgtcctgggaacaagaagctgagcactctggaacttcccataacatattagttgaagtacaagatgacggaaccatgaaaattaaggatgaagaaagagatgataccctaacaattttattaaaagcgacattactggcagtatccggagtttacccgatgagtataccagccacactcttcgtttggtacttctggcagaagaagaaacaaagatctggagtcttatgggacacgcctagtccaccggaagttgaaagggcagtgctagatgatggcatctaccgaatcttgcaaagaggtctattaggacgttcgcaagtaggagttggggtatttcaggacggagttttccatacgatgtggcacgttactcgaggcgcagtactcatgtatcagggcaaaagattagaaccgtcatgggcaagcgtaaagaaagatctcatcagttatggtgggggatggcgatttcaaggatcctggaatacaggagaagaagtccaagtcattgcagttgagcccggtaaaaatccgaaaaatgtacagacaacacctggcacttttaaaacccctgagggggaagtcggggcaatagcattggattttaaaccgggtaccagtggatctccgatagtcaatagagaggggaaaatcgtcggcctttacggaaacggtgtagtaaccacctcgggcacttacgtatcagctatagcccaagcgaaggcatcacaagaaggaccgttgccagagatagaggacgaagtatttaagaaaagaaacctaacaattatggatttgcatcccggtagtggcaaaacgagaagatatctgccggcaatggtacgtgaagcaatcaaaagaaaacttcgcactctaatcctggcccctacacgcgtcgtagcgagtgaaatggcggaagcactaaaaggaatgcctattagataccagacgactgccgtaaaatcagagcatactggccgagaaattgtagacctgatgtgtcatgcaacatttacaatgagactcctaagtccggttagagtgccgaattacaatatgattataatggatgaagcacattttacagatcctgcatcaatagccgcaaggggctacattagtacgcgggttggaatgggagaggccgctgccattttcatgactgcaacccctccggggtcggtagaggcattcccacaatcaaacgcagttatacaggatgaagaaagggacatcccggaacgatcatggaatagtggctatgattggataactgattttcccggaaaaactgtttggttcgtcccaagcattaaaagtggtaacgacattgctaactgcttgaggaaaaacggaaaacgagttattcagctatcgcgaaagaccttcgatacggaataccagaaaactaaaaacaacgattgggattatgtagtcactacagatatatcggaaatgggtgcaaattttagggcagaccgtgtaatagatccaaggaggtgccttaaaccggtcattctgaaggatggtccggaaagagtaattctcgccggtccaatgccggtaacagtagcaagtgcagctcaaagacgaggcagaataggaagaaatcaaaataaggaaggggaccagtacgtctatatgggacagcctctaaacaacgatgaagatcacgcgcattggacagaagcaaaaatgttactagataacatcaacacaccagaagggattatacccgcattatttgaacctgaaagagagaaaagcgcggctatcgatggagaataccgtctccgaggagaggccaggaaaaccttcgtggagttaatgagacgtggcgatctacctgtatggctttcttataaagttgcgagcgaaggatttcaatatagtgataggagatggtgttttgatggcgaaaggaataatcaagtacttgaagaaaacatggatgtagaaatttggactaaagaaggagaaaggaagaaattaagacccagatggctagatgcacggacctactctgatcctttagcattgcgtgagtttaaagagtttgcagctggaaggagatctgtctcaggagatctaatactcgaaatcggaaagctaccgcaacaccttacacttcgggcgcagaacgcattggacaacttagttatgttacacaattccgaacagggtggcaaggcttatcggcacgcgatggaagaattacctgatacaatagaaacattaatgcttctagcacttatagctgtattaactggcggagtaaccctcttcttcctatctggaaaaggacttggtaaaacctctattggactcctgtgtgtaacggctagtagtgccttattgtggatggccagtgtagaacctcattggatagcagcctcaattatactagagttctttttaatggtattattaatacctgaacctgatagacaacggactccacaggataatcaactcgcatatgtggttataggcctgttatttatgatactaactgtcgctgctaacgaaatgggacttctggaaactactaagaaggacttgggtataggtcacgttgcagccgaaaaccaccagcatgcaaccatgctcgacgtggacctaaggccagcgtctgcatggaccttatacgccgtcgcaacaactgtgataacaccgatgatgagacatacaatagagaacacaacagcaaacatatcactcacagcaattgcaaatcaggccgcaatactcatggggttagataaagggtggccgataagtaagatggacataggagttccattactagctttaggttgctatagtcaagtgaatcccttaacattaacggcagctgtactaatgctagtagcacattatgccatcataggacctggattacaggcgaaagcaacgcgagaggcgcagaaacgaacagccgctgggattatgaaaaacccaactgttgacggcattgtcgccatcgaccttgatccggttgtatatgatgctaaattcgagaaacaattaggtcaaataatgctactcattttatgtacttcccaaattttattaatgagaacgacatgggccctgtgtgaatctataacactagcaacgggtccattgacaacgctatgggagggttctcctggaaaattttggaataccacaatagctgttagcatggcaaacatatttagaggaagttatctagcaggcgcaggacttgcattttccttgatgaaatctttaggaggaggacgtaggggaacgggagcacaaggtgagactctgggtgagaaatggaagcgacagcttaaccaattatcaaagtcagagttcaacacgtacaagcgctctggtatcatggaagtagataggtcagaggccaaagaaggacttaaacgtggcgagacaacaaaacatgcagtctcacgcgggaccgcgaaattgagatggtttgtagagcgaaatttagttaagccagaaggtaaagttatcgatttaggatgcgggaggggcggatggtcctattactgtgcaggccttaagaaagtgacggaagtcaaaggatacacaaaaggtggtcccggacatgaagaaccgataccaatggcgacttatgggtggaacttagttaaattgcatagtggaaaggatgtattcttcatgccaccggaaaaatgtgatacactgttatgtgacataggggaaagctcaccaaaccctactatagaagaaggacgaacattaagggtcttaaaaatggttgaaccttggctaaggggaaatcaattttgcataaaaattttaaatccatatatgccttctgtagtcgaaacactcgaacagatgcaacggaaacatggcggcatgctagtcagaaatccactatcacgcaacagtactcatgaaatgtactgggtatcatgtggaacaggaaatatagtctccgcagtcaacatgacttctcggatgttattaaataggtttacaatggcacataggaaacctacttacgaaagagacgtggacttaggagctggaacacggcacgtagcagtagagccggaagttgcgaaccttgatataataggacagcgaatcgaaaatatcaaaaatgaacataaaagcacgtggcactatgatgaagacaacccatataaaacttgggcctatcacggcagctatgaagtgaagccaagtggatcagcgtctagcatggtaaacggagtggtgagactgctgacaaagccatgggatgtaataccgatggttactcaaattgcaatgacagatacaaccccatttggacaacaaagagtttttaaagaaaaggtagatactaggacaccacgggcaaaacgaggtacaacccaaataatggaagtgactgcaaaatggctctggggattcttatcaaggaacaagaagcccagaatttgcacgagggaagagttcacaagaaaggtgcgatcgaacgccgctataggagcagtctttgttgatgaaaaccaatggaactccgccaaagaagcagttgaggatgaacgattttgggacttggtacatagagaaagagaactacacaaacaagggaaatgcgcaacatgtgtctataatatgatgggtaaaagagagaagaaattgggtgagttcgggaaagcaaaaggaagtcgcgctatttggtacatgtggcttggagccagatttctagagttcgaggcattgggattcatgaatgaagaccactggttttcaagggaaaattcattatcaggtgtcgaaggtgaaggcctccacaaactaggatatatattacgagacattagcaaaatacccggtggcaatatgtacgcagatgatactgcaggatgggatacccgaataacagaagatgacctacaaaacgaagcaaaaataacagaaataatggaacctgaacatgctttactggctacatcgatttttaaattgacatatcaaaataaggtggttcgagtgcaaaggcccgctaaaaacggcaccgtaatggatgtaatttctaggagagaccagcgaggaagcggacaagtgggtacatatggattaaatactttcacgaatatggaggtgcaacttattagacaaatggagtcagagggtattttcctgccctcagaattggaaacaccaaatcttgcagaaagagtattagactggttagaaaaacatggagctgaaagattaaagagaatggcaatttccggagatgattgtgtcgtaaagcctattgatgataggtttgctaccgcgcttacagcactaaacgatatgggaaaagtgaggaaagatataccacagtgggagccttcaaaaggatggaatgactggcagcaagtcccattctgctcacatcacttccatcagctaataatgaaagatggcagagagattgtagtaccttgtcgtaatcaagacgaattagttggtcgtgcgagggtttcacagggagccggatggtcattacgggagaccgcttgtttaggaaagtcgtatgcgcaaatgtggcaacttatgtattttcatagacgagatctaagattagcagccaatgcgatatgcagcgctgtaccggtagattgggtgcctactagcaggactacatggagcatacacgcacatcatcaatggatgacaaccgaagatatgctaagtgtatggaatagggtttggatcgaagaaaatccttggatggaagataaaactcatgtatcaagttgggaagaagttccttatttagggaaaagggaagatcaatggtgcggatccctcataggattaaccgcaagagctacttgggccacgaatatccaagttgccattaaccaggtacgtagactaattggcaacgaaaattacttagattatatgacttcaatgaaaagatttaaaaacgaatcagatcccgagggagcgctatggtaa

SEQ ID NO: 21226 - RNA, 9879 nt, synthetic construct
  misc_feature 1..9879: note = derived and/or modified CDS sequence (opt6) from DENV-1__GU131958__SS-prME
  source 1..9879: mol_type = other RNA
agtgtcactatgctattaatgttattgcctacagcattagcatttcatcttacgacacgaggcggagaacctcacatgatagtatctaaacaagaacgcgggaaatctctattatttaaaacatctgcgggggtgaatatgtgtactctaattgcaatggatctgggagaattatgtgaagacacgatgacctacaaatgtcctcaaataaccgaagcagaaccggacgatgtagattgttggtgtaacgctacggatacatgggtcacgtatgggacctgctcacaaactggagaacaccgcagggacaaacgcagcgttgcactcgcgccacacgtgggactggggttagaaactcgtaccgaaacttggatgagctctgaaggcgcatggaaacaaatacagagggtcgaaacatgggctctcagacatcccggcttcacagtaatagctttatttttagcccatgcaataggtactagcatcactcaaaaaggaatcattttcatattgctaatgctggtcactccgtcaatggctatgagatgtgtgggaataggtaacagagactttgtcgaaggcttaagtggtgctacatgggtggatgtcgtcctcgaacatggatcctgtgtaacgacaatggccaaaaataaaccaactctcgatatagaacttctgaaaaccgaggttacaaatcccgctatattgagaaaactttgtattgaggcaaaaatttccaatacaacaacagattctagatgtcctacccagggagaagcaaccctagtagaagaacaagatgctaattttgtctgccgaaggacatttgtagatcgaggatggggcaatggttgcgggttgtttggaaaaggcagtttattaacatgtgcaaaatttaaatgcgtaacaaagttagaaggtaaaatagttcaatatgagaacctgaaatatagtgtgatagttactgtacacaccggagaccaacatcaagtaggcaatgaaacaacagaacacgggacgatagcaactattaccccacaagcaccgactagcgaaatacagcttacagattacggagcgcttacgctagactgtagccccagaacaggacttgattttaacgaaatggttcttttaactatgaaagagaaatcatggttagtgcacaaacagtggtttttggacttaccgcttccatggacatcaggagctagtacatcgcaagagacttggaatcgacaagacttattagtgacctttaagacggcacatgctaaaaagcaagaggtagtagttctaggcagccaagaaggggcaatgcataccgcgttgacaggtgcaactgaaatacaaacttcagggactaccaccattttcgcgggacacttaaaatgcagattaaaaatggacaagctaacgcttaaaggtacatcatacgtcatgtgcacgggctcttttaaactcgaaaaagaagtcgcagaaacgcaacatggcaccgtcttagtccaggtaaaatatgaaggaacagatgctccttgtaaaatacctttcagtactcaagacgaaaaaggtgtaactcaaaacggcagattaattacagcaaaccccatagtaacagacaaagaaaagcccgtaaacatagagacagaaccaccctttggtgagtcttatattgtggtcggcgccggcgagaaagccttaaaactttcttggttcaagaagggaagcagtataggcaaaatgttcgaagcaacggctcgaggcgcccgccgtatggcgatcctcggagacacggcatgggactttggtagtatcggaggagtttttacgagcgtaggcaaactcgtacaccaagtttttggcactgcatatggagttttattttcaggagtcagctggacgatgaaaataggaataggcattctcctaacctggttgggacttaactcacgaagtacttcgttatccatgacatgtatagctgtgggtatggttaccttatatctaggggtaatggtacaggctgatagtggctgtgtgataaattggaaaggacgcgagttaaaatgtggaagcggtatatttgtcactaatgaagtgcatacctggacagaacaatataaatttcaagcagattcgcccaaaagattgtcagcagctattgggaaggcttgggaggaaggagtgtgtgggatcagaagcgcgacacgtttagaaaatattatgtggaagcaaatatcaaatgaattaaatcatattctgttagagaatgatatgaagtttacagtggtagtaggggatgccaacggaattttggcacagggcaagaaaatgattagaccacaaccgatggagcataaatattcttggaaaagttggggcaaagcgaaaataataggagcggatatacagaatacaactttcatcatagacggaccggatacgccagagtgccctgacaatcagcgagcatggaatatatgggaagtcgaagactacggattcggaattttcactactaatatttggctaaaactgcgcgattcatatacccaaatgtgtgatcaccgtttaatgagtgcagcaataaaagattcaaaggccgtacacgcagacatgggttattggatagagtctgagaaaaatgaaacatggaaactcgcaagggcttcttttatcgaggtaaaaacttgtacgtggcccaaatcgcataccctgtggagtaatggcgtactcgaaagtgagatgataatacccaaaatatatggtggcccaattagccaacataattatcgtccgggatacttcacccagacggcagggccttggcatttaggaaaactcgaattagactttgatttatgcgaaggaactactgtagtagtagacgaacactgcggaaatagaggtccgagtctcaggactacaacggtgacaggaaaaatcatacacgagtggtgctgtcgttcgtgtacccttccacccctacgctttagaggagaagatggttgctggtatggtatggagattaggccagtaaaagaaaaagaagaaaatttagttagatcgatggtttcagcaggatcaggagaagtggactcattcagtctaggtatactttgtgcgtcgataatgatcgaagaagtgatgcgtagtcgttggagtcgcaagatgctaatgacgggaacattagcagtgtttttgctactaatcatgggtcagctgacatggaacgacttaatccgtttatgcatcatggtgggagctaatgccagtgatagaatgggtatgggtacaacctatttagcattaatggcgacatttaaaatgagacctatgttcgccgtaggacttctatttaggcgattgacaagcagagaagtacttctattaacaataggacttagcctggtggccagtgtagagctccctaatagcttagaagaattaggagatggattagctatgggaataatgatgctaaaactactaacagagttccagccacatcaactctggacgacactgttgtctctaacattcatcaaaacaactttaagcctagattatgcttggaaaacgacggccatggcactatcaatagtaagtttgtttccactatgtctttcaacaacctcgcagaaaactacgtggctacccgtcttattaggtagttttggatgcaaaccattaacaatgtttctgatcaccgagaataaaatatggggtagaaaaagttggccccttaacgaaggcattatggcgatagggatagtaagtatcctcttatcatctttattaaagaacgatgtcccattagctggtccactaatagccggaggaatgctgatagcatgttacgtcattagtggatcttcagcagacttatctttggaaaaagcagccgaagtcagctgggagcaagaggcggaacatagtggaacgtctcataatattttagtagaagtacaagacgatggcacgatgaaaatcaaggatgaagaaagggacgatacactcacaatccttttaaaagcaactctactcgctgtcagcggagtctacccgatgtcaatcccagctacattgtttgtttggtacttttggcagaagaagaaacagaggtctggcgttctttgggatacaccgagtccacctgaagttgaacgagcagtcctcgacgatggcatatacaggatcctccaaagagggcttttagggcgttcgcaggtaggggtaggtgtttttcaagatggtgtatttcacacaatgtggcacgtaactaggggtgctgtgttaatgtatcaaggaaaaaggcttgagcccagttgggcgtctgtcaagaaagatttaatctcttatggaggtgggtggagattccaagggagctggaatacaggtgaagaagtacaagtaattgctgtagaaccaggcaagaacccgaaaaatgtacagacaacaccaggaacctttaaaacccctgaaggtgaagttggagcaattgctttggattttaagccagggacaagtggtagcccaatagtaaatcgcgaaggcaaaatagtgggcttgtacggaaatggcgtagtaacgacttcagggacgtatgtaagcgcaatcgcacaagctaaggctagtcaagaaggtccactaccagaaatcgaagatgaggtatttaagaaacgcaatctcacaataatggatttacaccccggaagcggtaaaaccaggagatacttgcctgctattgtgcgagaagcgataaaacgtaaattaagaactttaattctagcaccaacaagagtagtagcatcagaaatggcggaagcattaaaaggcatgccaatccgctatcagacaacagctgtcaaatcagaacacactggccgtgaaattgttgacctcatgtgtcacgcaacgttcacaatgcgcttattatctcccgttagggtaccaaactataacatgataataatggacgaagcgcactttaccgaccctgctagtatcgccgcccgtgggtatatatcaactagggtgggtatgggagaagcagcagctatcttcatgacagctacacctccgggtagtgtagaggcatttcctcaaagcaatgctgtcatccaggatgaggaacgtgacatacctgaacgaagttggaactcaggttatgactggataactgattttccaggaaagacggtttggtttgttccatcgataaaatcaggtaatgacatagccaattgcttacggaagaacggtaaacgagtaattcaactatcacgcaagacatttgacacagaataccagaaaactaaaaataatgactgggattatgtagttacaacggatatatccgaaatgggtgcaaactttagggctgacagagttatagatccgagaagatgtttaaaaccggttatactaaaagatgggcctgaacgagttattttagccggcccaatgcctgtgactgtggcctcggccgcgcaaagacgtggcaggatcggacgaaatcaaaataaagagggagatcaatatgtctatatggggcaacctttaaacaatgacgaagaccatgcccactggacggaagcgaaaatgctcttagacaatattaacacacccgaagggataataccagcactttttgaaccagaacgagagaaaagtgcggcaatcgatggagaatacaggctaaggggcgaagcccgaaagacctttgtcgagttaatgagacgaggtgacttaccagtctggctcagctataaagtagcatcagaaggattccaatacagcgatcgtaggtggtgtttcgatggggaacgtaacaatcaagttctagaagagaatatggacgtagaaatatggacaaaagaaggtgaaagaaagaagttaagaccacgctggctagatgcacgaacttacagcgacccactagctctaagagagtttaaagagttcgctgcaggtaggagatccgtctctggagaccttatcctagaaatcggaaagttaccacagcaccttacgttgagagcgcaaaacgcgttagataatcttgtaatgctacacaactctgaacaaggtgggaaggcgtatagacatgctatggaagaattacctgacactatagaaaccttaatgctgttagcattaatcgcagtgttaactggaggggtaacattattctttctctcagggaaaggtttaggcaaaacatcaatagggctactatgtgttactgctagttcagcgcttttgtggatggctagtgtagaaccccactggatagctgcttctataattttagaatttttcttaatggtcttgctcattccagagcccgacagacaacgaacaccgcaagacaaccaattagcttatgttgttattggattgttattcatgattctgacagtggccgccaatgaaatgggattgctggaaactacgaagaaagatctgggaataggacatgttgcagcagaaaaccatcaacacgccacgatgctcgatgtagatttacgacctgcctctgcatggactctatatgcagtcgcgaccactgttattacaccgatgatgcgtcacacaatcgaaaataccacagccaatatctcactaacagcaatagcgaaccaagctgctatccttatggggttagacaagggatggcctatctccaaaatggatataggagtaccgcttctagcattaggatgctactcccaggtaaacccattgacgttaactgctgcagtactgatgctagtcgcacattatgcgattatcggacctggattacaagcaaaagccactcgagaagcgcagaaaagaaccgccgccggaatcatgaagaacccaacagtagacggcatagtggcaatcgatttagatccagtagtatatgatgcaaaatttgaaaagcaactcggacaaatcatgcttttaatactatgcacaagtcaaatcctattgatgaggactacgtgggcattgtgtgaatcgattactctagctaccggacctttaactacactatgggaaggtagtccagggaagttttggaatacaacgatcgctgtatcgatggctaacatcttcagaggttcatatttagcgggggctggcttagctttctcattaatgaaatccctaggagggggcaggagagggacgggcgcgcaaggagaaacgttaggagagaaatggaagaggcagcttaaccagctaagtaaatcagagttcaacacatataaacgaagtggtataatggaagtagatagaagcgaggctaaagagggattaaaacgtggagaaacaacaaaacatgcagtatcacgaggaacggcgaagttgagatggttcgttgaaagaaatttagtgaaacccgaagggaaggtgattgatttaggatgtggaagaggaggatggtcttattactgcgcgggtcttaaaaaggttacagaagttaagggatatactaaaggcggacccggacatgaagaacccatacctatggcaacatatggttggaatctcgttaaactacattcggggaaagatgtgttctttatgcctccagaaaaatgtgatacattactatgtgacatcggagaatcaagtccgaatccaacgatagaggagggacgcacattaagagtactcaaaatggtcgaaccttggcttagaggaaatcaattctgcattaaaatactaaacccgtatatgccgtcagtcgtggaaacactagaacaaatgcagcgaaaacacgggggaatgctagtcaggaacccgctatctagaaactcaactcatgagatgtactgggttagctgtggaacaggcaacattgtttctgccgtcaacatgacaagtcgcatgcttctcaacagattcacaatggcacatagaaaaccgacattcgaacgcgatgtcgaccttggagctggtactagacatgtcgcggtggaaccagaagttgcgaacttggatataataggacaaagaattgaaaatataaagaacgaacataaatcaacctggcattacgatgaagataatccttataaaacatgggcataccatggaagttacgaagttaagcctagcggctcggcgtcgagcatggtaaatggcgtggtgagattactaaccaagccctgggatgtcattcctatggttacccaaatagcaatgaccgacacgacgccttttggccaacaaagggtctttaaagaaaaggttgatactagaactcctagagctaagcgcggtacaactcagataatggaagtcactgctaagtggctttgggggtttctatcacgcaataaaaagcctcgtatatgcacgcgggaagagttcacccggaaagtcagaagtaacgcagccatcggagctgtattcgtagatgaaaaccaatggaatagcgcgaaagaggccgtagaggacgaaagattctgggatctagtacatagagaacgtgagttacataaacagggaaagtgtgccacttgtgtttacaacatgatgggaaaaagagaaaagaaacttggcgaatttggaaaagcgaagggctcaagggcaatatggtacatgtggttaggtgcaaggttcttggaatttgaagctcttggttttatgaatgaagatcattggttctcaagagaaaattcactatccggagtagaaggtgaaggacttcataaattaggttacatactaagggatataagtaaaattcccggaggaaacatgtacgctgatgacacagctggttgggatacaagaataaccgaagatgacctacaaaatgaggcaaagattacagatataatggagcccgaacatgctttactggccacttcaatcttcaaattaacgtatcaaaataaagtggttcgtgtacagcggccggccaaaaatggtactgtcatggacgtaatatctagacgtgaccagcgaggctcaggacaggtaggcacatatggactaaacacgtttaccaatatggaagtacaattgataaggcaaatggaaagtgaggggatctttttacctagcgaactggaaacaccgaacttagctgaacgtgttttggactggctagagaaacatggtgcggaaagacttaaacgtatggcaataagcggtgacgattgtgttgtaaaacctatagacgatagattcgcaacggccctcactgcacttaatgacatgggtaaagttaggaaagatattccccagtgggaaccaagtaagggttggaatgattggcaacaagttcctttttgttctcatcacttccaccaattgataatgaaagacggaagagaaattgtggtaccatgccgtaaccaagatgagctagtaggacgtgcccgtgtgtcacaaggagctggctggtcactgagagaaacagcatgcttaggcaaatcttacgcacaaatgtggcaactaatgtattttcacagacgagacttgcgtctagctgccaatgcaatctgcagtgcggtacccgtcgattgggtgcctacatcacgtacgacctggtccatacatgcacatcatcagtggatgactactgaagatatgctatcagtttggaatagggtctggattgaagaaaatccttggatggaagacaaaacccacgtgagctcatgggaagaggtaccataccttggtaaaagagaagatcagtggtgcggaagtctaatcgggttaacggcgagggcaacatgggctacaaatattcaggtcgcaatcaatcaagtaagaagactaataggtaatgaaaactatcttgattatatgaccagcatgaagcgattcaaaaacgaatctgatcccgaaggtgcgctatggtaa

SEQ ID NO: 21227 - RNA, 9879 nt, synthetic construct
  misc_feature 1..9879: note = derived and/or modified CDS sequence (opt6) from DENV-1__GQ868499__SS-prME
  source 1..9879: mol_type = other RNA
agtgtaacgatgttgttaatgctacttcccaccgctctggcatttcacctaacgacaagaggaggagaacctcatatgattgttagcaaacaagaacgaggaaaaagtttgttatttaaaaccagcgcaggagtaaatatgtgtacattgatagcaatggacttaggagaactatgcgaagatacaatgacctacaaatgtccccaaataacagaagcagaacctgacgatgtggattgttggtgtaatgcaaccgatacgtgggtcacatacggaacatgtagccaaacaggaggacacaggagagaaaaacggtctgtcgcgttagctccacacgtaggattagggcttgaaacccgtactgaaacttggatgtcgagtgaaggagcatggaaacaaatacagcgggtagaaacttgggctttacgacatccaggttttacagtaattgctttatttttagcacatgcaattggaactagcattacgcaaaaagggataattttcattctgctgatgctcgtgacaccatcaatggcaatgaggtgtgtaggtattggcaaccgcgattttgtcgaaggactgagtggagcaacgtgggtagatgtagtacttgaacatggatcatgtgtcactaccatggctaaaaataaaccgacacttgacatagaactacttaaaacagaagtgacaaatccagccgtattaagaaaattgtgcattgaggcgaagatatccaatacaacgactgatagtaggtgtcctacacagggcgaagcgacgttagtggaagaacaagacgcaaactttgtatgtagacgaacatttgttgaccgcggttgggggaatggttgcggattgttcggcaaagggagcctacttacttgtgcaaaatttaagtgtgtaactaagttggaaggaaagattgtccagtacgaaaatctaaagtattcggtaatagtaacagtccatacaggagatcaacatcaagtaggtaatgaaactacggagcacggaaccatcgctacaattaccccacaagcaccaacttctgaaatccaattaactgactatggtgctctaacactagactgttcccctaggaccggattggactttaacgagatggttctcttgaccatgaaagagaaaagctggttggttcacaagcagtggtttttagatctaccgcttccctggacaagcggagctagcacttcacaggagacctggaacaggcaagatcttctggtcacttttaaaactgcacatgccaagaaacaagaggtcgtggtacttggatcgcaagaaggggctatgcatacggcattaactggcgcaacagagattcaaacatcaggtacaaccactatattcgcggggcacctgaaatgtaggctcaaaatggataaattaactttgaaggggacttcgtatgtaatgtgcacgggtagctttaagctagaaaaagaagtagcagaaacacaacatggaacggtattggtacaggtgaaatatgaaggaaccgacgcaccttgcaaaattccattttctacacaggatgaaaaaggagtaacacaaaatggaaggttaataaccgctaatccgatagtaactgacaaagaaaaaccggtaaatatagaaacggaacccccatttggagaaagctatatagtggtaggagctggggaaaaagcgttaaagttgtcttggtttaagaaagggagcagcattggaaagatgttcgaagcaacagcccgaggggccaggagaatggcaatactaggcgatacagcgtgggatttcggctcgataggaggtgtatttacatcagtaggaaaattggtccatcaagtatttggcaccgcatatggcgtgttgtttagtggtgtatcttggacgatgaaaattggtatcggaatactattgacatggttaggcctcaattcaagatccacttcgcttagcatgacgtgtatagctgttgggatggtaactttatatttaggcgtgatggtgcaagctgactctggttgtgtaataaactggaaaggtagagagttaaaatgtggatctggtatcttcgtaacgaatgaggtacatacctggaccgagcaatacaagtttcaagcggactccccaaaaaggctttcagcagccataggtaaagcatgggaggagggggtctgcggtataagatctgctaccaggttagaaaatattatgtggaagcaaatatcaaacgaactaaatcatattcttttagaaaacgacatgaaatttacagttgtagtaggcgatgcaaacggaattttagcgcaaggtaaaaagatgattagaccccaacctatggaacataagtacagctggaagtcctggggaaaggctaaaattattggggccgatattcaaaataccacgttcataatcgatgggccagacacccccgagtgccccgacaaccaaagagcatggaatatctgggaagttgaagattacgggttcggaatattcacgactaatatttggcttaaactacgagactcttacacgcaaatgtgcgatcatagactgatgagcgcagcaataaaagacagcaaggccgtccacgccgatatgggctattggatagagtcggagaaaaacgaaacctggaaactcgctagagccagttttatagaagtcaagacatgtacttggcccaagagtcatacactctggagtaatggcgttttagaaagcgaaatgataatcccgaaaatatacgggggtcccatttctcagcacaattacagaccgggatattttactcaaacagcgggaccttggcatctaggcaaattggaacttgattttgacctatgcgaaggtactacagttgtagtagatgaacattgcggtaacagaggacctagcttgcgaaccacgacagtaactggcaaaataatacatgaatggtgctgtaggagttgcacattgccaccattgagatttcgaggggaagatggatgttggtacggcatggagattcgaccagtcaaagaaaaagaagaaaatctagtcagatctatggtaagtgcaggcagcggcgaagtcgatagcttcagtctagggatcctttgtgcaagtataatgatagaagaggtcatgcgaagtcgatggtcaagaaagatgctaatgacaggaacactagctgtctttttactattaattatggggcaactgacttggaaggacctcatacgcctgtgcatcatggttggagccaatgcttcggatagaatgggcatggggacgacttatttagcgctaatggcaacattcaaaatgaggccaatgtttgcggtcggtttgctattcaggcgacttaccagtcgcgaagttcttttactgaccataggcctcagcctagtagcttcccttgaactcccgaacagtttagaagaacttggagatggtctcgctatgggcataatgatgttgaaactcttgacagaatttcaaccccaccagttatggaccacattactaagtctgacctttattaaaacaaccttatcccttgactatgcgtggaaaaccacggcgatggcgctaagcatagtttcgctctttcctttgtgcctatccacgacgagccaaaagacgacatggctcccagtacttttaggcagcttcggatgcaagccattaacaatgttcctaatcaccgaaaataagatttggggtcgtaaatcctggcctctaaacgaaggtataatggcaataggtattgtttccattttactcagttcgcttctgaaaaacgacgtacccctcgcaggaccacttattgccggaggtatgttaattgcttgttacgttataagtggctcaagtgcggatttaagtctagagaaggtggcagaagttagctgggaacaagaagcagaacatagtggcacatcgcataacatcctagtcgaggtacaagacgatggtacgatgaagataaaagacgaagaacgtgatgatacgctgacaatattattgaaggcaactttactggcagtatctggcgtatatccaatgtcaatccccgcgactttatttgtctggtatttttggcagaaaaagaagcaacgctcaggggtgctctgggataccccttcaccaccagaagtggaacgagcggtgctggatgatggaatatacaggatcttacaacgcgggttgttgggacgatcgcaggtcggagtaggagttttccaagacggggtgttccatacaatgtggcatgtaactcgaggggcggtgcttatgtaccaagggaaacgactagaaccgagctgggcgtctgtcaaaaaggatctgataagttatggcggaggatggcggttccaagggtcctggaatactggagaagaagtacaggtaatagcagtggagccaggtaagaatcccaaaaatgttcagactactcccggaacattcaagacgccggaaggggaagtgggagctatcgccttagatttcaagcctggaacaagtggcagcccaatagtcaatcgagaaggaaaaatagttggactatatggaaacggagttgtgactacatcaggtacatatgtatcggcgattgcacaagcaaaagcgagccaggaaggaccgctgccagaaatagaagatgaagtatttaagaaaagaaatcttactattatggacttacacccgggcagtggaaaaacaagaagatacctccccgcaatcgtccgcgaagcgataaaaagaaaacttcggacgctaattttagcaccgacgcgagtggtagcgtctgaaatggcagaagcgctaaagggcatgccaataaggtatcaaacgacagctgttaaatcagaacacacgggcagagagatagtagacttaatgtgccatgcaacattcaccatgaggctcctctccccggtaagagtacccaattataatatgattattatggatgaggcacatttcacagacccagcttccatagctgcaaggggatatatatcgacaagagtaggaatgggcgaagcggcggcgatatttatgacggcaactcctccaggaagtgtagaggcttttccccaaagcaatgccgtcattcaagatgaagaaagggacatacctgaacgaagttggaactcgggctatgactggataaccgacttccctggtaaaacagtatggtttgtaccctcaattaaaagtggtaatgatatcgcaaattgtctaaggaaaaatgggaaacgtgtcattcaacttagtagaaagacttttgatactgagtatcaaaagaccaaaaataacgattgggattatgtagtgacgacggacattagcgagatgggtgcaaatttcagagcggacagggtaattgacccacgtagatgtctcaagccagtaatactaaaagacggtcccgaacgcgtcatcctcgcgggtccgatgcctgtaacagttgcaagtgcagctcagcgaagaggtcgaataggaagaaatcaaaataaagaaggagatcaatatgtttatatggggcaaccattaaacaacgacgaagatcatgcgcattggacagaagcaaagatgttgctggataatataaatacccccgaaggtataattccggctctatttgaacccgaacgagagaaatccgcagcaattgacggagagtataggttgaggggcgaggctcgaaagacatttgttgaattaatgagacggggtgacctgcccgtatggctttcttataaggtagcaagtgaagggttccagtattcggatcggagatggtgtttcgacggcgaaagaaacaatcaagtcttggaagaaaatatggacgtagaaatctggacgaaagaaggggaacggaaaaagctgcgcccaagatggttagatgctagaacttactcggaccccctcgcactaagggagttcaaagaatttgcagcaggtagaagatcagtctccggagacctcatactggaaattggtaaattaccccaacatttgacgcttagagcgcaaaatgctcttgacaatctagtgatgcttcataattcagagcaaggaggaaaggcttacaggcatgcgatggaagaacttccggatacgatcgaaacactgatgttactggctctcattgctgttcttaccggaggagtaacactatttttcctttcaggcaaagggttaggtaagacatctattgggttattatgtgtgactgcatcatcagcattattatggatggcttcagtagaacctcattggattgccgctagtataatactagaatttttcttaatggtacttttaattccggaacctgacagacaaagaacaccacaagataatcaacttgcatatgttgtcattggactcttatttatgatactcacagtagcagccaatgagatgggtttactagagacaactaagaaagaccttggaattggtcatgtcgcggcagaaaatcatcaacacgcgacaatgttggatgtagatttacgaccagcttctgcttggacgctgtacgcggttgctactaccgtaattacgcctatgatgagacacactattgaaaacacaaccgctaatatatcactaacggctatagcaaatcaagcggcaatactaatgggtttggataaaggttggccaatttcaaagatggacataggggttccactgctagcgttggggtgttactcacaagttaacccgctaactctaaccgcagctgtattaatgcttgtagcacattacgctatcattgggccgggtttacaggctaaagctacaagggaggcgcaaaaacgaacagccgctgggataatgaaaaatcctaccgttgatggaatagtagccatcgacctcgatcctgtagtatacgacgcaaaattcgaaaaacaattaggccaaataatgctcctaatattatgtacaagccaaattctgttaatgagaacgacttgggctctttgtgaaagcattacactagcaaccgggccacttacaacgctctgggagggaagcccaggaaaattctggaacacaacaattgcagtatccatggctaacatatttcgcggttcctacctagctggtgcaggactagctttctcactgatgaaatcgttaggtggaggacgacgaggcacaggcgcccaaggcgaaacattaggtgaaaaatggaaaagacaactaaaccaactctcgaaaagtgagttcaatacctacaaacgcagcggcattatggaagtagatagatccgaagcaaaggagggactaaaacgaggtgaaacaactaaacacgcagtttcgcgtggcacagccaaattaagatggtttgttgagagaaatcttgtcaaaccggagggtaaagtaatagatctcggatgcggtcggggagggtggagttattattgcgcaggcttaaagaaagttacagaagtaaaaggctacactaaaggtggaccaggacacgaggaaccaatacctatggctacgtacggttggaacttggtaaaactacattcaggaaaagatgtcttctttatgccacctgagaaatgcgatactttattatgcgacataggtgaatcaagtcctaacccaactatagaggaaggccgtacacttagagtgctcaaaatggtagaaccctggttaagaggaaaccaattctgtatcaaaatcttaaatccatatatgccgagcgtagttgagactctggagcaaatgcaacgtaaacatggaggtatgctagtgaggaatcccttatctagaaacagtacacacgagatgtactgggtaagctgtggcacagggaatattgtatcggcggttaacatgacttctagaatgctattgaatagattcactatggctcatcgaaaacctacgtatgaacgtgacgtagatctaggagcgggcactcggcatgttgcggtagagccagaagttgcgaatctggacatcataggacaaagaattgaaaatatcaaaaatgagcacaaaagcacatggcattacgacgaagacaatccatataaaacttgggcatatcatgggagttacgaagtaaaaccgtctggaagtgcctcaagcatggtaaacggagtcgttcgattgttaacaaaaccttgggatgttattccaatggtcacacaaatcgctatgacagacacaacaccctttggtcaacagagagtttttaaagaaaaggtagacacccggacaccaagagcaaagagaggaaccacacagataatggaggtgacggccaagtggttatggggtttcctatccagaaacaaaaagccgagaatatgcactcgtgaagagttcaccagaaaagtcagaagtaatgctgcgataggtgcagtattcgtagatgaaaatcaatggaactctgctaaggaagcagtggaggacgaaagattctgggacctcgttcacagagaaagagaactacataaacaaggtaaatgcgcaacttgtgtatacaatatgatgggaaaaagggagaagaaattaggagaatttggaaaagcaaaaggtagcagggcgatatggtatatgtggctaggagccagattcctagaatttgaggctttgggatttatgaatgaggaccactggttctcgagagaaaattctctgagtggggtcgaaggggaagggttacataaactaggatatatattgagagatataagcaagatacccggcgggaacatgtatgctgacgatacagcagggtgggacacacgcataacggaagacgaccttcaaaacgaagccaagataacagatattatggaaccagaacatgcattgctcgcaacatcaattttcaaactaacataccagaataaagtagtgcgcgttcagcggccagccaagaatggaacagtaatggacgtaattagtcgtcgagatcagcgaggtagtggacaagtaggcacatatggattgaacactttcacgaatatggaagtacaattaataaggcagatggagtccgaaggtatcttccttccgtctgaattggagactccgaacctagccgagcgagtactggattggctggaaaaacatggagcggaacgcctaaaacgaatggctataagcggggatgactgcgtagtaaaacctatagacgatagatttgccacagccttaacggcactaaatgacatgggtaaagtaagaaaagatatcccgcagtgggagccctcaaaagggtggaatgattggcaacaagtacctttttgttctcatcattttcatcaactcataatgaaagatggaagagaaattgtagtaccctgcaggaatcaagatgaattagtcgggcgcgcccgagttagccaaggcgcgggatggtcattaagagaaaccgcttgtctaggaaaaagttacgcacaaatgtggcaattaatgtattttcatagacgagacttgagactagcagccaatgccatttgtagcgctgtccccgtagattgggtccctacatccagaacaacttggtcaatacatgcccatcatcaatggatgacaacggaagatatgctttcagtatggaatagggtttggattgaagaaaacccgtggatggaagataaaacacacgtatcttcttgggaagaagtgccttacctcggaaaaagggaagaccaatggtgtggtagcttaataggccttacagctcgggctacttgggcgacaaacattcaagtagcgatcaaccaagtaaggcgccttatagggaatgaaaactatttagattatatgacttcaatgaagcggtttaaaaacgaaagtgatccagaaggagctttgtggtaa

SEQ ID NO: 21228 - RNA, 9879 nt, synthetic construct
  misc_feature 1..9879: note = derived and/or modified CDS sequence (opt6) from DENV-1__GQ868500__SS-prME
  source 1..9879: mol_type = other RNA
tcagtcacgatgttgctcatgttacttcccaccgcattagcattccatttaaccacgcggggaggtgaaccacacatgatagtgagcaaacaagaacgaggtaaatctctgttatttaaaacatcagctggagtaaacatgtgtacgcttatagcaatggatttaggagaactttgcgaagacactatgacatataaatgtccacaaatcaccgaagccgaacccgatgacgtagactgttggtgcaacgctacagatacatgggttacgtatggaacttgttctcaaacgggagaacatcgacgcgataaaaggtcggttgcgttagccccacacgtaggacttggtttagaaacgagaaccgaaacatggatgtcaagcgaaggagcttggaaacaaatccaaagagtcgaaacatgggccctaagacatcctggtttcacagtaattgccctttttctagcgcacgcaatcgggacttctataactcaaaaaggaataatcttcatactgttaatgttagtaaccccatctatggcaatgcgatgtgtaggcattggcaaccgagactttgtagaaggtttaagtggtgcaacctgggtagacgtggtccttgaacacgggtcttgcgttacaaccatggccaaaaataaacctacattggacatcgaattactaaaaacagaggtaaccaacccagcaattttacgaaaattatgcatagaggcgaaaatatctaatactactacggactcccgttgtccaacacaaggggaagcaacccttgtagaggagcaagacgcaaactttgtttgcagaaggaccttcgtggatcgagggtggggaaacggatgtggattatttggaaaaggctcgctcttaacctgtgccaaatttaaatgtgtcactaaactcgaaggaaaaatagtacaatatgaaaatttgaaatatagtgtgattgtaacagtgcacactggagatcaacatcaggtaggtaatgaaacaactgaacatggtacaatcgctacaataacaccccaagctcccacatcagaaatacaactcacagattacggggctctcactttagactgttcgcccaggacagggttagatttcaacgagatggttttgcttacaatgaaagaaaaatcttggctagtacataaacagtggtttttggatttaccccttccctggacaagtggcgctagtactagccaagaaacatggaatcgacaggaccttctagtaacgtttaaaacagctcatgccaagaaacaagaggttgttgtcctaggaagtcaggagggagcgatgcataccgcactaactggcgcgacggaaatccagacttcagggactaccacgatctttgctggacatctaaaatgtaggctcaaaatggataaactgacattaaaaggaacaagttatgtaatgtgcaccggttcattcaaactagaaaaagaagttgcagaaacgcagcacgggacagtattagtgcaagtgaaatatgagggcaccgatgctccatgtaaaatcccatttagcacacaagacgaaaaaggagtaacacaaaacggaaggcttatcacagcaaatcccattgtaaccgataaagaaaaaccggtcaatatcgaaactgaaccccctttcggagagagttatatagtagttggagctggagaaaaagctctaaaactctcatggttcaagaaaggatcatctattggtaaaatgtttgaagcaactgcaagaggagctcgaaggatggcaatactaggggataccgcatgggacttcggatcaattggaggcgtatttacaagcgtcggcaaattagtccaccaagtcttcgggacagcgtacggagtacttttcagtggagtatcctggaccatgaaaatagggataggtatattattgacttggctaggtctcaactcgagaagtacaagtttaagtatgacttgtattgccgtcggaatggtgacattgtatctaggcgtaatggtccaagcagatagcgggtgtgttataaattggaaaggaagggaactaaaatgtggaagtggaatatttgtaactaatgaagtacacacctggacagaacaatacaaatttcaggcggattcaccaaaacgactgtctgcagcaattggcaaggcttgggaagaaggagtctgtgggatacgatcggcgacgagactggaaaacattatgtggaaacaaatatctaatgagttaaatcacatcttactagaaaatgatatgaaattcactgtagtagtcggagatgctaacggaatactcgcacaaggcaagaaaatgatcagacctcaaccgatggaacataaatattcttggaaaagttggggaaaagccaaaataattggtgcagacatacaaaatactacatttattatagatggcccagatacgcctgagtgtccagacaaccagcgagcttggaatatctgggaagtcgaagattatgggtttggaatatttacgaccaatatttggctaaaactaagagacagttatacccaaatgtgtgatcatagactaatgtctgcagcaataaaggactcaaaggcagtacatgcggatatgggttattggatagaaagtgagaaaaatgagacttggaaacttgctagagctagctttatagaggtaaagacctgtacatggcctaagtcccatactctgtggtctaatggtgtattggagagtgagatgataattccaaaaatatatggaggtcctataagccaacataattacaggccaggttactttactcaaacagcaggtccatggcatctaggaaaattggaacttgattttgatttatgtgaaggcacaactgtagtcgtagacgaacattgtggaaacagaggacccagcctgcgaaccacaacggtaactggcaagattatccacgaatggtgctgtagatcctgcactctacctccactccggttccgcggcgaagatggttgttggtatggaatggagattagaccagtaaaagaaaaggaagaaaaccttgttcgtagtatggtctcggcaggttcaggtgaagtagattccttctctttaggaatactttgtgcgagcattatgatcgaggaagtgatgcgatctcgatggtcacgcaagatgttgatgaccggaacactcgcagtattcctacttttagtcatgggccaacttacatggaacgacctaatcagactctgtataatggttggcgcaaatgcatcagacaggatggggatgggaacgacatatttagcactgatggcaacgtttaaaatgagaccaatgtttgccgtcggtctcctattccgacgattgacatcacgtgaagtgttgctattgaccattgggttatctcttgttgccagtgttgaactacctaattcattggaagaattaggagacggactagcaatgggtataatgatgctaaaacttctaacggaatttcaaccacatcaactgtggacgactttactaagcctaacattcatcaaaacgacccttagtttggattatgcatggaaaactacggcaatggctttaagcatagtctctctatttcccctgtgtcttagtactacaagccagaaaacgacctggttacctgtactactcggaagtttcgggtgtaaaccattaacaatgttcttaataacggaaaataaaatatggggacgtaagtcctggcctcttaacgagggtataatggcgataggtatcgtatcaattttgttgtcttcattactcaaaaatgatgtacccctagccggtccattgatagcaggaggtatgctgatagcctgctatgtaatatcaggatctagcgcagacctctcacttgaaaaggctgcagaagtttcttgggaacaagaggctgaacacagcggaacgtcacataacattctagtagaagttcaggacgatggaaccatgaaaattaaagatgaagaacgagatgacacattgactatcttactgaaagccacgctactagctgtatcaggcgtgtacccaatgtctataccagccacactttttgtctggtatttttggcaaaagaagaaacaaagatcaggcgtattatgggacacaccatctccccctgaagtcgaacgagccgtattagatgacggcatatatagaatactacaacggggtctgttagggaggtcacaggttggcgtgggagtgttccaagatggagtattccacaccatgtggcacgtaactcgaggcgcggtattaatgtaccaaggtaaaagattggaaccaagttgggcaagtgtgaagaaagacttgataagctacggaggtggttggagatttcaggggtcttggaatactggtgaagaagttcaggtaattgctgtcgaaccaggcaaaaaccctaaaaatgtccaaacaaccccgggaaccttcaaaacaccagagggtgaggtgggagccattgctttagattttaagcccggaaccagtggatcacctatagtaaatagagaaggaaaaattgtgggcctctatggtaatggcgtggtgacaacatcgggcacatatgtatcggccattgcacaagcaaaggcatcacaggaagggccgttacccgaaatagaagatgaagtttttaagaaacgcaacctcacaatcatggatcttcacccaggaagtggaaaaacacgacgatatctccccgcaatggtcagggaagcgatcaaacgaaaacttcgcacgttgatactagcaccgacgagagtagtcgcaagtgaaatggctgaagccctaaagggaatgccaataagataccagactaccgcagtgaagagtgaacacacaggcagagaaatagtcgatcttatgtgtcatgcaacgtttactatgagacttttatctcccgtaagagtacctaactataacatgatcattatggatgaagctcattttaccgacccggcatcaattgcagcaagaggatacatcagtacacgagtaggcatgggggaagcggctgccatcttcatgacagccacgccaccaggaagcgttgaagcatttccgcaaagtaatgcagtcattcaagatgaggaacgtgatattcccgaacgatcttggaactctggatatgactggataacagattttccaggaaagaccgtctggtttgtaccatcaattaaatctgggaatgacatagctaattgtttgagaaagaatggaaaacgagttatacaactatcacgaaaaacattcgacactgaataccagaaaactaaaaataacgattgggattatgtagtaacaacggacatttctgaaatgggggcaaattttagagctgatagggtcatcgatccaagaagatgtttaaaaccagtgatattgaaagacgggccggaacgcgtaatcttagctggaccaatgccagtaacagttgcgagcgcagcacaacgtcggggaagaataggacgaaatcaaaacaaagagggagatcaatacgtatatatggggcaacctctaaataatgatgaagaccacgcacattggacagaggcaaaaatgctactagataacattaatacgcctgaaggcatcataccggctctattcgaacctgaacgagaaaaatcggctgctatagatggtgaatatagacttcgaggcgaagcaagaaaaacttttgtcgaactgatgagaaggggtgatctaccggtgtggctgtcatataaggtggcaagtgagggttttcaatactcggatagaagatggtgtttcgatggtgaacgaaataatcaagtgttggaagaaaacatggacgtagagatttggacaaaagagggtgagagaaagaagttaaggccccgttggttagacgcgcgaacatactcggaccccctggcactaagagagttcaaagagtttgcagcagggcgtcgctcagtaagtggagacctaatactagaaattggaaaactacctcaacacctcactcttagagctcagaatgctttggataatctcgtaatgttacataatagtgaacaaggtgggaaggcctataggcatgctatggaagaactcccagatactatagaaacgttaatgctattagcattaatagcagtgttaactggtggagtaacattattctttctaagcggcaagggattaggaaaaacgtccattggcctcctgtgcgttaccgcgtcaagcgcacttctctggatggctagcgtagaaccacattggattgcggctagtattatactagagttcttcttaatggtacttttaataccagaaccggatcgacaacgtacaccacaagataatcaactcgcgtacgtagtaatcggacttttattcgttatactaacggtagctgcaaacgaaatgggccttctcgagactactaagaaagatttaggaatcggacacgtagcagcagaaaaccatcagcacgcgacaatgcttgatgttgatttgagacccgcatcagcatggacactttacgccgttgctacgacagtgataacacctatgatgagacatacaatagaaaacaccaccgctaatatatctctcacagcaatagcgaatcaggcagcaattctaatgggattagataaaggttggccaataagcaaaatggatataggagtgccattactcgcattaggttgttatagccaggttaatccactcacactaaccgcagctgtactaatgcttgtcgcacactacgctattataggtccaggattacaggccaaagcaacaagagaagcacagaaaaggaccgctgctggtatcatgaaaaatccaactgtagatggaattgttgcgatagatctagacccggtagtatatgacgcaaaattcgaaaaacaactaggacaaattatgttgttaatattatgtacatctcaaatactactaatgaggactacatgggccctctgtgagtctataacactagcgactgggccattgactactctatgggaaggtagtccaggaaagttctggaatacgacaatagcagtttctatggcaaacattttcagaggatcatatctagccggtgcaggcttggcattctctctaatgaaatcactcgggggtggtcgcaggggaaccggagcacaaggggaaacattaggagaaaagtggaaacggcaactaaatcaactaagtaagtccgagttcaatacttacaagcgaagcggcattatggaggtagatagaagtgaagctaaggaaggactgaaaagaggggaaacaacaaaacacgcggtgtccagaggcaccgccaaacttcgatggttcgtagagcgaaacttagtaaaaccagaaggcaaagttatagacctcggatgtggaagaggtggttggagttattactgtgccggtctaaagaaagtgactgaagttaaagggtacaccaaaggtggcccaggtcacgaggagcctataccaatggcaacgtatggatggaatttagtaaaattgcactccggaaaagatgttttcttcatgccaccagagaaatgtgataccttactatgcgatataggggaaagctcaccgaatccaaccatcgaggaggggagaactctccgcgtattgaagatggtggaaccgtggttgaggggtaatcaattctgcataaaaatactaaacccatacatgcctagtgtagttgaaaccttagaacaaatgcaacgaaaacacggtggaatgcttgtccgtaatcccttgagtcgaaatagcacacacgaaatgtattgggtcagctgcgggaccggtaacattgtctctgcagtcaacatgacatcaaggatgttattaaaccggttcacgatggcgcataggaaacctacttatgaacgagatgtggatttgggtgctggaacacgccatgtggcggtggaaccagaagtcgcgaacttggacataatcggacaaaggatagaaaatataaagaacgagcacaaatctacttggcactacgatgaggataacccgtataaaacttgggcataccatggatcttatgaagtaaagcctagtggcagtgcgagtagcatggttaatggtgttgtgaggctgttaaccaaaccatgggatgtaatacccatggtgaagcaaatcgcaatgaccgatactacaccatttggtcaacagcgagtatttaaagaaaaggttgatactagaacacctagagcaaaaagaggaaccacacaaattatggaggtaacagcaaaatggttgtggggatttctctcgagaaataaaaagccacgtatatgtacacgtgaagaatttactcgcaaagttcgctcaaatgcggcgatcggtgctgttttcgtaggagaaaaccaatggaacagcgcaaaggaagcagtagaagatgaacgagtttgggacttagtacatcgagagcgcgaactacacaaacaagggaagtgtgcaacatgtgtatacaatatgatgggtaagcgtgagaagaaattaggagaatttggtaaagcgaagggtagtagggctatatggtacatgtggcttggggcgcggtttttagaatttgaagcattaggttttatgaatgaagatcattggtttagtagagagaactctttaagcggtgtggagggtgaaggcttacacaaactaggttatatattacgtgatatatccaaaatcccagggggcaatatgtatgcagacgacaccgcgggttgggatacaagaataacagaagatgatctacaaaatgaagcaaaaataactgagattatggaacccgagcatgccctattagctacgtcgatatttaaactcacatatcaaaacaaagtagtgcgcgtccagagaccagcgaaaaacggcacggttatggatgtcataagcaggcgtgaccagaggggctcaggacaagtaggtacttacggtcttaatacttttactaatatggaagtccagctaattaggcaaatggaaagcgaaggaatttttctcccttctgaactagaaaccccaaacttggcggaacgtgttttagactggcttgagaaacatggagccgagagactaaaaagaatggcaatatcaggcgatgattgtgtggttaaacccatagacgaccgattcgcgactgcacttaccgctttgaacgatatgggtaaagtcaggaaagatataccacaatgggaaccgagtaagggttggaacgattggcagcaggtcccattttgtagtcatcattttcatcaattgataatgaaagatggaagggagatagtagtgccgtgcagaaaccaagatgaacttgttggccgagctcgggttagtcagggcgcgggttggtcattgagagaaacagcctgcctaggcaagtcttatgcccaaatgtggcaactcatgtactttcatagacgcgacttgagactagcagcaaatgcgatctgttctgcagtgccagttgattgggttccaacatccaggactacatggtctatccatgctcatcaccaatggatgactactgaagatatgttatcagtctggaacagagtttggattgaagaaaacccatggatggaggacaaaacacatgtttcatcatgggaagaagtcccttacttaggaaaaagggaagaccaatggtgcggcagcttaattggactaacggcacgcgcaacgtgggctacaaacattcaagtagccatcaatcaggtgcgaagactgatcggtaatgaaaattatctagattatatgacaagtatgaagagatttaaaaatgaatcagaccccgagggagctttatggtga

SEQ ID NO: 21229 - RNA, 9879 nt, synthetic construct
  misc_feature 1..9879: note = derived and/or modified CDS sequence (opt6) from DENV-1__GU131961__SS-prME
  source 1..9879: mol_type = other RNA
tctgtaactatgctactaatgctcttaccgacagcacttgcctttcacttaacaactcgcggtggagaacctcatatgattgttagcaaacaagaaagaggaaaaagtttattatttaaaacctctgcaggagtcaacatgtgtacactcattgctatggacttgggcgaattatgcgaagacactatgacatataaatgtcctcaaataacagaagccgaaccagacgacgttgactgctggtgcaatgcaacggacacctgggtgacgtacggtacctgttcacaaacaggagagcaccgtagagataaaagatcggtagctttagccccacacgttggtcttggacttgaaacccgaacggaaacatggatgtcctcggaaggagcatggaagcaaattcaacgtgtagagacctgggcattaagacacccaggttttacagtaatagcactattcttggcacacgcaattggtacatcaataacgcaaaaaggtatcatcttcattttattgatgttagttaccccaagcatggcaatgcgttgcgtaggtataggtaacagagattttgtcgagggactatctggtgcaacatgggttgatgtggttttagaacatggatcttgtgtaactaccatggccaaaaataagccgactcttgacattgaattattaaagacagaggttactaaccctgccatacttagaaagttatgcatagaagcaaaaataagcaacacaacaacagacagtagatgtccaacacaaggtgaagcaacattagtcgaagaacaagatgctaattttgtgtgtagaagaacttttgttgataggggatggggcaacggatgcggtctattcggaaaaggaagcctccttacttgtgccaaattcaaatgcgttacaaaattagaaggaaagattgtacaatacgaaaacctcaaatatagtgtgatcgtaactgtacatacaggagaccaacatcaagtgggcaatgaaacgacagagcatggcacaatcgctacaattacacctcaagcgccaacatctgaaatacaactcaccgactatggcgcgttaacactagattgtagtcctcgaacgggactagactttaacgaaatggtgttgcttacgatgaaggaaaagtcatggttagtccataagcaatggtttctagatctacctttaccgtggacaagcggggcatcgacctcccaagagacatggaatagacaagatcttttagtaacattcaaaactgctcatgcgaaaaagcaagaggtcgtagtattaggttctcaagagggcgcgatgcatactgccttgacaggagccacggagatacagacatcaggtactactacaatattcgctggccatttaaaatgccgacttaagatggataaattgaccctaaaaggcacttcatatgtcatgtgtacaggcagtttcagactagagaaggaagttgctgaaacacaacatggaaccgtgttagtacaggtgaagtatgaaggaaccgatgctccctgcaaaatcccttttagtacacaagatgaaaagggtgtaactcaaaacggaagattaataacagccaatccaatcgttactgacaaggaaaagcctgtaaacatagagacagaacctccctttggtgagtcatatatagttgttggagctggagaaaaagcattaaaattgtcttggttcaagaaagggtcttctatcggcaaaatgtttgaagccacagctcggggagcaagaagaatggctattttgggagacacagcgtgggacttcgggtcaattggaggggtgttcacgtcagtaggaaaacttgtacatcaggtcttcggtactgcttacggagttttgttttctggagttagttggactatgaaaataggcataggcatattacttacttggttggggttaaattcacgatcaacgtcgctttctatgacttgtatcgcagtaggcatggttaccctgtatcttggtgtaatggtgcaggccgattcaggatgtgtgataaattggaaaggcagagaattaaagtgtggatcaggaatatttgtaacaaatgaagttcacacttggacggaacaatacaagttccaagctgacagtcctaaaagactatcagcagcaattggaaaagcatgggaagagggcgtatgtggtataagatcagcaacaagactagaaaatataatgtggaaacaaatatctaacgagcttaaccatatactactagagaatgatatgaagttcacagtcgtcgtcggcgatgctaatggaatactagcgcagggtaagaaaatgatccgaccgcaaccaatggaacacaagtatagttggaaaagttggggaaaagctaaaataataggagccgatatccagaataccacgtttataatagatggtccggatacgccggaatgcccagataatcaaagagcttggaacatctgggaagttgaagactatggatttgggatattcacgacgaatatatggctgaaattaagggacagttacacgcaaatgtgtgatcaccgtttaatgagtgctgcaataaaagactcaaaggcagtacacgccgatatgggatactggatagaaagtgagaaaaatgaaacttggaagttagccagagcgtcgtttatcgaggttaaaacatgtacatggccaaaatcacatactttgtggtcaaatggtgtgttagaatcagaaatgataattcccaaaatctacggcggccccatttcgcagcacaactaccgacctggctacttcactcaaactgcgggcccttggcatctagggaaattggaattggattttgatttgtgtgagggtactaccgtagtagtggatgaacattgtggaaaccgtggaccaagtctcagaaccacaacagtgaccggtaaaataatacacgaatggtgttgcagatcatgtacattacctccattaaggttcagaggagaagacgggtgctggtatggcatggaaatacgacccgtgaaagaaaaagaggaaaaccttgttaggtctatggtatcggcaggatcgggtgaagtggactcttttagtttaggtattttgtgcgcgagcataatgattgaagaagtaatgcgaagcagatggtctagaaagatgctaatgacaggaacactcgcagtatttttgctgttaataatggggcaattaacttggaatgatttaataagactgtgtattatggtaggtgccaatgcaagtgacagaatggggatgggtacgacatatttagccctcatggcaacttttaagatgcgaccaatgttcgccgtaggcctcctgttccggagactaacaagcagagaagtacttcttctgactataggattgagcctagttgcaagtgtggaacttcctaactcactggaggagcttggcgatggattagctatgggcataatgatgttaaaactacttacagaatttcaaccacaccaactgtggacaactttattaagtttaacttttataaaaacaacattaagtcttgactatgcgtggaaaactacagccatggctttatctatagtaagtctatttcctttatgtttgtcaacaacgagtcagaaaactacatggttaccagtacttctaggctcatttgggtgcaaaccactaacaatgtttcttatcacggaaaacaaaatttggggcaggaaatcctggccattgaatgagggaattatggctattggtatagtgagtattctgttatcttccctcctgaaaaatgatgtaccgttagcaggcccactcattgctggtggtatgttaatagcttgttatgtaatctccgggagctctgctgatttatccttagaaaaagcagcagaggtatcttgggaacaagaagctgaacatagtggaacaagccataacattttggttgaggtccaagatgacggaacaatgaaaattaaagatgaggaaagagatgatactttgacaatattattgaaagctaccctgttagcagtaagtggcgtctatcctatgtccataccggccactctgtttgtatggtatttctggcaaaagaagaaacaacgcagcggagttttgtgggatacaccgtcccctcctgaggtcgagagagctgttttagacgatggtatatacaggatattacaaagggggttactggggaggtcacaagtgggcgtgggcgtatttcaagacggggtgtttcatacaatgtggcatgttacgagaggtgcggtgttaatgtaccaaggcaaacgtttagaaccttcctgggcgtcggtcaagaaagatttgataagttatggcggtggttggaggttccaaggatcttggaatactggtgaagaagtacaagtgattgcagtagaaccggggaagaatcccaaaaatgtacaaaccactcctggtacatttaaaacaccagaaggagaagtaggtgccatagctttggattttaagccagggacatcaggaagtcctatcgtaaatagagaaggcaaaatagtaggactctatggaaacggagtagtgacaactagcggaacttatgtaagtgctatagctcaggcaaaagcctcacaagaaggcccactaccagagattgaagacgaagtatttaaaaagcgtaacttaacaataatggatctacacccaggtagtgggaaaacccgacgatacttgccagcgattgtcagggaagctataaaacgtaaattaagaactttaatactggctccgacccgagttgtagcatctgaaatggctgaagcgttaaagggtatgccgattcgttaccaaactaccgctgttaagtcagaacataccggacgagagatagtagatttgatgtgccatgcaacttttacgatgcgtttgttaagcccagtgcgggtgcccaattacaacatgattattatggacgaggcccattttacagatccggcctcaattgccgctagaggatatattagtacgcgcgtcggtatgggagaagcggctgctatatttatgactgccacaccacccggaagtgtagaagcatttccacaaagtaatgcagtaatacaggacgaggagcgtgatatcccagagagatcatggaatagcggttacgattggataactgacttcccaggtaagactgtatggtttgtaccatcaataaaatcaggtaatgacattgcaaactgcttaaggaaaaatggaaagagagttattcagctatcacgaaaaacatttgatactgaatatcagaaaactaaaaataatgattgggactatgtagtaacaacggatatctcggagatgggggcaaactttagggcggaccgagtaattgacccccgtagatgcttaaaaccggtaatattaaaggatggaccagagcgagtaattttagcaggtccgatgcctgtgacagttgcaagtgcggcacagagacgagggaggattggacgaaatcaaaacaaagagggagaccaatatgtgtatatgggacaacccctaaataacgatgaagatcacgcacattggacagaagcaaagatgctacttgacaatataaacacaccagaggggataatccctgccttattcgaaccggaacgcgaaaagtcagcagctattgatggtgaatatagattgcgaggagaggcacgaaagacttttgttgaacttatgcggagaggggatctgcctgtatggctatcgtacaaagtcgcgagtgaaggcttccagtattctgaccgccgatggtgttttgatggagaaaggaacaatcaagtcctagaagaaaacatggatgtggaaatatggacaaaagagggagagagaaagaaactacgaccaagatggctagatgcaaggacttatagtgacccattagcccttcgtgaatttaaagaatttgccgcaggccgccgatcggtaagtggagacctgatactagaaatagggaaattaccgcaacaccttacgctaagagctcaaaatgcgctcgataacttagtaatgctacacaatagcgaacaaggagggaaggcatataggcatgctatggaagaattaccagacacaatcgaaactttaatgttgctagcactcattgctgtcctcacaggaggagtgacgctgttctttttatcaggaaaaggtctaggcaagacgtctataggacttttatgcgtaaccgccagttccgctttactttggatggcatcagttgagcctcattggattgcagcatcaattatcttagaatttttcctaatggtactgttaatacctgaacccgaccgacagcgcacacctcaagataatcagcttgcatatgtagtgattggattgctatttatgatattaacagttgctgccaatgaaatgggactattagaaactactaagaaagatctggggatcggtcatgtagcagccgaaaaccatcaacacgcgacaatgctggatgtagaccttcgtcccgcgagtgcatggacactatatgcggttgcgacgacggtgattacgcccatgatgcgtcatacaatcgaaaacacaacagctaatatatctttaacagcaatagccaatcaagcagcgattttgatgggtttagataagggatggccaataagtaagatggacataggagtgccactattagcgttaggttgttatagccaagtgaatccactaacattaacggcagcagttctaatgttggtagcacactacgcaatcataggtcctggtctacaagccaaggcaacgcgcgaggcacaaaagcgaacagctgcaggaataatgaaaaacccgacagttgatggtattgtggctattgatctcgaccccgtggtatatgatgcaaagtttgaaaagcaattgggtcagataatgttattaatcttgtgtacaagtcaaatcctgttgatgagaacaacctgggcactctgtgaatcaatcacactggcaacggggccactaacaaccttatgggagggaagcccgggcaaattctggaatacaacaatcgcagtgtcaatggcgaacatcttcaggggatcctatcttgcaggagctgggctcgcattctcccttatgaaatccctgggtggaggaaggaggggtacgggtgcgcaaggagaaacattgggtgagaaatggaaacgccaattaaaccaattatccaagtcagaatttaatacgtataaacgttcaggtataatggaagtcgaccgaagtgaagcaaaagaaggcttgaaacgaggagagacaactaagcatgctgtctcacgaggaacagccaaactgagatggtttgtagaacgtaacttggtcaaacctgagggaaaagtcattgacttaggctgcggaagagggggatggtcgtattattgcgcaggactaaagaaagtaaccgaagtcaaaggatatacaaaaggaggaccaggacatgaagaaccgatacccatggcaacttatggatggaatctggtgaaacttcactcgggaaaagacgttttcttcatgccaccagagaaatgtgacacacttctatgtgatataggtgaaagttcaccaaaccccacaattgaagaaggaaggacactacgagtacttaaaatggtagagccgtggttacgtggaaatcagttttgtataaagattttgaacccatacatgccctccgtcgtagagacgttagagcaaatgcaacgtaaacatggaggaatgctcgttcgaaacccgctatcgagaaattcgactcatgaaatgtactgggtgagttgcggaactggtaacatcgtcagtgcggtcaacatgacgagccgaatgttattaaatagattcaccatggcacatcgtaagcctacatttgaaagggatgttgacctgggggctggtacaagacatgtggcagtagaaccagaagtagccaatttagacattataggacaaaggatcgaaaatatcaaaaatgaacacaagtctacctggcattacgacgaagataacccatacaaaacgtgggcttaccatggatcatacgaggtcaagccgagtggttctgcaagttctatggtcaacggagttgtgaggttattaacgaagccttgggacgtcatacctatggtgacacagatagcgatgacagatactacaccattcggccaacaacgcgtcttcaaagagaaagtcgacacgagaacgcctcgggccaagagaggtactactcagattatggaagtgaccgccaaatggctatggggattcctgtctaggaataagaaaccgagaatatgtacacgggaagaatttacaagaaaagttagaagtaacgctgcaatcggagctgtcttcgtagatgaaaatcagtggaactcagccaaagaggcagtcgaagatgaaagattttgggatctcgtacatcgagaaagagaactacacaaacaaggaaaatgtgccacatgtgtctacaacatgatgggaaaacgagagaagaaattaggagaatttgggaaagcaaaaggatcaagagctatatggtatatgtggttaggagcaagattccttgagttcgaggcgttaggctttatgaatgaagatcactggtttagtagagaaaactctctttctggggtagagggagagggcttacacaaattgggatatatcctgcgagacataagtaagataccaggaggcaatatgtacgccgatgacacagcggggtgggatacacgaataaccgaagacgatctacaaaacgaggcaaaaattacagatattatggaaccggaacatgcactactagcgacaagtatatttaaattgacgtaccaaaataaggtggtccgcgttcaacggccggcaaagaatgggacggttatggatgtaatatctcgtcgggatcaaaggggaagtgggcaagtaggaacatacggactaaatacatttacaaatatggaagtgcaattgatacgacaaatggaatccgagggcatatttttaccgtctgaactggagacaccaaatctggctgaaagagtacttgattggttagaaaagcacggagctgagaggttaaagagaatggcgatctcaggtgacgattgtgtagtaaaaccaattgacgatagattcgccacggccttgacggctttaaacgatatggggaaagtaaggaaagatataccgcaatgggaaccgagcaagggttggaatgactggcaacaagtgccattttgtagtcatcacttccaccaacttataatgaaggacggtagagaaatagtggtgccttgcagaaatcaggatgagctagtaggtagagcccgcgtatcgcaaggggcgggctggagcctaagagaaacggcgtgtttgggtaaatcatatgcccagatgtggcaactgatgtatttccatcgaagagatctaaggcttgctgccaatgctatctgttcagcagttccggtcgattgggtgcccacgtcgagaacgacatggagtattcacgcgcaccatcaatggatgacaaccgaagatatgctatccgtatggaatagggtttggatcgaggagaatccatggatggaggataaaacacacgtctcgtcgtgggaggaagtgccctaccttggcaaacgggaagatcaatggtgtggatcattaattggattgaccgcgagggccacttgggccacgaacatccaagtggcgataaaccaagtacgtcgtttgattggtaatgaaaactatttagattatatgacaagtatgaaacgatttaaaaatgaatctgatccggagggcgtattatggtga

SEQ ID NO: 21230 - RNA, 9870 nt, synthetic construct
  misc_feature 1..9870: note = derived and/or modified CDS sequence (opt6) from DENV-1__GU131962__SS-prME
  source 1..9870: mol_type = other RNA
tcagtgacaatgttattaatgttattaccaacggctcttgcgtttcatcttacgacaaggggaggagaacctcacatgatagtgagcaaacaagaacggggaaaatccttattatttaaaacatctgcaggcgttaatatgtgtacactcatagcaatggatttaggtgaattatgtgaagacacaatgacctataaatgtccgcaaataacagaagctgaaccagatgatgtagattgttggtgtaatgctacagacacttgggttacatacggcacttgttctcaaaccggtgaacatagacgtgataaaaggtccgttgcgttggcccctcatgtaggacttggacttgaaactcgtacagaaacatggatgagcagcgaaggagcctggaagcaaatacaaagagtagaaacttgggcactaaggcacccaggattcacggtaatagcactttttctagcccatgcaatcggaacttcaataactcagaaagggataatttttattttactcatgttggttactccatctatggccatgagatgcgtcggaataggaaatcgggatttcgttgaaggattatcaggagcaacatgggtggatgtagttttagaacacgggtcttgtgtaactactatggccaaaaataaaccaaccttagacatcgaacttttaaagactgaagtcacaaaccccgctattttgagaaaactttgtatagaagcaaaaatctcaaacactactaccgactcccgctgcccaacccaaggtgaagcaacattagtagaagaacaagatgcgaattttgtatgccgacgtacgttcgtcgacagagggtggggtaatggatgtggattatttggcaaaggtagtttattaacatgcgcaaaatttaagtgcgttaccaaacttgaaggaaaaatcgttcaatacgaaaacctaaaatattcggtaatcgttacagtccatactggcgaccaacatcaagtaggaaacgaaacaaccgaacatggcaccatagctactatcacgccccaagcccccacaagcgaaattcagctaactgattatggcgcgctaacactagactgctctccacgtacaggactggattttaatgagatggtactattaactatgaaagagaaaagctggttagtacataaacaatggttcttagacttaccactaccatggacaagcggtgcatcaaccagtcaggaaacttggaaccgacaggacttgctagtcacatttaaaaccgctcatgcaaagaagcaagaagtagtcgtcttaggcagccaggaaggtgcgatgcatacagcgctaactggggcaacagaaatccaaacttcaggcacaaccaccatctttgctgggcatttaaagtgtagattaaaaatggataaactaactttgaaaggaaccagctatgttatgtgtacagggtcttttaaactagaaaaagaagtagcagaaactcaacacggcaccgtcttagtgcaagttaagtatgagggaacagacgcaccttgcaagataccgttttccacacaagatgaaaaaggagttacacaaaacggacgcctaattacagcaaatcctattgtcactgacaaagagaaaccagtcaatatcgaaacagaaccacccttcggcgagagttatatagtagtgggcgcaggggaaaaggcactaaaactttcatggtttaagaaaggatcctcaatcggaaaaatgtttgaagcaacagcccgcggggcaagaagaatggcaattttaggagatactgcttgggattttggctcgatcggtggcgtctttacttcggtgggtaaacttgtccatcaagtatttggtacagcgtacggagtgctgttctcaggtgtaagctggacgatgaaaatcggtatagggattctactaacatggcttggactgaatagtcgtagtacgtcattaagtatgacttgcatagctgttggaatggtaacattgtacttaggagttatggtacaagcagattcgggatgtgtaataaattggaaaggacgggagctaaaatgtggctcgggcatatttgtaacaaatgaggttcatacttggacagaacagtataaatttcaagccgactccccaaagcgccttagcgctgcaataggcaaagcgtgggaagagggagtatgcggtataaggtccgcaaccagactagaaaatatcatgtggaaacaaatcagtaacgaattaaaccacattcttctagaaaacgatatgaagttcacagtagtggttggcgacgccaatggaatactagcacaagggaagaagatgataagacctcagccaatggaacataaatactcatggaaaagctggggcaaagcgaaaattatcggagcagatatacagaataccacgtttattatagacggcccagatacacccgaatgcccagacaaccaaagagcttggaatatctgggaagttgaagattacggttttgggatattcacaacaaacatctggctaaagttaagggattcgtatacgcaaatgtgcgaccatcgactaatgagtgcagcaataaaggattcaaaggccgtacatgctgacatgggttattggatagagtctgagaaaaatgagacttggaaactggcaagagcatctttcattgaagttaaaacttgtacttggccaaaatcacatactttatggagtaacggagtgttagaatctgaaatgataataccaaagatttacggcggcccgatttcacaacacaattatcgaccaggatatttcacacaaacagcgggaccatggcatttaggcaagctagaactagacttcgatttgtgcgaaggtactaccgttgttgtggacgaacattgtggtaatagaggacccagcttgagaacgacaacagtcaccggaaaaataatacatgaatggtgctgccgatcgtgtacgctcccaccactaaggttcagaggtgaggatggatgttggtacggaatggaaataagaccggtgaaagaaaaagaagagaacttggtacgttcaatggtatcagcgggaagcggagaagtagattcttttagtttaggaatattatgtgtaagtataatgatagaagaagtaatgcgatccagatggagtcgaaaaatgttaatgacgggaacgttagcagtatttctacttttagtaatgggtcaattaacgtggaatgaccttataagattatgtattatggtaggtgctaacgcgtcagatagaatggggatggggacgacctaccttgcactcatggccacgtttaaaatgaggcctatgttcgcagtcggactattattcagaagattgacatcccgcgaagttctccttctaacgataggtttgtcattagtcgcttcggtggaactgccaaattctttagaggaactgggagacgggttggccatgggaataatgatgcttaagctattaacggaatttcaaccgcaccaactatggacaacacttctatcacttacatttatcaaaacaaccctttccttagactatgcatggaaaactaccgcaatggcattgtccatagtaagtttatttcctttatgcctaagcacgacaagtcagaaaactacttggcttcctgtattacttggcagtttcggctgtaagccgctaactatgtttttaataacagaaaataaaatatggggacgaaaaagttggccgcttaatgaaggtattatggctatcggtattgtatctatacttttaagctcattactgaagaatgatgtaccgttggcgggcccactgatcgcaggagggatgctgattgcttgttacgtaatctcaggttcaagcgccgacctttctctagaaaaagctgccgaggtttcctgggagcaggaggcagaacactctggtacaagtcataatatattagtagaagtccaagatgatggaaccatgaaaattaaagacgaagaaagagacgatactttgactatccttcttaaggccacattattagctgtgtctggtgtataccccatgagcattcccgccacgttattcgtctggtatttttggcagaagaagaaacaaaggagtggagtattatgggatacaccgtcacctccagaagtagaaagagcagttttagacgatggaatttatcgaatattacaaagaggattactaggtcggtcgcaagtaggtgtaggagtgtttcaagacggggtattccatactatgtggcacgtaacacgaggggcagtattaatgtatcaaggtaaaagattagagccatcatgggcttcagttaagaaagatttaataagttacggtggtggatggcgcttccagggatcatggaataccggagaagaagtacaggtaatcgcagttgagccaggcaagaaccctaaaaatgtacaaacgaccccaggaacttttaagactcccgaaggcgaggtaggtgcaattgccctagatttcaaaccagggacaagtggttcaccaatcgtgaatcgggaaggaaaaatcgtcggactatacggcaacggggtagtgacaacatcaggcacctacgtttcggccatagcacaagctaaagcgtctcaagagggaccgctacctgaaatcgaggacgaggtattcaagaaacgtaatcttactattatggatctacatccagggtctggtaagactcgtagatacttgccggcaatagtaagggaagcaataaaaagaaaactccggacactaatattagctccaacaagagtagtagcatcggagatggccgaagcactgaaaggaatgccaattagatatcagactacggctgtcaaatcggaacacacaggcagagaaattgtagatctaatgtgtcatgcaacgttcacgatgagactattatctcctgtacgggtacctaattataatatgattatcatggacgaagcacattttactgaccctgcaagtattgccgcaaggggatacataagcacgagggttggtatgggtgaagccgcggctatcttcatgaccgccactcccccaggaagtgtagaggcttttccacagtcgaatgctgtaatacaggacgaagaacgggacatcccagaaagaagttggaatagtggatatgactggataaccgatttcccgggtaaaacagtgtggtttgtgccttccatcaaaagcggaaatgatatagcgaattgtcttagaaagaatgggaaacgagtaatacaattatcacgcaaaaccttcgatacggaatatcagaaaaccaaaaataatgactgggattatgtcgtgaccaccgatataagtgaaatgggggccaactttagggcagatagagtaattgacccacgtcgctgtctcaaaccagtcatattaaaagatggccccgaaagggtaatcttagccggacccatgcccgttactgttgctagcgctgcacaaagaagaggcagaattggaaggaatcaaaataaggagggagatcaatatgtatacatgggacagcccctcaataatgatgaggatcatgcgcattggacagaagctaaaatgttattagataatatcaatactccggaaggtataatcccagcattatttgaaccagaaagagaaaaatccgctgcgatcgatggagaatataggctaagaggggaagcaagaaaaaccttcgtcgaacttatgcgacgaggagatctgccagtatggttatcgtataaagtagcaagtgaaggattccaatatagtgacagaagatggtgttttgatggagaaagaaataatcaagtactggaagaaaacatggatgtcgaaatatggacgaaagaaggtgaacgtaagaaacttagaccaagatggcttgatgcccgaacatactcggatcctctagcgctcagagagttcaaagaatttgcggcaggaaggcgatcggtatcaggggatcttatactggaaataggaaaacttcctcaacatttaactttaagggcccaaaatgcactcgataaccttgtgatgctccacaatagcgaacaaggcggaaaagcgtataggcatgccatggaggaattgccagatacaatagaaaccctgatgttactggccctaattgccgtattaacgggtggggtaactctattctttttatccggaaaaggcttgggaaaaacatcaataggcttattgtgtgtaactgctagctccgcgttactatggatggcaagcgtagaaccccactggattgccgcttctataatattagaatttttcctaatggtgctcttaataccagaaccggacaggcaaagaacacctcaagataatcaattagcttatgtagttataggcctcctatttatgatcttaaccgtagcagctaatgaaatgggacttctcgaaacaacaaagaaagatttaggtataggtcacgtagcggcggaaaatcaccaacatgcaaccatgctagatgtcgacctacgccccgccagcgcttggaccctgtatgctgtagcaaccacagtaataactccaatgatgaggcacaccatagaaaacactacggcaaatatatccttaacagcaatcgctaatcaggcggccatactaatgggtttagataaaggatggccaatatcaaaaatggatattggtgtaccacttttggcactggggtgctatagtcaagttaatccgcttacgttgaccgcagccgtactaatgttagtggcacattacgcaattatcggcccaggcttacaagcgaaagcaacccgcgaagctcagaaaaggacagcagctggcattatgaaaaaccctacagttgatggaattgttgctattgatctggatccagtagtttacgatgccaagtttgaaaaacagctaggccagatcatgctcttgatcctttgcacaagtcaaatcctccttatgcgaaccacatgggccctatgtgaatctataacgctggcaactgggccgctcaccacactctgggaaggtagtccaggaaagttttggaacacgacaattgcagttagcatggctaacatatttagaggttcgtacctagcgggcgctggattggcattttcactaatgaaaagtttaggtggcggcaggcgaggaaccggggcacagggcgaaacattaggagaaaaatggaaaagacaattgaatcaacttagtaaatctgagtttaatacatataaaaggagtggaataatggaagtagacaggagcgaagctaaagagggcttgaagcgtggcgaaacaacaaaacatgcggtatccagaggaacggcaaagctcagatggtttgttgaaagaaatttggtgaagcctgaagggaaggttattgacctcggttgcggaagaggtggttggagttattattgcgctgggttgaagaaagtcacagaatatgcatcggcggggttagcaataatagttccgcttcccttagacacttacgggaggaaccgtcttaagatacattcaggaaaggacgtatttttcatgcctccagagaaaggcgatacactactttgtgatataggtgagtcgagtcccaatcctactattgaagagggtagaaccttacgagtgttaaaaatggtggaaccttggctcagaggcaatcaattttgcattaagattcttaatccgtatatgcccagcgtagttgaggcactagaacaaatgcaacgaaaacacggaggtatgttagtaaggaatcccttatcccgaaactctacccatgaaatgtattgggtaagctgtggtactggaaatatagtcagtgccgtaaatatgacttcccggatgctcttaaaccgatttacaatggctcacaggaagccaacttacgaaagagatgtcgacctaggagcaggtactcgtcacgttgccgtagaacctgaagttgcaaacctggacattattgggcaaagaattgaaaacatcaaaaatgagcataaatctacatggcattatgatgaagacaacccatataagacgtgggcataccacggatcttatgaagtcaaaccttctggctcggcgtcctcaatggttaacggggttgtaaggctactgaccaaaccctgggacgtaattccaatggtgacacaaatagcaatgactgacaccacgccgttcggacaacaacgtgtatttaaagaaaaagttgacacgagaactccacgcgcaaaacgaggaacaacgcaaattatggaggtcaccgccaaatggctatggggattcctatctcgtaataaaaagcccagaatatgtacaagggaagagtttacaagaaaggtacgatccaatgccgcgattggtgccgtatttgtagacgaaaaccaatggaactctgccaaagaagcggtagaagatgaaaggttttgggatttagtccatcgcgagagagaactccataagcagggaaaatgcgcgacttgcgtatataacatgatggggaagcgcgagaagaaacttggtgaatttggtaaagcaaaaggtagccgtgccatatggtatatgtggttaggtgcgcggttcttagagtttgaagcattaggattcatgaacgaggatcattggttttcgcgtgaaaatagtctaagcggagtggagggggaagggttgcacaaactgggatacatactgagagatatatcgaaaataccaggtggtaatatgtatgctgatgatactgctggatgggacacaaggatcacggaagacgaccttcaaaacgaggcaaagataactgaaataatggagccagagcatgcgttactcgctacatccattttcaaattgacgtaccaaaacaaggttgtacgtgtacagcgaccggctaaaaatggaactgttatggacgttatatcaaggagagaccaacgaggatcaggacaagttggaacgtatggtttaaatacatttactaacatggaggtacagttgatccgccaaatggagagcgaaggaatctttttaccgtccgaactagaaacaccgaatctcgctgaacgagtactagattggttagaaaaacatggggcagaacggctcaagcgaatggcaatttcaggagacgactgtgttgtgaaaccaattgacgataggttcgccaccgcactgaccgctttaaatgacatgggaaaggtacgtaaagacataccccagtgggaacccagcaaaggatggaatgattggcaacaggtaccattttgttcgcatcactttcaccagctaattatgaaggatggaagggaaatagtcgtaccgtgtagaaatcaagacgagttagtcggaagggcacgggtatcacaaggagcaggctggtcattgagagaaactgcttgtttgggcaaatcctatgcccaaatgtggcaactcatgtactttcatagacgtgacttaagactcgccgcaaatgccatatgtagtgctgtgcccgtagactgggttccaacatcaaggaccacatggtccatacacgcacaccatcaatggatgacaactgaagatatgttgtcagtatggaatagagtatggattgaggaaaatccttggatggaagacaagacgcatgtttcctcatgggaggaagtcccatacctcggaaaacgagaggaccaatggtgtgggtcattgataggtctcactgcccgagccacctgggccacgaatattcaagtcgcaataaatcaggttcgtagactaataggtaacgaaaattatttagactatatgacatccatgaaacgttttaaaaatgaatcagacccagaaggtgcgttgtggtga

SEQ ID NO: 21231 - RNA, 9879 nt, synthetic construct
  misc_feature 1..9879: note = derived and/or modified CDS sequence (opt6) from DENV-1__GU131963__SS-prME
  source 1..9879: mol_type = other RNA
agcgtaactatgttattaatgttacttcccactgcactagcattccacttaactactcgtggaggagaaccacatatgatagtgagtaaacaagaacgaggtaaatctctactatttaaaacgagtgccggtgtgaatatgtgtacacttatagcgatggatcttggcgaactatgcgaagatacaatgacatataaatgtccacaaataacagaagcggaacccgacgacgttgattgctggtgcaatgccacagatacatgggtaacttatggaacttgttcgcagacgggagaacaccggcgagataaacgaagcgtagcactcgcaccccacgttggactcggcttagaaactaggactgagacttggatgtcatctgaaggcgcttggaaacagatacagagagttgaaacttgggcactccgacatcctggttttaccgttatagcattcttcctagcacacgcaatagggacatcgatcacacagaaaggaattatatttatacttttaatgctagttaccccttcaatggcaatgagatgtgtaggaataggtaaccgagactttgtcgaaggactgtccggagcaacttgggtcgacgtagtactcgaacacgggagttgcgtaaccacaatggctaaaaataaaccaacattagatattgagctgttaaaaacagaagttactaaccccgcaattttgagaaaactatgcatagaagcaaaaataagcaacactactacagactctagatgccctactcagggcgaggctacgttagttgaagaacaagacgcaaacttcgtttgtagaagaacgtttgtggatcgtggttggggaaatggttgtggtttgtttggaaaaggttctctactaacttgtgcaaaattcaaatgtgtgaccaaactagaaggaaaaatcgttcaatacgaaaacctcaaatatagcgtcatagtaactgtgcacacaggagaccaacaccaagtaggtaacgagacaactgaacacgggacgatcgcaacaattacaccccaagcccctacttctgaaattcaattaacagactatggcgctctaacgcttgattgttcgcctagaactgggctcgacttcaatgaaatggttcttcttactatgaaagagaaaagttggttagtgcataaacagtggttcctagatttaccacttccttggacaagtggtgcaagtacaagtcaagaaacgtggaatcggcaggatctacttgtcacttttaaaacagcacacgccaagaaacaagaagttgtcgtgctaggttctcaagagggtgcgatgcatacggcattaacaggtgctacagagattcaaacgtcagggacaaccactatatttgcaggacatttaaaatgcagactaaaaatggataaattaacgcttaaagggacgtcctatgtcatgtgcacaggctcatttaaactagagaaggaggttgcagaaacacaacacggaacggtactcgttcaagtcaagtacgaaggcactgatgcaccctgcaaaatcccctttagtacgcaagatgaaaaaggggtaactcaaaacggtcgactgattacagccaacccaatcgttactgataaagagaagccggttaatattgaaaccgaacctccatttggcgagtcatatatagttgtaggggctggtgaaaaagcgcttaaacttagttggtttaagaaaggatcctcaatagggaaaatgtttgaagccacggccaggggagcaagaagaatggccatattaggagacacagcatgggattttggcagcatcggaggtgttttcaccagcgtagggaaacttgtccatcaagtctttggtactgcttatggagtattattttctggagtgagctggactatgaaaatagggatcggaatattactaacatggcttggattaaatagtagaagcacctctctaagtatgacttgtattgcagttggtatggtaactttgtatctcggtgttatggtgcaggcagatagtggctgcgtaattaattggaaaggccgtgaattgaagtgtggtagcggaatatttgtaaccaatgaagtgcatacatggacagaacaatacaagttccaggcagattcccccaagcgcctctcagcggcaataggtaaagcatgggaggaaggggtctgcggaataagatcagcgaccagactagagaatattatgtggaaacaaatttccaatgaactaaaccacatccttcttgagaatgatatgaaattcaccgtcgtggtaggagatgcgaatggaatcttagcacagggcaagaaaatgattcgacctcaacccatggaacataaatatagctggaaatcgtggggaaaggcgaaaatcattggagctgatatacaaaacacgacttttattatagacggacccgataccccggaatgcccggacaatcaacgggcatggaacatatgggaagttgaagattacggtttcgggatatttactactaatatatggctgaagttaagggatagttatacacagatgtgtgatcacagactcatgtcggcagctataaaagatagtaaagccgtacatgcagacatgggatactggatagaaagtgaaaagaatgaaacgtggaaactcgcaagggcaagttttatcgaagtaaagacctgtacatggcctaaaagtcatactctctggagtaatggagtcttagaatcggaaatgataatacctaaaatttacggtggtccaataagtcaacacaattaccgtccaggatattttacacaaacagccggaccatggcatcttggtaaattagagctcgacttcgacttgtgtgaaggaactacggtagtagtggatgaacactgtggaaacagaggaccgtctctcaggaccacaacagtaactggcaaaatcatccacgagtggtgctgtagatcttgtactttgccgccgctaaggtttagaggagaggacggttgttggtacgggatggaaatccgacctgttaaggaaaaagaagaaaacctggtgagatctatggtaagcgccggctcaggggaagttgacagcttctctttgggaatattatgcgtaagcataatgattgaagaagttatgagaagtcgttggagcagaaaaatgcttatgacaggaacactcgccgtatttcttctcctagttatgggacaattgacttggaacgacctaattagattatgcataatggtcggggcaaacgcttcagatagaatgggcatggggactacatatctggcactcatggcaacattcaagatgcgaccgatgtttgcagttggactattatttcgcagactgacctcacgagaagtgcttcttctaactatcggattgagcttagtcgcatccgtagaactgccaaattcattagaggaattaggtgatgggttagctatgggtattatgatgctaaaattacttacagaatttcaaccacatcaattatggacgacgctattgagtctcacatttataaaaactactttatctttagactacgcgtggaaaacaactgcaatggctctatcaattgtatctctctttcctctgtgtttatcaactacctcacagaaaactacttggctacctgtactacttggatccttcggatgtaagcccctaacaatgttcctgataactgaaaataaaatatggggccggaaaagttggcctttaaacgaaggcataatggcaatcggcatagtgtctatacttctaagttcactcttaaagaacgacgtgcctttggcaggtcctctcattgccggaggaatgttaatagcttgttatgtgatttctgggtcctcagcagatttaagtttagaaaaagcagctgaagtgtcctgggagcaagaagctgaacattcaggcacctcacacaatatattagtggaggtacaagatgatggtactatgaaaattaaggatgaggaaagagatgatacgttaacaattttactaaaggctactttactagctgtctcaggtgtctacccaatgtctattcctgctacactgttcgtgtggtatttctggcaaaagaagaaacaaagatcaggggtcctatgggacacaccatcacctcccgaagttgaacgtgctgttcttgacgatggaatctacaggattctacaaagagggttacttggacgatcccaggttggtgttggggtttttcaagatggagtgttccatacaatgtggcacgtaacacggggagcagtgttgatgtatcaaggtaaaagattagaaccttcttgggcttcagtgaaaaaggacctgatatcatacgggggaggatggagattccaaggcagttggaataccggggaggaggttcaggttatagcagtcgaaccgggcaagaatcccaaaaacgtgcagacgacaccagggacttttaaaacacctgaaggagaagtcggtgcgatcgctcttgacttcaaaccaggcacctcaggaagccccattgttaatagagaggggaaaattgtaggtctatatggaaatggcgtagtaaccacctctggaacatatgtttcagcgatagcgcaggcaaaagcgagtcaggagggtcctctccccgaaattgaagacgaagtttttaagaaaagaaatcttacaataatggatctacatccgggaagtggaaagactagacgctatctaccagcaatcgtacgagaagctataaaacgaaaattgagaaccctgattttggctcctacaagagttgtagcatcagaaatggcagaagcgttgaagggaatgcccattcgttatcagacgacagcagtcaaaagtgaacacacgggcagagagatcgttgatcttatgtgtcatgccactttcacaatgcgactgttatctcctgttcgcgtaccgaattataatatgataataatggacgaagcgcactttacagatccagcatctattgcggcaagaggttatatttctactcgtgtaggaatgggagaagctgccgctatatttatgaccgccacgccacccggttcagtagaagcgtttccgcaatcaaacgcagtcatccaagacgaagaacgggacatacccgaaaggtcttggaatagtgggtacgactggataactgatttcccaggtaaaacagtatggttcgttccatcaattaagtctgggaatgatatcgctaattgtctacggaaaaacgggaagagggttattcaactaagtcgaaaaacttttgatacggaatatcaaaagaccaagaataatgattgggactatgtagtaaccacagacatttctgagatgggagcaaattttcgagctgacagagtgattgatcccagaagatgcctgaaacctgtcattctcaaggacggtccagaaagagtaatactagcaggaccgatgccagtcacggtagcatcagcagcacaacgaagaggtcgcattggaagaaaccaaaataaagagggtgaccagtacgtttatatgggtcaaccattaaacaacgacgaagaccatgcacactggacggaggcaaaaatgttactagacaatattaatacaccagaagggatcatcccagcattattcgaaccagagcgcgagaaatccgcagctatagacggagagtatagactaaggggagaagctcgcaaaacatttgtagaactgatgcgtcgaggtgatttaccagtctggctgtcgtataaggtcgctagcgaaggattccaatattctgatcgaaggtggtgctttgatggagaaagaaacaatcaagtacttgaggaaaatatggatgttgaaatctggaccaaagaaggagaacggaagaaattacgtccacgatggcttgatgccagaacttatagcgatccactcgcattgagggagttcaaagagttcgcggcaggaaggaggagcgtgtcaggcgacttgatcttagagattggaaagttaccacaacatttaaccctgcgagcccaaaacgcgttggacaatctcgtgatgttacacaattctgaacaagggggaaaggcttatcgtcacgcaatggaagaattaccggatactatagaaactctgatgttattagccctgatagcagttctcacgggcggcgtcacattatttttcctttcaggcaagggattaggtaaaacatcaattgggctgctatgtgttacagccagttcagctcttttatggatggcatcggtagaaccacactggatcgcagcaagtatcatattggagttctttcttatggtattacttatacctgaacctgaccgtcaaagaacgccacaagataatcaattggcttatgttgttatagggctattattcatgatactaacagttgcagctaatgaaatgggtttattggagacaactaagaaagaccttggtatcggacatgttgccgctgaaaatcatcaacatgcaactatgcttgatgtagatctaaggcctgcttctgcctggacactatacgcagtggctactactgtaattacgcctatgatgcgacacactattgagaatactaccgctaacatctctctgactgccattgccaatcaggctgccattctcatgggactagataaaggctggccaatttccaaaatggacattggagtaccgctgctggctctaggatgctattcccaggtaaatccactgaccctgacggcagctgtacttatgttggttgctcattatgctataattggccctggtttgcaagcgaaagcaaccagagaagctcaaaaacgtacagccgcaggaattatgaaaaatcccacagttgacggaatagtggcgatcgatttggacccagtagtctatgatgcaaaatttgaaaaacagttgggacaaataatgttattaatcctctgtacttctcagatacttttgatgagaacaacatgggccttatgtgaatccattactctcgcgacaggaccactgacaacactttgggaagggtctccaggaaaattttggaacacgaccatagcggtatctatggcaaatatatttagaggatcatacctagccggagccgggttagcgtttagccttatgaaatcacttggtggcggacgtagaggaaccggggcgcaaggcgaaacccttggtgagaaatggaaacgacagcttaatcaacttagcaaatctgaatttaacacttataaacgatcaggtataatggaagttgatagatcggaagccaaagaaggacttaaacgaggtgagacgacaaaacacgcagtgtcgcgaggtacagctaaattaaggtggtttgttgagaggaacttggtaaaacctgaaggaaaggtgatcgacctaggatgcggacgcggcggttggtcttactactgtgcgggcctaaagaaagtaaccgaagtaaaagggtacaccaaaggcggacccggacatgaagaacctatcccgatggcaacatatggttggaacctagtaaaactccattcaggaaaagacgtgtttttcatgccgcccgaaaaatgcgatacactgctgtgcgatataggagagtcaagtcctaatccaacgatcgaagaaggaagaactctcagagtacttaaaatggtcgaaccatggttacgtggcaatcagttctgtattaaaatacttaatccctacatgccgtccgtcgtagaagccctggaacaaatgcaacgaaaacatggaggaatgcttgtaagaaatcctttatcaagaaactctacacacgaaatgtactgggtaagttgtggcacaggtaatatagtttcagcggtaaacatgacaagccgcatgttgctaaatagattcacgatggcccacaggaaaccaacatacgaaagggatgtagacctcggagcaggtactcgtcacgtagccgtcgaaccagaagtagcgaacttagatatcataggacaaagaattgaaaatatcaaaaatgaacataaatcgacctggcattacgatgaagataatccttataagacatgggcataccatggaagctatgaagttaaaccaagcggctctgcttcatcgatggtaaacggtgttgtgagactattgacaaaaccctgggatgtgatccctatggtaactcagatcgcaatgacagacacaacaccctttggccaacaaagagttttcaaggaaaaagtagacaccaggactcctagggctaaaagaggaacaacacaaataatggaagtcacagcaaaatggctgtggggcttcctgtctagaaacaaaaagcctcggatatgtaccagggaggaatttacacgaaaagtcagatcgaatgcagcaataggggcagtatttgtcgatgagaatcagtggaactcagccaaagaagcagtcgaagatgaacggttctgggatcttgtccatagggaaagagaattgcacaaacaaggtaagtgtgctacatgtgtctataacatgatgggaaagcgcgagaagaaattgggcgaatttggtaaggctaaaggttcacgcgcaatctggtatatgtggttaggagctcgtttcttagagttcgaagccctaggttttatgaacgaagaccattggttctcccgcgagaatagcctaagcggagtagaaggggaagggttgcataagttaggttacatattaagagatatatcaaaaatccctggtggaaatatgtatgccgacgacacagccggatgggacacaagaattaccgaggatgatctacagaacgaggccaagataacagagattatggaacctgaacatgccttactagcaacgagtatttttaaactaacataccaaaataaagtagtaagagtacaacgcccggcgaaaaatggaacagtaatggatgtcatttctaggagagatcaaaggggcagtggacaagtaggtacatacggtctaaatacattcaccaatatggaagtgcaacttataagacaaatggagagtgaaggaatattcctaccctctgagttagaaacgccaaatttagccgaaagagtgctcgactggctggaaaaacatggtgccgaaagactgaagaggatggcgatatcgggcgacgattgcgttgtgaaacctatcgatgataggttcgcgacagctctaacagcacttaacgatatgggtaaagttcgaaaagacatcccgcaatgggagcccagtaaaggatggaacgactggcaacaagtgccattctgctcgcatcatttccaccaattgattatgaaagatgggcgtgaaattgtagtcccttgtcggaaccaagacgaattggtaggtcgggctagagtaagtcaaggtgccggttggagtttaagggaaactgcctgtctcggaaaatcatatgcgcaaatgtggcaactaatgtatttccacagacgagatttgcgtcttgcagccaacgcaatatgttctgcagtccctgttgattgggttcctacaagccggaccacatggtctatacatgcacaccaccagtggatgactactgaagacatgttatcggtttggaacagagtttggattgaagagaacccctggatggaagataagacacaagtaagcagctgggaagaggtcccatacttgggtaaaagggaagatcaatggtgtggttcccttataggcttaaccgcccgagcaacatgggctaccaacatccaagtagcgataaatcaggtaaggcgcttaataggcaatgaaaactatttagattacatgacttcaatgaaacgtttcaaaaacgaaagtgatcccgaaggagctctgtggtaa

SEQ ID NO: 21232 - RNA, 9879 nt, synthetic construct
  misc_feature 1..9879: note = derived and/or modified CDS sequence (opt6) from DENV-1__KF955442__SS-prME
  source 1..9879: mol_type = other RNA
agcgtaactatgcttttaatgctgttacctactgcacttgcattccatctaactacacgcggaggcgaaccccatatgatcgtatccaaacaagaacgtggcaaatctcttttatttaaaacgtcagcgggtgtaaatatgtgcactttaatagcaatggatttaggggaactgtgcgaagacactatgacttataaatgcccacagatcactgaagccgaacccgacgatgtagattgctggtgtaacgcaactgacacatgggttacatatggaacctgtagtcaaacgggtgaacatcgaagagacaaaagatcagtagccctagctccacacgtaggactagggttagaaacaaggacggaaacatggatgtcatcagaaggagcctggaaacaaatacagagggttgaaacttgggccctaagacatcccggatttactgtaatcgcactattcttagctcacgcgatagggacatctattactcagaaaggaataatttttatactactaatgttagtcaccccttcaatggcaatgcgttgtgtaggcataggaaaccgagactttgtcgaaggactgtctggcgctacatgggtagacgtagttctcgaacatgggagttgtgtcaccactatggccaaaaataaacccacactagatatcgaattgctaaaaacagaagtaacaaacccagcaatattgcgcaaattatgtattgaagcaaaaatcagtaacaccacaacggattcaagatgtccaacccaaggtgaagcaacattggtagaagaacaggacgcgaattttgtatgtaggcgtacatttgtagatcgaggttggggtaacggttgtggtctatttgggaaagggtcactcttaacatgtgcaaagtttaaatgcgtcacaaagttggagggaaaaatcgttcaatacgaaaacttaaaatattcggttatagtaacagtgcatactggtgatcagcaccaagtagggaatgaaacaacagagcacggtacaatcgcaactataacaccacaagcaccgacaagtgaaatccaactaacagattatggagcacttacattggattgctctcctagaacagggctagactttaatgaaatggtacttctaacaatgaaggaaaaatcatggcttgtacacaaacagtggttcctcgacttgcccttaccatggacatcaggagcatcaacttctcaagagacctggaatcgtcaagatctattagttacatttaaaacggcacacgccaagaaacaagaggtcgttgtcctaggaagtcaagaaggcgcgatgcatactgctcttacaggtgctacagaaatacagaccagcggcactactaccatatttgcgggtcacttgaagtgcagactaaaaatggataaacttacactaaaaggaacatcatacgtgatgtgtacaggatcattcaaactagaaaaagaggtagcagaaacccaacatggcacagttcttgtgcaagtcaaatatgaaggaaccgatgcaccatgcaagatcccattctcgacgcaagatgaaaaaggagtcactcaaaatggacgtttaatcacagcgaacccaatagtgacagataaagaaaaaccggttaatatagaaacagaacctccattcggtgaaagttatattgtagttggtgccggagaaaaggcattgaaattaagttggttcaagaagggttcaagcatcggtaagatgtttgaggcaaccgcacggggagcaagacgaatggccatattaggagacacggcttgggatttcggttcaataggtggagtgttcaccagtgtgggcaaacttgtccaccaagtcttcggaacagcgtatggcgtactgtttagtggtgtttcatggacgatgaaaattggcattgggattttgctaacatggctaggcctaaattcccgcagtacatcattgagtatgacatgtatagctgttggaatggtcaccttgtatctaggagttatggtacaagcggattcaggctgtgtaatcaactggaaaggcagagaattaaaatgtggctcaggcatattcgtcacaaacgaagtacacacttggaccgaacagtataagtttcaagccgactcacctaagcggttaagcgccgcgattggtaaggcgtgggaggaaggtgtatgcggaatcagaagtgctactagattggaaaatatcatgtggaagcaaataagcaatgaacttaaccacattctattggaaaatgatatgaaatttacagtggtagtaggtgatgcaaatggtattctagcccaaggtaagaaaatgattcgcccacagccaatggaacacaaatatagttggaaatcatggggcaaagccaaaataataggtgcagatatccaaaataccactttcatcatagatggtcctgatactccagaatgcccggataatcagcgagcatggaacatatgggaagtagaagattatggatttggtatttttacgacaaatatctggctaaaactaagagattcttacactcaaatgtgtgaccacaggctgatgtcagctgctatcaaggattctaaggcagtgcacgctgatatggggtactggatcgaaagtgagaaaaacgaaacttggaagctagctagagcgagctttatcgaagttaaaacgtgtacctggccaaaaagtcatacactatggtctaatggagtcttggaatctgaaatgataataccgaagatatatggaggtccaatctcccaacacaactatcgtcctggatatttcacgcaaacagcagggccatggcatttaggaaaacttgaacttgattttgacttgtgtgacggaaccacagtagtagtcgatgaacattgtggaaatcgaggacccagtttgagaacgaccacggtaactggaaaaatcattcatgagtggtgttgccgatcatgtacattacctcctttaaggttcagaggagaggatggctgttggtacggaatggagattagacccgtaaaggagaaggaggaaaacctagtcaggtccatggtaagtgctggttctggtgaagtagattcgttttcattggggattttgtgtgcttcgattatgatagaagaagtcatgcgaagtagatggagcagaaaaatgctgatgactggaacgctcgccgtgtttctgctcctcataatggggcaactaacgtggaatgatttgatccgactatgcattatggttggagcaaatgcaagcgatcgaatgggaatggggaccacttatttggcattaatggccacatttaagatgagaccaatgttcgcagttggactgttgttccgaagattaacgtcgagagaagtgctattattaacaattggcctttcgttggtagcatccgtcgagttaccaaattcactcgaagaattgggtgatgggttggctatgggcataatgatgcttaagttactgactgaatttcaacctcatcaactgtggacaactctactttctcttacatttattaaaaccacattgagtttagattatgcttggaagacaactgcaatggccttgtctatcgttagcttatttccattatgcctctctacaacgtcacaaaagaccacatggctaccagtattgctcggtagcttcggatgtaaaccactaactatgttccttatcactgagaataaaatatgggggcgaaagagttggccattgaatgaaggtatcatggcaatcggaatagtaagtatccttcttagctcattgctgaaaaacgatgtacctctcgcggggcctttgatagctggtggaatgttaatagcatgttacgttatatccggttcttctgcagatctatcattagaaaaagcagcagaagtatcttgggagcaagaagcagaacattcaggaacatcacacaatatattagtagaggtccaggatgatggtacaatgaagattaaagatgaagaaagggatgatacgctgaccatcttactcaaagcaacactattagctgtgtctggagtgtatcccatgtcgattccagcaactctttttgtatggtacttctggcaaaagaagaagcaacgaagtggagtattatgggatacgccctcaccacctgaagtggaacgggcagtactagatgacgggatatacagaatcttacagcgagggttgctcggcagatctcaagtaggagttggcgtgttccaagacggagtatttcatacgatgtggcatgtgacgaggggagccgtacttatgtaccaaggtaaacgactagaaccctcatgggcatcagtcaagaaagatcttataagctatggtggaggttggcgttttcagggatcgtggaatacaggagaagaagtacaagtcatcgcagtcgagcctgggaaaaatcctaaaaatgttcaaacaactcctgggacttttaaaaccccagaaggtgaagtaggagcaatcgcactagactttaaacccggcacgtcgggatcgcccatagtaaaccgagaagggaaaatcgtagggctatatggaaatggagttgtgactacatcaggtacatatgtctcagcaatagctcaagcaaaagcatctcaggaaggccctttgccagaaatagaagatgaagtttttaagaaaaggaatctcacgataatggacctgcatcctggatccggcaaaacgagacgatatctccctgcgatcgtaagagaagcaattaagaggaaattacgtacactcattttagcacctacacgtgtcgtggcttctgaaatggccgaagcattaaaaggtatgcctatccgttatcaaactactgccgtgaaatcagagcatacggggcgtgaaattgtagacctcatgtgccatgccacttttactatgagactgttgtcacccgtcagagtgccaaactataacatgataattatggatgaagcccacttcaccgaccccgcgtccattgcagctagaggctacatttctactagggtgggaatgggagaggcagcagctatatttatgacagcgacaccacccgggtccgttgaagccttcccccaaagtaatgcagttatacaagacgaagaaagggacattccggaaaggagttggaactctggctatgactggatcactgactttcctgggaagaccgtatggtttgttccttctatcaaaagcggaaacgatattgccaattgcctacggaaaaatggaaagagagtcattcaactttcaagaaaaacctttgacactgaatatcagaaaactaagaacaatgattgggattacgtagttactacagatatttcagaaatgggagcgaattttagagccgaccgcgtcatagacccccgtagatgtttaaaacctgtaattctcaaagatggaccagaaagggtcatacttgccggtcctatgcctgtaactgtcgcatcggccgcacaaaggcgaggaaggataggaagaaaccaaaataaagaaggtgaccaatacgtatatatgggccaaccgcttaataatgacgaagatcatgcgcattggacggaagcaaaaatgctattagacaacattaatactcctgaaggtataatacctgcattatttgagccagaacgtgaaaagtcagcagctatcgatggagaataccgcttacgaggcgaagctaggaaaacattcgtagagttgatgagaagaggcgatttgcccgtgtggctgagctacaaagttgcaagtgaaggatttcaatatagcgataggcgatggtgcttcgacggtgaacgtaataatcaagtcttagaagaaaatatggatgttgaaatttggaccaaggaaggtgaaaggaagaaactcagacccagatggttagacgcacgtacttattcagacccattagcattacgtgagttcaaggaatttgcggccggcaggagaagcgtttctggggatttgatcctagaaattggtaaactacctcaacaccttacgctgcgagcacagaacgcattagataatctcgttatgctccataactcagaacaaggcggtaaggcctacaggcacgcgatggaagaattacccgacactatcgagacattaatgttgcttgccttaatagcagtactcactggaggggtcacactattctttttaagtgggaaaggtttaggaaagacaagtataggcctgttgtgtgttaccgcaagtagcgcattactctggatggccagcgtggaaccacactggattgctgcttcgataatactcgagttctttcttatggtcttattgatacctgaaccagacaggcagagaacaccacaagataatcaacttgcatatgtcgttataggccttttatttatgatattaactgtggccgccaatgaaatgggactcctagaaactacaaagaaggatctagggataggacatgtagcagcagagaatcatcaacatgctactatgcttgacgtagatcttagaccagcgagtgcttggacactatatgcagttgcaacaactgttataactcctatgatgcgacacacaattgaaaatactaccgcaaatatatcactaaccgctatcgcgaatcaagctgctatattaatgggactcgataaaggatggccaatttccaagatggacataggggttcccctactagccttaggctgttatagccaagtgaaccccttaacattaactgccgcagttttaatgttagtcgcacattatgcgataattggtcctggtctgcaagcgaaagctacaagagaagcacaaaaacgaaccgcagcaggcattatgaaaaatccaactgtagatggcatagttgcaattgatctagatccagtggtatatgacgcaaagttcgaaaaacaattaggacaaatcatgcttttaatattatgtacgagtcagatactacttatgcgaactacttgggcactgtgcgagagcataacattagcgacaggtccactgaccacactatgggagggaagtccaggaaaattttggaataccacaattgctgtttcaatggcgaatatcttccgtgggagctatttagcaggggcaggattggcgttttcattgatgaagtcactaggcgggggaagacgcgggactggcgcacagggagagactcttggtgagaaatggaaacgtcaactcaaccaactatctaaatctgaatttaacacatataaacgaagcggtatcatggaagtcgacagatcagaagcaaaagagggacttaaaaggggtgaaacgacaaagcacgctgtaagtaggggaacagccaaactgcgttggtttgtagaacggaacctagtaaaacccgaagggaaagtgatagatctcggctgtgggcgtgggggatggtcatactactgtgcaggactaaagaaggtgactgaggtaaaaggatatacaaagggagggccgggacacgaagaaccaatcccaatggcaacctatggatggaatctggtaaaacttcactcgggaaaagatgtatttttcatgccacccgaaaaatgcgatacattattatgcgacattggtgaaagttcgccaaaccccactatagaagaagggagaacattacgagttctaaaaatggtggaaccgtggcttaggggaaatcaattttgcataaaaattttaaatccgtacatgccgtcagttgtcgagactttggaacaaatgcaaagaaagcatgggggaatgttagtgaggaatcctctctctaggaacagcacacacgaaatgtattgggtcagttgcggcacaggaaatattgtaagtgccgttaacatgacatctagaatgctgctcaacaggttcacaatggcacatagaaaacctacgtttgagcgagatgttgatttgggcgccggcaccagacatgttgcagtcgaacctgaagtggccaacctcgatatcatcggacaaagaattgaaaatatcaaaaacgagcataaaagcacgtggcattatgatgaggataatccgtataaaacatgggcttaccacgggtcatacgaggtaaaaccttcaggatctgcgagtagtatggttaatggagttgttagactgctaactaagccttgggacgtaatacccatggtaacccaaattgcaatgacagacacgaccccattcggacaacagagagttttcaaagagaaagtcgatacccgcacccctagagcgaaaaggggtactacacaaatcatggaagtcacagcgaagtggctctggggatttctatcacgcaataagaagccgagaatatgcacacgggaagaatttacacgtaaagtcaggtcaaatgctgctatcggagcagtcttcgtggacgaaaatcaatggaatagcgccaaagaagccgtcgaagatgagagattctgggatttagtccatagagaacgtgaactacacaaacaaggaaaatgtgctacgtgcgtatacaacatgatggggaagcgtgagaagaaacttggagagttcggaaaagccaaaggatccagggcaatatggtatatgtggcttggagctagatttttagagttcgaagcactcggattcatgaatgaagaccactggtttagtagagaaaactctttgagcggagtggaaggggagggactacacaaactcggatatatattaagggatataagtaaaatcccaggtggtaacatgtacgcagacgatactgcgggctgggatacgagaataacagaggacgacttacaaaacgaagccaaaattactgatatcatggaacctgagcatgcactgcttgcaaccagcatattcaagctgacttatcaaaataaagtagtaagagtccaacgaccagccaaaaatggaacggtcatggatgtaatctctagacgagatcagcgtggctcgggtcaagtagggacatacggcctaaatacgtttacaaacatggaggtacaactgatccgccaaatggagtccgagggtatattcctgcctagtgaactagagactcctaacctcgcggaacgagtactggattggttggagaagcatggtgcggaaaggctaaaaaggatggcgataagtggcgacgactgtgtagtaaaacctatagatgatcgatttgcgaccgccttaacagcattaaatgatatgggaaaggttagaaaagatatcccacagtgggaaccatccaaaggatggaatgactggcagcaggtacctttttgttctcatcattttcatcagctcataatgaaagacggccgtgagatagtagtaccttgcagaaaccaagatgagttagttggacgtgctagagttagtcagggagcgggctggtcgctacgagagaccgcgtgtttaggaaaatcttatgctcaaatgtggcaattgatgtattttcacagaagggatctgagattggctgccaatgcgatttgttctgcagtacccgtagattgggtacctacaagtagaacaacctggtctatacacgcgcatcatcaatggatgactacggaagatatgttaagcgtttggaacagagtttggattgaagagaacccctggatggaagacaaaactcacgttagctcttgggaggaggtaccctatctcggcaaacgcgaagatcaatggtgtggtagccttatcggactaaccgcaagagctacttgggctacgaacatccaagtcgcaataaatcaagttagacgattaattggaaacgaaaattatttggattacatgacgtcgatgaagagattcaaaaacgaaagcgatccggagggagctctctggtaa

SEQ ID NO: 21233 - RNA, 9879 nt, synthetic construct
  misc_feature 1..9879: note = derived and/or modified CDS sequence (opt6) from DENV-1__GU131965__SS-prME
  source 1..9879: mol_type = other RNA
tctgtcacaatgcttcttatgcttctaccaaccgcattagctttccatttgacgacccgtggaggagaacctcatatgatagtatccaaacaagagagaggcaaatctctcctcttcaaaacaagtgctggcgtaaatatgtgtactttgattgcaatggacctcggggaattgtgtgaggatactatgacatataaatgtccacaaattactgaagcagaacccgacgatgtagactgttggtgcaatgctaccgatacgtgggtaacttacggcacctgttcccaaactggagaacacagaagagataaacgatcggttgcattagcaccacatgtcgggttgggccttgaaacccgaacagaaacctggatgtcatctgaaggggcatggaaacaaatacaaagagtagaaacttgggtactccgacatccagggttcacggttattgcgttatttttagcacatgccatcggaacatcaatcacgcaaaaaggcataatatttatactactcatgcttgttaccccatccatggcaatgagatgcgtaggaataggcaatagagactttgtagaaggcctaagtggagcgacttgggtagatgttgtcctagaacacggttcctgtgtcacaacaatggctaaaaataaaccgacattggatatagaactcctcaaaacagaagttacaaacccagcgattctaagaaaattgtgcatcgaagcgaaaattagcaataccacgaccgactccaggtgcccaacacaaggggaagccacgttagttgaagaacaagacgcaaacttcgtatgcagaagaacatttgttgatcgaggttggggaaacgggtgtggattatttgggaaaggatccttgttaacctgtgcaaaatttaaatgtgttaccaaattagaaggaaaaattgtacaatacgagaacttaaaatattcagtcattgtcactgtacatacaggcgaccaacatcaggtcggcaacgaaacaactgaacacggaacgatcgcaactataacacctcaagctcctacatcggaaatacagttaactgattatggtgcattaacgttagactgcagtccgcgcactgggcttgattttaatgaaatggtacttctaacgatgaaagaaaaatcatggcttgttcataaacaatggtttctagacttaccacttccatggacaagcggtgcatccacatctcaggagacatggaatcgacaagacctattagtcacctttaaaacagctcatgccaagaaacaagaagtagtagttttaggctcacaagagggggctatgcacaccgcccttacaggagccactgaaattcaaacctctggaaccactactatctttgctggccacctcaaatgtcgactaaaaatggataaactcacattgaaaggtaccagttatgtgatgtgtacgggatcatttaaactagaaaaagaggtcgcagaaacccaacatgggacagtattagtacaagtaaaatatgaaggaacagatgcgccatgcaaaattccgttttccacgcaagacgaaaagggcgttactcaaaacggtaggttgataaccgcgaatcctatagtaactgataaagagaaacctgtaaacatagaaacagaaccaccattcggtgaatcatatatagtagtaggagctggggagaaagccttaaaactttcttggtttaagaaaggttcatcaataggaaaaatgttcgaggctaccgcaagaggggcacgacgtatggcaatattaggagacaccgcttgggattttggatctatcggaggagtttttacatctgtggggaagttggtgcaccaagtatttggaactgcatatggagttttattttcaggtgtgtcatggacgatgaaaataggaatcgggattctcttaacttggttggggttaaattcaagaaatacatcattaagtatgacatgtatagcagtaggtatggtaacgctgtaccttggggtaatggtgcaggctgatagcggctgtgtcataaattggaaaggtagagaacttaaatgtggatcggggatattcgttacaaacgaagtacacacatggacagaacaatacaagtttcaagcagactcacccaaaagactctcagcagctataggtaaagcgtgggaagaaggagtatgcggaatacggagcgcaacgagactagagaatatcatgtggaaacaaatttccaatgagttaaaccatattcttttagagaatgatatgaaatttacagtagtagtaggagatgcaaatggaattttagcacaaggtaagaaaatgataagacctcaaccaatggaacataaatatagttggaaatcatggggcaaagcaaaaatcatcggggccgatatacaaaatacaacattcattatagatggacctgataccccagaatgtccagacaatcaaagggcatggaacatttgggaagttgaggattacggcttcggaatatttacaacaaacatttggttaaagttaagggattcttacactcaaatgtgtgaccacagattgatgagcgcggcaatcaaagatagcaaagcggtccatgcggatatgggttactggattgaatccgaaaagaacgaaacatggaagttggcacgagcatccttcatagaagtcaaaacttgtacttggccaaaatctcataccctatggtctaacggcgtcttggaatccgaaatgataataccgaaaatttatggaggacccatatcgcaacacaattatagacctggctatttcactcaaaccgcgggtccatggcacctcggaaaacttgaactcgatttcgacctatgtgagggaacaacagttgttgttgatgaacattgtggtaaccggggaccaagccttcgtactacaacagcaactgggaaaataatacacgaatggtgttgtcggtcatgcacactaccgccactaagatttagaggcgaagatggatgttggtatggaatggagatacgtcctgtaaaagaaaaggaggaaaatttagttcgcagtatggtttctgcaggatccggtgaggttgacagttttagcctgggcattctgtgcgcaagtataatgatagaagaagtgatgcggagtcggtggtcgcgaaaaatgttaatgactggaacgctagctgtgttcctattgctagtaatgggtcaattaacatggaatgacctaatacgattatgcataatggtaggagcaaatgcgtcagatagaatgggtatgggcaccacatatcttgcactaatggcgacctttaagatgcgaccaatgtttgccgtcggattgctatttagacgtttaaccagtagggaggtgctattattaacgatcggcctgagcctagttgccagtgtagaacttcccaactcacttgaagaactaggtgatggactggcaatgggtataatgatgctaaaactattaactgagtttcaaccacatcaactttggacaaccctattaagcctgacatttatcaaaacaactttgtccctagattacgcttggaagacaacggctatggccttatcgatcgttagtctttttccactatgtctatctactacatcacagaaaacaacatggcttccagtcctcttgggttctttcgggtgcaaaccactaacaatgtttctaataactgaaaacaaaatctggggtcgcaaatcctggccgttaaatgaagggataatggccataggtatagtgagcatcctattatcatcgcttcttaaaaatgacgtaccactagctgggccactaatagcaggaggtatgctcattgcgtgttacgttatttcaggttcaagtgccgatctgtctttagagaaagcggcagaagtcagttgggaacaggaagcggagcattcgggaacaagccacaacatcctcgtcgaagtacaagatgatggaacaatgaaaattaaagatgaggagcgcgatgatacccttacaattttgcttaaagcaacattattagctgtctcaggtgtctaccccatgagtatcccagccacgttgtttgtttggtacttttggcagaagaagaaacagagatccggtgtattatgggatacaccaagcccacccgaagtagaacgagcagtgttggacgatggaatttaccgtatattgcaacggggtttattgggaaggagtcaagtaggtgtaggtgtatttcaggacggagtattccatactatgtggcacgtgactcgtggggccgtattaatgtaccaaggtaaacggctagaaccaagttgggcctccgttaaaaaggatcttatatcatacggtggtggatggaggttccaagggtcttggaacacaggtgaagaagtacaggtaatagcggtagaacccgggaaaaaccctaagaatgtacagacaacaccaggaacattcaaaacccctgagggtgaagttggagccatagcactagactttaagccgggtaccagcgggagtccaattgttaaccgggaaggaaaaattgttggactatacggaaatggtgttgtaaccaccagcggaacctatgtgagtgctatagcgcaagctaaagcatcacaagaaggacctcttcccgaaattgaagatgaggtgttcaagaaacgcaatttaacaataatggatttacacccgggttcaggaaaaacacgacgctatttacctgcaatcgtaagggaagcaataaaaaggaaattaagaacactaattttagctccaacacgagtagttgcaagtgaaatggccgaagcgctaaaaggaatgccgatacgatatcaaacaacagcagtaaaaagcgaacatactgggcgggaaattgtagatcttatgtgtcatgcaacgtttacgatgaggttactaagccctgtaagagtgcctaattataacatgatcattatggatgaagcccactttactgatccagccagcatagcagcaagaggttatatatctacgagggttgggatgggtgaggcagctgccatctttatgacagcgaccccgccaggatccgtcgaagcgtttcctcaatccaatgcagtaatccaggatgaagaacgagacatcccggaaagaagctggaactccggttacgactggattactgactttcccggtaagacagtatggtttgttccttctatcaagagcggcaacgacatcgcaaactgtctcaggaaaaacgggaaaagggtgatacaactgagtcgcaaaaccttcgacaccgagtatcagaaaaccaaaaataatgattgggattatgtagttactacggatatatcggagatgggagctaatttcagggcagaccgagtcatagacccgagaaggtgtctcaagccggtaatattgaaagacggtccggaacgtgtaatactagcgggtccaatgcccgtaacagttgcaagtgcagcacaacgacgtggaaggattggacgaaatcagaataaagaaggcgatcaatacgtttatatgggacaacccctgaataatgatgaagatcacgctcactggacagaagcaaagatgttattggataacatcaacacccccgagggcatcataccggcgctctttgaaccagagcgggaaaaatcagcagcaatcgatggagaatatcgattacgtggtgaagctcgtaaaacattcgtcgaattaatgagacgaggggaccttccagtatggttatcgtataaagtagcttcagagggatttcagtactccgatagaagatggtgttttgatggagaaagaaataatcaggttttggaggaaaacatggatgtagagatttggacaaaagaaggtgaaaggaagaagttaagaccacgatggttagatgcgagaacatacagtgaccccttagcgctacgagaatttaaggaatttgcagcaggaaggagatcggtttccggtgatttaatacttgaaataggtaaactacctcaacatctaacactccgagcacaaaatgctttagacaacttggttatgctacacaattcagaacaaggtggaaaagcatatcgccatgcaatggaggaactgcccgacactatcgaaacattaatgttgcttgcattaattgctgtcttaacaggtggggttacattattctttttatccggcaaagggctgggtaaaactagcattgggcttttatgcgtcaccgcatctagtgcattattgtggatggcatctgtagaacctcactggattgcggccagtataatattagagttctttcttatggtactgctaatacctgaacccgatcgacaacgcaccccgcaggataatcagttagcgtatgtggttataggtctattattcatgattctgacagtcgcagcaaatgaaatgggactactagaaacaactaagaaagatcttggaatcgggcatgttgctgcggaaaatcatcaacatgctaccatgttagatgtggatttacgtcctgctagcgcatggactctatacgcagttgcaactacagtaataacgccgatgatgcgacataccatcgaaaacaccacagcaaacattagcctcacagcgatagcgaaccaagcagccatccttatgggtttagacaagggatggcccataagtaagatggacataggagtaccgcttctagctctaggatgttactcgcaggtaaaccctctaacattaactgctgcagtgttaatgctagtagcccattacgccataataggacctgggctccaggccaaggccacccgagaggcacaaaaacgcacggctgcaggaattatgaagaacccaactgtggacgggattgtggcaatagatcttgaccctgtagtttacgatgcaaagtttgaaaaacagctcgggcaaataatgttactaatattatgcacgagccaaatattattaatgagaacgacatgggcactatgtgaatcaattacgttagccacaggaccgcttactactctatgggaaggaagtccaggcaaattttggaacacaacgatagccgtaagcatggcgaatatatttaggggttcttacttagcaggggccggtctggcgtttagtctaatgaaatcgctagggggtggacgcagaggtacgggagcccagggagaaactctaggggagaaatggaaacgccaactcaaccaactatccaaatcggaatttaacacgtataagcgttccggcataatggaagtcgatagatcagaagcaaaagagggcctcaaacgtggagagacgacaaaacatgccgtttcacggggaactgccaaacttcgttggtttgttgaaagaaatctcgtaaaaccagaaggaaaagtgattgacttaggatgcggtcgagggggatggtcatattactgtgccgggctaaagaaagtcaccgaggtaaaggggtatactaaaggtggcccaggccacgaggaaccgataccaatggcaacatatggatggaacttggtcaaactacatagcggtaaagatgttttctttatgcccccagaaaaatgtgacacattactttgcgacatcggtgaatcctcgccaaatccaacaatagaggaaggtcgtacgttaagagttttaaaaatggtggaaccatggttgagaggaaaccagttctgcatcaagattctgaacccttatatgccttctgtcgtagaaacccttgaacagatgcaaagaaaacacggaggtatgctagttagaaatccattaagcagaaactctactcacgaaatgtattgggtatcctgtggtaccggaaatatagtttcggccgtaaacatgacatcgagaatgcttctaaaccgctttactatggcccacagaaaacctacatacgaaagagacgtggatctaggagcaggtaccagacacgtagcagtggaaccagaggtcgcaaacctcgatatcatcgggcaacgaattgaaaacattaaaaatgaacacaaaagcacatggcattacgatgaagataatccatacaaaacgtgggcttatcatgggtcatatgaagttaaaccatccggatccgcttccagtatggtcaatggggtagtaaggctactaacgaaaccttgggatgtaatcccgatggtcactcagattgccatgacggatacaacaccattcggacagcagagggtttttaaagaaaaggttgacacacgaacaccaagagctaaaaggggaacaacacaaatcatggaagttactgcaaaatggctctggggtttcctatcaagaaataagaaacccaggatttgcactagagaagagttcaccagaaaggtaagatcaaacgctgcgataggtgccgttttcgtagatgaaaatcaatggaacagcgccaaggaagcggtagaagatgagcgattctgggacttagtgcaccgtgaaagagaattacacaaacagggtaaatgcgccacttgtgtatataacatgatgggtaaaagagagaagaaattaggagagtttggtaaagcaaagggttcaagggcgatctggtatatgtggctcggagctcgcttccttgaatttgaggcattggggttcatgaatgaagaccattggtttagcagagagaatagtctctcaggtgttgaaggggagggcctacataaactcggctacatattacgagatatcagcaagatacctggcgggaatatgtatgcggacgatacagcggggtgggacacgcgaattacggaagacgatctccaaaatgaggcaaaaataacagagatcatggagccagaacacgcattattagccacgagtatatttaagttgacatatcagaataaagtagttagagtacagaggccagccaaaaatgggacagtgatggatgttatatctagaagagatcaaagagggtccggacaagttggtacctacggtctaaatacgtttactaatatggaagtacaattaatacgccaaatggaaagcgaaggcatatttctaccatctgaattggagacgccaaacttagccgagagggtactagactggttagaaaaacacggggccgaacgactaaaaagaatggcaatatcaggagatgactgtgttgtaaaaccgatagatgataggtttgctactgcccttacagccttaaacgatatgggcaaggtacgaaaagatatacctcagtgggaaccatcgaaaggatggaatgactggcagcaagttccgttctgttcacatcatttccaccagctcataatgaaagatggaagagaaatcgtagtgccatgccgcaaccaagatgaactcgtgggacgagcacgcgtatctcaaggcgcaggatggagcctaagagaaaccgcatgcttaggaaaatcatacgctcaaatgtggcaactaatgtactttcatcggagggaccttaggctagcagctaacgctatttgctcagccgttccagtagattgggtgccaacttcaagaacaacatggagtattcatgctcaccaccaatggatgactacagaagatatgctatcagtttggaatcgagtatggattgaggaaaacccatggatggaagacaaaacccacgtgagctcatgggaagaggtaccctacctcgggaaacgtgaagatcaatggtgtggtagcctaatagggttaacagctcgagcgacatgggcaacaaatatccaagttgcaattaatcaggttagaagactaataggtaatgagaattaccttgattatatgaccagcatgaaaagatttaaaaatgaatccgatcccgaaggggccctgtggtga

SEQ ID NO: 21234 - RNA, 9879 nt, synthetic construct
  misc_feature 1..9879: note = derived and/or modified CDS sequence (opt6) from DENV-1__GU131966__SS-prME
  source 1..9879: mol_type = other RNA
tctgttacaatgttattgatgttactcccgacagcacttgcatttcatctgacaacacgcgggggagagccacatatgatagtcagtaaacaagaaagaggaaaatccctcctctttaaaacctcggccggtgttaacatgtgtaccttaattgcaatggacctcggtgagttatgtgaagacactatgacttacaaatgtccgcaaattacagaagcagaaccagacgatgttgattgttggtgtaatgcgactgatacatgggtaacatacggaacatgtagccaaacgggagagcatagacgcgacaaaagatctgttgcgctcgcgcctcatgttggattagggcttgaaactcgtactgagacatggatgagctctgaaggtgcgtggaaacagatacagagagttgaaacgtgggcattgcgtcatccaggatttactgtaattgctttgtttcttgcacatgcaataggtactagcataacccagaaaggaattatatttattcttttgatgctcgtgactcctagtatggctatgcgctgtgttgggattggaaacagagactttgtagaggggctatctggagcgacatgggtggacgtagtactggaacatggttcttgcgttacgactatggccaaaaataaacccacccttgacattgagctcctaaaaacggaagtaaccaacccagcgattctgcgaaaattatgcatagaggccaaaataagcaacacaacaacagacagtcgttgccctactcaaggagaagccacactggtagaagaacaagatgcaaacttcgtgtgccgaagaacatttgtggatagaggatggggaaatggctgtggactcttcgggaaaggaagtttactcacttgtgcgaaattcaaatgcgtaacaaaacttgagggcaaaatagttcaatacgaaaatcttaaatatagcgtaatagttaccgtacatacaggtgatcaacaccaggttggcaatgagacaacagagcatggtactatagctacaattacaccgcaggccccgacatctgaaattcaattgaccgactatggggctttgacattggattgtagtcctagaaccggtcttgattttaatgaaatggtactcttgacaatgaaagaaaaatcgtggcttgtacacaaacaatggtttctagatcttcctctcccatggacatcaggggcttcaacatctcaagaaacatggaatagacaagacttattagtaacctttaaaacggctcatgccaagaaacaagaagtagttgtattaggcagccaagaaggtgctatgcatacggctttaacaggtgctacagagattcagacatcaggaacaacaactatatttgcaggtcacttaaaatgtagactaaaaatggataaattgactttgaagggtacctcatatgtaatgtgcaccggttcctttaaactagaaaaagaagtcgcagaaacacagcatggaactgtactggtacaagtcaaatatgaaggcacagatgcaccatgtaaaattcctttttccacccaagacgaaaagggtgtgacacaaaacggcagacttatcacagctaatccaatcgttacagacaaagaaaaacctgtaaatatagagaccgaacccccgtttggtgagtcatacatcgttgtaggggcgggtgagaaggctttaaaattaagttggtttaagaaaggtagctcaattggtaagatgtttgaggcaacagctaggggtgcacggcgaatggctatactcggggatacagcgtgggatttcggcagtattggaggagtctttacctcagttgggaagctcgtgcatcaagtatttgggacagcctacggagtcttattttcgggagtgagttggaccatgaagatcggaataggtatactactgacttggttgggattaaattcacgaagcacttcgctatctatgacatgcatagccgtaggtatggttacactatatctaggtgttatggtacaagcagatagtggatgtgtcattaattggaaaggtcgcgagcttaagtgcggatccggcatttttgttactaacgaagtacatacttggaccgaacaatataaattccaggcagacagtccgaagcgtctctcggcagcaatcggcaaggcttgggaagaaggagtatgcggtataagaagcgctacaagattagagaatataatgtggaagcaaatctcaaacgaattaaatcacatattactggaaaatgatatgaaatttacagttgtagttggtgacgcgaatggaatattagcacaagggaagaaaatgatacggccccaacctatggaacacaagtacagttggaaatcgtggggaaaagcaaagataataggagctgatattcaaaacacaacttttattatagatggccccgacacgcccgagtgccccgataaccaaagagcgtggaacatctgggaagtagaagactatggatttggcatttttacaactaacatatggctaaagttgagagatagttatacacaaatgtgcgatcatagactaatgtcagctgccatcaaggatagtaaggcagtgcacgcagatatgggatattggatagaatcagagaagaatgaaacttggaaattagcgagagcgtcattcattgaagttaaaacatgtacttggccgaaatcacacacactatggagtaatggggtactagaaagcgagatgataataccaaagatctatggaggacctataagtcaacacaattacagaccgggatacttcactcaaacggcaggaccgtggcacttaggtaaattagagcttgactttgacctatgcgagggaacgacagttgtggttgacgaacattgtggcaacaggggcccaagtctacgaactacgacagttacaggtaaaattattcacgagtggtgctgtaggtcctgtacactacctcccttacgatttagaggagaagacggatgctggtatggcatggagataaggcctgtaaaagaaaaggaggaaaatttggtaaggagcatggtatctgcgggtagcggtgaagttgactcgttttcattaggtatattgtgtgcctctattatgatcgaagaagttatgcgaagtaggtggagtcgtaaaatgcttatgactggaactctagctgttttcctcctgttaataatgggccaacttacgtggaatgatttgataagactatgcataatggtaggagcgaatgcctcggatagaatggggatgggaacaacatatctggcactaatggcaacatttaaaatgcgcccaatgttcgcagtcggtctgctatttagaaggctcacaagtagagaagtattactcctaaccattggcctctctcttgtggcatcggtggaactgcctaattcattagaggaacttggtgatgggcttgcaatgggaatcatgatgctaaaactccttacggagtttcaaccacaccaattatggaccacactgttaagtctaacatttatcaagactacattaagtttagattatgcttggaaaactaccgctatggctttatctatagtctcactctttccattatgtctcagtactacttctcagaaaacaacatggctaccagttctgttaggcagtttcgggtgtaaaccattgactatgtttctaatcacggaaaacaaaatatgggggcgtaagtcctggccgctaaatgaaggaatcatggctataggtatagtctctatactattatcaagtctattaaagaatgacgtcccattagcgggaccactaatagcaggcggcatgttaatagcttgttatgtcataagtggatcgtcagcagatctaagtctggaaaaagcagcagaagtgtcttgggaacaggaagcagagcattccggaacaagccataatatattagtggaagtccaagacgatgggaccatgaaaataaaagatgaggaacgggatgatacattaactatattattaaaagccactttactcgcagttagtggagtatatcctatgtcaatccccgcaacccttttcgtatggtatttttggcaaaagaagaaacaaaggagcggagtactatgggacactccctcgccacccgaagtagaaagagcagtcctagacgatgggatttatcgtatactccaaagagggctcctaggtaggtctcaagttggagtcggcgtatttcaagacggagtgtttcatacaatgtggcatgtaacacgaggagccgtgttaatgtatcaaggaaaacgtttggaaccctcctgggccagcgtcaaaaaggacctaatatcgtacggcgggggatggcgtttccaaggatcttggaacactggtgaagaagtacaagtcattgccgtcgaaccaggcaaaaatcccaaaaatgtccagacaacgccaggaacattcaaaacaccagagggagaagttggagcgattgcgttggactttaaaccgggtacgtcaggatcaccgattgtaaatcgggaaggaaagatagtagggctctacggaaatggcgtagtgacaacctcaggaacatatgtgagcgcgatagcgcaagcaaaagcgagtcaagagggacctcttccggaaatagaggatgaagtttttaagaaacgcaatctaacgattatggaccttcatccaggatcgggaaagacaagaaggtatctaccagcaatagtgcgggaagcgataaaacgaaaacttcgcacgttaatattagccccaacgagagtggtggcatctgagatggcagaggctctaaaaggaatgcctatccgatatcaaactaccgcggttaaaagcgaacacacaggaagagaaattgttgaccttatgtgccatgccacattcactatgagattattaagcccagtacgtgtacccaattataacatgataatcatggatgaagctcattttactgacccggccagtatcgccgcaagaggatatataagtacgagagtcgggatgggtgaggccgcagcaatatttatgactgctacaccaccaggaagtgtcgaagcctttccacaatccaacgcagtgatacaagacgaggaaagggatataccagaaagatcttggaatagcgggtacgattggattacggactttccaggtaaaaccgtatggttcgttcccagcatcaaaagtgggaacgatattgccaattgccttaggaagaatggaaagagagtaatccaactgtcccggaagacgttcgatacagagtatcagaaaaccaagaacaacgattgggactacgtagtaaccacagacatatcagaaatgggggcaaacttcagagccgaccgggttatcgatccaagacgttgtcttaaaccagtaattctcaaggacggtcctgaacgagtaatcctcgcaggtcccatgcccgttacggtagcttcggcagcacaacggaggggaagaataggccgtaaccagaacaaagaaggagatcaatacgtctatatgggacaaccgcttaataacgatgaagatcatgcacattggaccgaagctaagatgttattagacaatatcaatacacctgaaggaattattcctgccttatttgaacccgaaagggagaaatctgcagcaatagatggcgagtataggttgagaggagaggcccgaaaaacgttcgtagaactgatgcgtcgtggagacttacctgtatggcttagttacaaagtcgcttcagaaggttttcagtattcagatagaagatggtgcttcgacggtgaaagaaacaatcaagtactagaggagaatatggatgtagaaatatggacaaaagaaggtgaacgaaagaaattaagaccacgatggctggacgctaggacttactcggaccctctagccttgcgagaatttaaagaatttgcagcgggaaggagaagtgtgtcaggggacctcattttggaaataggcaaactaccacagcatctgacattgagagctcaaaacgctcttgacaatcttgttatgctccataatagtgaacagggtggaaaggcttatagacacgcaatggaagaactaccagataccattgagactttaatgcttctagcacttatagctgtgttaacaggtggcgttacattatttttcctatctggtaaaggactaggaaaaacaagtatcggattactatgtgtaacagcttcttcagcccttttgtggatggcatctgtagaaccacattggatcgcagcatctattattttggagttctttctaatggtattgttaataccagaaccagacagacagcgaacacctcaagacaaccaactggcgtatgtcgtaatcggactcctttttatgatattgactgttgctgcaaatgaaatgggattattagaaacaacaaagaaggatttaggaattggtcatgttgcagcggaaaatcatcaacatgctaccatgctagacgtcgatctacgtccagcatcagcttggactctttacgcggtggctaccaccgttataacaccgatgatgcgccatactattgaaaatacaacagcgaacatttctctgaccgcaatagctaatcaagcagctatactgatgggattggacaaagggtggcccataagtaaaatggacattggcgttcctttgttagcactgggatgctatagtcaagtgaaccctcttacgttaacagcggcagttttaatgctggtggcgcactatgcaatcattgggccggggttacaagcgaaggcaactcgcgaagcacagaaaagaacagcggccggaatcatgaaaaaccccacagtagatggaatagttgccatcgatttagacccagttgtatatgacgcgaaatttgaaaaacagctaggccaaataatgctactaatattatgcacttcacaaattttgctgatgcgaacgacatgggcattatgcgaatcgataacacttgctacagggccactgacaacactctgggaaggtagcccaggaaaattttggaatacgaccattgcagtatcaatggctaatatatttagagggtcataccttgctggagctggactcgccttcagcttgatgaagtcactgggaggtggaagacgaggaactggggcacaaggagaaaccctgggagaaaaatggaaaagacaactaaatcaactatcaaaaagtgagttcaacacgtacagaagaagcggtataatggaagtagacagaagtgaagctaaagaaggtctcaagagaggagaaacaactaagcatgctgtctcacgtggaaccgcaaaattacgatggttcgtggagcgaaacctagtgaaaccagaagggaaagtaattgatttaggttgtggtcgaggtggatggtcatactactgcgctggcctaaagaaagtgactgaagtaaaaggttataccaaagggggacccgggcacgaagaaccgatacctatggcgacatacggatggaacttggtcaagttacacagcggtaaagatgtatttttcatgccacctgagaagtgcgataccctattatgcgacataggcgaaagctcaccaaatcccaccattgaggaaggtcggactttgagagtccttaaaatggttgagccgtggttaagaggaaatcaattttgcataaaaattttaaatccttatatgcccagtgtggtagaaaccttagaacaaatgcaacgcaagcatggcggaatgttagttcggaatccactaagccgcaatagtactcacgagatgtattgggtctcctgtggtacggggaatattgttagtgcagttaatatgacttcccgtatgttactaaatcgttttaccatggcacatcgtaagccaacgttcgagagggatgtcgatcttggagccggcactcgacacgtagcggtagagcccgaagtggcgaatctagatatcataggacaacgcattgaaaatatcaaaaatgaacataaatcaacgtggcattatgatgaagataacccatacaaaacatgggcatatcatggcagctatgaagtaaaaccatcaggaagtgctagttcaatggtaaatggggtcgtccgtttgttaaccaaaccttgggatgtcataccaatggttacccaaatagcaatgaccgatactaccccctttggacaacaacgggtattcaaggaaaaagtagatacaaggacccctcgggcaaaacgtggaacaacccaaataatggaagttactgctaaatggctatggggttttctgtccagaaataaaaagcctcgaatatgtacaagagaagaatttacaaggaaggttcgttcgaacgcggcaatcggcgctgtttttgtagatgagaaccaatggaactcagcgaaagaagccgtagaagatgaacgcttctgggatttagtacaccgagaacgtgaattgcataaacaaggaaaatgcgcaacatgcgtatataatatgatgggaaaaagagaaaagaaattgggagaatttggcaaagcaaaaggatcacgcgcgatttggtacatgtggttgggtgctagattccttgagttcgaagcattgggttttatgaatgaagatcattggttcagtcgagagaatagcttgtcaggagttgagggtgagggtctccataaactaggctacatacttcgagacatatctaaaataccaggtggaaatatgtatgctgatgacacagcaggttgggacacacgtataacagaagatgatttgcagaacgaggcaaaaataaccgatataatggagccagaacatgcacttttagccacatcaatatttaaactcacataccaaaacaaagtagtacgcgtacagcgaccagctaagaatggcacagttatggatgtaatttccagacgcgaccaaaggggctctggccaagtaggtacgtacggtttaaataccttcacgaacatggaggtgcagctaataaggcagatggaaagtgaaggtatatttttaccaagcgagttagaaactcctaatttggcagaaagggtgcttgactggttagaaaaacacggagcagaacgactaaaacgaatggcaataagcggagatgattgtgttgtgaaacctattgacgacagatttgcaacggcattaacggcgctgaacgatatgggtaaagttagaaaagatatcccacaatgggagccgagtaaaggctggaatgactggcaacaagtacctttctgcagccatcatttccatcagctgattatgaaggatggaagagagattgttgtaccctgccggaaccaagatgaacttgtaggcagagctcgcgtatcgcaaggcgcaggttggtcgttacgggaaactgcctgcctaggaaaaagttacgcacaaatgtggcagttgatgtattttcatagaagagatttaagattagccgcgaatgctatatgcagtgcagtacctgtcgactgggtacctacgtcaagaacgacttggtccatacatgctcatcatcaatggatgacaacggaagacatgctaagtgtttggaatagggtatggattgaagaaaatccatggatggaagataaaactcatgttagctcgtgggaggaagtcccatacctaggtaaacgggaagatcaatggtgcggcagcctaataggactaacagctcgtgcgacttgggcaacaaacatacaggtagcgataaatcaggtgcgccgactaataggcaacgaaaattatttggattatatgacatcgatgaagaggtttaaaaacgagagcgacccggagggagccttatggtaa

SEQ ID NO: 21235 - RNA, 9879 nt, synthetic construct
  misc_feature 1..9879: note = derived and/or modified CDS sequence (opt6) from DENV-1__GQ868501__SS-prME
  source 1..9879: mol_type = other RNA
tcggtaactatgcttttaatgttgctaccaactgcattagcgttccacctgacgacaagaggtggagaaccacacatgatagtatcgaaacaagaaagaggaaaatcgctactatttaaaacatctgctggggttaatatgtgcactttaatcgctatggacttaggcgaattatgcgaagatactatgacatataaatgtcctcaaataaccgaggcggaaccagatgacgtggactgctggtgcaacgcgacagacacttgggtaacgtacggaacatgtagccaaactggtgaacacagaagagataaacgttcggtcgcactagcaccacatgtcggcctgggtctcgaaactaggacagaaacatggatgagtagtgagggcgcatggaaacaaatacaacgagtagaaacttgggcacttcgtcacccaggtttcacagttatagcactgtttttagctcatgctataggaacatcaatcactcaaaaaggtataatatttattttattgatgctagttacgccctctatggcgatgcgttgtgttggtatcggaaatagagattttgtcgagggcttatcaggagcgacatgggtagatgtcgtgttggaacacggaagttgcgtaacaacgatggccaaaaataaacctacactcgatatcgagctacttaaaaccgaagtaacaaatccagcaatcttgcgtaaactttgtattgaagcaaaaatttcaaataccacaactgattcaaggtgccccactcaaggcgaagcaaccttagtagaagaacaagacgcaaacttcgtgtgtagacgaacttttgtagacagaggttgggggaatggatgcggcttgtttggaaaaggcagcctattaacatgcgcaaaatttaaatgtgtaacgaaattagaagggaaaatcgtacaatacgagaatttaaaatacagcgtcatcgttaccgtacatacgggtgatcaacaccaggtcggaaatgaaaccaccgaacatggaacaatcgctacaatcacacctcaagcacccacgtctgaaatacaactaaccgattatggagcattaactctagactgcagtcctagaacaggtctagattttaacgaaatggtattattgactatgaaagagaaaagttggcttgtacacaaacaatggtttctagatttacccttgccctggacaagtggcgcatctacatctcaagagacttggaatagacaggatctattagtaacctttaaaaccgctcatgctaagaaacaagaagtcgtagtactaggaagccaagaaggagccatgcataccgctttgacaggcgctacggaaatacaaacgagtggaactactacgatattcgctgggcatctaaaatgcaggttaaaaatggacaaattaacgctaaaaggtacatcatacgtaatgtgcaccggttcattcaaattagagaaagaagtagctgagacgcaacatggaaccgtgttggtgcaagttaaatatgaaggaacagatgctccctgtaaaattccattctctacacaggacgaaaaaggagtcactcaaaatgggcggctgattacggcaaacccaatcgtcactgataaagagaaaccagtaaacatagaaaccgaacccccgtttggtgaatcatatatagtagtgggtgcaggagaaaaagcattaaaattatcttggtttaagaaaggaagttctataggcaaaatgtttgaagcgactgcacgaggtgcccgaagaatggctattttaggcgacaccgcatgggatttcggctcgataggaggggtcttcacaagtgtcggcaaattagtccaccaggtattcggaacagcatacggagtattgttctccggggtatcctggactatgaaaattggaatcggtattttattaacctggttaggattgaatagtagatcaacttccctttcgatgacatgcatagcggtcgggatggtgacgctatacttaggagtaatggtacaagcagattcgggatgcgtaataaattggaaaggtcgagaattaaaatgcggaagtggaatctttgtcacaaatgaagtgcatacatggacagaacaatataaatttcaagcagacagtcccaaaagattgagtgctgctataggaaaggcttgggaagaaggcgtatgtggcatccgtagcgccacaagattggagaatataatgtggaaacaaataagtaatgagttgaatcacattttgctcgaaaatgatatgaagttcacagtcgttgtaggagacgcaaatggaatactggctcaaggtaagaaaatgataagacctcagcctatggagcataaatacagttggaaaagttggggcaaagccaaaatcataggagcagatatacagaatactacattcattatcgacgggcccgatactcctgaatgcccagataatcaacgtgcgtggaatatatgggaggtggaggattatggtttcggaatattcacgactaacatatggcttaagctaagagatagctatacacaaatgtgcgaccacagactcatgtcggcagctataaaagactccaaagcggtccatgcagacatgggatactggatagaaagtgaaaagaatgaaacatggaagttagctagggcctcgtttattgaagtgaagacttgtacttggcctaaaagccacacgctgtggtcaaatggcgtgctcgaatccgaaatgatcatacccaaaatctatggaggccccataagccaacataactaccgtccggggtactttacacaaactgcggggccttggcatcttggcaagttagaactggactttgacttatgcgaagggacaacagttgtagtggatgaacattgtggaaatcgaggtccatcactaagaacaacaactgttacaggaaaaataatacatgaatggtgctgtagaagttgtacacttccacctctaagatttcgaggggaggatggatgctggtacggcatggaaatcagaccagttaaagaaaaggaggaaaatttagtcaggtccatggtcagcgctggatccggagaagttgattcgttttctttaggtattctctgtgcgagtatcatgatagaagaagttatgcgaagcagatggagcaggaaaatgttaatgaccggaaccttagcagtatttctactactaattatgggccaattaacctggaacgacctaatacgcttatgcataatggtcggcgcaaacgcaagcgataggatgggaatgggaacgacgtacttagcattaatggcaacgtttaaaatgcgtcccatgttcgcagtagggctcttgttccgccgtctaacaagtcgtgaggtactgttgctaactataggactctcactcgttgcaagcgtggaacttccgaactcattggaagaattaggtgatggtttagccatgggaataatgatgttaaaacttttgacagagtttcagccacaccaactatggaccacgcttctgagtttaacttttataaaaacaacgttgtcacttgactacgcctggaaaaccacagccatggccttatcaatagtatctctattccctttgtgcttaagtacaacatctcagaaaacaacatggctacctgtcctattaggatctttcggatgtaaaccactgactatgtttctaataaccgaaaatcagatctgggggcgcaagtcttggccgctaaacgaaggaatcatggcgataggaatagttagtatcctgttaagtagcctgttaaagaacgacgtaccactagcaggaccactaattgccggcggaatgctaatagcatgctacgtgatatctggatcttctgcagacctgtcgctagagaaaactgcagaagtaagttgggaacaagaggctgaacactcgggcactagccacaatatcctagtagaggtacaggacgatggaaccatgaagattaaggacgaagaaagagacgatacattaactatccttctgaaagcaacgttactggccgtctctggtgtgtacccaatgtctattccagcgaccttatttgtatggtacttttggcagaagaagaaacagagatccggagtcttatgggatacaccctcgccaccagaagttgaacgagcagtactagatgatggcatatatcgtatactacaacgaggcctattgggtcgatctcaagtcggagtaggagtatttcaggatggtgtatttcacactatgtggcacgttacaagaggagccgtcttaatgtaccaaggaaaacgtttagagccgagctgggcatctgtaaagaaagatttaatatcctatgggggcggttggcgttttcaaggaagttggaacaccggagaggaggtgcaagtaatcgcggttgaaccgggcaaaaaccctaagaacgtacaaacaacaccaggaacctttaagacaccagaaggtgaagtaggcgctatagcactggatttcaagcctggtacttcaggtagtccaatagtgaacagggaaggaaaaatcgtcggactatatggtaacggggttgttactacttcgggtacctatgtctctgcaattgcacaagctaaagccagtcaagaaggtcctctacctgaaatagaagatgaagtcttcaaaaagaggaatcttaccattatggatttacacccgggatccggaaaaacacgcagataccttccagctattgtgcgagaagccataaagagaaaacttagaactcttatacttgcccctacacgagtggtagcatcggaaatggcggaagctcttaaaggtatgccgatccgataccagactacagcagtgaaatctgaacatacaggacgagaaattgttgatctaatgtgccacgctactttcacaatgagattattaagcccagtcagagtaccaaattataatatgattattatggacgaagcgcattttaccgacccagcatcaattgctgcacgaggatatatatcaacccgagtaggaatgggagaagcagctgcgatattcatgactgctactcctcctggttccgtggaagcatttccacaaagtaatgccgttattcaggacgaagaacgcgacatccctgaacgttcatggaactcaggttatgattggataacagatttccctggcaagacagtatggtttgtaccatccataaaaagtggcaacgatattgcaaactgcttgcgcaagaatgggaagcgcgttatacagctgtctagaaaaacttttgacactgaatatcagaaaaccaaaaacaacgattgggactacgttgtcacaacagatatctcggaaatgggagcaaatttccgagcagatagagtcattgacccgaggagatgtttaaaacccgttattcttaaggatggaccagaacgagtaatattagctggacccatgccagtaactgtagctagtgcggcccagcgaagaggacgcattgggagaaatcaaaataaagagggtgatcaatacgtgtatatgggacaaccccttaacaatgatgaagatcacgcgcattggaccgaggccaagatgttgttggataacataaacactccggaaggtataataccagccctttttgagcctgagagggaaaaatctgctgcgatagatggagaatatagattaagaggagaagcccgaaaaacgttcgttgaactgatgcgacgaggtgatttaccagtttggttaagttacaaagtggcctcagaaggatttcaatacagtgatagacgttggtgcttcgatggagaacgtaacaatcaggtactcgaagagaatatggacgtagaaatatggaccaaagaaggtgaacgcaagaaattaagacccaggtggttagatgcgcgtacctacagtgatccgttagcacttcgtgagttcaaagaatttgcagccggccgaagatcagtcagtggagaccttatattagaaataggaaaactaccgcaacatttgacgttaagagcacaaaacgccttagacaatctagtaatgttacataattccgaacaagggggaaaagcatatagacacgcgatggaagaacttcctgacaccatagaaacattaatgcttttagccttaatcgcggtgttgactgggggagttactttattctttctaagtggaaaggggttaggaaaaacgtctattggtttactctgcgtaactgcctcgtcagcactactttggatggccagtgtagaaccacactggatagcagctagcatcatcttggagttcttcctgatggttcttctaataccagaaccagacaggcagaggacaccccaagataaccagttagcttatgttgtaatcggacttttattcatgattcttactgtcgcagctaacgaaatgggcctcttagagactaccaagaaagacttgggcataggccacgtggctgccgaaaatcaccagcatgctacaatgttagacgtggacttacgtccagcgagtgcatggacactgtatgccgtagcaactactgtcattactcctatgatgagacacacgattgaaaacacaacggctaacatttcattgacagccatcgcgaatcaggcagcgatattaatgggattagataaaggatggcccatttctaagatggatataggagttcctttattagcactggggtgttattcacaagtcaatccccttacactaacagcagctgtattaatgcttgtagcccattatgcgattatcggacctggactacaagctaaggctaccagggaggcacaaaagcgtacggctgcgggaataatgaagaacccgactgtggatggaatagtggctatagacttagatcccgtcgtttatgacgctaaatttgaaaaacaacttggacaaattatgttactcatcctttgtacatcccagatattgcttatgagaacaacgtgggccctatgcgaatccattacgttagcaactggaccgctgactacattatgggagggctcacccggaaaattttggaacaccacaattgcagttagcatggcaaacatattccggggaagttacctcgcaggagcaggattagcgttttcactaatgaaatctttagggggcggccgacgaggtactggagcacaaggagagactttgggtgaaaaatggaaacgacaacttaatcagttaagtaagtcagaatttaacacatataaaagaagcggaatcatggaagtcgatagatctgaggctaaagaggggttaaaaagaggtgaaacaactaaacacgccgtttccagaggaactgctaaattgcgatggttcgtggaacgaaacctcgtaaaacccgaaggaaaagttatagatttgggctgtgggagaggcgggtggtcctattattgtgcaggacttaaaaaggtaactgaagtgaaaggttatacgaaaggtggtcctgggcatgaagaacctatactcatggcgacatatggctggaaccttgttgaattacattcagggaaggatgttttctttatgcctcccgaaaaatgtgatacactattatgcgatataggcgaatccagtccaaaccccactatcgaggaagggagaaccttaagagtcttaaaaatggtggagccctggttaaggggaaatcaattttgtattaagatcctaaatccgtatatgcccagcgtagtcgaaaccttagaacagatgcaacgtaaacatggaggaatgctcgttaggaatcctctaagcaggaactcgacacacgaaatgtactgggtatcatgtgggaccggaaacatagtatctgcagtcaatatgaccagtagaatgttattaaatcggtttacaatggctcaccgaaaacccacgtttgagcgagatgttgacttaggggcaggcacaaggcatgtagccgtagaacccgaagtagcgaacttagacataataggacaaaggatcgagaatatcaagaacgagcataaaagtacgtggcattatgatgaggataatccatataagacttgggcctatcatggaagctacgaagtaaaacctagcggaagtgcatctagtatggttaatggtgtcgtcagactcctaacaaaaccatgggatgtcatacctatggtcacacaaatagcaatgaccgacaccaccccattcggccaacaacgggtatttaaagaaaaagtggacaccagaacacctagggctaagaggggcacgacgcaaataatggaggtgactgcaaaatggctctggggatttttgagtagaaataagaaacccagaatctgcacacgggaagaatttacacgaaaagttagaagcaatgccgccattggagccgtttttgtcgatgagaatcagtggaactccgctaaagaagccgtagaagatgaacgtttttgggacctcgttcatagagaacgtgagttacacaagcaaggtaaatgcgcaacttgcgtgtacaatatgatgggcaagcgcgagaagaaacttggtgaatttggaaaagcaaaaggcagtagagcaatatggtatatgtggttgggggccagattcctggaatttgaagccctaggatttatgaatgaagatcattggttttccagagaaaattcgcttagcggagtagagggagaaggactacacaaactaggatatatcctgagagacatcagtaaaatccccggcgggaacatgtatgctgatgataccgcagggtgggacacccgcatcactgaagacgacttacagaatgaagcaaagataacggacataatggaaccagaacacgcacttctcgctacatccatctttaaactgacataccagaataaagtggtgcgagtacaaagacccgccaaaaatggcacagttatggatgttattagtagacgagaccagcgaggatcaggtcaagttggtacgtacggactaaacacgttcaccaacatggaggtacaattaattaggcaaatggaatctgaggggattttcttaccatcagaattggaaactccaaacttagccgaaagagtactcgattggcttgaaaaacatggagcggaacgtttgaaaagaatggctattagtggagatgactgtgtagtaaaaccaatagacgatcggttcgcaacagctcttacagcgttgaatgatatgggaaaagtcagaaaagatataccacagtgggaaccatctaagggatggaatgattggcagcaagttcccttctgtagtcatcattttcaccagttgataatgaaggatggacgagaaatagtagtaccatgccgtaaccaggatgagttagtagggcgagcacgggtatcgcaaggagctggatggtcactgcgagaaacggcatgtctgggaaagagctatgcacagatgtggcaactaatgtactttcacagacgagacttgaggttggcggcaaatgctatctgttcggcagttccagttgattgggtcccgacgagtagaacaacttggagtatacatgctcatcaccaatggatgaccactgaagatatgttgtcagtgtggaatcgggtgtggatagaagaaaacccatggatggaggataaaactcatgtgtcaagctgggaggaagttccctatctggggaagcgagaagaccaatggtgtgggtcgttgatcggtttgacagcgagagcgacgtgggcaaccaatatccaagtagcaattaatcaagtgagaagattgattggcaatgaaaattatttagattacatgacaagtatgaagagatttaaaaacgaaagcgatcccgagggagcactttggtag

SEQ ID NO: 21236 - RNA, 9879 nt, synthetic construct
  misc_feature 1..9879: note = derived and/or modified CDS sequence (opt6) from DENV-1__HQ166035__SS-prME
  source 1..9879: mol_type = other RNA
agcgtgactatgttacttatgcttcttcccactgctctagctttccacctgactactcgcgggggagaacctcatatgattgtgagtaaacaagaacgaggtaaaagtctattatttaaaactagcgctggggtgaacatgtgcacactaatagcgatggatttaggtgaattatgcgaagatacaatgacttacaaatgccctcaaataacagaagccgaaccagacgacgtggattgttggtgcaatgctacagatacgtgggttacgtatggtacgtgcagtcaaaccggtgaacataggagagacaaacgatcagtggcacttgcgccacacgtaggcttagggttagaaacaagaacagaaacatggatgagttcggaaggagcgtggaaacaaatacaaagagttgaaacatgggcactaagacatcccgggttcacagttatagctctatttcttgcccatgcaataggtacaagtataacacagaaagggattatatttatattattgatgcttgtaactccaagcatggccatgcgctgcgttgggatcggaaacagggactttgtggaaggtttatcaggagcaacatgggtagatgttgtattggaacacggaagttgcgttacgaccatggccaaaaataaacctacacttgacatcgaattattaaaaacggaagtgacaaacccggcaattttgcgaaaactctgcatagaggcaaaaatctctaatactacgacagattctcgatgtccaacgcagggagaagcaactttagtcgaagaacaagacgcaaattttgtatgtagaagaacattcgtcgacagaggctggggaaatggctgtggactctttggtaaaggcagcttactaacatgcgcaaaatttaaatgcgtaacaaagctggaaggaaaaatagtccaatatgaaaatttgaaatactctgttatagtcacagtacatacaggcgatcaacatcaggtgggtaatgaaacaaccgaacatggcacaattgctactattacaccgcaagcacctacatctgaaataaggcttacagattatggagcattgaccttagactgtagcccaaggacaggtctcgacttcaatgaaatggtccttctcaccatgaaagagaaaagttggttggtacataagcagtggttcttagacctccccttaccatggacctccggagcttcgaccagccaagagacatggaataggcaggatctattagttacatttaaaaccgctcacgctaagaaacaggaagttgtcgtcttgggatcacaggaaggtgctatgcatacagctttaacaggagcaactgaaatacaaaccagtggaacaactacaattttcgcaggacacttaaagtgccgattgaaaatggataaactcacgttaaagggtacctcctacgttatgtgcactggctcttttaaattagaaaaggaggttgctgagacccaacacggcacagtcctagtacaagttaagtacgagggaaccgatgccccatgcaaaatccctttttcgacccaagatgaaaaaggagtaacgcaaaacggtcgattaattactgccaacccaattgtaacagacaaagagaaacctgtaaatatagaaacagagccaccttttggagaatcttatatagtcgtaggcgcgggagaaaaagcactaaaactcagttggttcaaaaagggatcatcgatcggtaagatgtttgaggctaccgcaaggggagcacggagaatggcaatattaggagatacagcatgggactttggaagtataggaggagtatttacaagtgttggcaagttagtacatcaggtattcggaactgcgtacggagtactcttctctggcgtaagctggacgatgaagataggtattgggattctactaacatggttgggtctaaatagtcgaagtaccagcctaagcatgacttgtatagccgtgggaatggtaacgttgtacttgggagtaatggtacaggccgactccgggtgtgttataaattggaaaggaagagaactaaaatgtggatcagggatatttgttactaacgaggtacatacatggactgagcaatataaattccaagcagatagtccaaaaaggttgagtgcagcaataggaaaagcatgggaagagggtgtttgtgggatcaggtctgctacacgcctggaaaacataatgtggaaacaaatatcaaatgaactcaaccacattcttcttgaaaatgatatgaaatttacagtagtagtaggcgatgcaaatggtatcctcgcgcaaggtaagaaaatgattcggcctcaaccaatggaacacaaatatagttggaagtcatgggggaaggcaaagataattggggctgacatacagaatacaactttcataatcgacggacctgatacgccagagtgtccagacaaccaacgagcttggaatatttgggaggtagaagattatggttttgggatatttacaacaaatatttggttaaaattgagggattcatacactcaaatgtgtgatcatcgattgatgagtgctgcaataaaagactcaaaagctgttcatgcggatatgggttactggatagaatcagagaaaaatgagacgtggaaattagcccgagcctccttcatagaagtaaaaacatgtacatggccaaaaagccacaccttatggtccaatggtgttctcgaatccgaaatgattattccaaaaatatacggaggtcccattagtcaacataattatagaccggggtattttacccaaacagctggtccttggcacttagggaagctagagctagacttcgatttatgtgagggaacgacagttgtcgtagacgagcactgcggtaatcgcgggccgtccttacggacgaccacagtcacaggaaaaataatacatgaatggtgttgtcgatcttgcacattaccaccattaagatttcgaggtgaggacggttgctggtacggtatggaaataagacccgtaaaagaaaaagaagaaaatctcgtacgttcaatggtctccgcgggatccggagaggtcgatagtttctcattaggtattctatgtgtgtcgattatgatagaagaagttatgcgttctcggtggagccggaaaatgttgatgacaggaacgttagcagtctttcttctcttagtaatggggcaactaacgtggaatgacttaattcgcctctgcataatggtaggagctaacgcttccgatcgtatggggatgggaacgacttacctagcactgatggcgacattcaaaatgcgaccaatgttcgcagttggtctcttgttcaggagactgacaagtcgagaagttttactcctgactataggactctcattagtcgcgagcgttgagcttccaaattccttggaagaactcggcgatgggttggccatgggaataatgatgttaaagttgttaactgaatttcaacctcatcaattatggacaaccctattgtcgttgacatttatcaaaacaactctcagtcttgattatgcatggaagactacagctatggcgttgtctatcgttagcttattccctctgtgtctaagtactacttcccagaaaactacttggttaccagtgttgttaggatcttttggatgtaaaccattgacaatgttcttgattacagaaaacaaaatatggggtcgcaaaagttggccattgaatgagggaattatggcaataggtatagtatctatattgctctctagtttattaaagaatgacgtacctttagcgggacccttaatagctggaggaatgctaatagcttgctacgttatcagcggttctagtgcagatttaagcctagagaaagcggctgaggtttcgtgggaacaagaagctgagcacagcggaacctctcacaatatattagtcgaggtacaggatgacggcactatgaagattaaagacgaagaacgtgatgacactctaactatactattgaaagctaccatgttggctgtaagtggcgtatacccaatgagcataccagccacaccgtttgtatggtacttctggcagaagaagaaacaaagaattagagtactatgggatacgccctcgccaccagaggtggaaagagcagtgcttgatgatggtatatacagaatactgcaaagaggccttttgggcagatcacaagtgggtgtcggcgtctttcaagacggtgtttttcatacaatgtggcacgtaactcgaggagcagtcctgatgtatcaaggaaaaagattggaaccatcatgggcaagcgttaagaaagatttaatatcatacgggggaggttggcgttttcaaggatcatggaatacaggagaagaagttcaagttattgcagttgaacctggcaaaaatcccaagaatgtgcagactacgccaggaacatttaaaacaccggaaggagaagtaggagcaatagcgctagatttcaaacctgggacaagcggctcgccgatagttaacagggaagagaaaatagtaggactttatggaaatggggttgtaacaaccagcggtacatacgtttcggcgatagcacaagctaaagcaagccaggaaggaccgttaccagagattgaagacgaagttttcaaaaagagaaacttaactataatggatcttcaccctggcagcggcaaaacacgtagatacttaccagccatagttagagaagcaataaaaaggaaacttaggactttaatactagcacctactagagtggttgccagtgagatggctgaagcactaaaagggatgccaattcgatatcaaacaactgctgtgaagtccgagcataccggtagagaaatagtcgacttgatgtgtcacgcaacatttacaatgagactcctaagccccgttagagttccgaactataacatgataataatggacgaagcacattttactgacccggcaagtatagcggccagagggtacatttctacccgggtaggaatgggtgaagcagcagctatctttatgacagccacgcctcccggaagtgtagaagccttcccacaatctaatgccgtcatacaggacgaagaaagagacattccagaaaggagctggaactctggctatgattggataacagacttcccaggcaaaaccgtatggtttgttccttcaataaaaagcggtaatgatatagcaaattgcctcaggaaaaatggaaaacgtgtaatccagttatctcgtaaaacgttcgatacggaatatcagaaaactaagaataatgactgggactatgtagtgactacggatatatcagaaatgggagctaattttagagctgatcgggtgatcgatccacgtaggtgcctaaagcccgttattctcaaggatggcccggaacgagttattctcgctgggccgatgccagtaactgtggcttcggccgctcaaagacgaggtagaataggtcgcaaccaaaataaggaaggcgatcaatatgtatatatggggcaacctctgaataacgatgaggatcacgcacactggacagaagccaaaatgctccttgataatataaatactccagaaggtattatacccgccctattcgaaccagaaagagaaaaatccgcagccatagatggggaatataggttaaggggagaagctcgcaaaacgttcgtagaattaatgcgccgcggggacctacctgtttggctatcttataaggtggcctcagaaggattccaatattctgaccgcagatggtgttttgatggtgagcgaaataatcaagtgctcgaagagaatatggacgtagaaatctggacaaaggaaggagaaagaaagaaattaagaccgagatggcttgatgcaaggacctattcagatccccttgcattaagagagttcaaagaatttgcagcagggagacgctcagtatctggagatttaatcctagaaataggaaaactaccacagcatctaacactacgagcacagaacgcattagacaacttagtaatgttacacaattctgagcaagggggcaaagcatacaggcatgccatggaagaattacctgacacaattgagactttgatgttactagccctaatagctgttttaacaggcggtgtcacgctattctttttatccggaaaagggttgggaaaaacaagcataggtctcttatgtgtgacagcttcttctgctttactatggatggcaagcgtcgaaccacactggatagctgcgagcataatattagagttctttctcatggtattattgatcccagagcccgaccggcaacgaacaccacaagataaccaattagcgtatgttgtaataggattactcttcatgatattaactgtagcggccaacgaaatgggattactagaaactaccaagaaagacttaggcattggtcacgtggccgcggagaatcaccagcatgcgacaatgttagatgtcgatctgcgccctgcatccgcatggacattatatgcagtagctaccactgtaataacgccaatgatgcggcatacaatagaaaatacgaccgctaatataagcctcaccgcgatagccaatcaagctgcaatacttatgggtttagacaagggatggcctatttccaaaatggacatcggtgtgccattactagctttaggttgttactcacaagtaaatcctttgaccttgacagctgccgtcctaatgctagtagcacattatgcaatcataggtcccggtctacaggcaaaagcaacccgggaagctcaaaaacggactgccgctggcataatgaaaaatcctacagtagatggaattgttgctatcgacttagacccagtagtttacgatgcaaagtttgaaaaacaattaggccagataatgctattgatattgtgcacctctcagattttattaatgcgaacaacctgggcgctatgcgaatctataaccttagctacgggaccactaacgactttgtgggaaggctcaccaggaaaattttggaatacaaccatcgctgtaagtatggccaacatatttcgcggtagttacctagccggcgctggccttgctttctctctgatgaagagtttgggtggaggaagacgcggaacgggagcgcaaggcgaaacacttggagaaaagtggaagcgtcaattgaatcaactttcgaaatcagaatttaacacatacaaacgatcgggtattatggaggtggatagaagcgaagcaaaggaaggattaaagagaggagagacaaccaagcatgccgtctcacgagggaccgcaaaactgcgctggttcgttgaacgcaatctcgtgaaacccgaagggaaagtgatagatcttggatgtggacgtggtgggtggtcctattactgtgccggtctcaagaaagtcactgaagtaaagggttacacaaaagggggaccgggacatgaagaaccaatacccatggcaacatatgggtggaatttggtaaaattacattccggaaaagatgtatttttcatgccgccagagaaatgtgacacccttttgtgtgatataggcgaatcaagtccaaatccaactattgaagaagggcgaacgctccgtgttctaaaaatggtagaaccgtggcttaggggaaaccaattctgtataaaaatactgaatccctatatgccctcagtagttgaggcactagaacaaatgcaaaggaaacatggaggtatgttggttcgaaatcccttaagtcgaaattctactcatgaaatgtattgggtaagctgcggtactggaaatatagtttctgcggttaatatgacgtcaagaatgctactcaatcgatttaccatggcacataggaagccaacatatgaacgtgatgttgacctcggggccggaacaagacacgtggctgtagaacccgaagtagcaaacctggacattataggtcagagaattgaaaacattaagaatgaacacaaatccacatggcattatgacgaagacaatccatataagacttgggcctaccatggatcttacgaagtcaaacctagcggatcagcatcctcaatggttaacggtgtcgttcgtcttttaacaaaaccatgggacgttataccaatggtaacacagatagcaatgacggatactacaccatttggacaacagagagtttttaaagaaaaagttgatacaaggacaccaagagctaaacgaggtacgacacaaatcatggaggtaacggcgaaatggctctggggtttcttatcgagaaataagaaaccccggatatgtacaagagaagagtttacgcgcaaagtgcgcagtaatgccgcgatcggtgcagtatttgttgacgaaaatcaatggaactcagcaaaggaagccgtggaagatgagagattctgggatctggtgcaccgagaaagagagcttcacaaacaaggaaaatgtgcaacctgcgtatataatatgatgggcaaaagagagaagaaactaggagaatttgggaaagcaaagggtagcagagcaatatggtacatgtggttaggagcacgttttctagagttcgaagcgttgggattcatgaatgaagatcattggttcagtagggaaaactcactatcaggcgtggagggagaagggttacacaaactaggctatatactacgagacatctccaagatcccaggcggtaatatgtacgcggatgacacagcagggtgggacactaggataacagaagacgacttacaaaacgaagcaaaaattactgaaataatggagccagaacatgcattgttagcaacttccatatttaaactaacttaccaaaataaagtcgtgagagttcaaagacctgccaagaatgggaccgtaatggacgttattagccgtcgagatcagcgaggatcaggacaagtaggaacctatggattgaacacctttaccaatatggaggttcaactaataaggcagatggaatcagaaggaatctttctaccgagcgaattggagacacctaacctcgctgagagagtcctagattggttagaaaagcacggtgcggaaagattaaagagaatggcaatatcaggagatgactgcgtcgttaaacccattgatgatagatttgcgacagctctaacagccttgaatgacatgggaaaagttcgaaaagatattccacaatgggagccttcaaaaggatggaacgattggcaacaggtgccattttgttcacatcattttcatcaattaattatgaaagatgggcgagaaatagtagtcccgtgtcgaaatcaagacgaattagtaggacgcgctagagtttcccagggggccggctggtcattgagagagacggcttgcctgggaaagtcctacgctcagatgtggcaattaatgtacttccatagaagagatttgagattggctgctaatgcaatctgtagtgcagtacctgttgactgggttcccacatcccgaacgacatggtcaatacatgcacaccaccaatggatgacaacggaagatatgctttcggtttggaatcgagtctggattgaggaaaacccatggatggaagataaaactcacgtgagttcgtgggaggaggtcccctacctaggaaaaagagaagatcaatggtgcggttcattgataggccttacagcgcgagctacctgggcaaccaatattcaggtagcgattaaccaagttcggagattgataggcaatgaaaactatcttgactatatgacatctatgaagcgctttaagaatgaaagcgacccggagggagccttgtggtaa

SEQ ID NO: 21237 - RNA, 9879 nt, synthetic construct
  misc_feature 1..9879: note = derived and/or modified CDS sequence (opt6) from DENV-1__GQ868502__SS-prME
  source 1..9879: mol_type = other RNA
agtgtaacaatgttattaatgctcttacccacggcgctggcgtttcacctaacaacgcgaggaggagaaccacatatgattgtgtctaaacaagaaagaggcaaatctcttttattcaaaacaagtgctggtgtaaatatgtgtacattaattgctatggatttaggggaactctgcgaagatactatgacatataaatgtccacaaataactgaagctgaaccggatgacgttgattgttggtgcaatgctaccgatacttgggtgacatacggtacctgtagccaaacaggtgaacacaggagagacaaaagaagcgtagccttggctcctcatgtagggttaggactggagacacggaccgaaacgtggatgtcgtctgaaggagcctggaaacagatacaacgagtggaaacgtgggcactgaggcatcccggattcactgttatagccttatttcttgcccatgctattggtacctcaattacacaaaaaggtacgatatttatacttctaatgctagctacaccgtcaatggcaatgaggtgcgttggtataggcaaccgtgattttgtagaagggttaagtggtgcaacctgggtcgatgttgttctagaacatggcagttgtgttacaactatggctaaaaacaagccgaccttggacatagaattattaaaaacggaagtgacaaatccagcaatactgagaaaattatgtattgaagctaagataagtaacaccactacggactccaggtgccctactcaaggagaagcaacgctagttgaagaacaagatgccaatttcgtatgcagaagaacgttcgtagaccgaggatggggtaacggttgtgggctctttggcaagggaagtctcttgacatgtgctaaattcaaatgtgtaacaaaattagaaggtaagaccgttcagtacgaaaacctcaaatattccgttatagttacggttcatacaggtgatcaacatcaagttggaaatgaaacaactgaacacggaacaatagcaacaataacccctcaggcaccaacatcagagattcaattaacagattacggtgcactgactttagactgctcacctagaacaggccttgattttaacgagatggttttattgactatgaaagaaaaatcatggttggtgcataaacaatggtttcttgatcttccattgccttggacatcaggagcatcaaccagtcaagagacttggaatagacaagacctattggttacatttaaaactgcacacgctaaaaagcaggaggttgtggtgcttgggagccaagaaggcgcaatgcacaccgcactaacaggagcaacagaaatacagacctctggaaccacaacgatatttgctggacatttaaaatgtcgactaaaaatggacaaacttactttaaaaggaacgtcatacgtcatgtgcacaggtagttttaaactggaaaaagaagtagctgagacacaacacggaactgtgttagtacaggtaaagtatgaaggtactgacgccccttgcaagattcctttctcaacccaagatgaaaaaggcgtaacacaaaatggtcgattaatcacagcaaaccctattgtaacagacaaagagaagcctgttaacatagaaactgaaccacccttcggtgaatcatatattgtggttggagcgggcgagaaggcactaaaattgtcatggtttaagaaagggtcttctatcggaaaaatgttcgaggccaccgctagaggcgcgcgaagaatggcaatactcggcgataccgcatgggatttcggatcaattggcggagtctttaccagcgtaggtaaattagtccaccaggtttttggcactgcatacggtgtgctgttctctggagtctcatggacaatgaaaataggaataggtattctcttaacatggctgggtctgaatagtcgaagcacaagtttgtcaatgacatgtattgcagtgggaatggttacactatatcttggagtgatggttcaagccgactccggatgcgttataaattggaaagggagagaactaaaatgcggaagtggaatatttgtcacgaatgaagttcatacttggacagaacaatacaagttccaagctgattctccaaaacgattgtccgcggccattggaaaagcatgggaagaaggagtgtgcggcattcgatcagcaacgagattagaaaatattatgtggaagcaaatatcgaatgagttgaatcatatattgcttgagaacgatatgaagtttaccgttgttgttggagatgctaatgggattctagctcaaggaaagaaaatgattagaccccaaccaatggaacacaaatacagttggaaaagttggggaaaagctaaaatcattggagccgatatacaaaatacgacatttattatagatggccctgatacaccagagtgtcctgataaccaaagggcctggaacatatgggaagtcgaagattatggatttggtatattcacaactaatatatggctaaaattaagagattcttatacacaaatgtgtgatcatagattgatgagcgcggcaataaaggattcaaaagcagtacatgcagatatgggatattggatagaaagtgagaaaaacgaaacatggaaactggcgagggcttcgtttattgaagtcaaaacatgcacatggccaaaaagccatactttatggtcaaatggtgtactcgaatctgaaatgataattccaaaaatttacgggggtccaatttctcagcacaattaccgtccgggctattttacgcagaccgccggaccatggcaccttggcaaattagagcttgattttgatttatgtgagggtactacagtcgtagttgacgaacattgtggtaataggggtccaagcctacgtactactacagtaacgggcaagataattcatgaatggtgttgcagatcatgcacattaccaccactaagattccggggtgaagacggatgctggtacggaatggaaatacgaccagttaaagagaaagaagaaaatctagtacgttcaatggtgagcgcgggctcgggagaggttgattcatttagccttggtatattatgcgccagcattatgatagaagaggtgatgaggtctagatggagtcgtaaaatgttaatgaccggaactttggcggtttttctcttattagtaatgggccagctcacgtggaacgacctcatacgattgtgtattatggtaggtgcgaacgcatctgataggatgggtatgggcacaacatatttagctcttatggccacgttcaagatgcgacctatgtttgccgtgggactattattcagaagactaacgtcacgggaagtgctattattaaccatcgggttgtctctcgtcgccagtgtagaactgcctaatagcttagaagaattaggagatggcttagcaatgggtatcatgatgctcaaacttctcaccgagtttcaaccacaccaattatggactacacttcttagtttgacattcatcaaaaccacgttatctctagattatgcctggaaaacaactgcaatggccttatctattgtttctttattccctttatgcctttcaacaacttcccagaaaactacgtggttaccagttcttttgggcagtttcggatgtaaaccacttacaatgtttctaattactgaaaataaaatttggggacgtaaatcatggccattaaacgagggaataatggcgatagggattgtatcaattttattatcaagtctacttaaaaatgatgtaccattagcaggcccacttatcgctggtgggatgttaatagcttgttacgttattagcggatcatcagcagacttgtcactagagaaagctgctgaagtatcatgggaacaagaagcagagcactcaggaacatctcacaacattttagttgaagtacaagatgatggtacaatgaaaatcaaggatgaggagagagatgataccttaacgatattattgaaagctacacttctagcagtgtcaggcgtatatccaatgagtataccagcaaccttattcgtatggtacttctggcaaaagaagaaacaaagatccggcgtattgtgggatactccttcacctcccgaagttgaaagagcagtcttagacgatggtatatacagaatcctacaacgcggactattaggacgtagccaagtaggagttggagtttttcaagacggtgtttttcatacgatgtggcacgtcacgagaggtgcggtattgatgtatcaaggaaaacgactagaaccgagctgggcaagtgttaagaaagatctaatttcttacggaggaggctggcggttccaaggttcatggaacacgggcgaagaggtacaagtaatcgcagtagaacccggcaaaaatccgaaaaacgtacaaacaacacctggaacctttaaaacaccagaaggagaagtaggagctatagcactagacttcaaaccagggacttcgggatcaccaatagtgaacagagagggaaaaatcgtgggcttatacggtaacggtgtggtcacaacctcggggacgtatgtgtcggctattgctcaagcaaaggcatcacaagaaggccccttacctgagatagaagatgaagtatttaagaaaaggaatttaactataatggaccttcaccctgggtcaggtaagacacgccgatatcttcccgcaatggttagggaagccatcaagcgaaaattgaggacattaatacttgcaccaaccagagtcgtggcatccgagatggcggaagcattgaaaggaatgcccatcagataccagacaacagctgtcaagtctgaacacacaggccgtgagattgtagatctaatgtgtcatgcaaccttcactatgagattattgtctcctgtaagagtgccaaattacaatatgataatcatggacgaagctcatttcactgacccagcatccatcgcagccagaggatacatatcgacacgtgtcggaatgggagaagcagcagcgatctttatgacagctacgccaccgggttccgtagaagcgtttccacaatctaacgcagttatacaggatgaagaaagggatataccggaacgttcatggaactcaggatacgattggataacagacttcccaggtaaaacagtatggtttgtaccctcaattaaaagtgggaatgatatcgctaattgtctccggaaaaatggaaaaagagttatccaactttccaggaaaacatttgatactgaataccagaaaaccaaaaataatgattgggattatgtggttaccaccgacattagtgagatgggtgcgaactttcgcgcagatcgagtcatcgatccaaggcgttgccttaagccggtcattctcaaagacggcccagagcgagttatcctagccggtccaatgccggtaacagtcgcttctgcagcgcaaagacgtgggagaattggaagaaatcaaaataaagaaggcgatcaatatgtatatatgggacagccactcaataatgacgaagatcatgctcattggacggaggcaaagatgcttttagacaatattaatacaccagaaggaataatcccagcgttgtttgaaccagaaagagaaaaatcagccgctatagacggggagtatagactaaggggagaagcacgcaagacctttgtagaactaatgcgacgcggagacttaccagtttggttgtcatacaaagtcgcaagcgagggtttccagtattcggacagacgttggtgttttgacggagaacgcaataatcaagttctagaggaaaacatggacgtggaaatctggacaaaagagggggaaaggaagaaattgcgcccaagatggctagatgccaggacatactcggatcccctagccttaagggaatttaaagaatttgctgctggcagacgatcagtgtcaggagacctaatcttggaaatcggaaaacttccacaacatctcacgcttagagcacaaaacgctctggataatttagtcatgttacataattccgagcagggaggtaaagcatacagacatgcaatggaggaactaccagacaccatcgaaacactgatgctattagccctgatcgcagtgctcactggtggagtaacattattctttctcagtggtaaaggtctcggcaagacaagtatcggattattatgtgtaactgcgtcgtcagcactattatggatggcatctgtcgagccgcattggattgccgcgtccatcatccttgagttctttttaatggtattacttattcctgaacctgatagacaaagaaccccgcaagacaaccaactagcgtacgttgtgattggtctgctattcatgatactaactgtagcagcaaatgagatgggtctactggaaacaactaaaaaggacctagggataggtcacgtagcggcagaaaatcaccagcacgcgaccatgctagatgtagacttgcgtccagcgtcagcatggactctatacgccgtagcaactaccgtaataactccaatgatgcgccatactatcgagaataccacagcaaacatttcactcacggcaatagccaaccaagccgcgatcttaatgggcttagataaagggtggcctatatctaaaatggatattggagtgcctcttttagctctcggatgttattcccaagttaatccactcacattaactgctgctgtactaatgctagttgcacattatgcgattataggcccagggctgcaagcaaaagcgacacgtgaggcccaaaagagaaccgcagctggtataatgaagaatcctaccgttgatggcatcgtagcaatagatttggatcctgtcgtctacgatgctaaatttgaaaaacaactcggtcaaataatgctacttatattatgcaccagtcaaatccttttaatgcgaactacttgggccttatgcgagtcgatcacccttgcaacaggtccattaactacactatgggaaggaagtcccggaaaattctggaatacaactatagcagtaagtatggctaatattttccgtgggagttatcttgccggagcaggtcttgcattctcgcttatgaagtcattaggcggtggaagaaggggcactggagcacaaggagaaacattaggcgaaaaatggaagagacaacttaatcagctttcaaaatccgagttcaatacatataaacgcagtgggatcatggaagtggatagatcagaagcaaaagaagggcttaagcgaggcgagaccacaaagcatgctgtctctcgcggaactgcaaaactaaggtggtttgtagagaggaatttggtaaaacccgagggaaaagtcattgatctgggttgtggaagaggtggatggtcttactattgtgcgggtctaaagaaggtaactgaagtgaaaggatatacaaaagggggtcccgggcatgaagaaccaattcccatggcgacctatggatggaatttggtgaaactgcactcaggaaaagatgtattctttatgccaccagaaaaatgcgatacgcttttatgtgatataggcgaaagtagcccgaatcctacaatagaagaaggtaggacattaagagtcttgaaaatggtcgaaccttggttgcgaggaaaccaattttgtatcaaaatattaaatccttacatgccatcagtagtagaaacattggaacaaatgcagcgtaaacacggaggtatgctagtaaggaaccccttatccagaaatagcacacacgaaatgtactgggtcagctgtgggactggcaatatagtcagtgcagtcaacatgacgtcaagaatgttactcaatcgttttactatggctcatagaaagccaacatatgagcgtgatgtagatcttggagcaggaacacggcacgtcgcggtagaaccagaagtggcaaacttagatataattggccagagaatcgaaaacatcaaaaatgaacataaaagcacctggcattatgatgaagataacccatataaaacttgggcttaccatggcagttatgaagtcaaaccttcggggagtgcgagtagtatggtaaatggtgtcgtgagactactaacaaaaccatgggacgtaattccaatggtaactcaaattgctatgactgatacaacgccctttggacaacagcgagtatttaaagaaaaagttgacacgaggacgcccagggcaaaaagaggaacaacgcaaataatggaggtgacggctaagtggttatggggatttttatctagaaacaaaaagccgcgcatctgtaccagagaggaatttactagaaaagtaagatcaaatgcagcaattggagccgtctttgtcgatgaaaaccaatggaactccgcgaaggaagccgtggaagacgaacgattttgggatctagtacatagagaacgtgagcttcacaaacagggaaagtgcgcaacgtgtgtatacaatatgatgggtaaacgagagaagaaactcggcgagtttggcaaggctaaagggagcagagcaatttggtatatgtggttgggagctcgtttcttagaatttgaggctttaggattcatgaacgaagaccattggttctcgagagaaaattccttaagcggagtcgaaggtgaaggactccataaactcggttacattttacgagatatatcaaaaataccgggtggaaacatgtacgctgatgataccgcaggatgggataccagaataacagaagatgacttgcagaacgaagccaaaatcacagagatcatggaaccagaacatgcacttttagctacaagtattttcaagctaacatatcaaaataaggttgtacgcgttcaacggccggcgaaaaacggaactgtcatggatgttataagtagaagagatcaacgcggctctggccaggtagggacctacggacttaacacatttacaaacatggaagtccaattaatcagacaaatggagagtgaagggatatttttaccttccgaactggagactccgaacttagctgagagggttttggattggttggaaaaacatggagccgaacgacttaaaagaatggcaatctccggtgacgattgcgtcgttaagcccatagatgataggttcgctacagcattaacagcattaaatgacatgggtaaagtccggaaagacatcccacaatgggaaccaagcaaaggatggaatgactggcagcaggtaccgttttgcagccatcattttcatcaacttattatgaaagatggtagagaaatagtagtcccctgtcgcaatcaagatgaactggttggtagagcgcgtgtcagccaaggggcaggatggagccttcgagagactgcgtgtctaggaaaaagttacgctcaaatgtggcaattaatgtatttccatcggcgtgatctcagactagccgctaatgcgatatgcagcgcagtaccagtcgactgggtgcccacaagccggactacgtggagtattcatgcccatcatcagtggatgacaactgaggacatgctaagcgtttggaatcgagtttggatcgaagaaaatccctggatggaggacaaaactcacgtgtctagttgggaagaagtgccttacctaggtaagcgagaggatcaatggtgtggatctctgattggattaaccgcacgtgccacttgggcaacaaacatacaagttgccataaatcaggtaagacgtttaattggtaacgaaaattaccttgattatatgacaagtatgaagaggtttaaaaacgaatcagacccagagggagcactctggtga

SEQ ID NO: 21238 - RNA, 9879 nt, synthetic construct
  misc_feature 1..9879: note = derived and/or modified CDS sequence (opt6) from DENV-1__GQ868503__SS-prME
  source 1..9879: mol_type = other RNA
agcgtgactatgctgttgatgttgctaccgacagcactcgcgtttcatctaactacacgaggaggggaaccacatatgattgtttcaaaacaagaaagggggaaaagtctcttatttaaaacatcggctggagtaaatatgtgtaccctgatagcaatggacttgggagaactgtgtgaagacaccatgacttacaaatgtccgcaaataacagaagcagaacctgatgatgttgattgctggtgtaatgcgacagatacatgggttacgtatggaacatgttctcagacaggagaacatcggagagataaacgatcagtcgctttagcaccccacgtaggattaggtcttgaaacgcgaactgagacatggatgtcgtcggaaggggcatggaaacaaatacaaagagtagaaacctgggcattaagacaccccggttttacagtaatagccttatttcttgctcatgccatagggacatctataacccaaaaaggcattattttcattctattgatgttggtaacgccatccatggcaatgcgatgcgtgggcataggtaatcgagacttcgtagaaggactaagtggtgctacttgggtggatgtagttcttgaacacgggtcttgtgtcaccacaatggcgaaaaacaaacccacccttgacattgaactcttaaaaacagaagtaacgaatccggcaatactaagaaaattgtgcatcgaggcgaaaatatcaaatactacaactgattctcggtgtccaacccaaggtgaagccacattagtagaagaacaagacgcgaactttgtgtgtcgacgaacctttgtagacagaggatggggtaatggctgcggtttgttcggcaaaggatctttgttgacatgtgccaaatttaaatgtgtaactaaactagaggggaaaattgtacaatatgaaaatctgaaatactcagttattgtaacagttcacacgggggaccagcaccaagtcggaaatgaaaccactgagcatggcacgattgccaccataacacctcaagcgccaacaagtgagattcaactgactgactatggagctttaacactcgattgttcacctcgtacaggactggacttcaacgaaatggtcctcttaacaatgaaagagaaatcctggcttgtacataaacagtggtttctagacttaccgttaccatggacatctggcgcgtcaaccagccaagagacatggaatcggcaggatctcctagtaacatttaaaactgcacacgccaagaaacaagaagttgttgtattagggtcacaggagggcgcgatgcatactgcattaaccggagcgacggaaatacaaacttcaggcaccacaacaatcttcgctggacatctgaaatgtcgattaaaaatggataaactcactctaaaagggactagctatgtaatgtgcactggatcatttaaattggagaaagaagtcgctgaaactcaacatggaaccgtcctggtgcaagttaaatatgaaggaactgatgcaccctgcaagataccctttagtacgcaaaatgaaaagggtgtcacacaaaatggtcgcttaatcacagcaaatccgattgtcacagataaagagaagcccgtaaacatagagacagaacctccatttggcgaaagctatatagttgtaggcgctggagaaaaggcactgaaattaagttggtttaaaaagggctctagtattggaaagatgtttgaagccacagctcgcggggcacgcagaatggctatattaggagatacagcttgggacttcggaagtattggtggagtattcacaagcgtaggcaaacttgtgcatcaagtgtttggcactgcgtatggagttttatttagtggcgtcagctggaccatgaagataggaataggtatattgttaacatggctagggctcaatagtagatctacgagcttaagtatgacgtgtattgcagtaggcatggtaacactgtatcttggcgtaatggtgcaagcagacagtgggtgcgttataaactggaaaggtcgagaactgaaatgtggatcggggattttcgtaactaatgaggttcacacatggacggaacaatacaaatttcaagccgactcgcccaagcgcctatctgcggcgataggaaaagcgtgggaagagggcgtatgcggaattagatctgccacaagattagaaaacataatgtggaaacaaatctctaatgaacttaatcacatcctacttgaaaacgatatgaaatttactgtagtcgtgggggacgcaaatggaattttagcccaaggcaagaaaatgatcaggcctcaaccaatggaacataaatactcatggaaatcctggggtaaagcaaagataataggagctgacatacagaacacgacattcataatagatggcccagatacacccgaatgtcctgacaaccaacgcgcctggaatatttgggaagtcgaagactacggatttggcatttttacgacaaacatatggctaaaacttcgggattcatacactcagatgtgtgatcatcgattgatgagcgctgcgataaaagacagcaaagcagtacatgcggatatgggatactggattgaatcagaaaagaacgagacatggaaactagaacgggcttcatttatagaagttaaaacgtgcacctggccaaaaagtcacactctgtggagtaacggagtactagaatcagaaatgataatcccaaagatatatgggggccctatttctcaacacaactacagaccaggatactttacacaaacagccggaccatggcacttaggaaaactcgaactcgattttgatctatgcgaaggaacaactgtcgttgtcgatgagcattgcggaaatcgtggcccatccttgcgtacgacaacagtaactggaaaaattatacatgaatggtgttgtaggagttgtactctgcctcctctgagatttaggggagaagatggttgttggtatggcatggagataagacctgtcaaggaaaaggaagaaaacctggtaagaagcatggtaagtgcgggctcaggagaagtagattcatttagcctgggtatactttgtgcttcaataatgatagaagaggtaatgcgatctaggtggtcgcgaaaaatgttaatgacggggaccttagcagtatttttactattaataatgggacagttaacatggaacgatctaattagactctgcatcatggtaggagcgaatgcaagtgacagaatgggaatgggaactacgtacctcgctttgatggcaacgtttaaaatgcggcccatgtttgcagtaggattacttttccggagactaacatctagagaagtattattattgaccataggactatcactggtcgcatcagtggaactaccaaattcgctagaagaactcggagatggtctggcgatgggcataatgatgctaaaacttcttacggaatttcaacctcatcaactatggacaacactcctcagcttaacatttataaaaactactctaagtttggactatgcctggaaaacgacagcaatggctttaagcatagtttccctatttccattatgccttagcacaaccagccagaaaactacatggctgccagtgttactaggatcatttggatgcaagcccctgacaatgtttcttattactgaaaacaaaatctggggcaggaagtcctggcccctaaatgaaggcattatggcgattggaatcgtaagtatactactcagtagcttacttaaaaacgatgttcccttagctgggccattaatcgccggtggtatgctgattgcatgttacgtaataagcggcagttcagcagatttaagcctggagaaagcagccgaagtcagttgggagcaagaagccgagcattctggaacatcacacaacatcttagtagaagtacaagacgatggcactatgaagattaaagatgaggaacgagatgatactttgactatcctattgaaagcaacattacttgcagtttctggggtatatcctatgtcaatacctgcaacgttatttgtatggtacttttggcagaaaagaaaacaaagatctggtgttttatgggacacgccttccccgccggaagtcgagcgagcagtgctagacgacggcatttatcgcatactgcaacgaggtttactaggtaggtctcaagtcggagtaggtgtgtttcaagatggagtatttcacactatgtggcatgttacccgtggagcagtcctaatgtatcaaggaaaacgcctagagcctagttgggctagcgtgaagaaagacttaatttcatacggcgggggctggagatttcaaggtagttggaacacaggcgaggaggtacaagttattgcagtagagccggggaaaaaccccaaaaacgtgcagactactccaggaatatttaaaactccggagggtgaggttggggctatagcactagattttaagcccgggactagcggatctcccatagtaaatagagaaggaaaaatcgtgggattgtatggcaatggggttgtaacgacaagtggcacatatgtgtcagcaatcgctcaagcaaaggcttcacaagagggcccattgcccgaaattgaagacgaagtattcaagaaacggaatttgaccatcatggatctccacccaggtagtgggaagaccagaaggtatttgcctgcaattgttcgagaagcgataaagcggaaactaaggacgttgatcttggcaccaacaagggttgtagcttcagaaatggctgaagcattaaaaggaatgcccataaggtaccagactaccgccgttaaaagcgagcatacaggaagagaaattgtagatctaatgtgtcatgctacttttactatgcgtctactctcacccgttagagtgcctaactacaatatgataataatggatgaagcgcatttcacagatccagcatcaatagcagctagaggctacatttcaacccgagtgggtatgggggaggcagcggctatttttatgacagctacaccacccgggagtgttgaggcctttccacaatcaaacgccgttatccaagacgaagaacgagacataccagaaagatcgtggaactctggttatgactggataactgacttccccggaaagaccgtgtggttcgttcccagcataaaaagcggtaatgatatagcaaattgtttaaggaaaaatggaaaaagggttatccagctaagccgtaagacatttgatacagaatatcagaaaaccaaaaataacgattgggattacgtagttacaacagatattagtgaaatgggtgcaaactttagagcagaccgcgtgatagatccaaggaggtgtttaaaacccgttattctaaaagacggtcccgagagagtaatactggcaggccctatgcccgtaacagtagctagtgccgcacaaagaaggggccgcatagggagaaatcaaaacaaagagggagaccaatatgtgtacatggggcaacctttaaataacgatgaggaccacgcacattggactgaagcgaaaatgctcctggataacataaatacacctgaaggcataattcctgctcttttcgaaccagaaagagagaaaagtgcagcaatcgatggagagtataggctgagaggggaggccagaaagacattcgtagaattgatgcgaagaggagatctaccagtatggctgtcctataaagttgcaagcgaaggattccagtactcagataggagatggtgcttcgatggtgagaggaataatcaagttttagaagagaacatggatgtagaaatatggactaaagaaggagagagaaagaaattacgtccaagatggttagacgcgcgaacatactcagaccccttagcattacgtgaatttaaagaatttgccgcaggtcgcagatcggtctccggggacttaatacttgaaataggaaaattaccccaacacttgacattacgcgcacaaaatgcattagataatcttgtaatgctacataactctgagcaagggggtaaagcataccgtcatgccatggaagaattacctgataccatagaaaccttgatgctactcgccttgatagcagtcctcacgggcggtgtaacattgttctttttgtcaggaaaggggttaggaaaaaccagtattggattgttatgcgtaactgcatcttcagcattattatggatggcgagcgtcgaaccccattggatagcagcatcaataattttagaatttttcttaatggtccttttaatacccgagccagatcgtcaaagaacaccccaagataatcaactagcctatgttgtcattggattattattcatgatactaacagtcgcagcaaatgagatggggctacttgaaactactaagaaagacttgggaataggtcatgttgcagccgaaaaccatcaacacgcaactatgctagacgtagacttaagaccagccagtgcctggactttgtatgcggtggcaaccacagttataactccgatgatgcgtcataccatagagaatacaactgcaaacattagtctgacagctatagctaaccaggcggctattctaatggggttagataaaggctggccgatttccaaaatggacataggtgtgcctttactcgcgctgggatgttactctcaagttaacccattaacgctaaccgctgcagttttaatgttagttgcacattacgctattataggtccgggcctacaagctaaagcaacaagagaagcacagaaaagaacggctgccgggatcatgaagaaccctacagtagatggcatcgtcgctattgacctagacccggttgtctacgatgcaaaatttgaaaaacaacttggacagataatgctcctaatcttatgtacgtcgcaaatattactgatgcgaactacatgggccctctgtgagtccataactcttgccacgggacccttaactacattatgggaaggttctccaggtaaattctggaacacaaccatagcagtaagtatggcgaacatatttagaggatcatacttagccggagcaggcttagcattctcattaatgaaatctctaggtggcggtcgaagaggtacaggtgcgcagggagagacgttaggagaaaaatggaaacgacagttgaatcagctaagtaaatcagagttcaatacatacaaaagaagtggtataatggaggtagatcggagtgaggctaaagagggattaaaacggggagagacgaccaaacatgctgtctccagaggaacggcgaagctgcggtggtttgtagaaagaaaccttgttaaaccggagggaaaagtaatagatctaggttgtggtcgcgggggttggtcctattactgcgctggtcttaagaaagttacagaggtgaaaggatatacaaaaggaggacccggtcacgaagaaccgataccaatggctacatatggatggaatctggtaaagctacattctggaaaggacgtcttctttatgccgccagaaaaatgtgataccctcttgtgtgatattggagagagttcgcctaatccaacaatagaggaaggccgaacacttagggtactaaaaatggttgaaccgtggttacgaggtaaccaattctgtatcaaaatacttaatccatatatgccaagtgtcgtagaaacattagaacaaatgcaaaggaagcatggaggaatgttggtacgtaacccattgagccgaaactcaactcatgagatgtactgggttagttgcggaacaggaaatatcgttagtgcagttaacatgacaagcagaatgctacttaataggttcacgatggctcaccgaaaacccacattcgaacgagacgtagatttaggtgctggtactaggcatgtagcagtagagcctgaggtcgcaaacttggacataatcgggcaaagaatagaaaatatcaaaaatgaacataagtccacatggcattacgatgaggataatccttacaaaacctgggcataccatggctcttatgaagtaaaaccgtctgggagtgcaagttcaatggtgaacggcgtagtacgactactaaccaagccatgggatgtaataccaatggtaacacaaatcgcgatgactgatacaacaccttttggtcagcaacgagtattcaaggaaaaagttgataccagaacgccaagagctaaaagaggcactacacaaataatggaagtcacggctaaatggctctggggatttttatcccgaaataagaaaccccggatttgtacgcgagaagagttcaccagaaaggttcggtccaatgctgctattggagcggtttttgtggacgaaaatcaatggaactcggctaaggaagcggtcgaagacgagagattttgggacttagtacaccgcgaacgagagttgcataagcaggggaaatgtgctacttgtgtttacaatatgatgggtaaaagagagaagaaactaggcgagtttgggaaagcgaaagggagtagagccatatggtatatgtggttaggtgcgaggtttttagagtttgaggcgttaggttttatgaacgaagaccattggttttcccgagaaaactcgctctcgggtgtagaaggagaaggtttgcataagctgggttatatattgcgcgacatatcaaaaatccccggagggaatatgtatgccgatgatactgcaggatgggacactcgaattactgaagacgatcttcagaatgaagccaaaataacggatattatggaacctgaacacgcactgctagccacttcaatattcaaattaacttaccaaaataaagtggtaagagtacaacgcccggcgaaaaacggtacggtaatggacgtaatttcaagacgtgaccaaagaggaagcggccaggtgggaacttacgggctaaatacattcactaacatggaggtccaattaataagacagatggaatcagaaggaatatttttgccaagcgaacttgagacaccaaatttagcagagcgagtcttagactggttagaaaagcatggagctgaaagactaaaaagaatggctatttcaggtgatgattgcgtggtgaaacctatcgacgacagatttgctaccgctctcacggcattgaatgatatgggcaaggtacgcaaagacattccccaatgggagccttcaaaggggtggaacgactggcaacaagtacccttctgtagtcatcacttccaccagcttattatgaaagacggacgagaaatagtggtcccctgcagaaaccaagatgaattagtaggacgagcgcgtgtaagccaaggtgcgggttggagtttaagagagacagcatgtttaggtaaaagctatgcgcaaatgtggcaacttatgtactttcatagacgtgacttgcgcctggcagcgaatgctatctgtagtgcagtgcccgtagactgggtcccaacaagccgtaccacgtggtcaattcacgcacatcaccaatggatgactactgaagatatgttaagtgtatggaatagggtatggattgaggaaaacccttggatggaagataaaacacacgtgtcctcatgggaagaagtaccttatcttggtaaaagggaagaccaatggtgtggctcactcataggactaacagcaagagcaacatgggccactaatattcaggtagcaataaaccaagtcagaaggttgattggtaacgaaaactatttagactatatgacaagtatgaaacgttttaaaaacgagtctgatccagaaggagctctctggtaa

SEQ ID NO: 21239 - RNA, 9879 nt, synthetic construct
  misc_feature 1..9879: note = derived and/or modified CDS sequence (opt6) from DENV-1__GQ868504__SS-prME
  source 1..9879: mol_type = other RNA
agtgtaactatgttattaatgctgttaccaaccgcattagcttttcacttgaccactcgtggaggtgaacctcacatgatagtctcaaaacaagaacgaggaaaatccttactattcaaaacctccgcaggcgtcaatatgtgtacattaattgcaatggatctcggggaactttgtgaagatacaatgacgtacaaatgcccccaaataacagaagcagaaccagacgatgtagattgttggtgcaatgcgacggacacgtgggttacatacgggacttgctcgcaaactggcgaacatagaagagataaaagatcagtagcacttgcacctcacgtagggcttggactggaaacccgaacggaaacatggatgagtagtgaaggtgcgtggaaacaaattcaacgagtagaaacatgggcgttaagacatccaggttttacggtaatagctctgtttctagcacatgctataggcacttccataacgcaaaaaggtataatattcatactgctaatgctagtcaccccaagtatggcaatgcgatgtgtaggtataggtaatcgagatttcgtggaaggccttagtggcgcaacatgggtagacgtggtattggaacatggatcttgtgttaccactatggccaaaaataaacccactctggatatcgaattgttaaaaacggaagtaactaatccagcaatcctccgaaaactgtgtattgaagcaaaaatttctaataccactacggatagccgctgtcctactcaaggtgaagcaaccctcgtcgaagaacaagatgcaaacttcgtatgccggagaacgtttgttgaccgtggatggggtaacggatgtggactgtttggaaaaggtagcttgcttacctgcgctaaatttaaatgcgttacaaaattagaaggaaaaattgtacaatacgaaaacttgaaatacagcgtcattgttacggtacatacaggcgaccaacaccaagtaggaaatgaaacaacagaacacggcacaatagccacaataacaccccaagcaccgactagcgaaattcagttgactgattacggggcactgactttagactgcagcccaagaacgggcctggactttaatgaaatggtattgcttaccatgaaagagaaaagttggctagttcataagcaatggttcttagatttacccctcccgtggaccagcggagcatcaacatctcaagaaacatggaaccggcaagacctattagttacgtttaagactgcacatgcaaagaaacaagaagttgttgtcctgggttctcaagaaggcgcaatgcacacagcattgactggagccacggaaatacaaaccagcggcacgactacaatatttgcaggtcaccttaaatgtagactgaaaatggacaaattaacgttaaaaggcacttcttatgtaatgtgtactggatcattcaaacttgagaaagaagtcgcagaaacccaacatggtacagtccttgtacaagttaaatacgagggaaccgatgcgccttgtaaaatcccattctcaactcaagacgagaaaggggtaacacaaaacgggagactaattacagccaatccgattgtgacagataaggagaagcccgtaaatatagaaactgaacctccatttggagaaagttatattgtagttggcgccggggaaaaggctttaaaacttagctggttcaagaaagggtcaagtattggtaaaatgtttgaggctacggctagaggggcccgtcgtatggcaatattgggtgatactgcgtgggacttcggatcaattggaggagtttttacatccgtaggcaaactcgtacatcaagtatttggaactgcatatggtgttctgtttagtggggtaagctggacaatgaagataggaattggaattttattaacatggctcgggttaaacagtcggtcaacatccctatctatgacatgtatagcggttggtatggttacgttatatttaggcgttatggtgcaagcagattcaggatgtgttattaactggaaaggacgagaactaaagtgcggttctggcatcttcgtaaccaatgaagtgcatacttggactgagcagtacaaatttcaagccgactctccaaaaagattgagcgcagcgattggaaaagcctgggaagaaggagtctgtggtatacgttcagccactcgacttgaaaatattatgtggaaacagatctcgaacgagctaaatcatatcctgttggaaaatgacatgaagttcacagtagttgtgggtgacgccaatgggatactggctcaaggtaaaaagatgattcggccacaacctatggaacacaaatattcatggaaatcatggggtaaagcgaaaattataggagcggacatacaaaatacgacgtttataatagacggtccggacacacctgagtgtccagacaatcaaagagcatggaatatatgggaagttgaagactatggcttcggcatttttaccacaaacatttggctaaagttaagagatagttatacacaaatgtgcgatcaccgcctgatgtcagcagccataaaagactcaaaggctgtgcacgcagacatgggatactggatcgaatcagagaaaaatgagacatggaaacttgcaagggcctcttttatcgaagtaaaaacctgcacgtggccaaagagtcacacgttatggtcgaatggtgttctagagtcagaaatgataatacctaaaatatacggcggaccgatatcacaacataactacagacccggttatttcactcaaacggcaggtccatggcatttagggaaattagaactagacttcgatctgtgtgagggtacaacagtagtggtcgacgagcattgtggcaacagagggccaagtttgagaacaacaacagtgaccgggaaaatcatacatgagtggtgctgtaggtcatgtacgttgcccccacttagatttcgtggagaggacgggtgctggtacggtatggagattcgtccggtaaaggaaaaagaagaaaatcttgtaagatcaatggtatccgcaggtagtggtgaggtagattcattttcattgggaatactctgcgtcagcatcatgatagaagaggtaatgaggagcagatggagtaggaagatgctaatgacaggaacattagccgtcttcctacttttagttatggggcagcttacatggaatgacctaataagattatgtataatggtaggtgccaacgcgtccgacaggatgggtatgggaacaacatatctagcattgatggcaacatttaaaatgagaccaatgtttgccgtaggattgttgttccgacgtctcacctctcgagaggttttactgcttacgatcggattatcgttggttgctagcgtagagctacctaattcattggaagaactaggggatgggttagcaatgggcattatgatgctaaaattgttgacagaatttcaaccgcatcaattatggactacactattatcgttgacttttattaaaactacactttcacttgactacgcatggaaaacaactgcaatggcactttcaatagtgagccttttcccactatgcttaagcacaacgagccagaaaactacttggcttccggttctgttaggctcatttggatgtaagccactaacaatgttcttgataacggaaaacaagatatggggtcgaaaatcgtggcccttaaatgaaggaataatggcaattggtatagtcagtatactattatcctcacttctgaaaaacgatgtaccactagcagggccattaatagccggtgggatgttaatagcctgttatgtgataagtggctcgagtgcagatctatcgctagaaaaagctgcagaggtctcatgggaacaggaagcagaacacagtggaacaagccataatattcttgttgaggttcaggatgatggtacaatgaaaattaaagacgaagagagggacgacacgttaacgatactgttaaaagctacactactagcagtatctggtgtgtacccgatgagcataccagccactctttttgtatggtatttttggcagaagaagaaacaacgaagtggtgtcctgtgggatacaccatcaccgccagaagttgaacgtgcagtcttagacgatggaatctatagaattttacaaagaggcttattagggagatctcaagtaggagtgggtgtatttcaggatggcgtatttcatacaatgtggcatgtcacaagaggagcagtccttatgtatcagggtaaacgattagagccaagctgggcttcggtaaagaaagatttaatatcatatggtggaggctggagatttcaggggagttggaacactggtgaagaagtacaagtaattgccgttgagccaggcaaaaacccaaagaatgttcagacaacccccggaacttttaaaaccccagaaggtgaggtgggtgcaattgccttagatttcaaaccaggtacatcaggctctccgatagtaaatagggaaggtaaaatagtaggcctatacggtaatggagtagtaacaacaagtggcacatatgtaagtgcgattgcacaagcaaaagcatctcaagaagggccactccctgaaattgaagacgaagtattcaagaagcgaaatctaacaataatggacctacatccaggaagtggaaaaacaagacggtacctcccagccatagtacgcgaagcaatcaaaagaaaattacgtactcttatcctcgctccgacaagggtcgtagcgtctgaaatggcagaagcattaaaaggaatgccaataaggtaccagaccacggctgtaaaaggagagcatacaggtcgtgagattgtggacctaatgtgtcacgctaccttcactatgagattgcttagccccgtgcgtgttccaaattacaacatgatcataatggatgaagcgcacttcacggaccctgcttctatagcagccagaggctatatatcaacgcgagttggaatgggagaggccgccgctatttttatgacagcgacacctccaggttctgtggaggcattcccccaatcgaatgctgtcatacaagacgaagagagagacataccggaacgaagttggaactctggttatgactggatcactgattttcctggaaaaacagtatggttcgtcccgtcaataaaaagtggcaacgacatagctaattgtttaaggaaaaatgggaagagagtcatacaacttagccgtaaaaccttcgatactgaataccagaaaactaagaataacgattgggactacgtagtaactaccgatatttctgaaatgggagctaatttccgggctgaccgagttatcgatccaagaaggtgcctgaagccagtcatactgaaagacggaccagaaagagtcattttagcgggacccatgcctgttactgtggcatctgccgcacagagaagggggcggatagggaggaaccaaaataaggagggtgaccagtatgtttacatgggtcaaccattaaacaatgacgaagaccacgctcattggaccgaagcgaagatgcttcttgacaacatcaatacaccagaagggataataccagcgttgtttgaaccggagagagagaaaagcgccgcaatagatggtgagtaccggctaagaggcgaagcacggaagacctttgtagaactgatgcggaggggtgatttgccagtatggttatcatataaagtagcctccgaaggatttcaatacccagaccgacgatggtgctttgacggagaacgaaacaatcaggtcctagaagaaaacatggacgtagaaatctggacaaaagaaggagaaaggaagaaactaagaccaagatggctggatgcaagaacttatagtgatccactagctttaagagagttcaaagaatttgccgccggtagaaggagtgtaagtggcgacctcattttagaaatcgggaaacttcctcagcatcttacactacgagcgcaaaatgcattagacaatctagtcatgttacacaatagtgaacagggtggtaaggcttaccgtcacgcaatggaagaattaccggacacaattgaaacgcttatgctccttgccctaatagccgtccttactggtggagtaactctattcttcttgtcgggaaagggattagggaaaacatcaatcggtctattatgtgtgaccgcttcatctgcactcctttggatggcatcggtagaaccgcattggatcgcagcgagcataatcctagaatttttcctaatggttttattgattccagaaccagatcgtcaaagaacaccccaagataatcaactggcatacgtagtcatcggtttactctttatgatcttaacagttgcagcaaacgagatgggcctgttagaaactacaaagaaagatttgggaattggacacgtcgctgcagaaaatcaccaacatgccaccatgttagacgtagatctgcgcccagcttcagcctggacactatatgctgtagctacaacggtgatcacacctatgatgcgccacacgatcgaaaacaccacagcaaatatatctctaacggcaatagccaaccaagccgctatattaatgggtctagacaagggctggccaatttcaaagatggatataggggtcccgttgttggctcttggatgttactcacaagtaaatcccctgacacttacggcggcagtgctaatgttagtagctcactatgctatcattggcccaggtttacaggcaaaagccacacgagaggcgcaaaaacggacggccgcaggaatcatgaaaaatccaacagtggatggcattgtcgcaatagacttggaccctgtggtatatgacgcaaaatttgaaaaacaactcgggcagatcatgcttttaattttgtgcacgtcgcagatactacttatgagaacaacctgggcactttgcgagagtattactctcgcaactggcccactaactacattatgggaggggtccccaggcaaattttggaacacaacaatagcggtttcaatggcaaatatattcagaggttcgtatctagctggcgcaggacttgcattctccctaatgaaaagccttggcggaggacgacgaggaacaggagcccaaggcgaaacactaggcgaaaagtggaaaaggcaacttaatcaattgtccaaaagtgagttcaatacatacaaaagatctgggataatggaagtcgatagatcagaagctaaagaaggactaaaaagaggagaaactacaaaacacgcagtctcacgaggtacagccaagttgcgttggtttgttgaacgtaatctagtcaaacctgagggtaaagtaatagatttaggatgtggtagaggcggatggagctattattgcgctgggctaaagaaagtaactgaagtaaaaggatatactaaaggtggtcccggacatgaggagcccataccaatggcaacctatgggtggaacctcgtgaaattacatagtggtaaggatgtgttctttatgccaccagaaaaatgtgacactttattatgtgacataggtgaatcgagcccaaatcctacaatcgaagaaggaagaacattgcgagtactaaaaatggtggaaccatggttaagaggtaatcagttttgtataaaaatactaaacccgtatatgccctcagtagtggaagcattagaacagatgcagaggaaacatggcggcatgttagtaagaaatccactatcaagaaatagcactcatgaaatgtactgggtttcatgtggcacaggtaacatcgtcagcgcagtaaatatgacatcgcggatgttgctgaatagattcacaatggctcacagaaaaccgacctacgaaagagatgtggatctaggtgcaggaaccagacatgtagccgttgagccagaagtagcaaatttggacataattggacagagaatagaaaatattaaaaatgaacataaaagcacatggcactatgatgaagacaatccttacaaaacatgggcctaccatggaagttacgaagtgaaaccttctggttcggcgtcctcaatggttaatggcgtcgtacgtcttttaacgaaaccttgggatgtaataccaatggtcactcaaatagcgatgaccgatactacaccattcggacaacagagagtatttaaagagaaagtcgacacaagaacgccgagagcaaaacgaggtaccacacagattatggaagtcaccgccaaatggctatggggttttctaagtcgaaataaaaagccaaggatatgtactcgcgaggagttcacgagaaaagtaagatctaatgcagccataggagcagtatttgtcgacgagaatcaatggaactcagcaaaagaggcagttgaagatgaacgtttttgggatcttgtacaccgggaaagagagttacataaacaaggaaaatgtgcaacatgtgtatacaatatgatgggtaaaagggagaagaaactaggcgaatttggtaaagcaaagggctctagagcaatatggtacatgtggctaggggctagattcctggagttcgaagcactcggttttatgaatgaagatcattggttttcgcgagagaacagcttatccggggtagagggggaagggctacacaaactaggttatatcctgagggatatttctaagatcccagggggtaatatgtatgcagatgatacagctggatgggatacgcggattaccgaagacgatctgcagaatgaagcgaaaataacagaaataatggagcccgaacacgccttactagccactagcatttttaaactcacctaccaaaacaaagttgtcagggttcaaaggccagctaaaaatggtacagtcatggacgtaatatctagaagggatcagcgcggttcagggcaagtcggcacttatggcctaaacacttttaccaatatggaagtacagctaatacgacaaatggaatcagaaggtatatttcttcctagtgaattagaaacacccaacctggcagaaagagtattagattggctcgaaaaacacggggctgaacgactcaagagaatggccatctcaggcgatgattgcgtagtgaagccaatcgacgaccgctttgctacagctttaaccgcgctcaacgacatgggaaaggtaaggaaagacatcccacaatgggaacccagtaaagggtggaacgattggcaacaagtgcctttctgttctcatcattttcaccagttaataatgaaagatggacgagaaattgtagttccctgccggaaccaagatgagctagtaggcagagctagggtctcacaaggagccggttggagcctcagggaaaccgcctgtctgggaaagtcatatgcacagatgtggcaactgatgtatttccatagacgcgatctaagacttgcggcaaacgctatctgctccgcggtcccggtagattgggtcccaacgtcgcgcacaacatggagtatacatgctcatcatcagtggatgacaacagaggatatgttaagtgtttggaacagggtatggattgaggagaacccatggatggaagataagacacatgtaagttcctgggaagaagtgccatacctcggaaaacgggaagaccaatggtgtggtagcctcataggtttaacagccagagctacgtgggcaactaatatacaggtcgcaataaatcaggtaagacgccttattggtaacgaaaattacttggattacatgacatcaatgaaacgttttaaaaacgaatcagatccagaaggtgcgttatggtag

SEQ ID NO: 21240 - RNA, 9879 nt, synthetic construct
  misc_feature 1..9879: note = derived and/or modified CDS sequence (opt6) from DENV-1__GU131967__SS-prME
  source 1..9879: mol_type = other RNA
agtgtgactatgcttctgatgttactgcccactgcattagcctttcatttaacaacgagagggggcgaaccgcatatgatagtctcaaaacaagaacgaggcaaatcactgctattcaaaacgtcagctggggttaatatgtgtacgctgatagccatggatctgggtgaactctgcgaagacaccatgacgtataaatgcccccaaataactgaggcagaaccggatgatgtagactgctggtgtaatgcaacggacacatgggttacttatggaacctgttcacaaactggagaacataggagggacaaaagaagtgttgctttagccccacatgtaggattaggattagaaactcgaacagaaacatggatgtcttcggaaggggcatggaaacaaatacaacgtgtagaaacatgggccctgagacacccaggattcacagttattgcacttttcctggcccatgcgataggaacatcaataactcaaaaaggaatcatatttattttactaatgttagtgacaccctctatggcaatgagatgcgtagggattggaaaccgtgattttgtggagggactatccggagcaacttgggttgatgtcgtattagaacatggtagttgtgtaacgactatggccaaaaataaaccaacgttagacatagaacttctaaaaacagaagtaaccaatccagcaatcttgcgtaaattatgcatagaagcaaaaataagtaacacaactactgactcacggtgccccacacaaggggaagcgaccctagtggaagaacaagacgcgaacttcgtttgtagacgaacctttgtagacagaggctggggtaacggctgtgggctattcggaaaaggttcattactgacatgtgcaaaatttaaatgcgttactaaattggagggaaagatagttcaatatgagaacctgaaatatagcgttattgtaactgtgcatacgggagaccaacatcaagtcggtaacgaaactacggaacatggaactatagccactataactccacaagctccaacatcggagattcaactaaccgattacggtgctctgacgttagactgtagtccccgaaccggtctcgactttaacgaaatggtacttcttactatgaaagagaaaagttggctagtgcataaacaatggtttttagaccttcctttgccttggacctcgggagccagtacttcccaagaaacctggaatagacaagatctattagtgacattcaaaacggcccatgcgaagaaacaggaagtagttgtcttagggtcccaggaaggtgccatgcacacagcattgacaggcgctactgaaattcagacctctggtactaccaccatctttgcaggccatctaaaatgtagattaaaaatggacaagttgaccttaaaaggaacgtcatacgtgatgtgtacaggatcgtttaaactggagaaagaggtcgccgaaacacaacatggaaccgttttagtacaagtaaagtatgaagggacagatgcaccttgcaaaatacccttttcaacccaggacgaaaaaggagtaactcaaaatgggagacttattactgcaaatccgatcgtaacagataaagaaaagcctgttaacatagaaactgaaccacctttcggggagtcgtacatcgtagtaggggctggagaaaaagcattgaaactttcctggttcaagaaaggatccagtataggaaagatgttcgaggctactgcccgaggagcgcgcagaatggcaattttgggagacacagcatgggactttggttctataggtggtgtatttacgtcagttggtaaattggttcatcaggtattcggaacagcctacggagtcctattctctggggtatcatggacaatgaaaataggaataggcatattgttgacctggttaggtttaaatagcagaagtacatcgcttagtatgacatgtatagccgtaggaatggtcactctatacctaggtgtaatggtgcaagctgattccggttgtgtaattaactggaaaggaagagaattaaaatgcggatcaggcattttcgtcactaatgaggtacatacatggacggaacaatacaaatttcaagcggattcgccgaagcgattatcggcggcgatagggaaagcatgggaagaaggtgtctgtgggattcgatcagccactagactagagaacatcatgtggaaacaaattagcaatgaactgaatcatatactcttggaaaatgatatgaaatttacagtagtcgtcggagatgctaacggaatacttgcacagggtaagaagatgataagaccacaaccaatggagcacaagtacagttggaaaagttggggaaaagctaaaataattggagccgatatacaaaatacaacttttatcatagacggccctgatacgccagaatgtccagataatcaacgtgcttggaacatctgggaagtagaggattatggatttggtatattcacaacaaatatttggttgaaactccgcgactcatatactcaaacatgcgaccatcgacttatgtcagcagcaataaaagattcaaaagcagtgcatgcagatatgggttattggatagaatcggagaaaaatgaaacatggaaattagcaagagcatcttttatcgaagttaaaacgtgtacgtggccaaaaagccacactttatggtctaatggggttttagaatcggagatgataataccaaaaatttatggcggcccaataagtcaacataactaccgaccaggttattttacacaaacggcagggccgtggcacctgggaaaactagaattagactttgatctatgcgaaggcacaacagtagtcgtagatgagcattgtggaaatcgaggtccatctttaaggacgacaacagtaactggcaagataatacatgaatggtgctgtcgatcatgtactttgcccccgctacgatttagaggcgaagacggctgctggtacggtatggaaatacgaccggttaaagaaaaagaagaaaatttagtgaggagcatggtatcagctggaagcggtgaggttgatagtttcagtttaggaatcctatgtgtttctattatgatagaggaagttatgcgcagcagatggtccagaaaaatgttaatgacaggcacgctcgccgtttttctacttctcgttatgggccaattaacatggaacgatctaattaggctttgtattatggtaggcgcaaacgccagcgatagaatggggatgggcacaacgtaccttgccctcatggcaacgttcaaaatgagaccaatgtttgcggtagggctactatttcgaaggctaacctcacgagaagtcctcctacttacaattggattgtcgttggtagcttcagtagaattgcccaactcattggaagaattaggagatggccttgcaatgggcataatgatgctaaaattactaacggaatttcagccacatcaattgtggacaacactcctttctttaacatttatcaaaacaacactatcattagactacgcctggaagacgactgcaatggcactctcaattgtcagcttattccctttgtgtctgtccactacaagtcaaaagactacctggctaccagtactacttgggtcattcggatgcaaacctttaacaatgtttcttataacagaaaataaaatatggggtcgaaaatcttggccgctaaacgaaggtatcatggcaatcgggatcgtaagtatactactaagctcgctcctgaaaaatgatgtgccactagcagggcctctcatcgccggaggaatgttgattgcatgttacgttattagtggctcatccgcagatctatcactagaaaaagcagcggaggtgagctgggaacaagaagcagagcactctggaacatcacataatatcttagtagaagtacaggacgatggaaccatgaaaattaaagatgaggagcgagatgataccttaacaatcctattaaaagcaacactattagcagttagtggcgtatatccaatgtcaataccagccacgttattcgtgtggtacttttggcagaagaagaaacaacgttccggagtcttgtgggacacaccttcacctcccgaagtagaacgagctgtcctcgatgacgggatataccgtatcctacagagaggcttgctggggaggtcacaggttggtgttggagtgtttcaagatggagtctttcatacaatgtggcatgttaccagaggcgcagtgctgatgtatcaaggaaaaagactagaacccagttgggccagcgttaagaaagatttaatcagctatggagggggttggaggtttcaagggtcctggaacacgggagaagaagtacaagttatagctgtagagcctggtaaaaatcctaaaaatgtacagacaacaccaggaacatttaaaaccccagaaggcgaagttggagccatagcactcgactttaaacctggaaccagcggaagtccgatagtgaatcgagaaggtaaaatcgtggggctatatggcaacggagtagtaacgacctctggcacctatgtctctgcaattgcacaagcaaaagcatcacaagaaggaccgttaccggaaatagaagatgaggtatttaagaaacggaatcttaccatcatggatctgcacccaggctctggaaaaacgagaagataccttccagcaattgttagagaagcaatcaagagaaaattaagaacgctaatactagcaccaacacgtgtggttgcgtctgaaatggcggaggctttaaaaggaatgcccattagatatcagacgacagcagtcaaatcagagcatacagggcgtgagatagtagacttgatgtgtcatgccacattcacaatgaggctactatctcccgtacgcgtgccgaattataacatgataattatggatgaagcgcatttcaccgatcctgctagtatagcggcaagaggttacattagtacaagggtcggaatgggagaggcagcagcaatattcatgactgcaactccaccaggtagtgtggaagcattcccacaatctaatgctgtcatacaagacgaagaaagagatattccagaacgatcatggaactctggttatgactggataacagatttcccgggtaaaactgtttggttcgtgccatctattaaatccggtaacgatatagcgaactgcttacgaaagaatggaaaaagagtaatacagttatccagaaaaacctttgataccgaataccagaaaactaaaaataacgactgggattatgtagtaacaacagatattagcgagatgggtgctaactttagggcagacagggtaatagatccacgaagatgtctaaaacctgtcattctcaaagatggcccagaacgggtcattttagcaggtcctatgcccgttacagtagcaagcgccgctcaaagaagaggtagaatcggtcgaaatcagaacaaggaaggagatcaatatgtttatatggggcagcccctaaataatgatgaagatcatgctcactggaccgaagctaaaatgctgctagacaatattaacacaccggagggaattattccagccctttttgaacctgaacgggagaaatctgccgccattgacggagaatataggcttagaggtgaagctagaaagacatttgtcgagctcatgagaagaggcgatttacctgtttggctatcatataaagtagcgtctgaaggttttcaatatagcgacagaaggtggtgtttcgacggagaacgtaataatcaagttttagaagagaatatggatgttgaaatttggactaaagaaggggagagaaagaaattgcgaccgcggtggcttgacgcgcgaacctattcggatcctctcgccttacgggaatttaaagaatttgctgctggccgcaggtctgtatcaggagacttaatcctagagattggcaaacttccccaacatttaactctaagagcccaaaatgctttagataatttagtaatgctacataattctgaacaaggagggaaagcatatagacatgccatggaagaactaccagatacaatagaaacattgatgcttcttgcacttatcgcagttcttactggcggagtaacattgttcttcctcagtgggaaaggacttggtaaaacaagtattggattattatgtgttacggcaagttcagccctattgtggatggcaagcgtggagccacattggattgcggcttcaattattcttgagttctttctaatggtattgttaatccctgaacctgatcgccaaaggactccccaagataaccagttagcttatgttgtgataggtttgctatttatgatattaactgtggctgccaacgaaatgggtcttctcgaaacaactaagaaagatcttgggataggtcacgtcgctgccgaaaatcatcaacatgcgacaatgttagacgtagacttaagacccgcctctgcatggacactttatgccgttgcaacgaccgtaataacccccatgatgcgtcatacaatagaaaacactactgccaacataagcctaaccgctatagccaaccaagcagcaatcttgatgggattggacaaaggttggccaatcagtaaaatggatataggcgtacccctcctggccctaggatgctacagtcaagttaaccccctaaccctcacggccgcagtgctcatgctggtggcacattacgcgataataggacctggtttgcaagcaaaagccacaagagaagctcagaaacggacagcggctgggatcatgaaaaatcctacggtcgatggtattgtagctattgacctagatcccgtggtgtatgatgcaaagtttgaaaaacagttgggacaaatcatgctacttattttatgtaccagtcaaattcttttgatgaggacgacatgggctctgtgcgaatctataacacttgcaactggaccattaacaaccttatgggagggatcacccgggaaattttggaacactaccatagctgtgtccatggctaacatattcagagggtcgtatttagcgggcgctggattagcattttcactaatgaaatcattgggaggtgggagacgcggaactggagctcaaggggaaacgctgggtgagaaatggaaaagacagctaaaccaactgtccaagtcagaatttaatacgtataagagatcaggaataatggaagtagatcgaagcgaagccaaggagggtctcaagcgaggtgaaacaacaaaacatgcagtgtcgcgaggtactgcaaaactacgttggtttgttgagcgaaatctagtaaaaccagaaggaaaagttatagatcttggttgtggtcgtggaggttggtcgtattattgtgctggactaaagaaagtgactgaagtcaagggatataccaaaggaggtccaggccatggcgaaccaatacctctcgccacatatggttggaacctagttaagctccatagtggaaaagatgtattctttatgcctccagaaaaatgcgatactttgttatgcgatataggcgaaagtagtccaaatcccactatagaagaagggagaacacttagagttttaaaaatggtagagccatggttacgaggaaatcaattctgtattaagattttgaacccatatatgccaagcgtggtagaagccttagaacagatgcaacgaaaacatggaggtatgctagtacgcaaccccttgtcaagaaattcgacacatgaaatgtactgggtttcttgtggaacgggaaatatcgtctcggccgtaaatatgacttcaagaatgctcttaaatcgatttacaatggcccatcgtaagccgacgtacgagagagatgttgaccttggcgcaggtacgcgacacgtagcagttgagccggaagtagcaaatcttgatattataggtcagcgaatcgaaaacatcaaaaacgagcacaaaagtacttggcattatgatgaagataacccttataaaacgtgggcttatcacggatcatatgaagttaaaccttctggttctgcctcatcaatggtgaatggggtagttagattacttaccaaaccttgggatgtaataccgatggttacgcaaatagcaatgactgatactacaccgttcggacaacaaagggtgttcaaggaaaaggtagatacaaggactcccagagcaaaacgaggtactacgcaaattatggaagtaacagccaaatggctatggggctttttatcacgaaataagaaacctcgtatatgcacacgagaggagttcacaagaaaagtaagatcaaatgcggctataggcgcagttttcgttgatgagaatcaatggaactccgcaaaagaagcagtggaagatgaaagattttgggaccttgtccatagagaaagagaattacataagcaaggaaagtgcgccacgtgtgtttataatatgatgggaaagagagagaagaaacttggagagtttggtaaagcaaaaggatcacgggcaatctggtatatgtggttgggtgcaagatttttagagtttgaagcccttgggttcatgaatgaggatcactggttttcgcgtgaaaattctttaagcggtgtggaaggtgaaggattacataaactaggttatatcctaagggatattagtaaaattccagggggcaacatgtacgcggatgatacagcgggatgggatactagaatcaccgaagatgacttacaaaatgaggcaaaaatcacagaaataatggaaccagaacacgctttattagccactagcatattcaaactaacttaccaaaacaaagtagtgagagtacaaaggccagccaaaaatgggacagtcatggatgtaataagtcgcagagatcagaggggatcgggtcaagtaggtacatatggcttgaatacatttacgaatatggaagtccagctaattagacaaatggagagtgaaggcatatttttaccgtcagaactcgaaacaccaaacctagcagagagagtcctcgactggctcgaaaaacatggagcagagagattgaagagaatggcgataagcggggacgactgtgttgttaagccaatcgacgaccgttttgcaaccgcgttaaccgcattaaatgatatgggtaaagtaaggaaggacattcctcagtgggaaccaagtaaaggttggaacgattggcaacaagttccgttttgttcacaccattttcatcaattaataatgaaggatggacgagagattgtagtgccttgtagaaatcaagatgagttggttggacgcgctagagtttcgcaaggtgcaggatggtcgcttagagaaacagcctgcctaggtaaatcatacgcgcagatgtggcagcttatgtatttccacaggagagatctacgtctcgccgctaatgcaatatgcagcgctgttccagttgattgggtaccaacctcgaggacaacttggtcaattcatgctcaccaccagtggatgacgaccgaagacatgcttagtgtatggaatagagtatggattgaggagaatccatggatggaggacaaaacacacgtgagctcctgggaggaagttccatacctgggaaaacgagaagaccagtggtgtggatccctaattggcttaacagctcgcgcaacttgggctacaaatatacaagtagccataaaccaagtaagacgactcatcggcaacgagaactatcttgactatatgacatctatgaaaagattcaaaaatgagtccgatccagaaggcgcactttggtaa

SEQ ID NO: 21241 - RNA, 9879 nt, synthetic construct
  misc_feature 1..9879: note = derived and/or modified CDS sequence (opt6) from DENV-1__GU131968__SS-prME
  source 1..9879: mol_type = other RNA
tcagttaccatgctattaatgttattgcccactgcgcttgcattccaccttaccacacgcggaggagaaccgcatatgatagtatcaaaacaagaaagaggaaaaagcctactttttaaaaccagtgctggcgtcaatatgtgtactttaattgcaatggacttaggggaactatgcgaagacactatgacatataaatgcccgcaaataactgaagctgaacctgacgatgtggattgctggtgtaacgcaactgatacatgggtaacctacggaacttgttcccaaacgggagaacataggagagacaaaaggagtgttgcattagcgccgcatgtcggtttaggtctagaaacccgaacagaaacatggatgtcctccgaaggggcttggaaacaaatacaaagggtcgaaacatgggcgctacgtcaccctggatttacagtcatagcgctatttctagcacatgccataggaacaagtataacacaaaaaggcataatttttatattgttgatgttagtaacaccctccatggccatgcgttgcgtaggaataggtaaccgtgatttcgtggaaggactatctggtgcaacatgggtagacgtagttctcgaacacggatcctgtgtaacaacaatggctaaaaataaacctacacttgatattgaattacttaaaactgaagttaccaatcctgcaatacttcgtaagctatgcattgaagcgaagattagtaatacaacgacagattcacgatgcccaactcagggagaagccacacttgtggaagaacaagatgctaactttgtatgtcgccgcaccttcgttgatagagggtggggtaacggatgtggactattcggaaaagggagcttattgacatgtgccaaattcaaatgtgtaacaaaactggagggaaaaatagtacagtatgagaacttaaaatatagcgtcatcgtaacagttcataccggcgaccaacaccaagtaggaaacgaaaccactgaacatggaactatagctacaataacaccgcaagcccccacaagtgaaattcagctcaccgactatggggcgctaacgctcgactgcagccctcgaacagggttggattttaatgaaatggtattattgaccatgaaagaaaaatcatggttagtccacaaacaatggttcttagatttacctttaccgtggacgtctggggcaagtacaagtcaagaaacgtggaaccgtcaggatctattagtgacatttaaaacagctcatgcgaagaaacaagaagtagtcgtattaggaagtcaagaaggagcaatgcacacggcattaaccggcgctactgaaatacaaacaagtgggactacaactatctttgcaggtcatttgaaatgtagactgaaaatggataaactaacattaaaaggtacctcatacgtaatgtgcactggttcgtttaaattagaaaaagaagttgccgaaactcaacatggaacggtattagtacaggtcaaatacgaaggcacggatgcaccatgcaaaattcccttttcaacccagaatgaaaaaggagttacacagaatggaagactaataaccgccaatcccatcgtaacagataaagagaaaccagtaaacatagaaactgaacctccctttggggaatcatatattgtagtaggtgctggtgaaaaggcgttaaaactttcgtggttcaaaaaggggagctcaattggaaaaatgtttgaggcaacggcacgaggcgctaggagaatggcaatactaggggacaccgcgtgggatttcggcagtattgggggtgtattcacctctgtgggaaaattagtgcaccaggtttttggtactgcgtacggagtgttattctcaggtgtttcgtggacgatgaaaattggtataggaatcttattaacttggctcggactaaatagccgtagcacatctctaagtatgacgtgtattgcagtgggtatggttacattgtatttaggagttatggtacaagcagattctggctgcgttatcaactggaaggggcgagaattaaagtgtggaagcgggatctttgttactaatgaggtacacacttggacggaacaatataaattccaagctgattcgccgaaacgtctgagcgcagcaatcggtaaagcctgggaggaaggagtttgcggcattcgttcggctaccagattagaaaatataatgtggaaacaaatctcgaacgaacttaatcacatattactagaaaacgatatgaaatttacagttgtagtaggcgacgctaatggaatccttgcacaagggaaaaagatgatacgtcctcaacctatggaacataaatactcttggaaaagttggggaaaggcaaaaatcatcggtgcagatattcagaatactacatttattattgacggaccagataccccagagtgtccagataatcaaagagcatggaatatatgggaagtcgaagattatgggtttggtatctttacgacgaacatatggctgaaacttagagactcttatactcaaatgtgtgaccatcgcttaatgtcagcggctataaaagatagtaaagctgtgcatgctgatatgggatactggatagagagtgagaaaaacgagacatggaagttagaaagagctagtttcatagaagtaaaaacgtgtacctggccaaaaagtcataccctatggagcaatggagtcctagagtcagagatgataatcccgaagatatacggcggccctatatctcaacataactataggcctggatattttacacaaacagcaggaccatggcacttaggtaaattagaattagatttcgatctttgtgaaggaacaacagtagtagtggatgagcactgtggtaaccgtggcccaagtctaagaacgactacagtgacaggcaaaattatacacgaatggtgttgtcgcagctgtacgctgcccccattaagatttagaggagaggacgggtgttggtatggcatggagataagacccgtcaaagaaaaagaggaaaatttagtacggtccatggtaagtgcggggtctggggaagtggattcattcagtttgggaatattatgtgcaagtatcatgatagaagaagttatgagatctcggtggagtcggaagatgctcatgacggggactctagctgtgtttttgctattgatcatggggcagcttacttggaatgaccttattagattgtgcataatggtgggggctaatgcaagtgatagaatgggtatgggaactacatatttagcccttatggctactttcaaaatgcgaccgatgtttgcggttggtttactttttagacgcctcacttctcgggaagtcttattattaactattggattgagcctagttgcttcggtagaattaccaaacagcctagaggaacttggggatggattagcaatgggaataatgatgctgaaattattgacagagtttcaaccacaccagttgtggacgacgttattatccctgacatttattaaaacaacattatcgctggattatgcctggaaaacgacggcaatggcgctttcaattgtcagtctatttccactgtgtctcagtactacgagccagaaaacaacttggctaccggtattgttgggaagttttggatgcaaacctcttactatgttcctgattacagaaaacaaaatatggggaagaaagagttggcccctaaacgaagggattatggcaataggaatagtcagtatattactgtcgagcctactcaaaaacgatgttcccttagcaggtccactaattgcgggtgggatgcttatagcatgttacgttatatctggcagttcagcggacttatctctagaaaaagcggcagaagtatcatgggaacaagaagctgaacattccggaactagccataatattctagtggaagttcaagatgatggcaccatgaaaatcaaggacgaagaaagagacgacactcttacaatattgctgaaagcaactttactagctgtatccggagtatacccaatgtcaatacccgctactttattcgtttggtacttttggcaaaaacgcaaacaaaggagtggcgtattgtgggacactccttccccacctgaagtggaaagggcggtactggatgacggaatatatagaatcttacaacgtggtctgttgggacgtagtcaagtaggagtaggagtttttcaggacggtgtgttccatactatgtggcatgtaacacgaggtgctgtattaatgtaccaaggtaaacgattagaacccagctgggcaagcgtgaagaaagatttaattagttatggtggagggtggcggtttcagggcagttggaacacaggtgaggaagttcaagtaatcgcggttgaacctgggaaaaaccctaaaaacgttcagacaaccccagggacatttaaaactcctgaaggcgaagtaggggcaatagcattggatttcaaaccgggaacttcaggctcaccaatagtaaatagggaaggaaaaattgtagggttatacggtaacggagttgtcaccacttcagggacgtatgtttccgccatcgcccaagcgaaggcttcgcaggaaggaccacttccagagattgaagacgaagtattcaagaaacgaaatttgacaatcatggatttacatcccggatccggaaagactcggcgatacctccccgcaattgttcgagaagccataaaaagaaagttgagaacactcatattggcgcctacaagagttgttgcaagcgagatggcggaagctctgaaaggtatgccaataagatatcaaactaccgcagtaaaaagcgaacacactggtcgggaaatcgttgatctcatgtgccacgcaacttttactatgagactcttatctcccgtaagagtaccaaattataacatgataattatggatgaggcacattttacagatccagcatctattgctgccagaggatatataagtacacgtgttggaatgggggaagcagccgctatattcatgacagcgacaccgccaggatctgtagaggcttttccacaatcaaatgcggtaatacaggacgaagagagggatatccctgaaagaagttggaactcaggctatgactggataaccgatttccccggaaagacagtgtggtttgtgcctagcataaaaagcggtaatgacattgcaaattgcctacgtaagaatggcaaaagagttatacaactatctagaaagacattcgatacggaatatcagaaaacgaagaataatgattgggactatgtagtcaccacagatatatcggaaatgggtgctaactttagggccgatagagtaatcgatcctagaaggtgccttaaaccagtaatattaaaagacggtcccgagagagtcatattagctggacccatgccggttacagtcgcatcggcggcccaaaggcgtgggcgtatcggcagaaatcaaaacaaagaaggtgaccaatatgtatatatgggacaaccattaaataacgatgaggatcacgctcactggacagaagcaaaaatgctactagacaatattaatacaccggaaggcattataccagctctatttgaaccagagcgagaaaaatctgcggcaatagacggagaatatagactcagaggcgaagccagaaagacgtttgtagaattaatgcggcgaggtgacctaccagtgtggctcagctacaaagttgcaagcgaaggatttcaatactctgacagaaggtggtgttttgatggtgagaggaataatcaagtattggaagagaatatggatgtagaaatatggacaaaagaaggtgagcgaaagaaactacgccctagatggctcgatgctagaacatattcagatccactcgctctaagggagttcaaagagttcgctgccggacggagatcggtcagcggtgacttaatactggaaataggaaaattaccacaacacctaacactacgtgcacaaaatgcattagataatttggttatgctccataatagcgaacaagggggtaaggcttacagacacgctatggaagaattacccgacaccatcgaaactttgatgctcctggcgcttatagccgtgttaacgggtggtgtcacattgtttttcctgagtggaaaaggattaggtaaaacaagcatagggctattgtgtgttacagccagctcagccctgctatggatggcttctgtagagccccactggatagcagcatcgatcatcttagagttcttccttatggttctattaattccggaacctgaccgccagcgaactcctcaagacaatcagcttgcttatgtcgttataggattactctttatgatattgacagtagcagcgaatgagatgggattattagaaacgactaagaaagatttgggtatagggcatgttgctgcagaaaatcatcaacacgcaactatgctagatgtcgatcttagaccagcctcagcgtggactctgtatgcggtagcaactacagtaattactcccatgatgcgacatacaatagagaacactactgccaacatttccctgacagcgatcgcgaaccaggcagcaattctgatgggactcgataaagggtggcctatttcaaaaatggatatcggcgtaccactcttagctcttgggtgttactcacaggtgaatccgctaactcttaccgcggcagttctcatgttggttgcacattacgcaataataggcccaggattgcaagcaaaggctacacgtgaagcacagaaaaggactgccgctgggattatgaaaaatccgacagttgatggaatagtagctattgatttagatccggttgtatatgacgctaaatttgaaaaacaacttggacagattatgttactcatactttgcaccagccaaatcttactcatgcgaacaacttgggccctatgtgaatcaataacacttgccacaggaccgctaactacgctatgggaaggatcccccggtaagttttggaataccaccatagcagtttcaatggcaaatatattccgaggatcgtacctggctggtgcgggtttagctttctctttaatgaaaagtttagggggaggacgaaggggaacaggcgctcaaggagagaccctaggagaaaagtggaaacgacagttaaaccaattatctaagagtgagtttaacacatacaaacgatctgggattatggaagtagatagatccgaggcgaaagaagggctaaaaagaggtgaaacaactaaacatgctgtaagtagaggaaccgccaaacttcgttggttcgttgaaagaaatctagtaaaacctgaaggtaaagtgatagacctcggatgtggtaggggagggtggtcgtattactgtgcaggtctaaagaaagttacagaagttaaaggatatacgaaaggagggccgggacacgaagaacctataccaatggcaacttacggttggaacttagtcaaattacactctggtaaagatgtgtttttcatgcctccggaaaaatgtgatacattattgtgcgacataggtgaaagttctccaaatccaaccatagaggaaggaaggacactgagagtacttaaaatggttgaaccctggttacgcggaaatcaattttgcatcaaaatattaaatccatacatgccgtctgtagttgaaacgttagaacaaatgcaacgcaaacatggaggaatgttagtacgaaatccattatctagaaattcaacacacgaaatgtattgggtaagttgtggtacaggaaatatagtatcagcagttaatatgacttccagaatgcttttaaatcggttcacaatggcacaccgaaaacctacatttgaaagagacgtcgatttgggtgcaggtacccgacatgttgcggtagaacctgaagtagcaaatttagacatcatcggtcaacggattgagaacattaaaaatgagcataaatcgacttggcactacgatgaagacaatccttataaaacctgggcctaccacgggagttacgaagtaaaaccgagtggaagcgcatcaagcatggtgaatggtgtggtccgcctactaaccaaaccatgggatgtcataccaatggtgacgcaaattgccatgaccgacaccacaccattcgggcaacagcgtgtattcaaggaaaaggtggataccagaacaccgagagcgaaaagagggacaacgcaaataatggaagtgactgcgaagtggctttggggctttttgtctagaaataagaaaccaagaatttgcaccagagaagagttcacacgtaaggtccgttcaaatgctgcgataggtgctgtatttgtagatgaaaaccagtggaactcagcaaaagaggcggttgaagacgaacggttctgggatctagtccacagggaacgagaattacataaacagggaaaatgtgcgacatgtgtctataacatgatgggaaagagggagaagaaactgggagagttcggaaaagcaaaaggctcacgcgcaatttggtacatgtggctaggggcaaggttccttgagttcgaggctttgggttttatgaacgaggaccactggttttcacgagaaaattctctctcaggagtagaaggagaaggtctacataaattgggctatattctacgggacatcagtaagataccagggggaaacatgtatgcggatgatacagctgggtgggatactagaataactgaagatgacttgcagaacgaggcaaaaataactgatataatggagccggaacacgccctactagcgacttccatattcaaacttacttaccaaaacaaagtcgtacgcgtgcaaagacctgcaaagaatggcacagtcatggatgtcattagcagacgagatcaacggggttctgggcaggtagggacatatggactcaacactttcactaatatggaagtccaattaattcgtcaaatggagtcagaaggaatatttctaccttctgagttagagactcccaacctagctgaacgcgtactcgattggttagaaaaacacggtgcggaaagactaaagagaatggccatctcaggagatgattgtgtggttaaaccaatagacgatagattcgctacagccctgactgcactcaacgacatgggaaaagttcgcaaggatataccacaatgggaaccaagtaaaggatggaacgattggcaacaagttccattttgcagtcatcacttccaccaactgataatgaaagatggtagagaaatagtcgtcccatgccgaaatcaggatgagctggtagggagggccagggtttcacagggagcaggttggtccttaagggaaaccgcttgcctaggaaaaagctacgcccaaatgtggcaactcatgtacttccataggagagatttaaggttagctgctaacgccatatgtagtgctgttcccgtagattgggtaccgacttctagaacaacttggtcaatacatgcgcatcatcaatggatgacaacagaagacatgctttcagtgtggaatagagtatggattgaagaaaatccttggatggaggacaaaacccacgtatcgtcttgggaagaggtaccatatcttggaaaacgagaggaccaatggtgcggatcgttgatcggattaacagcacgcgccacatgggcaactaatattcaagttgcaataaatcaagttcgacgattgataggaaatgaaaattatctcgattatatgacgtcaatgaaacgatttaagaacgaatctgatcctgaaggtgcattgtggtaa

SEQ ID NO: 21242 - RNA, 9879 nt, synthetic construct
  misc_feature 1..9879: note = derived and/or modified CDS sequence (opt6) from DENV-1__GQ868506__SS-prME
  source 1..9879: mol_type = other RNA
agtgtaacgatgttattaatgttattaccaacagccctcgctttccatttaactacccgtggtggggaacctcatatgatagtatcaaaacaagaaaggggaaaatcgctcctctttaaaacttcagccggagtaaacatgtgtacactcatagctatggatttgggggaactctgtgaagataccatgacttataaatgtccgcaaataactgaagctgaaccggatgatgtagattgctggtgtaatgctacagatacgtgggtaacatatggaacgtgtagccaaacaggagaacatagaagagataaaagaagcgttgcacttgcccctcatgtagggctgggactagaaacccgcacagagacctggatgtcgagtgaaggagcatggaaacaaatccaacgcgtagaaacgtgggctttaagacacccgggattcactgtaatagcattctttctcgcccacgcgataggaacaagtattacccaaaaagggataatctttattctcttaatgctcgtaacaccttcaatggcgatgcgctgcgtgggaataggtaacagagatttcgttgaaggtctaagtggagccacatgggtagatgttgtacttgaacatggttcttgcgtaacgactatggctaaaaataaaccaacactcgatatcgaattactcaaaaccgaggttacaaacccggctatattaagaaaactctgtatagaggcaaaaattagcaatactacaactgattcacgatgtcctacacaaggtgaagctacccttgtggaagaacaagatgctaattttgtatgccgccgaacatttgtagacagaggttggggtaacggatgtggactattcggtaaaggaagcctactaacgtgtgccaaattcaagtgtgtcacgaaattagagggaaaaatagtccaatatgagaatcttaaatattcagttattgtaaccgtacatactggagatcaacatcaagtaggtaatgaaacaacggaacatggaacgatcgctacaataacaccccaggctccaaccagtgaaatacagctaacagactatggagcactaactctggattgttccccgcgaaccgggttagacttcaacgaaatggtactactaacaatgaaggaaaagtcttggctagttcataaacaatggtttctagacctccctttaccttggacatctggagcaagtacctcccaggaaacatggaatcgccaggatttattagttaccttcaaaactgcacatgctaagaaacaagaagttgtagtactaggatcacaagagggagccatgcacacagcccttacgggagccacagaaatccaaacgtcaggaacaacaactatcttcgcgggacacttgaagtgcagacttaaaatggataagctgacgctcaaaggaacatcttacgttatgtgtacggggtcattcaagctagaaaaagaggtcgcggaaactcagcacggaactgtcttagttcaggtgaaatatgagggaacggatgctccctgtaaaataccgtttagtacacaagatgaaaaaggggtcacgcaaaacgggagactaataaccgcgaatcctatagttacagataaggaaaagcccgttaacatagaaacagagccaccgttcggagaaagctatatagtagttggagccggtgagaaggctctaaagctgtcatggtttaagaaaggttcctcaatcggtaaaatgtttgaagcaacggcaagaggtgcgagacgaatggctatccttggtgatactgcatgggatttcggtagcatcggtggagtgtttacatctgttggtaaattagttcaccaagtcttcggaactgcgtatggtgtattattctcgggagtctcgtggaccatgaaaataggaataggcattctcttaacgtggctaggacttaactcacgatctacttctttgtcaatgacctgcatagcagttggcatggttacattataccttggtgtgatggtacaggccgattctggatgtgttattaattggaagggcagagaattaaaatgcggctctgggattttcgttacgaacgaagtccacacctggacagaacaatacaagtttcaggcagattccccgaaaagactgtctgcagctatagggaaggcatgggaagaaggtgtttgtggaattagatcagcaacaagactagaaaacatcatgtggaaacaaatttccaatgagctaaaccacatattactcgagaatgacatgaaattcactgtagtcgttggagacgccaacggcattctcgcacagggcaagaaaatgatcagaccacagccaatggaacacaaatattcttggaaaagttggggaaaagcgaaaataattggggcggatatccaaaatactacgttcattatagatggtccagatacaccagagtgccctgataatcagagagcgtggaatatatgggaagtagaagattacggcttcggtatcttcacaacgaatatctggttgaaattacgtgatagttacacacaaatgtgtgaccatcgtctaatgtctgccgcaataaaagatagtaaggcagtgcatgccgatatggggtattggattgaaagcgagaaaaacgagacttggaagttagcaagagcttcttttatagaagtgaagacatgcacttggccaaaaagccataccctctggagtaacggcgtacttgaaagcgaaatgataataccgaagatatacggtggaccaatttcccaacacaactaccgacctggttacttcactcaaacagccggtccatggcatctaggaaaattagaattagattttgacctctgtgaaggcacgacagtagtagttgatgaacactgtggcaatcgtggccctagtttaagaacaactacagtgactggaaaaatcatacatgaatggtgttgccgatcctgtacattgccgcctttaaggttcagaggtgaagatggatgttggtacggaatggaaatacggcccgtaaaagaaaaggaagaaaacttagtccgatcaatggtgtctgcaggcagtggtgaagtagacagcttctcattaggcattctatgtgtctcaattatgatagaggaagtaatgaggtccaggtggagcagaaagatgctcatgacagggacattagcagttttcttgttgttggtcatgggacagctaacatggaacgaccttataaggttatgcataatggttggtgcgaacgcatcagaccgcatggggatgggtacaacatacttagcacttatggccacatttaaaatgagaccgatgttcgcggtaggattgctttttagacgactcacaagtagagaagttttattacttactattggactatccctagtagctagcgtagaacttccaaattcattagaagaattgggggacggcttagcaatggggatcatgatgttaaaactcttaacagaatttcagccccatcaattatggacaactctgttatcactaaccttcatcaaaacaacactatcccttgactatgcttggaaaacaacggccatggccctatccatagtatcgttattccccctatgtctttcaacaactagccagaagacaacatggctacctgtactattgggctcttttggatgcaagcccctgactatgtttttgataactgaaaataaaatttggggaagaaaatcttggccactaaacgagggaataatggcaatagggatagtctctatacttctgtcgtcactattaaagaacgatgtaccactggcaggaccactaatcgcgggaggtatgctaatcgcttgttatgttatatcgggatcttctgccgatctaagtctggaaaaagcggcagaagtatcttgggaacaagaagcggagcacagcggtacatcccataatatattagtagaagttcaggacgatggcactatgaaaattaaggatgaagaaagagacgacacactaacaatccttttgaaagcgactttacttgccgtaagcggagtgtatcctatgagtatccccgcaactttatttgtatggtatttttggcagaagaagaaacaacgttctggggttttatgggatacgccaagtcccccagaagtcgaaagggccgtactagacgatgggatatatcgaattttacaaaggggcttacttggaagatcgcaagttggtgttggtgtatttcaggacggagtattccatactatgtggcatgtaacacggggagctgtactaatgtatcaaggtaaacgactagaaccgagttgggcgagcgtgaagaaagatttgatttcgtacggtggtggctggagatttcaagggagttggaacaccggagaagaagtacaagttatagctgtagaaccggggaaaaatcccaaaaacgtgcaaacaactccagggaccttcaaaacccccgaaggagaagtaggggcaatagctttagacttcaaaccaggtacatccggctcacccatagttaaccgagaaggcaagatagtcggcctatacggaaatggagtagtaaccacaagtggaacctatgtatcggcaatagcacaagcaaaagcgagtcaagaaggccctctaccagaaattgaggatgaagtatttaagaaaagaaatttaactataatggatctccaccccggctcaggaaagaccagacgctatctaccggctattgtgcgtgaagctataaaacgaaaattaaggaccttgatcctagctcctacaagagtagtagcttcagaaatggcagaagcattgaaaggtatgcctatcaggtatcaaactaccgcagtaaagtcagagcacacgggaagagagattgtcgatttaatgtgtcatgcaacttttaccatgcgactcttatctcccggtagggtacccaattataatatgataataatggatgaagcgcactttacagacccagcatctatagcggcacgaggctatatttcaactcgggtaggtatgggagaagcagccgcaatattcatgacggccacaccaccgggaagcgttgaggcgtttccacagtcgaatgcagtgatccaagatgaagaaagagacattccagaaaggagttggaactcaggttacgactggataaccgactttcctggaaagacagtctggttcgtgccatctatcaaatccggaaacgatattgcaaattgtttaaggaagaatgggaaaagggttatacaattaagcaggaagacgttcgatactgaatatcagaaaacgaagaataatgattgggattacgtggtaacgacagatatatcggaaatgggggctaattttagggcggatcgagtaatagatccccgtagatgcctgaaaccagtaattctaaaagacgggccagaaagggtaatcttagcaggtccgatgccggttactgtagcttcggcagcccaaagacggggcagaattggtcgcaaccagaataaagaaggagatcaatatgtatatatgggtcaacctctaaataatgatgaagatcatgcacattggacagaagcaaaaatgctcctagataatataaataccccagaaggcataataccagctctatttgaaccggagagggagaaaagtgccgctattgatggtgaatacagactacgaggtgaagctcgaaaaacgtttgtagagttaatgagaagaggggacttacctgtatggctatcctataaagtggcatcagaaggattccagtattcagacagaagatggtgcttcgacggtgaacgtaataatcaagtactagaagagaacatggacgtagaaatatggacaaaagaaggagaaaggaagaaattacgtcccagatggctggatgccagaacttattctgatccgctggcactcagagaatttaaagaatttgcagcaggacgaagaagcgtatcgggagacctaattcttgaaattggcaaattgccacagcatctaactctaagagctcagaacgctctagacaacctcgtaatgctacataattcagaacaaggaggaaaggcttacagacatgccatggaagaacttcctgatacgatagaaacccttatgttattagcactcatagcggtgctcacaggaggcgtcacgttattctttttgtcaggaaaaggtttgggcaagacttcgataggattattatgtgtaactgcgagcagtgctctcctctggatggcatcagttgagcctcattggatagcagctagcattattttggaatttttcctcatggttctcttgatcccagaacctgataggcagagaacaccgcaagataaccaactcgcctacgtagttataggcttattatttatgattttaaccgtagcagcaaatgaaatgggacttctagaaacaactaaaaaggacctcgggattggacatgttgcggcggaaaatcaccaacatgcaactatgttagacgtagatctgcgcccagcgagtgcatggacattatacgcggtggctacgacggtaattacccccatgatgagacacaccattgagaacactactgcaaatatttctttgacagctatagccaaccaagccgccatcttaatgggtttggacaagggctggccaatatctaagatggatattggggttccactactggcattgggatgctattctcaggttaacccgctgacattaacagcagcggtgctaatgctagttgcacattatgcaataatagggccgggacttcaagcaaaagcaactagagaagctcagaaaaggaccgcagctggtatcatgaaaaatccaacagttgacggtatcgtggcaattgatttggaccctgtagtatatgacgctaaattcgagaaacagttaggacaaatcatgttactgattctatgcaccagccaaatattactgatgagaacaacttgggcactctgtgaatcaattacattagctacaggccctcttactacactatgggagggaagtcctggcaaattttggaatacaacaatagctgtatcaatggctaacatcttcaggggatcgtatttggctggcgctggtctcgcatttagcctgatgaaaagcctaggagggggacgaaggggaacaggcgcacagggagaaactttaggtgaaaaatggaaaaggcagcttaatcaactaagtaagtcggaatttaatacatataaaagaagcggtattatggaagttgaccgttcagaagcaaaggagggtttaaaacgcggtgaaactacaaaacatgcagtgtccagaggcacagcaaaactccgttggtttgttgagcgtaatttagtaaaacccgaaggaaaagtgatagacttaggttgtggacgaggaggatggagttactactgcgcaggactcaagaaagtaacagaggtcaaaggatataccaaagggggcccaggacacgaagaaccaatccccatggcaacttacggttggaacctagtaaagttacactcaggcaaagatgtgttctttatgccacccgaaaaatgtgatacccttctttgtgatattggtgaaagttcacccaacccgactattgaagaaggaaggaccttgcgagttttgaagatggtcgaaccttggttacgtggcaaccaattttgtataaaaatactcaacccgtatatgccaagtgttgttgaagcccttgaacaaatgcaaagaaaacatgggggaatgttagtgagaaacccattatccaggaactcgactcatgaaatgtattgggtatcgtgtggtaccggtaatatcgttagtgcggtaaacatgacctcacgaatgctcttaaatagatttacgatggcacacaggaaaccgacttatgaaagagacgttgacctgggggcaggaacaagacacgttgcggtcgaaccggaagtagcgaacttagatataattgggcaacggatcgagaacatcaaaaacgaacataaaagcacatggcattacgatgaggataatccctataaaacttgggcgtatcatggatcatatgaagtaaaaccatcaggaagtgcatcatcgatggtaaatggagtagtaagattactgactaaaccttgggatgtcattccaatggtaacacaaatcgctatgactgatacaacgccatttgggcagcaacgagtttttaaagaaaaggtcgatacgagaactccccgtgccaaacgaggaacaacacaaataatggaagttactgcaaaatggctttgggggtttcttagcagaaataagaaacccagaatttgtactagagaggagttcacaaggaaggtacgtagtaatgcagctataggagcagtatttgtagacgaaaatcagtggaacagcgctaaagaagcagtcgaggacgagcgtttttgggatctggtgcacagagaaagagaactgcataaacaaggaaagtgtgcaacgtgcgtatataacatgatgggtaaacgcgaaaagaaactcggggagtttggaaaggcgaaaggctcaagagcaatatggtatatgtggctaggagcgaggttcctggaatttgaagccctaggtttcatgaatgaggatcactggttcagtagagaaaactcgttgagcggggtagagggtgagggcttgcacaagttgggatacatacttcgggacataagcaaaattccaggcggcaatatgtatgcagatgacactgctggatgggacacccgaataactgaggatgatctacaaaatgaagccaaaatcacggaaataatggaaccagaacacgcattattggccacctccatttttaaactgacgtaccaaaataaggttgttagggttcagagaccggccaagaatggcacagttatggacgtaatttctagaagagatcagagaggatcgggacaggtaggaacatacggactaaacacattcactaatatggaagttcaattaattagacaaatggaaagtgaaggcatatttttaccttctgagctcgaaacacctaatctagctgaacgagttctagattggttagaaaaacacggagccgagcgtcttaaacgaatggccattagcggtgatgattgtgtagtaaaaccaatcgacgaccgcttcgcaaccgctctcacagctttaaatgacatgggtaaagttagaaaagatattccccaatgggaaccatctaaaggatggaacgactggcaacaagtacctttctgttctcatcactttcaccaactaataatgaaagatggaagggaaattgttgttccatgccgaaatcaagatgagcttgttggtcgcgcaagagtaagtcaaggtgctgggtggagtcttcgagaaaccgcttgtctcggtaaatcttatgcgcagatgtggcaactaatgtactttcaccgcagagatttacgcctcgctgctaatgctatctgttcggcagttcctgtcgactgggtaccgacatcccgaacaacttggtctatacacgctcatcatcagtggatgaccacggaagatatgctatccgtgtggaatagggtatggattgaagaaaatccatggatggaggataaaacccatgtttctagttgggaagaagtaccctacttaggtaaacgggaagatcaatggtgcggatcattaattgggctgacagcaagagcgacctgggctacaaatatacaagttgcaataaaccaagttagacgccttatcggaaatgaaaattatttggattatatgacgtctatgaaaagattcaagaacgaatcagaccctgaaggagcgttatggtaa

SEQ ID NO: 21243 - RNA, 9879 nt, synthetic construct
  misc_feature 1..9879: note = derived and/or modified CDS sequence (opt6) from DENV-1__GQ868507__SS-prME
  source 1..9879: mol_type = other RNA
tctgtgacaatgttattaatgttactgcccacggcacttgcctttcatttgacgacgcgaggcggtgaacctcatatgatagtctccaaacaagaaagaggtaaatcattactctttaaaacatctgctggggtcaatatgtgtacattgatagccatggatttaggggaactttgtgaagatacaatgacatataaatgccctcagataacagaagcagaaccagatgatgttgactgttggtgcaatgcaactgatacatgggtgacctatggaacatgttcacaaaccggagagcacagacgcgataaaagaagtgtagcattggctcctcatgtagggttaggcttggagacccgtaccgaaacatggatgtccagtgagggtgcatggaaacaaatacagagagtagaaacctgggcactcagacaccccggctttacagtaatagctttattcctcgcacacgcaataggcacgtcaataactcaaaaaggaataattttcatcctattgatgttggtcacaccgagtatggcaatgagatgcgtcggaataggcaatcgcgactttgtcgaaggcctatcaggggctacatgggtagatgttgtcttagaacatggtagttgtgttacaacaatggccaaaaataaaccaactctagatattgaattattaaaaacggaggttacaaacccagccatccttcgaaaattatgtatagaagccaaaatatctaatacaacaacggactcacggtgcccaactcaaggagaagctacattagtcgaagaacaagacgcaaattttgtttgtcgaagaacgttcgttgatagaggatggggaaatggatgtggcctatttggaaaaggatcactgctcacttgcgctaaattcaaatgtgttaccaaactagaaggcaaaatcgtacaatacgaaaatctaaaatattctgtaatagttacagtacacacaggggaccaacaccaagtaggtaacgaaacaactgagcatggtaccatagcaactataactccgcaagcacctacttctgaaattcaactaaccgattatggtgctcttacattagactgtagcccacggacaggactggatttcaacgagatggttctcctaactatgaaagaaaaatcttggttggttcataaacaatggtttctggatttaccattaccatggaccagcggcgcatcgacatctcaagaaacatggaatagacaagacttattggtaacgttcaaaaccgcacatgccaagaaacaggaagttgttgtcctaggaagtcaagagggcgcaatgcatacagctttaaccggagcgactgagattcagactagcggtactacaactatttttgcgggccacctcaaatgtcgcttaaaaatggataaattgacattgaagggcacgagttatgttatgtgtactgggagttttaaattagaaaaggaagtagccgagacgcaacacggtactgtgcttgtacaggtgaagtatgaaggtacggacgcaccatgtaaaatacccttctcaacacaggacgagaagggcgtaacgcagaatggacggttgatcacagctaatccaattgttacggataaggagaagcctgttaatatagaaacagagcccccttttggtgagtcgtatatcgttgtgggtgcaggagaaaaagccttaaaactatcctggttcaagaaaggatcttctataggtaaaatgtttgaagccactgccagaggagcaaggagaatggcaatattgggagatactgcttgggatttcgggagcataggcggcgtattcacatcggtagggaaacttgtccatcaagtatttggcactgcatatggcgttctatttagtggagtttcgtggacaatgaagattggaataggaatattacttacttggttgggactaaattcacgctcaacaagcctcagcatgacatgcatcgctgtaggtatggtaaccttgtatttgggcgtaatggtacaggcagatagcgggtgtgtaataaactggaaagggagggaactaaaatgcggaagtggtatctttgtgacaaacgaggtacatacgtggactgagcaatataaattccaggcagactctccaaaaaggttgtcagcggctatcgggaaagcctgggaagagggagtatgtgggattagatcagcaacaaggttggaaaacataatgtggaaacaaatatcgaatgaactaaaccacatattgttagaaaatgatatgaaattcacagtagtagtgggtgacgctaatggcatacttgcacaaggaaagaaaatgatcaggccacagcctatggaacacaaatattcctggaaaagctggggcaaagctaaaataatcggtgccgacatacaaaatacaactttcattatagacggtcctgatacacctgaatgcccagataatcaacgggcgtggaatatatgggaagtggaagattatgggtttggaatcttcacgaccaacatttggttgaaacttcgtgattcatatacgcaaatgtgcgatcatagacttatgagcgcagctatcaaagattctaaagcagtacacgctgatatgggttattggatagagagtgagaaaaatgaaacgtggaaactagcaagagcgagtttcattgaagtgaagacatgtacgtggccaaaaagtcatacattatggtcaaatggagttctagaaagcgaaatgataataccgaagatatacgggggcccaatcagccagcataattatcggccaggttatttcacacagacagcgggaccttggcacctgggcaaactagaacttgacttcgatttgtgcgaaggaactacagtagttgtggatgagcactgtggtaatagaggaccgtcactaagaacgacaacggtaacggggaaaatcatacatgagtggtgttgtagaagttgtactttgccacccctaagatttagaggagaagacgggtgttggtatggaatggaaataaggcctgtaaaagaaaaagaggaaaacttagttagatccatggtaagcgccggaagtggagaagtcgactccttttcattaggtatcctatgcgcatctataatgattgaggaggttatgcgtagtcgttggagtcgaaaaatgttaatgacaggtacgctagcagtcttcttacttttggtaatgggacaattaacgtggaatgacttaatacgattatgtataatggtaggagcaaatgcaagtgaccggatgggaatgggcacaacttatctagcactgatggctacatttaaaatgcgccccatgtttgctgttgggttattattcaggcggttaacaagtcgtgaagtactgctattaacaattggcttaagcctagttgcatcggtagagttgccaaatagtcttgaagaactcggtgatggtttagcgatgggcattatgatgctaaaactgcttacggaatttcaaccacaccaattatggataactttactctccttgacctttataaaaaccaccttgagtttagattacgcgtggaaaacgacagccatggcactgtcgatagtatcactttttccgttatgcttaagtactacaagtcagaaaactacttggctgccggtattactcggctcctttggttgcaaaccattgacaatgttccttataacggaaaacaaaatatggggacgcaaaagctggccattaaacgaaggaataatggctattgggatagtatcaatattactttcatctctcttgaaaaacgatgtaccattagcaggtcctctaattgcgggcgggatgctaatagcatgttatgttataagcgggtcatccgccgatttaagtttggagaaagcggcggaagtgtcctgggagcaagaggctgaacactctggcaccagtcacaacatcttggtagaagtacaggatgacggcacaatgaagattaaagatgaggaaagagatgacacacttacaattcttttgaaagccacgctattagcagtcagtggtgtctacccaatgagtataccggcaactctctttgtgtggtatttttggcagaaaaagaaacaacgcagtggagtcctttgggatacaccctcacctccagaagtcgagcgagctgtgctagatgatggaatctaccggatactacaaagaggattattaggaagatcgcaggttggagtaggagtattccaagatggagtttttcatactatgtggcatgtaaccagaggtgccgtgcttatgtatcaaggtaaacgcctagagcccagctgggcgagcgtcaagaaagatttaataagctacgggggaggttggaggtttcaaggttcatggaatactggcgaggaagtacaggtaatagcagtcgaacccggcaaaaaccctaaaaatgttcaaacgatgcctggaacattcaaaactccagaaggagaagtgggtgcgattgccttagacttcaaacctggaaccagcggaagcccaatagtaaatcgcgaaggaaaaatagtcggcctatatggtaacggcgtggtaaccacgtctggtacatacgtttctgctatagcacaagcaaaggcaagccaagaagggccgctgccagaaattgaagatgaggtcttcaaaaagcgcaacctcactataatggatcttcatccagggtctggaaaaactcgcaggtatttaccagccatggtaagggaagctatcaagcgaaaattgagaacattaatactagcacccacaagggtcgtcgcatccgaaatggcggaagctctaaaaggtatgccaattcgctaccaaacaacagctgttaaaagtgaacatactggtcgcgaaatcgtagatctgatgtgtcatgctacttttacaatgagactcctatcccctgttagagtaccaaactacaacatgatcatcatggacgaagcacacttcactgacccagcttcaattgccgctcgaggatacatttcgactcgcgttggaatgggcgaagcagctgcaatttttatgacggcaaccccaccaggatctgtagaggcctttccacagtcaaatgcagtaatacaagatgaagagagagatatcccggaacgttcttggaactccgggtatgactggatcactgattttccgggaaaaacggtatggttcgtcccttcgataaagagtggcaatgatatcgcaaactgcttgaggaaaaatggaaaaagggtaatacaactctcacgaaaaacttttgacacggagtatcagaaaactaagaacaacgattgggactacgttgttacgacagatatatccgagatgggagcaaatttccgcgccgacagggtgatagacccgagacgatgcctcaaaccagtaatactgaaagacggccccgaaagagtaattctcgcaggaccgatgcccgtaactgttgctagtgcagcacagaggaggggtaggataggtagaaatcaaaataaagaaggtgatcaatacgtctacatggggcaacccctgaataatgacgaagatcatgcccactggacagaagctaaaatgttacttgataatataaatactccagaaggaattattccggccctattcgagcctgagcgagagaaaagtgcagcaatagacggggaatatagactgcgaggggaagcacggaagacttttgttgaattgatgagacgaggagatttacctgtttggttatcatacaaggtagcttccgaaggatttcaatactcagatcgacgatggtgttttgacggtgaaagaaacaaccaagtgttagaggaaaatatggatgttgaaatctggacaaaagaaggagagaggaagaaacttcgtccgcgatggttagatgctcgtacgtactcggatccacttgcattacgtgaatttaaggaatttgctgcaggtagaagaagtgttagcggtgatcttatactagaaatagggaaactgccacaacaccttaccctacgagctcagaatgctctagataacctcgttatgcttcacaacagcgagcaaggagggaaagcatatagacatgcgatggaagaactaccagacaccatagagaccttaatgctattagctctaatagctgtgctgacaggaggggtcacactattctttttaagcgggaaaggattaggaaagacgagtatcggattgttatgtgtcactgctagttccgccttactttggatggcatctgtggaaccccactggatagcagcttctataatattagagttctttttaatggtgctattaatacctgaaccggatcgccaaagaacacctcaggataaccaactggcatatgtagttatcggtctactattcatgatcttaacagtagcagctaacgaaatgggactcttagaaacaactaagaaagatttgggtatcggccacgtagcggctgaaaatcaccaacacgcaaccatgttagatgtagacttaagaccagccagcgcatggacgctatatgcagtcgctacgacagtaataacgccaatgatgcgacacacaatagaaaatactaccgcgaacatatccttaaccgccattgccaatcaagctgcaatactgatgggtctagacaaaggatggccaatctcaaaaatggatatcggagttcctctgttagcattaggatgttattcacaagtaaatcccctgacattaacagcagcagtgttaatgctcgtagctcactatgcaataattggtccaggattacaagctaaagctaccagagaagcccagaaaagaaccgcagcaggaataatgaaaaatccaactgttgatgggatagtggcgattgatttggaccccgtggtttacgacgctaaatttgagaaacagttgggccagataatgttactaatattgtgcacttcacaaatacttttgatgcgaaccacatgggcactttgtgaatctattactcttgcaacaggacccctaacaactctttgggaaggttctcctggcaagttttggaatacgactatcgcggtctccatggcaaacatttttcgtggttcatacttagcaggggctggcttagcattttcgctaatgaaaagtctcggaggtgggcgaaggggaacgggtgctcaaggggaaacccttggtgaaaaatggaagagacaacttaaccaattatcaaaaagtgagttcaacacatacaagcgcagtggtataatggaggttgatagaagcgaggccaaagaaggtctaaaacgtggggaaaccacaaaacatgcagtttcacgtgggacggcaaaactcagatggttcgtggaacgcaaccttgtaaaacctgagggtaaggtaattgatctaggctgtggtcgagggggctggtcatactactgtgctggtctcaagaaagtaacagaagttaagggatatactaaaggtggtccgggtcacgaggaaccaataccaatggcgacctacggatggaatttagttaaactacctagcggaaaggatgtcttctttatgccgccagaaaaatgcgatacgctactatgcgatatcggtgaatcgagcccaaacccaacgattgaagaaggtcgaacgttaagagtgttaaaaatggttgaaccctggctgagaggaaaccaattttgcattaaaattttaaacccttatatgccaagtgtagtcgaaacgttagaacaaatgcaaagaaaacatgggggcatgctcgtccgaaacccactttcacgaaactcaacccacgaaatgtactgggttagttgcggtactggcaatatcgtaagtgcagtcaatatgacaagtcgaatgttattaaacagatttactatggctcaccggaaaccaacctatgaacgtgacgtagatctaggggcaggcacaagacatgtcgctgtcgagccggaggtagctaatcttgatattataggacaaagaatagaaaatatcaaaaacgaacacaaatcaacatggcattacgatgaagataatccctataaaacatgggcataccacgggtcatacgaagttaaaccaagtggatcagcttcgagtatggttaatggtgtcgtacggctcttgacgaaaccttgggatgtaataccaatggttactcaaatagcaatgactgatacaacgccatttggtcaacaaagagtctttaaagaaaaagtagatacaagaacacccagggccaaacggggtactacacagataatggaagtaaccgcgaaatggctatggggattcttgtcacgcaataagaaaccgcgaatatgcactagagaagaatttacaagaaaagttaggagcaatgctgctatcggtgcggtatttgtagatgaaaaccaatggaacagcgcgaaggaagccgttgaggatgaaagattctgggatctagttcatagggaaagagagctacataaacaaggtaagtgtgcgacatgtgtatataacatgatgggtaaaagggagaaaaagctaggagaatttggtaaagctaaaggaagtcgagcaatttggtatatgtggcttggagcgagatttttagaatttgaggctttaggattcatgaatgaagatcattggttctcacgggaaaatagtctatctggtgtagaaggggaaggattacataaattaggttacatcctacgggatattagcaagatacctgggggcaacatgtatgcagatgatacagccggctgggatacacgaattacagaggatgacctgcagaatgaagcaaaaatcacagaaataatggagccagaacatgcgttactagccacaagtatattcaaattaacgtatcaaaacaaagttgtaagggtgcaaagacctgcaaagaacggaacagtaatggatgtcatatcgagaagagatcaaagggggagtggacaggtaggtacttacgggctcaatacgtttacaaatatggaagtccaattaatccgccaaatggagtctgaaggaatctttttgccttcagagcttgaaacaccgaatttggcagaaagagttttagattggttggaaaaacatggagccgagagattaaagagaatggcaattagtggtgacgattgcgtcgttaagcctatagatgatcggttcgcaacggcattaacggcattaaatgatatgggcaaagttcgaaaagacattcctcaatgggaaccatctaaagggtggaacgattggcaacaagtcccattttgcagccatcactttcatcaattgataatgaaagacggccgagaaatagtcgtgccatgtagaaaccaagacgagttagtgggtagagctcgcgtaagtcaaggggcagggtggagcttgagagaaactgcctgcttgggtaagtcgtatgctcagatgtggcagctgatgtacttccaccggcgcgatttacgtctagccgccaatgctatctgttcagccgtgccagtggactgggtaccaaccagtcgaacgacttggtcaatccacgcacatcaccaatggatgactactgaagacatgttatccgtatggaatagagtgtggatagaggaaaacccatggatggaagataaaactcatgttagctcttgggaagaagttccgtacttaggaaagagagaggaccaatggtgtggttctttaatcggcttaacggcacgagcaacatgggcaaccaacattcaggtagcaatcaatcaagtacgccgtctaatcgggaacgaaaactatttagactatatgactagcatgaaaagatttaaaaatgaatcggaccccgaaggtgctttgtggtag

SEQ ID NO: 21244 - RNA, 9879 nt, synthetic construct
  misc_feature 1..9879: note = derived and/or modified CDS sequence (opt6) from DENV-1__GQ868508__SS-prME
  source 1..9879: mol_type = other RNA
tcggttactatgttactaatgttgttaccaacagcactagcattccatttaacgactcgaggtggtgaaccacatatgatagtatcgaaacaagaacgtggaaaatcgctgttatttaaaacatcggcgggcgtaaacatgtgcactctaattgctatggatctaggcgaactgtgtgaggacacaatgacctacaaatgtcctcaaattaccgaggctgagcctgatgatgtagattgttggtgtaatgcaactgatacttgggtgacgtacgggacatgctctcaaacaggtgaacaccgacgagacaaacgatctgttgctctagcaccacatgtcgggctcggattggaaacaagaacggagacatggatgagtagcgagggggcatggaaacaaatacagagggtagaaacatgggcgctacgccatcctggatttactgtgatagcactattcctggcgcatgcgataggaacatcgattactcagaaaggaatcatattcattttattgatgctggtaacaccgtcaatggcaatgagatgtgtgggaattggcaacagagacttcgtcgaaggtctaagtggcgcaacatgggtcgatgttgtcctagaacatggatcatgcgtgacaacaatggctaaaaataaaccaacactagatattgaattgctgaaaacagaagtaacaaatcccgcaatattgagaaaactatgtatcgaagctaaaattagcaatacaacaaccgatagtagatgtcctacccaaggggaggctacgcttgtcgaagaacaagacgcaaattttgtctgtcgacggacatttgtagataggggatggggcaatggatgcggattgtttgggaaagggagcttattaacatgtgcaaaatttaaatgtgtaaccaagttggaaggaaaaatagttcaatacgaaaacttgaaatactcggtaatagttacggttcacactggtgaccaacatcaggtgggtaatgaaactactgagcacggaaccattgcaacaattacacctcaagccccgaccagcgagattcaattaaccgattacggagccctaacactagactgttcaccaagaaccggactggacttcaatgaaatggttttattgactatgaaggaaaagagttggttggtacacaaacaatggtttcttgatctgcctctcccctggacgtcaggagcatcgacgtcacaggagacgtggaatcgacaagacctattagtcacttttaaaacggcacatgctaagaaacaagaggtcgttgtgttaggcagtcaggaaggcgcaatgcatacggcacttacaggcgcaacagaaatacaaacaagtgggacgacaaccatttttgcaggccatcttaaatgccgattgaaaatggacaaactaaccttaaaaggaacttcttatgtaatgtgcaccggaagttttaagctagaaaaagaagtagcagaaacacaacatggaactgtcttggtgcaggtaaaatatgagggaacagacgcaccatgtaagattcctttcagcacacaagatgaaaaaggagtaactcaaaatggtaggctaataacggctaatccaatagttacagacaaggaaaaacctgtaaacatagaaacagaacctccctttggcgaaagctatattgtagtaggggcgggagaaaaggctttgaaactaagttggttcaaaaagggatcatcaattggaaagatgttcgaagccacggctcgtggggctagacgtatggcaatattaggcgatacagcatgggactttggttctattggtggcgtatttacaagcgtcggaaaattggtccatcaagttttcggtaccgcgtatggagtcttgtttagtggcgttagttggacaatgaaaattggaataggaatccttctaacgtggctggggttgaatagtcgatcgacgtccttatcaatgacatgcatcgctgtgggtatggtaactctctatctaggggtcatggttcaagcagacagtggatgcgtaattaattggaagggccgcgaactcaagtgcggctcaggcattttcgtaacgaatgaggtgcatacatggactgagcaatataagtttcaggcagattctccaaaacgactaagtgccgctattggcaaggcttgggaagaaggagtttgcgggattcgttcggccacaagacttgagaatataatgtggaaacaaataagtaatgaactaaatcacatattactagaaaacgacatgaaattcacggtcgtagtaggggacgctaatggcattctagcacaaggcaagaaaatgattcgacctcaacctatggaacataaatactcatggaagtcctggggtaaggctaaaataataggcgctgatatccaaaacaccacgttcatcatagatggaccagatacaccagaatgtccggataaccaaagagcatggaacatatgggaagttgaagattatggctttggaatattcacgacgaatatttggttaaaactacgcgacagctatacacaaatgtgcgaccacagattgatgagcgcagcaattaaggattcaaaagctgtgcacgcagacatgggatactggattgaatcagagaaaaatgaaacttggaaactggcaagagcatccttcatagaagtaaagacatgcacatggcccaaatcacataccctatggtcgaacggagtattagaatctgaaatgataattccaaaaatttacggagggccaatttcccaacacaattatcgtcccggatactttacacagactgccggcccatggcatttagggaagttggaactagactttgatttatgcgaagggacaacagttgtcgtggatgaacactgtggtaaccgcggaccgtctttaagaaccaccacagtaacggggaaaatcatacacgagtggtgctgcaggtcctgcactctgcctccattaagattccggggtgaagatggatgttggtatggaatggaaataagacctgtaaaagaaaaagaagaaaatctggtcaggtcaatggtcagtgcagggtccggtgaagtagacagcttttcgctaggtatactatgtgcttcaattatgattgaggaagtgatgcgtagtcggtggtcgcgaaaaatgttaatgactggaaccttagcggtttttctattattagttatgggacaacttacatggaatgatttgatcagattatgcatcatggtaggcgcaaacgcttctgaccgcatggggatgggcacgacatatttagcgctaatggcaacatttaaaatgcgtccaatgttcgccgtcggactgttgtttcgtagacttacctccagggaagttcttctattgacgattggattaagtctcgtcgcaagtgtagagttgccgaactcactagaagaattaggagacggattagctatgggtattatgatgctaaaattattgacggagttccaaccacaccagctatggatcactttgttaagtctgacgtttataaaaacgacactatcactagactatgcgtggaaaacaaccgcaatggctctatctatcgtatcgttattcccactgtgcttatcgacaacgagtcagaaaacgacatggttaccagtcttactcggtagctttggatgtaaaccacttacaatgtttctaatcacagaaaataaaatatggggtcgaaaatcctggccactgaacgagggaataatggcaatcggaatagtaagcatacttctaagtagtctactcaaaaatgatgtaccgttggcaggaccccttatagccggtggcatgttaatcgcatgttacgtaataagtggatctagtgcagacttaagcctagaaaaagcagctgaagtgagctgggaacaagaagcagaacattctggaacgagtcataatatacttgtagaagttcaagatgatggtaccatgaaaataaaagatgaggagagagatgatacactcacaattttattaaaagctacgttactggcagtctcaggagtatatcctatgtcaatccctgcaactctattcgtatggtacttttggcagaaaaagaaacaacgaagtggagttttatgggacacacccagtcccccggaggtagaaagagctgttcttgatgacggcatatataggattttacagaggggccttctaggacgatcacaagtgggtgtaggcgttttccaggatggggttttccacacaatgtggcacgtgaccagaggtgcagtgctcatgtaccaaggtaaacgactagaacccagctgggcaagtgttaaaaaggacttgatttcttacggaggaggttggagattccaggggagttggaatacgggagaagaagtacaggtaatagcggtagaacccgggaaaaaccccaaaaatgttcaaacaatgcctggcactttcaaaacacctgaaggagaagtaggagcgattgcattagacttcaaacctggaacttcgggatcacctatagtcaatagagaaggtaaaatcgtcggtctttatggaaatggtgtcgtcaccacgagcggcacttacgttagtgctatcgcccaagcaaaggcttcgcaagaaggtcccttgccagagatagaagacgaagtattcaagaaaaggaacctcactataatggacctacacccgggaagcggtaaaacacgtagatacctaccagctatggttagagaggcgataaaaagaaaactacgaacactaatcctggcaccaacacgagtagtagccagcgaaatggctgaggctttaaaagggatgccaataaggtaccaaacaacggcagtaaaaagtgaacacacgggtcgagaaatagtagaccttatgtgtcatgcgacgtttactatgaggttactttcacctgtaagggtaccaaattataatatgattatcatggacgaagcacactttacagatccggcgagtattgcagcacgtgggtatatttccacacgcgttggaatgggggaagcagctgctatcttcatgactgctactcctcccggttcagtggaggcttttccacagtcgaatgcagttatacaagatgaagaacgagatattccggaaaggtcctggaatagtggttatgactggataacagattttccaggaaaaacagtgtggtttgtaccatcgattaaatcaggtaatgatatcgcaaattgcttacgtaaaaatggaaaaagagtaatccaactatcgcggaaaaccttcgacactgaatatcagaaaactaaaaacaatgattgggattacgtggtgacaactgatatatcagaaatgggggctaattttagggcagacagagtaattgatccacgaagatgtctcaaaccagtcatattgaaagatggtccagagcgagtaatactcgccgggcctatgcctgtgaccgtagctagcgcagcccaaagaagaggaagaatcggtcggaaccaaaacaaagagggagaccaatacgtctatatggggcagccattaaataatgatgaagatcatgcgcattggaccgaagctaaaatgctactagataacattaatactcctgagggaatcatacccgccctatttgagccagaaagagaaaaatcagctgctattgatggtgaatatcgattaagaggagaggcaaggaaaacatttgttgagttgatgaggagaggagatttacccgtatggttatcatacaaagttgcatcagaaggttttcaatacagtgaccgacgctggtgcttcgatggggaaagaaacaatcaggtactagaagaaaatatggacgtagaaatatggacaaaggaaggtgaaaggaagaaactcaggcctagatggctcgatgcaagaacatattcagaccctctagcgttaagggaatttaaagagtttgcagcaggaagaaggtccgtctccggtgacctaatactcgagattggtaaattacctcagcatctcaccctgagggctcaaaatgcgctggacaatctagtaatgctacataatagtgaacagggcggtaaggcgtataggcatgctatggaagaactacctgacactatagaaaccttaatgttactggccttaatagcagttctgacaggtggtgttacattatttttcttatcaggtaagggattaggaaaaacatccatcggcttactatgtgtaacggcatcctcggccttgctttggatggcatcagtagaacctcattggatagctgcatcaataattttagagttctttttgatggttttactaataccagaacccgatcgccagaggacaccccaagataaccaattagcttatgttgtaatagggttactttttatgatcttaacggtcgctgcaaatgaaatgggattgcttgaaacaaccaagaaagatctgggaataggccatgtcgcagcagaaaatcaccaacatgctacaatgctagatgtagacctaagaccggctagtgcttggacactgtatgcagtagcaacgacagtaatcacacctatgatgcggcacaccattgaaaataccactgcgaatataagtctaacggcaattgcaaatcaggctgccatattaatgggccttgacaagggctggcctatcagtaaaatggatataggagtacccttattggccctaggatgttactcgcaagtgaatcctttgactctaaccgcggcagtacttatgctggtagcacactatgccattataggtcccggacttcaagcaaaagcaacaagagaagcgcagaaaaggacagcagccggaatcatgaaaaacccaacagttgacggtatagtggcgatagatctagatccagtagtctatgatgcaaagttcgagaagcagctagggcaaatcatgctcctaattttgtgcacttctcagatccttcttatgagaacaacatgggctttgtgcgaatctataacattagcgaccggtcctctgactacgttatgggaaggttcaccggggaaattctggaacactactatagcagtcagtatggcaaacatattccggggatcatatttagctggagcaggtttagcattttctttaatgaaatcgttaggtggtggcagaagggggactggagcacaaggagaaactctaggagaaaaatggaaaagacaattgaaccaactctcgaaaagcgagttcaatacttacaaacgatcaggaataatggaagtagatcgatctgaagcgaaggaaggcttaaaacggggagaaacgactaaacatgcagtatcaagaggtacagcaaaacttagatggtttgttgaaaggaatctagtgaaacctgaaggtaaagtaatcgatttaggctgtggacgcggaggatggtcgtattactgcgcaggattgaagaaagtaacggaagttaaaggctacactaagggtggtcccggccacgaagaacccatacccatggcaacttatggttggaatttggtgaagctacatagcggcaaagacgtgttctttatgccaccagagaagtgtgataccctattatgtgacatcggagaatcgtcaccaaatcccacgatagaagaaggacgaactttacgagtcctgaaaatggtagagccatggttacggggtaatcaattctgcatcaaaatattgaacccatacatgccgagtgttgtagagactctggagcaaatgcagcggaaacacggtggaatgcttgttagaaaccccctatcacgcaacagtacgcatgagatgtactgggtaagctgtggcacaggtaacattgtctcggcagttaatatgacgagcaggatgctattaaacaggtttacaatggcacatcgaaaacctacatatgaaagagacgtagatttaggagcaggaacgcgtcatgtagctgtagagcctgaagtagccaatttggatatcataggccagcgcatagagaatattaaaaacgaacacaaatcgacgtggcattatgatgaagataatccttataaaacatgggcatatcatggatcatatgaggtaaaaccaagtggatcagccagttctatggtgaatggagtggtacgactactaacaaagccatgggacgtaattcctatggtaacgcagatagcgatgacagacacaacgccttttggccaacagagggtatttaaagaaaaagttgatactagaactccacgagccaagcggggaactacacagatcatggaagtgacagcgaaatggctttggggatttttgagtagaaataagaaaccacggatttgtacaagagaggaatttactagaaaagtaagaagtaacgctgcaattggagctgtttttgtagacgaaaaccaatggaactcagctaaagaagcggtggaagatgagcgtttttgggatttagttcatagagaaagggagttacataagcaaggaaagtgcgcgacctgtgtatataatatgatgggcaagagagagaagaaattaggtgaatttggcaaagcaaaaggcagtagagcaatatggtatatgtggctgggagctagattccttgagtttgaagcactaggatttatgaacgaagaccattggttcagccgtgaaaactctttaagtggagttgaaggagaggggctgcacaaacttggatatatacttagggatatatcaaaaattccgggaggaaacatgtatgctgatgacactgcgggatgggacactaggataacagaagacgatttacaaaatgaggccaaaattacagaaattatggaaccagaacatgcgttattagctacatcgatatttaagttaacgtaccaaaacaaagtggtacgcgttcaaaggccggccaaaaacgggacagttatggatgtcatctcaaggagagatcagcgaggatccggacaagttggtacttatggactaaatacgttcaccaatatggaagtgcagcttattagacaaatggaaagcgaaggaatatttttaccgagtgaactggaaaccccgaacctcgctgaaagagtactggactggctagagaagcatggagctgaaagattaaaaagaatggcaatatccggagacgattgcgtggtaaagcctattgacgatcggtttgcaaccgcattaactgcgttaaatgacatgggtaaggtaagaaaagatataccgcagtgggaaccaagcaaagggtggaacgactggcaacaagtcccgttttgctctcaccacttccatcaactgatcatgaaagacggaagagaaatagtagttccctgcagaaaccaagatgaattagtggggagagccagggtctcccaaggagcaggatggagtttaagagagactgcatgcttagggaagtcctacgcgcaaatgtggcaattgatgtatttccatagacgcgacctaaggctcgcagctaacgcgatatgtagtgccgtaccagtagattgggtccccaccagcagaactacatggagtatacacgcacatcatcagtggatgaccactgaagatatgctgagtgtgtggaatcgcgtgtggatagaagaaaatccttggatggaagataaaacacatgttagttcatgggaggaagtaccctacctgggtaaacgtgaagaccaatggtgcggctcactcatagggttaacagctcgtgcgacatgggccactaacattcaagtggcaataaatcaggttagaagactaatcgggaacgaaaattatttagattacatgacttctatgaaacggtttaagaatgaatccgatcctgaaggtgccctttggtaa

SEQ ID NO: 21245 - RNA, 9879 nt, synthetic construct
  misc_feature 1..9879: note = derived and/or modified CDS sequence (opt6) from DENV-1__GQ868509__SS-prME
  source 1..9879: mol_type = other RNA
tcagtaactatgttgttgatgctattgccaacagcgcttgcatttcatttaacgacacgcggaggagaaccacatatgattgtatcaaaacaagaaaggggaaaatcattactctttaaaacgtcagccggtgtaaacatgtgtacattgatagctatggacctgggtgaactgtgtgaagatacaatgacttataaatgcccacaaataaccgaagctgaaccagatgacgtggattgctggtgcaatgcgactgatacttgggttacatatggaacatgttcacagactggagaacataggcgagataaaagatcagtagctcttgcgccccacgtaggactcggactggaaacacgcaccgaaacttggatgtccagtgaaggtgcttggaagcaaatacaaagggttgaaacgtgggctctacgacatcctggattcactgtcattgcactatttttagcacatgcaatcggaacgtctattacccagaaaggtataatattcattttactgatgctcgttacaccatccatggcaatgagatgcgtgggaattggaaatagagacttcgtcgaaggactttcgggagcgacttgggtagatgtcgtactggaacacggaagttgcgtaaccactatggccaaaaacaaaccaaccttggatattgaactactaaaaacggaagtaacaaatccagcaattttacgaaaactgtgcatcgaggcgaaaatatcaaatacaacaactgactcaagatgccctacacaaggtgaagcgactttagtagaggaacaagacgcaaacttcgtatgtagacggactttcgttgatcgcggctgggggaatgggtgtgggttatttggaaaaggtagcttattaacctgtgcaaaatttaaatgcgtaactaaactggagggtaaaatagtccaatatgaaaatttaaaatacagtgtaatagtaaccgtacatacaggtgatcaacatcaagtaggaaatgaaactaccgaacatgggaccattgccacaattacacctcaagcaccaacttcagaaatccaactcactgactatggcgcattaacactcgattgcagcccaagaaccggattagacttcaacgaaatggtacttttaacaatgaaagagaaaagctggttggtacataaacaatggttcctagatctaccgttaccctggaccagcggtgcaagtactagccaagagacatggaacagacaagatctcttagtaaccttcaaaacagcgcatgccaagaaacaagaagttgtcgtacttggctcacaagagggagcgatgcatacagctttgactggggccacagaaatacagatgagtggcactactacaatattcgctggacatctcaaatgccggttaaaaatggataaactaacactcaaaggcacgtcatatgtaatgtgcaccggctcttttaaattagaaaaagaggttgccgaaacgcaacatggaacagttttagtccaagtaaaatatgagggtacggatgcaccctgtaaaatccccttcagcactcaagacgaaaaaggagtcactcaaaatgggagacttatcaccgcaaatccaatagtgacagataaagagaaaccagtcaatattgaaaccgaaccgccatttggtgaatcgtacatagtcgttggtgctggagaaaaggcactaaagttaagctggtttaagaaaggatctagtatcgggaagatgttcgaagcaactgcccggggcgcgagacgaatggctatattaggagacactgcttgggacttcgggtcaataggtggtgttttcacttcagtgggaaaactcgtgcaccaagtattcggtacggcatatggagtattattttcaggggtatcctggaccatgaaaatcggaattgggattttactaacatggctcggcctgaatagccgttctacctcgttgagcatgacatgtatagcagtggggatggttacgctctatttaggagtaatggttcaagctgactctggttgcgtaataaactggaaaggcagagagctaaaatgtggttcgggaatatttgtaacaaacgaagtgcatacatggaccgaacaatataaattccaggctgattcgcccaagaggctgtcggccgccataggcaaagcgtgggaagagggagtatgcgggataaggtcagtgacccgactagaaaatataatgtggaaacaaattagcaatgaattaaatcacatattattggaaaacgacatgaagttcaccgtagtggtgggagacgctaacggtattttagctcaaggaaagaaaatgattcgacctcaaccgatggaacacaaatactcgtggaaaagttgggggaaagctaaaataataggagctgacattcaaaacacaacttttataatagatggaccagacacacccgagtgcccagacaatcaacgcgcatggaacatatgggaggttgaagactacggctttggtatattcactactaatatttggttgaagttaagagacagctatacgcagatgtgtgaccacagactcatgtcagcagcaataaaagattcaaaagctgttcatgcagatatgggttattggattgaatccgagaaaaatgaaacctggaaacttgcacgtgcatcgttcatagaagtcaaaacatgtacttggcctaaatcccatacactatggtcaaatggtgtcttagaaagcgagatgatcattcccaagatctatggaggacccattagccagcataactaccgaccaggttatttcacacaaacagcaggaccatggcacttagggaaactagaactcgattttgacttgtgtgagggaacgacagtagttgtcgatgaacactgtgggaatagaggcccatcactacgaacaacaacggtaacagggaaaattatccatgaatggtgctgtaggagctgtaccttaccgccattacgctttaggggagaagacggatgctggtacggtatggaaataaggccggtcaaggaaaaagaggagaacctggttagatcaatggtatcagcaggatccggcgaagtagatagtttctcacttggtatactatgtgctagtatcatgatcgaggaagtcatgcgtagtagatggtccagaaagatgctaatgacaggaacactggcagtgtttctattacttattatgggccaattgacatggaacgatctaataagattatgtataatggtaggagcaaacgcttcggataggatgggaatgggaactacgtacctcgctctgatggccacatttaagatgcgacccatgtttgccgtagggttattatttaggaggttaacgagtagagaagtattactattgacaataggtcttagcttggttgctagtgttgaactgccaaattcactggaagaactaggcgatggtctagcaatgggcataatgatgttaaaacttttaacagaatttcaacctcatcaattatggacaacgcttctatcattaacttttataaaaactacattatctctggactatgcttggaaaactaccgcaatggcattaagtatagtaagtctattccctttatgtttgagcacaacaagtcagaaaacgacgtggctacccgtcctgctgggtagttttggctgcaaacccctcacaatgttcttaatcactgaaaacaaaatatggggaaggaaaagctggccccttaatgaaggtattatggccattggtatcgtcagcatactattatcatcactccttaaaaatgacgtcccactcgcgggtccgttgattgctggtggcatgctcattgcgtgttacgtaatttcgggaagctctgcagatttatcacttgaaaaggccgctgaagtcagttgggaacaagaggccgagcacagcggtacctcacacaatatacttgtagaagtacaagacgatggaactatgaagataaaagacgaagaaagagatgacacactgacaatcttgctaaaagctacactattggcagtgtcaggtgtctaccctatgagtatacctgctacactatttctttggtatttttggcagaagaagaaacaaagatctggtgtactttgggacaccccttctccaccagaggtagaaagagcggttttagatgatggaatttatagaatactacagcgggggctgctcggaaggagtcaagtaggagtaggtgtctttcaagacggagtatttcacactatgtggcatgtgacgagaggggctgtattgatgtatcagggaaagagactagaaccgagttgggcctcggtgaagaaagacctcatatcgtatggtggtggttggaggtttcagggctcttggaacacaggagaagaggttcaagttatagccgtagaacctggtaagaatcccaaaaacgtacaaaccacaccagggacttttaaaacaccagaaggggaggtaggagctatcgcattggattttaaaccaggcacgtcaggctctccaatagtaaatcgtgaaggaaagatagtgggcttatatgggaacggcgtcgtcacaaccagtggaacatacgtatcggcaatagcacaagcgaaagcaagtcaagaaggtccactaccagagatagaagatgaagtttttaaaaagcgcaatcttacgataatggatctacatccaggttcaggcaaaacaagacgatatttacccgcaatagttagggaggcaataaaacgcaaactacgcacactaatcctagcgccaacaagagttgtcgcaagcgaaatggctgaagcactcaaggggatgccgatacgatatcaaacaacagcagttaaaagcgaacacacgggacgtgaaattgtcgatcttatgtgccacgccacatttaccatgcgcttactttctccagtaagggttcctaattacaacatgattattatggacgaagcacactttacagacccggctagcatcgctgcgagaggctacataagcacgcgagttggaatgggcgaagctgctgccattttcatgacggccacacctcctggctcggtagaggcttttccacagagcaatgcggtgatacaggacgaagaaagagatatccctgaacgcagctggaacagcgggtatgactggattacagattttcctggcaagactgtttggttcgtacctagcattaaaagtggaaatgacatagctaattgcttaaggaaaaacggtaagagggtaatccagttaagtcgtaagacgttcgacacagagtatcagaaaactaaaaataatgactgggactatgtcgtcaccacagatatttctgaaatgggtgcaaattttcgcgcggatagagtcatcgacccaagaaggtgtctaaaaccagtgatacttaaggatgggccagaaagagttattttagcgggaccaatgccagttacagtagcgtcagcagcgcaacggagaggcagaataggtaggaaccagaataaggaaggggaccaatacgtttatatgggacagcctctaaacaatgatgaagatcatgctcattggaccgaagctaaaatgttgcttgataacatcaatacaccagagggaataatacctgctctatttgaaccagaacgtgaaaaatcagctgctatagacggagagtatagactacgaggggaagccagaaaaacatttgtagaattgatgcggcgaggtgatctgccggtatggctctcatacaaagttgcatccgagggattccaatattcggaccgtcgatggtgcttcgacggagaaagaaataatcaggtgcttgaagaaaatatggacgtagaaatctggactaaagaaggcgaacggaagaaacttagaccacgatggcttgatgcacggacctattctgacccattggcgcttagagagttcaaagagttcgctgccggaagaagatcggtatctggcgatttgatactggagattggaaaattgccacaacatcttacgctacgtgcacaaaatgcactcgacaacctagtaatgttacataacagtgagcaagggggaaaagcatatcgacatgccatggaagagttaccagatacaattgagactttaatgttgttggctttgatcgcagtactgacaggaggtgtcaccttattcttcctttcggggaaagggttaggtaagacgagtattggtttgctctgtgttacagcctcttcagctttattatggatggcaagtgtagaaccacactggatagctgctagcataatcctcgagttctttctaatggtacttttgatacctgagcccgatagacagagaaccccgcaagataaccagttagcatacgtggttatcggactactattcatgatactgactgttgcagcaaatgagatgggtttgctggaaacaaccaagaaagatcttggtataggtcatgtagccgctgaaaaccaccaacatgccaccatgctagatgtagaccttcggcccgctagtgcgtggactctatatgcggttgcaaccacagtgatcacaccaatgatgcggcatacgattgagaatacaacagcaaacatttcattgactgcaatagcaaatcaggctgcaattctaatgggcttagataaggggtggccgatcagtaaaatggatataggcgtacctttattggcactaggatgttactcacaggttaacccactaacgctaactgctgcagtgttaatgcttgtggcgcattacgctatcattggaccaggcttgcaggcaaaagctacccgagaagctcaaaaacgaactgctgcagggattatgaaaaacccaacagtcgatgggattgtagccatagatctcgatcccgttgtatacgatgcaaaattcgaaaaacagctcggacagatcatgttattgatattatgcacaagtcaaatcctcctaatgcgaacaacttgggctttgtgcgagagcattacactggctacagggccattaacaacattgtgggagggatcacctggaaaattttggaatacgacaattgcagtgagcatggctaatattttccgaggctcatacttggcgggagcggggcttgctttcagtctaatgaaaagtttagggggtggccgacgtggaacaggtgcgcaaggagagaccttaggcgagaaatggaaaagacaactaaaccaattatcaaagagtgaatttaatacatacaaaagatcaggaattatggaggtcgacagatccgaagcgaaagaagggctgaagagaggagaaacaaccaagcacgcagtctctaggggaacagcaaaactgagatggtttgtagaaaggaaccttgttaaaccagaaggcaaagtaatcgatctagggtgtggtagaggaggatggtcatattattgtgcaggactcaagaaagttactgaggtcaaaggttatacgaaagggggaccaggtcatgaagaaccgattcccatggctacttatgggtggaatctagtaaagctgcatagtggtaaagatgtattctttatgccgccagagaaatgtgatacacttctatgtgacataggagaaagctcaccaaacccgaccatagaggagggtagaacgctcagggtattaaagatggtcgaaccatggctgagaggaaatcaattttgcatcaaaattttaaatccctacatgccaagtgtagtggagaccctggaacaaatgcaaagaaaacacggaggcatgttggtaagaaatcctctctcaagaaattccacgcacgaaatgtactgggtgagttgtggaacgggaaacatagtgtcagccgtaaatatgacgtctagaatgctcttgaatcgatttacaatggctcatcgaaagcctacgtttgaacgggacgtagacttaggtgcaggcactcggcacgtagcagtcgaacctgaagtagcaaatttggatataattggacaaagaatcgaaaatatcaaaaatgaacataagagtacatggcattatgatgaggacaacccttataaaacatgggcgtaccatggatcttatgaagtaaaaccctccggatcagcatcgagcatggtaaacggcgttgttcgcttgctaacaaaaccatgggatgtaattccaatggtaactcaaatagcaatgaccgatactactccctttggccaacagcgtgtctttaaagaaaaggtagatacacgaacgccacgggctaaaagaggaactacgcagataatggaagtaacagcgaagtggttatggggtttcttatcaagaaataagaaaccaagaatatgtacaagagaagaatttacacgcaaagttagaagtaacgctgctataggtgcagtctttgttgacgaaaatcaatggaatagcgctaaggaagcggtagaggatgaaagattttgggaccttgttcatcgagaacgagagcttcacaaacaggggaaatgtgcaacatgcgtatacaatatgatggggaaacgcgagaagaaactaggggagttcggtaaggcgaaaggatcacgagcaatctggtatatgtggttaggagcaagattcttagaatttgaagccttgggtttcatgaacgaagatcactggttctcgagagaaaattcattaagtggtgttgaaggtgaaggactacataaactgggatacatattacgggacatatcaaaaatccctggaggaaacatgtatgctgacgataccgccggatgggatacaagaattacggaagatgatctacagaacgaagcaaagataacagacataatggagccggaacatgctttgttggccacgagcatattcaaacttacttatcagaataaagtagtacgggtccaaagaccggctaagaacgggacagtaatggatgtaatatcaagaagagatcagagaggtagtggacaagtagggacgtacggactaaacacatttacaaacatggaagttcaattaataagacagatggaatctgagggaatattccttccttccgaattagaaacgccaaatttagctgaacgggtactagactggttggaaaagcacggagcggaacgcttgaaacgaatggcaataagcggtgacgattgcgtagtcaaacctatagatgaccgatttgcaacagccctcaccgcactaaatgatatgggtaaagttagaaaagatataccacagtgggaacccagtaagggttggaacgattggcagcaagttcctttctgcagccaccattttcatcagttaataatgaaggatggtcgtgaaattgtcgtaccgtgtagaaatcaggacgagctagtaggcagagctagggtcagtcaaggagccggttggagtttacgggagacagcctgcttaggaaaatcctatgcccaaatgtggcaactgatgtactttcataggagggacttaagactagcggccaacgcaatctgttctgctgtgcctgtcgactgggttccaacctcacggacaacatggagtatacacgcacatcatcaatggatgacaacagaagatatgctgtccgtatggaaccgggtctggattgaagagaatccatggatggaagacaagacacatgtttctagttgggaagaagttccctacctaggaaagcgagaagatcaatggtgtggttctctaattgggctaacggctcgtgccacctgggccacaaacatccaggtagctatcaatcaagttcggagattgatagggaatgagaattacttagattatatgacaagtatgaagaggtttaaaaatgagtcagatcctgagggtgcgttatggtaa

SEQ ID NO: 21246 - RNA, 9879 nt, synthetic construct
  misc_feature 1..9879: note = derived and/or modified CDS sequence (opt6) from DENV-1__GQ868510__SS-prME
  source 1..9879: mol_type = other RNA
tcagtaactatgctgttgatgctattgccaacagcactagcatttcatttaacaactcggggaggagaaccacatatgatagtatctaaacaagaacgtggcaaatcattacttttcaaaacatctgctggagttaatatgtgtacgttaatagctatggacctaggagaattatgtgaagatacaatgacttataaatgtccacaaataactgaagcagaacctgacgatgtcgattgttggtgtaacgccacggatacatgggtgacctacggaacatgctctcaaacaggtggtcatagaagagaaaaacgctcggtagccttagctccacatgtagggttaggtttagaaacacgcacggaaacatggatgtcaagcgaaggcgcgtggaaacaaatacaacgggttgaaacatgggcgctgaggcatcctggcttcactgttatagctttgttcttagcacatgcaatcggaacaagtataacacaaaaaggcatcattttcatactattaatgcttgttacgccatcgatggcaatgcgatgtgtaggaataggaaaccgagatttcgtggaaggtttatctggggcaacttgggtggatgtcgtattggaacacggcagctgtgttactactatggctaaaaataaaccaacgttggatatcgaactattaaaaaccgaagtcaccaatcctgcaatactaaggaaattatgcatcgaagcaaaaataagcaatacaacgacagactctcgatgtccgacgcaaggtgaagcaactttggttgaagaacaagacgcaaatttcgtgtgtcgcagaacctttgttgatagaggatggggcaatgggtgtgggttatttggcaaaggaagccttctgacatgtgcgaaattcaaatgcgtaactaaactagaaggtaaaatcgttcaatatgagaatttaaaatatagtgtcattgtaaccgtccatactggagatcaacatcaagtaggaaatgaaacaaccgaacacggcactatagcaacaattactccacaagcaccaacgagcgaaatacaattgacggattatggagctctaacacttgattgtagccctcgaaccggactagactttaatgaaatggtgttgcttaccatgaaggagaaaagctggctagtccataagcaatggtttttagacctacccttaccttggacatctggggcgagtacaagtcaagaaacctggaatcgtcaagatttgcttgttacattcaaaactgcacacgctaagaaacaagaggtagtagttttagggtcccaggaaggggccatgcatacagctttaacgggggcaacggaaatccaaacttccggcacgacgactatatttgccggccatttaaaatgccgcttgaaaatggacaaactgacactaaaaggaacgtcttatgttatgtgcacaggatctttcaaactagaaaaagaggttgcagaaacgcaacacggcacagtcttggttcaagtaaaatatgaaggaactgacgcaccgtgcaaaataccattttccacgcaggatgagaaaggcgtaacacaaaatggtcgattaattacagccaatcctatcgtaaccgataaagaaaaaccggttaacatagagacggaacccccattcggagagtcatatatcgtagtaggtgctggagaaaaagctctaaaattaagctggttcaagaaagggtcttcaataggtaaaatgttcgaagctacggctcgcggagctagacgtatggcgattctaggcgatacagcatgggattttggttcaataggcggcgtctttacaagtgtaggaaaacttgtacatcaggtcttcggaaccgcatatggcgtcttatttagcggtgtgagctggaccatgaagattgggatcggcattctactaacatggcttggactaaacagccgcagcacatccctctctatgacttgtatagcggtaggaatggtaacgttgtatctcggtgttatggtgcaggctgactcaggatgtgtcatcaactggaaggggcgagaacttaagtgtggctccggtatatttgtaacgaacgaagtacacacctggactgagcagtacaaattccaagcggattctcccaaaagactttctgcagctataggtaaggcttgggaagagggagtatgcggaatacgatccgctacacgattagaaaatatcatgtggaaacaaataagcaatgaattgaaccatatactattagagaacgatatgaaattcacagtagttgtcggcgacgcaaacggcattttagcacaaggcaagaaaatgataaggccacaacctatggaacataaatacagctggaaatcctggggaaaggcaaagataataggagccgatatacaaaatactacctttataattgatggaccagatacccctgaatgcccagatattcaaagagcttggaatatctgggaggtggaagactatggttttggtattttcacgactaacatatggttaaagctaagagattcgtatacccaaatgtgtgaccatagactaatgtctgctgcgattaaggacagtaaagcagttcacgccgatatgggatattggattgaaagtgaaaagaatgaaacatggaaactggcaagggcttcgttcatagaagttaagacctgcacttggccaaaatcacatacgctttggtcgaatggcgttcttgaaagtgagatgataattcctaaaatttatggaggcccaatcagccaacataactataggccgggatacttcacgcaaacggctggtccctggcatttaggaaaattggaattggatttcgatctatgcgaaggtacgaccgttgtcgtcgacgaacactgcggaaatcggggtcctagcttacgaaccacgacagttacaggcaaaattatccatgaatggtgttgtagaagttgtacattaccgccattaaggttccgtggggaggatggatgctggtacggcatggaaattagaccagttaaggaaaaagaagaaaatttagtaaggagtatggtatctgcaggttctggagaggtcgacagttttagcttaggcatcctatgtgcttcaataatgattgaagaagtaatgagaagtcgatggtctcgtaaaatgttaatgacaggtacattggcagtgtttctattattaataatgggccaattaacatggaaagacttaataagattatgtatcatggtaggagctaatgcgtcagacagaatgggtatggggacaacgtacctggcacttatggccacatttaaaatgagaccaatgttcgccgtcgggctgttattccgtagattaacaagtagggaggtactgctattaaccataggactatctctggttgctagtgtagaattacctaacagtctagaagaattgggagatggactagcaatgggaataatgatgctcaaattattgacggagttccagcctcatcaattatggacgaccttgctcagcttgacttttattaaaacaacactgagtctcgactatgcttggaagacgacggcaatggctctttctatagtttccctcttccctttgtgcctaagtaccacatcacaaaagaccacttggttgccagtgcttcttggctctctaggttgtaaaccactcaccatgtttctaataacggagaataaaatatgggggcgtaagagctggcctctgaatgaagggataatggcaataggcattgttagtatactattgagttctttgctcaaaaacgacgttccactagcaggccctctcatagccggtggtatgctcattgcctgttatgtcattagtggttcctccgccgacttgtccctggaaaaagccgcagaagtgagctgggaacaggaggccgagcattccggaacaagtcacaatatcctagtagaggtacaggacgatggtactatgaaaattaaagatgaagaacgtgacgacacactaaccatactgttaaaagcgactttattagcagtaagtggagtatacccaatgagtattcctgccactttatttgtctggtacttctggcaaaagaagaaacaaagatcaggggttctctgggatacaccatcaccaccagaggtagagagagctgtgttagatgatggtatttacagaatactacaaagaggtttattagggcgatcacaagttggggtcggggtttttcaagacggtgtattccatacaatgtggcatgtaactcgaggagccgtgttgatgtaccaaggaaagagattggaaccttcctgggctagtgttaagaaagatttaatatcctatggagggggatggaggtttcaaggcagttggaataccggggaggaagtgcaagtaatcgcagttgagcccgggaaaaaccccaaaaatgtacaaacaactccgggaacattcaaaacgccagagggagaagttggagcaatagcattagactttaaacctggcacatcaggttcgcccattgtcaatagagaagggaagattgtcggactttacggcaatggggtagtaacaacgagtggtacttatgtaagtgcaatagcacaagcaaaagcctcacaggagggaccattacccgaaatcgaagatgaagtatttaagaaacgcaatctaacaataatggaccttcacccaggaagcgggaaaacaagacgttatttgcccgcaatagtaagagaggctataaaacgaaaacttaggaccttgatcttagcccctacacgagtcgtagcttcagaaatggccgaagcattgaaaggaatgcccattagatatcaaacaactgcagtaaagtcggaacacactggtagggaaatagttgacttaatgtgccatgcaacctttactatgaggttactttcaccagtgcgagtccccaactataatatgatcataatggatgaggcacattttacggatccagcatcgatcgcagctagaggatatataagtacaagagttggaatgggagaggcagcagcgatatttatgacagcgacaccaccgggttcagtcgaagcattcccacagtccaacgctgttatccaagacgaagaaagagatataccggagcgaagttggaacagcggatacgattggattacagactttcctggcaaaacagtgtggtttgttccaagcataaaatccggtaatgatattgcaaattgtttaaggaaaaatggaaaaagagtaattcagttgtcgagaaaaacattcgatactgaataccagaaaaccaaaaataacgactgggattacgtggtaactacagatataagcgaaatgggcgcaaacttcagagctgatagagtgatcgatcctagacgttgcctaaagccggttatacttaaagatggaccagagagagtaatactagcaggacctatgccagtgacagtcgcttccgccgctcagagacgaggtaggatagggaggaaccagaataaagaaggagatcagtatgtttatatgggacaacccttaaacaatgacgaagatcacgcacactggactgaggctaaaatgcttctggataatattaataccccagagggaattatcccagcgttatttgaacccgaacgtgagaaaagcgctgccattgatggagaatatcgcttacgaggagaagcccgaaaaacctttgtggaactaatgcgacgaggagacctgcccgtttggttatcatacaaggtagcgagtgaagggtttcaatactctgatagacgttggtgctttgacggtgaaagaaacaatcaagtcttggaagaaaacatggatgtcgaaatttggacgaaagaaggcgaacgaaagaaactacgaccaagatggcttgatgcaagaacgtacagcgatcccttggcattgcgagaatttaaagagttcgccgccgggaggagatcggtctctggtgatctaatattagaaataggaaaactaccacaacatttaacgttgcgcgcacaaaacgcactagataatttagtaatgttacataactctgaacaaggaggaaaggcttatcgtcatgcaatggaagaattaccggacacaatagagacattaatgttgttagcgctaatcgcagttctaactggcggcgtaacattattctttctaagtggaaaaggattaggaaaaacaagtataggtttgctatgtgtcacagcaagttcagcactattgtggatggcgtcggtagaaccacactggattgcggcatctatcattcttgagtttttcttaatggtgttgctaataccagaacccgatagacaacggacaccacaggacaaccaactcgcttacgtcgtaataggacttttatttatgattctaaccgttgcagctaacgaaatgggactattggaaacaaccaagaaagatttaggcatcggtcatgtcgccgcggaaaatcaccaacacgctaccatgttagacgtagatctacgaccagcaagcgcctggacattatatgcggttgcaaccactgtcattactcctatgatgaggcatactattgaaaacacaacagcaaacatttcattaactgcaatagctaatcaggccgcaatcttaatgggtctagacaaaggatggccaattagtaaaatggatataggcgtacctctattagcattggggtgctactcacaagtgaaccctctcacactgaccgcggctgtattaatgttagtggcccactacgctataatcggaccaggcctccaggctaaagcaacacgggaggcccaaaaacggacggctgcaggtatcatgaaaaatccaactgtcgacggcattgtagcaattgatttggatcctgttgtttatgacgcgaaatttgaaaaacaactaggccagatcatgcttttaatactatgcacctctcaaatattacttatgaggaccacctgggccttatgtgaatcaataaccctagcaaccggtccacttacaacactatgggaaggttcgccgggtaaattttggaatacaacgatagcagtatcaatggccaatatcttccgcggatcgtacttagcaggagccggtttggcattctcattaatgaaatctctcggtggtgggagacgaggaacgggtgcgcagggcgagactttgggggagaaatggaaacggcaactgaaccagttaagtaaatctgagtttaatacatacaaacggtccggtataatggaagttgatagaagtgaggctaaagagggactgaaacggggagaaacaactaaacacgcagtatcacgaggaacagctaagctgcggtggttcgttgaacgaaatctagtcaaaccagaaggtaaagtgatcgatctcggatgcggccgcggtggttggagttactattgcgcgggactgaagaaagtgacagaagtaaaaggctacacaaaagggggtccaggacatgaagaaccgatccctatggccacgtatggatggaacttagttaaactacacagcgggaaggatgtgttctttatgccgcctgagaaatgcgatacactcttgtgcgatataggcgaaagctcgccaaacccaactattgaagaaggacgcacattacgggtattaaagatggtcgaaccatggttgagaggaaatcagttttgtattaagatattgaatccatatatgccgtccgtagttgaaactttagaacaaatgcagagaaaacatggaggaatgttagttagaaatccgctatcacggaatagtacacacgaaatgtattgggtctcatgcggaacgggtaatattgtatctgcagttaatatgacatcaagaatgttattaaatcgattcacaatggctcatcgcaaaccaacttatgaaagggacgttgatcttggtgctggaaccaggcatgtggcggtagaaccagaagtagcaaaccttgatataatcgggcaacgaattgaaaatatcaaaaatgagcacaagtcaacatggcattatgacgaagataatccatacaaaacttgggcataccatgggagctacgaagttaagccatctgggtctgcatcgtcaatggtgaacggcgtagtccggctattaacaaaaccatgggacgttatacctatggttacacagatcgctatgacagacaccacgccatttggccagcagagagtgtttaaagaaaaggttgataccagaacaccaagagcaaaacgaggaaccacccaaataatggaggtaacagcaaagtggctttggggctttctaagccggaataagaaacctcgaatctgtaccagggaagagttcacgagaaaggtgcgatccaatgcggctataggtgctgtgttcgtagacgaaaaccaatggaacagtgccaaagaggcagttgaagatgaacggttttgggatctcgtccacagggaacgagagctacacaagcaaggaaaatgtgcgacgtgtgtatacaacatgatgggaaaacgtgagaagaaactaggagagttcggcaaagcgaaaggatctcgcgctatttggtatatgtggttaggagcgaggttcttagaatttgaagctctgggatttatgaatgaagaccactggttctcaagagaaaactccctttcaggtgtagagggtgaaggattacataaattaggatacattttgagggacataagtaaaatccctggcggcaatatgtacgcagacgatacggctggctgggataccagaattacagaggatgatttgcaaaatgaagccaagataacagacataatggagccagaacatgcactcctagcaacctcaatattcaaacttacgtaccaaaataaagtggtcagggtacagcgtccagcgaaaaatggaactgttatggatgtaataagcagaagggaccaacgcggctccgggcaagtgggtacttacggtttaaatacatttaccaacatggaagtacagttaatacggcaaatggagagcgaaggtatatttctaccaagtgaattagaaacgcctaatttggcagaaagagtcttagattggttaggaaaacacggcgccgaacgccttaaacgaatggccattagcggagatgattgcgttgttaaaccaattgacgatagatttgcaacagctctgactgctcttaatgatatgggaaaagttagaaaagatattcctcaatgggaaccatccaaaggctggaatgactggcagcaagtacctttttgttcacatcattttcatcaactaatcatgaaggatggaagagagatagttgtgccatgcagaaaccaggacgaacttgttggaagggcgagggtatcccaaggtgcaggctggtccctcagagaaacagcgtgcttgggaaaatcatatgcgcaaatgtggcaactgatgtactttcatcgtagggatctcagactagcagcaaacgcaatatgctctgcagtccctgtagattgggttccaacgtctcggacaacatggtccatccacgctcatcaccaatggatgacaaccgaagatatgctgagtgtttggaatagagtttggattgaggaaaacccatggatggaagataaaacacatgttagctcctgggaggaagtaccatatcttggaaaacgggaggatcagtggtgtggatcattaatagggcttacagcgcgagccacatgggcaactaatatccaagttgcgataaaccaagtaagaagattaattggaaatgaaaattatcttgattacatgacatccatgaaacggttcaagaatgaaagcgatcctgagggggcactgtggtaa

SEQ ID NO: 21247 - RNA, 9879 nt, synthetic construct
  misc_feature 1..9879: note = derived and/or modified CDS sequence (opt6) from DENV-1__GQ868511__SS-prME
  source 1..9879: mol_type = other RNA
tcagtaactatgttactaatgttgttacccacagccctggctttccacctgaccacacgtggaggagaaccacatatgatagtatctaaacaagaaagaggaaaatcactactttttaaaacttcagcaggagtcaacatgtgtacgcttatagccatggacttgggtgaattgtgtgaagatacaatgacttataaatgtccacaaattacagaagctgaacctgacgatgtcgattgttggtgcaatgctactgacacttgggtaacctatgggacatgtagccaaacaggagaacacaggagagacaaacgctctgtcgcgctagcgcctcatgtgggactaggacttgaaacaaggactgaaacatggatgagctcggaaggtgcctggaaacaaatacaaagggtggaaacttgggcgctgagacacccaggattcacggtaatagcacttttcttagcccatgctatcggaacatccatcacacagaaagggattatatttatactattgatgttagttacaccaagtatggctatgcgatgcgttggcatagggaaccgcgactttgtagaaggcttgagcggtgctacatgggtagatgtagtattggaacatggatcgtgtgtaacaactatggctaaaaataaaccaaccttagacatagaactattgaaaaccgaagtaacgaatcctgctatcctgaggaaactatgtatagaagcgaaaatttcaaacacgactacagatagtcgctgcccaacgcagggcgaagcaactcttgtcgaagaacaagacgcgaactttgtttgcaggagaacgtttgttgatagaggatgggggaatggatgtggattgtttggaaagggatcccttctcacatgcgcaaaatttaaatgtgttactaaacttgaaggaaaaatagtgcaatacgaaaacttgaagtatagcgtaatagttacagtgcatacgggcgaccaacatcaggttggtaatgaaacaaccgaacacggtactatagctactattaccccacaagcaccaacttcagaaatccaactaactgattacggcgcactaactctggattgcagtccgcgtactggtttagatttcaacgagatggtgctgctcacaatgaaagagaagtcctggctagtccacaagcaatggttcctagatctccctttaccttggacttcgggtgcttcaacgtcccaagaaacttggaatcggcaggatttgctagttacatttaagacggcacatgctaagaaacaggaagtagtagtactaggttcccaagagggagcaatgcatactgctttaacaggggctactgaaatacaaactagcggaactactactatctttgcgggacacctaacatgtcgactaaaaatggataagttaacgctgaaaggtacttcttacgttatgtgtacaggatcattcaagttagaaaaagaagtagcagagacacaacatggcactgtattagtgcaagtaaaatacgagggaacggatgcgccgtgcaaaattcctttcagcactcaagacgaaaaaggtgtcacccagaatggccgattaattacagcaaatcctatcgtgacggataaggaaaaaccagtaaacatcgaaacggaaccaccgttcggagaaagttatatagtagtcggtgccggggagaaagcactgaaattatcgtggtttaagaaaggcagctccattggaaagatgttcgaagcaacagccagaggtgcgcgtcgcatggcgattcttggcgacactgcctgggactttggatcaatcggcggtgttttcacaagcgtaggtaaactcgtacatcaagtatttggtactgcgtacggcgtattattttcaggtgtttcatggaccatgaagattggcataggaatactacttacatggttagggttaaacagtagaagtacatccctatctatgacatgcatagctgtcggcatggttacactttacctaggagtgatggtacaagcagattcaggctgtgtaataaattggaaaggacgcgaactaaagtgcgggagtggaatattcgtaacaaatgaagtacatacatggacagaacagtataaattccaagcagactcaccaaaacgtctgagtgcggcaataggcaaggcttgggaagagggtgtatgtggcatcagatccgcgacccgattggaaaacatcatgtggaaacaaatcagtaatgaactaaatcatattctcttggaaaacgacatgaagtttaccgtggtagtaggagatgctaatggaatattggcacaaggcaagaaaatgataaggccccaacctatggaacataagtactcatggaaatcttggggaaaagcaaaaatcataggagctgacatacaaaatacgacgtttataatcgatgggccagacacaccagaatgtccagacaaccagagagcctggaacatttgggaagtcgaagattatgggtttggaatctttactacaaacatttggttaaaattaagggacagttacacacaaatgtgtgatcatcgacttatgtcagctgcgataaaagattctaaagccgttcatgcagacatgggctattggattgagtcggagaaaaatgaaacatggaagttggctcgagcatcgtttatcgaagtaaaaacttgtacatggcctaaaagtcacacattgtggtcaaatggagtgcttgaatcagaaatgataattccgaaaatctacggcgggccgataagccagcataattatcgaccgggctattttactcaaactgcagggccatggcatctaggcaaattagaactagatttcgacttgtgtgaaggaaccacggtagtagttgacgaacactgcgggaacaggggaccaagtctacgcacgacaaccgtaacaggaaaaataattcatgaatggtgctgcagatcctgtacattgcctccactacgatttcgaggggaagacggatgttggtatggaatggaaataaggcctgtaaaagaaaaggaagaaaatttagtaagaagtatggtgtccgcaggctcaggcgaggtagacagtttttcgttaggcatactgtgcgcgagtattatgatagaagaggtgatgagatcacggtggagtcgcaagatgcttatgacaggaacacttgccgtctttttactccttgttatgggacaactaacatggaatgatctaatacgcttatgtattatggtaggagcaaatgcatccgatcgtatggggatgggaactacgtacttggcccttatggccacatttaaaatgcggcctatgttcgctgtcgggttgctgtttcgtagactaaccagcagggaagtcttgcttctaacgatcggattgtcgctggttgcgtcagtagagctcccaaacagcttagaagaattaggagatggcctagcaatgggtatcatgatgctcaaactattgactgagttccagccgcatcaattgtggacaactttattaagccttacttttatcaaaactactttgtcgttagattacgcttggaaaaccacagcaatggcactatcgattgtgagtttatttcccttatgtttatcgactacaagtcagaaaacaacatggttacctgtgctgttaggttcatttggatgcaaaccattgacaatgtttctcattaccgaaaataaaatttggggacggaaatcctggcccctaaacgagggtatcatggcgataggaatcgtatcgatcttattatcaagtttactcaaaaatgacgtcccattggctggaccattaattgccggaggaatgctcatagcctgctatgtgataagcggtagttctgcagatctttcattagaaaaagcagcggaggtgagctgggaacaagaagcagaacatagcggtaccagccataatattttagtagaagttcaagacgacggaaccatgaagattaaagatgaagaacgagacgatacactcacaatattactaaaggcgacccttctagctgtaagcggggtgtacccgatgagtatacccgcaactctgttcgtatggtatttttggcagaaaaagaaacaacgctcaggtgtcttgtgggataccccatctcctcctgaggttgaaagagcagttctggatgacggaatatatagaatcctgcaaagaggattattaggaagatctcaggtcggtgtgggtgtattccaggatggtgtattccatacaatgtggcatgtaacgcgaggagcagttttaatgtaccaaggtaaacgacttgaaccaagctgggcgagtgttaagaaagatctaatttcgtacggaggcggttggagattccagggatcgtggaacacaggagaggaagttcaggtgatagccgttgaaccaggcaagaatccaaagaatgttcaaacaaccccagggacgttcaaaacccctgagggagaagtgggggccatcgcactagacttcaaaccgggcacttccggaagtcccatcgtgaatcgggaaggaaaaattgtgggactgtatggtaatggtgtagttacgacatccggaacttatgtctctgctatagcgcaagctaaagcctcacaggaaggacctttacccgaaatagaggatgaagtatttaaaaagcgtaatctgacaataatggatttacatccaggaagtggaaaaacaaggaggtatctcccagcaattgtcagggaagctatcaagaagaaattacggacactcattctagctccgacacgagtggttgcctcagaaatggctgaagcattaaagggaatgccgataagatatcaaaccacagccgtgaaatcagaacacactggaagagaaatagtagatctaatgtgtcatgcgacatttactatgcgcttattgagtccagtcagagtgcctaattacaatatgattatcatggatgaagcacattttacagaccccgcatcgattgccgcacgtggttatataagtacaagagtaggaatgggagaagccgcagccatatttatgacagcaacaccgccaggctcagttgaggcatttccacaaagtaacgcagtgatacaagacgaagaacgagatattccagaaaggtcctggaatagcggctatgattggatcacggattttcctggaaaaacagtttggtttgtgccatcgataaagagtggtaatgatatagctaactgtcttagaaagaatggtaaaagggtcattcaactgtcccggaagacatttgatacagaatatcagaaaaccaaaaataatgactgggactacgttgttactacggatatatcggaaatgggtgctaattttcgcgctgatcgagtaatcgatccaagacgatgtctgaaaccagtaatactaaaagatggaccggaaagagtcatccttgcaggcccaatgcccgtaacagttgcaagtgctgctcagaggagaggtagaattgggcgaaatcagaataaagagggagatcaatatgtatatatgggtcaacccttaaataacgatgaagatcacgctcactggacagaagcgaaaatgctactagacaatataaacacaccagaaggaataatcccggctttatttgaacctgagcgggagaagagtgcggctattgacggcgagtatagactacgaggcgaggcgagaaaaactttcgtcgaattgatgcgacgaggagaccttccagtatggttaagttataaagttgcttcagagggatttcagtactcggatcgaaggtggtgcttcgatggagaaaggaataatcaagtccttgaggaaaacatggacgtagaaatttggacgaaagaaggagaacgaaagaaattgcgtcctagatggttagatgcaagaacatatagtgacccattagcgctacgagaatttaaggaatttgccgcaggacgtcgatcagtaagtggcgatttaattcttgaaatcggtaaattaccgcaacatctaaccctacgcgctcagaatgccctcgataatttggttatgctccacaactcggaacaaggtggcaaggcttatcgacatgcaatggaggagttaccagacacgatagaaaccctaatgttgcttgcccttatagctgtattaaccggtggcgtaactttattctttcttagtggtaagggactcggtaaaacttctatagggctcctttgtgttaccgcttctagtgccctattgtggatggcatcagttgaaccgcactggatagcagctagtattatccttgaatttttcttgatggtgctactaatccccgaaccagatcgacagagaaccccgcaagacaaccaactggcatatgtcgtgatcggcttattattcatgatactgacggtagccgccaacgaaatgggactccttgagaccacgaaaaaggatctgggtataggtcacgtagcagcggagaatcatcagcacgcgacaatgctcgacgtagacttaagaccggcaagtgcgtggactctatatgcagtggcaactacagtaataactcctatgatgagacatacgatagaaaacacaacggccaacatttcactaacggcaattgcgaaccaagctgcgatacttatggggctagacaaaggatggcctatatctaagatggacataggagtacctttacttgcgttaggttgttacagtcaagtcaatcctttaactttaacggcggcagtcctaatgctagtggcccattatgcaataattggcccaggtctgcaggcaaaagccacccgagaggcacaaaaacgaacagcggcaggaataatgaagaacccgacagtagatggtatagttgcaattgatttagaccccgtagtgtatgatgccaaatttgaaaagcaattaggccagattatgctattaatactttgtacgagtcaaatattactgatgcgaactacttgggcgttgtgcgaatctataacgctagcaactggccctttaactaccttatgggaaggctcacctggaaaattctggaatacaaccatcgccgtttcaatggcaaatatatttagggggagctacctagcgggtgcgggattagcatttagcctcatgaaaagcctcggtggcggccgcagaggaacaggcgcacagggtgaaaccctcggagaaaaatggaaacgacaattaaaccaattaagcaaaagtgaatttaacgcatacaaacggagcggtatcatggaggtggacagaagtgaggctaaggagggattgaaacgaggggaaactacgaagcatgcggtctcgcgaggaaccgctaaattaagatggttcgtcgaaagaaatttagttaaaccagagggcaaagtcatcgatctgggatgcggacgcggtgggtggtcctattattgtgccggcctaaagaaagtgaccgaggtaaaaggctatactaaaggaggcccaggacatgaagaacctatccccatggcaacttatggttggaatctcgttaagttgcattccggtaaagacgtatttttcatgcctccagaaaagtgtgacacattactctgcgacatcggtgagagttcaccaaaccctacgatagaagagggtagaacattaagagtgttaaaaatggtggagccatggcttaggggcaaccaattctgtatcaaaatattaaacccgtacatgccatctgttgttgaaacactagaacagatgcaaagaaaacacggcgggatgctagtcagaaatcctctgtcgagaaattcaacccacgaaatgtattgggtttcatgtggcacagggaacatcgtatcagcagtaaatatgacaagccgaatgctgctaaataggtttactatggcacatcgaaagccaacatatgaaagggacgtagacttaggggcagggactagacatgtagccgttgaacccgaagtcgcaaatctggatatcataggccaaagaattgaaaatatcaaaaatgagcataaatcgacatggcattatgatgaagacaatccgtataaaacatgggcgtatcatgggtcttacgaggtaaagcctagtggttcggcatcaagtatggtgaatggcgtggtccgactacttacaaagccctgggatgtcatcccaatggtgacacagatagctatgactgatacaacgccatttggtcaacaacgtgtttttaaggaaaaagtcgacacaagaactccccgggccaagcgagggacaacccaaataatggaagtgaccgcaaagtggttatggggttttctatctcggaataagaaaccgagaatttgtacccgagaagagttcactagaaaagtacgaagtaacgccgcaataggtgctgtgtttgtcgacgaaaaccaatggaactcagctaaggaagctgtcgaagatgaatctttttgggacctggtacataaagaacgagagttgcataaacaaggaaaatgcgcaacttgcgtttataatatgatgggaaaacgggagaagaaattgggagagttcgggaaagctaaaggttcacgagcaatatggtatatgtggttaggcgcacgtttcctagagttcgaggctttgggtttcatgaacgaagatcactggttctcgagagaaaactccttatcaggcgtggaaggcgaagggttacacaaacttggttacatattacgtgatatcagcaagataccagggggcaatatgtacgcagacgatactgctggatgggatacgcgtataactgaagatgatctacaaaacgaggcaaaaataacagaaatcatggaacccgaacacgcactactcgcaacatcaattttcaaattgacctatcaaaataaagtggttagggttcaaagacctgccaaaaatggtacagtaatggacgttatatctcgacgagaccaaagagggtcgggccaggtaggaacctacggactaaataccttcacaaacatgggagtacaactaattcgacagatggaaagtgaaggaatatttctccccagcgaattagaaacaccgaatctagcagaaagagttcttgattggttagaaaaacacggagccgagagattgaaaagaatggcaatatcaggcgatgattgcgttgtaaagcccattgatgacagattcgcaaccgcattgacagcattaaacgacatgggtaaagtacgcaaagacatcccccaatgggaaccgtcaaaaggatggaatgactggcagcaggtaccgttctgttcacatcatttccaccaactaataatgaaagacggcagggagattgttgttccttgccggaaccaagacgagttagtaggcagagcacgtgtctcgcagggagcggggtggagtttaagggaaactgcttgccttggaaagtcgtatgctcaaatgtggcagctaatgtacttccatagacgtgatttaagacttgcagccaacgcgatctgttccgccgtaccagtagactgggttccaacttcgcgtacaacttggtcgatacatgcacaccaccaatggatgacgacagaagatatgcttagtgtgtggaatcgagtctggattgaagagaacccgtggatggaggataaaactcatgtatccagctgggaggaagtaccttatctaggaaagcgagaggaccaatggtgcggaagtttaataggcttgaccgcaagagccacatgggctacaaacatacaggttgcgataaaccaggtccgaagactcataggaaatgagaattatttagattacatgacatctatgaaaagatttaaaaatgaatcggatcctgaaggagctctatggtga

SEQ ID NO: 21248 - RNA, 9879 nt, synthetic construct
  misc_feature 1..9879: note = derived and/or modified CDS sequence (opt6) from DENV-1__GQ868512__SS-prME
  source 1..9879: mol_type = other RNA
tcagtgactatgctattgatgttactaccgaccgcgctagcgtttcacttaactacgaggggtggggaaccacatatgatagtaagcaaacaagaaaggggaaaaagcctactatttaaaaccagtgctggggtgaatatgtgtaccttaatagcaatggatctaggtgaactatgtgaagacactatgacttacaaatgcccacagataaccgaagctgaacccgatgatgttgattgctggtgtaatgcaacagacacctgggtaacatacggaacgtgttcacagacaggagaacataggagggacaaaagatcagtagcattggctccacatgttggactaggcttagaaacgagaacggaaacctggatgtcttctgaaggcgcatggaaacagattcaaagagtagaaacatgggcattacgtcacccgggttttacggtaatagctttgttcctagcacatgctattggtacgagcatcacacaaaaaggtatcattttcatcctcctcatgcttgttactccatcgatggcaatgcgatgtgtaggtataggtaatagagatttcgtagaaggactatcaggcgcaacgtgggttgatgtcgttctagaacatggctcttgtgtcaccacaatggccaaaaacaaaccaactttagatattgaactcttgaaaacagaggtaactaatccagcaatattacgtaaactatgcattgaagcaaaaatatcaaatactacaactgacagccggtgtccaactcaaggcgaagcaacattagtagaagaacaagacgctaacttcgtctgtcgacgaaccttcgtagacagaggatgggggaatggttgtggacttttcggaaaaggttctttgttaacatgtgccaaattcaaatgtgtcactaaactggaaggaaaaatagtccaatatgagaatctgaaatattcagtaatagtcacagttcatactggagaccaacatcaggtcggaaatgaaacgacagaacatggtactattgcaacaattacaccacaagcaccaaccagtgaaatccaacttacagactatggggccttaacattagattgttcgccccgaacaggcctggatttcaacgagatggttttgctcacaatgaaagagaaatcatggctagttcacaaacaatggttcctagatttacctttaccctggacttctggggcaagtacaagtcaggaaacatggaatagacaagatctccttgtaacgttcaaaaccgcacatgccaagaaacaagaagttgttgtactaggaagccaagagggtgcaatgcacaccgcactaacaggggcgaccgaaatccagacctcaggcaccactactatattcgcaggccacctaaaatgcaggctaaaaatggacaaattaactctaaaaggaacaagttacgtaatgtgtactggatcattcaaactggagaaagaagtagctgaaacccaacacggaactgtactggtgcaagtaaaatacgaaggcacagacgcaccatgtaagattccgttcagcactcaggacgaaaaaggagtaactcaaaatggtagattaattacagcgaaccccatcgttaccgacaaggagaaacccgtaaacatcgaaactgaacccccttttggggaatcttatatagtggtaggagctggtgagaaagcattgaagctaagttggtttaagaaaggatcatcaataggtaaaatgttcgaagccacagctcgtggggctaggcgcatggccatattgggtgacactgcatgggactttggctcaataggaggtgtatttacaagtgttggtaaattggtacatcaagtgttcgggaccgcttatggggtcttgttcagtggagtctcgtggacaatgaaaatagggatagggatattacttacatggcttggactaaattcacgatcaacctctttgtcaatgacatgtatcgcggtaggtatggtgacgctatacttaggcgtaatggtacaagccgacagcggttgcgtaattaattggaaaggaagagagctaaagtgtggatccggaatatttgtcacaaatgaagtccatacctggaccgaacagtacaagttccaagccgatagcccaaagagactgtctgcagcgattggcaaagcatgggaagagggggtatgtgggatacgtagcgcaaccagacttgagaatataatgtggaaacaaattagcaatgaacttaatcacatcttattggagaatgacatgaaatttactgtggtcgtaggtgatgcaaacggcattctagcccaaggcaagaaaatgattagaccacaaccaatggagcataaatattcgtggaagtcgtggggcaaagctaaaataataggcgcagacattcaaaataccacctttataatagatggtcccgatacaccggaatgtcctgacaaccagcgggcctggaatatctgggaagtagaggattacggttttgggatatttacaacaaacatatggttgaagctccgggatagctatacacaaatgtgcgaccacagattaatgtctgcagcaatcaaagactcaaaagctgtacacgctgatatgggttattggattgaatcggagaaaaatgaaacatggaaattagcgagagccagtttcatcgaagttaagacatgtacctggccgaaaagccatacgttatggtcaaatggagtcttagaaagcgagatgataatccccaaaatatatggaggaccaataagtcaacataattatagaccgggctattttacacaaaccgcgggaccatggcacttgggtaagttagaacttgatttcgatctatgtgagggaacaacagtcgtagttgacgaacattgcggaaatagaggcccatcgctgagaaccacgacagtaactggaaaaataatacacgaatggtgctgcaggagttgtacgctcccgccactaagattcagaggggaagatggatgttggtacggaatggagattagaccagtaaaagaaaaggaagagaatcttgtgcgctcaatggtaagtgcaggttcaggagaagtggatagttttagccttggtatactttgcgtgtcgataatgatagaagaggtcatgcggagtcgatggtctagaaaaatgctaatgacgggaacattagcagtcttcctactacttgtaatgggacaactcacctggaacgatctcattaggctttgtattatggttggagcaaacgcttcggaccgaatgggcatgggaacaacttatttagcgttaatggctacatttaagatgagacccatgtttgctgtagggctgctattcagaagattaacaagcagagaagtgctgctattaactataggcttatctttagttgccagtgttgaactccctaatagtcttgaagaactaggggatggcctagcaatgggaataatgatgcttaaactgctcacagagttccaaccgcatcaattgtggacaacgcttttgagtttaactttcataaaaactacattgagtcttgattatgcatggaagaccacagcaatggctctatccatagtatcacttttccctctatgcctttcaactacgtcccagaaaactacctggttacctgtactgctgggttcttttgggtgtaaaccactcacaatgttcctaataacagaaaacaagatttgggggaggaaaagttggcccttgaacgaaggcattatggccattggcatagtctctatactattgtcatccctacttaagaatgatgtaccgttagcagggccgttaattgcaggcggaatgcttatagcctgttatgtaatatccggatcttcggctgatttaagtctagaaaaggccgcagaagtgagttgggaacaagaagctgaacatagtgggacttcgcataacatattagttgaagtacaagatgacggaacaatgaaaattaaagacgaggaaagagacgatacgctcacaatattactcaaggcgacactactagcagtctcaggggtttaccctatgagtattcctgctactttattcgtctggtacttttggcagaagaagaaacagagaagtggtgtgttgtgggacacacccagtccaccagaagttgaacgcgcagtcttagacgacggtatttatcgtatactacaaagagggttgttaggccgatcacaagtcggggtaggggtgtttcaagatggggtcttccacacgatgtggcacgtgacgcgaggtgccgtcctaatgtaccagggtaagcgactcgaaccaagttgggctagcgtcaagaaagatctaattagttatggtggaggatggagatttcaaggcagttggaacacgggtgaagaagttcaggttattgcggtagaacctggtaaaaatcccaaaaacgtacaaacaacacctggaacattcaaaaccccggaaggagaagtaggagcgatcgctctcgatttcaaacctggaacaagtggatctccaatcgttaatcgtgaggggaaaattgtaggattatatggaaatggtgtagttacaacgagtggaacatatgtttcagctatagctcaagcaaaggcgtctcaagaaggtccactaccagaaatagaagatgaggttttcaaaaagcgaaatcttacaattatggaccttcatcccggtagtgggaagactcgaaggtatcttcctgcgatagttcgggaggctattaaaagaaagttaaggacactcatcctcgccccaactagagtagtggctagtgaaatggcggaagcgttaaagggtatgccgatacgctatcagacaactgccgtcaaatcagagcatacagggcgtgaaattgtggatctaatgtgccacgccacattcacgatgcgactcctctcaccagtaagggtaccgaactataacatgataataatggatgaggcacatttcacggatcctgcatcaattgctgccagaggctatattagtaccagagtaggcatgggagaagccgcagcaatttttatgactgcaacgcctcccgggtctgtggaagcatttccccaatcaaacgcagtgatacaagatgaggagagagacattcccgagaggagctggaacagcggctacgattggattaccgactttccgggaaagacagtgtggttcgtaccttcgattaagtcaggaaacgacattgctaactgcttaaggaaaaacggcaaaagggtaattcaactgagtagaaaaacatttgataccgagtaccagaaaactaaaaataatgattgggactatgtagttacaacagatattagcgaaatgggcgctaatttcagagcagatcgggtgatagaccccagaagatgtctaaaaccagtgatattaaaagatggcccagaaagagttatactagccggacctatgccagtcacagtcgcgtcagcagcacaaagacgcggtcgaataggcagaaaccaaaacaaagaaggtgaccagtatgtttatatgggccaaccgttaaacaacgatgaggaccatgctcactggacagaggccaaaatgctactggacaatataaatacacccgaagggataataccagccctcttcgaacctgaacgagaaaaatctgcggcaattgatggggaatatcgcctacgaggagaagcaaggaaaacatttgtcgaactcatgagaagaggagacctgcctgtgtggttatcatataaagtagcatctgaaggttttcaatattcggatagaagatggtgttttgacggagaaaggaacaaccaagtcttagaagaaaatatggatgtagaaatatggacaaaagaaggtgagcgtaagaaattaagacctagatggttagacgcaagaacgtactccgacccacttgccctaagagaatttaaggagttcgcagcaggccgaagatcagtttcaggagatttaatattagaaattggtaagttgccacagcatttaacactgagagcccaaaatgcgctagacaatctcgttatgttacacaacagcgaacaaggtggcaaagcctaccgacatgctatggaagaattacctgatacaattgaaacattaatgttattggctttaatagctgtgcttactggtggagtaacattatttttccttagcggcaaaggactgggaaaaacttcaattggtttactgtgtgtcacggcgagtagcgccttattatggatggcttctgtggagccacactggattgcggcatctataattttagagttctttttgatggtgctgctcataccagaaccagatagacagagaacaccacaagataaccaattagcatacgttgtaataggcctcctattcatgattttaacggtcgcggctaatgagatgggtcttttggaaactactaagaaagatcttggaattgggcacgtagctgcagaaaaccaccaacatgctaccatgttggatgttgacttacggccagcaagtgcctggacgctctacgcggtcgcgacgacagtaatcacaccaatgatgcgacacacaatagaaaacacaaccgcaaatattagtcttactgccatagctaatcaagctgccatacttatgggactagacaagggctggccaatatcgaaaatggatatcggagtacctctattagccctcggctgctatagtcaagtgaatcctctgaccctgacagcagcggtacttatgttagtagctcattacgcaataataggaccgggattacaagcaaaggcaactagggaagctcagaagcgaacagctgcaggaataatgaaaaatccgacggtagatggaatcgtggcgatagatttggatccagttgtctatgatgctaaattcgagaaacagctaggacaaataatgctgttaatattgtgtacgtcccaaatactgttaatgaggacaacgtgggctttgtgcgaaagcataacgttagccacgggacccttaacaacgctttgggaaggcagcccaggtaagttctggaataccacaatagcggtcagtatggcaaatattttccggggatcatatctcgcgggagcgggtctagcgtttagcttgatgaagagtttaggcggtggtagaagaggaacaggggcccaaggtgaaacattaggcgaaaaatggaaacggcaattgaaccagctaagcaaatcagaatttaacacttataaacgctctggcattatggaagtagacaggtcggaggcaaaagaagggttaaaacggggagaaacgaccaagcatgcggtatcaagaggtacagctaagctaagatggttcgtagagagaaatttagtaaaaccagaaggtaaagtcattgatctaggatgcggacggggaggatggtcgtactactgcgcaggattgaagaaagtgactgaagtcaagggatatacaaaaggcggcccgggacacgaagaaccgataccaatggctacgtatggatggaatttagtaaaattacatagcggaaaggatgtattctttatgccacctgaaaaatgcgataccttgctatgcgatataggggagtcttcaccaaatcctacgatagaagagggaagaacacttagagtacttaagatggtggaaccatggttaagaggaaaccagttttgcataaaaattcttaatccatatatgccatctgtagtggaagctctagagcaaatgcagagaaagcacggcggaatgttagtcagaaatcctctaagccgtaactcaactcatgagatgtactgggtcagttgtggaacagggaacatagtaagtgcggtgaacatgaccagtagaatgttattaaaccgctttactatggcacataggaaaccgacttatgaacgcgacgttgatctaggtgcaggaacgcgccatgttgccgtagaaccagaggttgcgaatttagacattataggacaacgtatagaaaacattaagaatgagcacaaaagcacatggcattatgacgaggacaatccatacaagacgtgggcatatcatggctcatacgaagtgaaaccgagcggctcagctagctcaatggttaatggtgtagtacgtttattaacaaaaccatgggatgtcatacccatggtgacccaaatagctatgaccgacacaactccctttggacaacaacgggtgttcaaagagaaggtagacacaagaaccccaagagcgaaaagaggtaccacacaaattatggaagtaacagcaaaatggctctggggattcttgagcagaaacaagaaacctcggatttgcactagagaagagttcacgaggaaagttcggtcgaacgcggccatcggagcggtgtttgttgatgaaaaccaatggaatagcgcaaaagaagcggtggaagatgaaagattctgggacctggttcatcgagaacgtgaactacataaacagggaaaatgtgccacatgtgtgtacaatatgatgggaaaaagagaaaagaaactgggtgaatttggaaaagcaaaaggaagtcgagctatctggtatatgtggctaggagctagattcctagaatttgaggcactaggtttcatgaacgaggaccattggtttagcagagaaaactccctaagtggagtagaaggggagggactacataagttaggctacatactccgggacatctctaagattcctggaggcaatatgtacgccgacgatacagcagggtgggatacgaggataacagaggatgacctccagaacgaagctaaaataacagaaataatggaaccagaacacgccttgttagcaactagcatttttaagttaacgtaccaaaacaaagttgtaagagtccagcggcccgctaaaaatggtacagtcatggatgtgatatcgagaagagaccagcgcggatccggacaggttggaacctatggtcttaatacgttcactaacatggaagttcaattaatacgtcaaatggaaagcgaaggtattttcctcccgtcggaattggagacaccaaatctcgcggaacgggtacttgattggttagaaaaacatggggctgaacgacttaagaggatggccatctcgggtgatgattgcgtagtaaaaccaatagacgatcggtttgctacggccttaacagcccttaatgatatgggtaaggtaagaaaagacatccctcaatgggagccgtcgaaaggctggaatgattggcaacaggtaccattctgtagtcaccattttcatcaattaataatgaaagacggaagagaaattgtcgtcccctgcagaaaccaggacgaacttgtaggtcgtgccagagtgtcacaaggagcaggctggtcgttaagagaaacagcctgcttaggcaaatcctatgcccaaatgtggcaattaatgtatttccacagacgagatctcagactggcagctaatgccatatgtagcgcagtccctgtggactgggtacccacttctagaacaacatggtcgatacatgcccaccatcaatggatgacaaccgaagacatgcttagcgtttggaacagagtctggattgaagaaaacccttggatggaggataagacgcacgtatctagttgggaggaagtaccatacttagggaaaagagaagaccaatggtgcggctccttgattggactaaccgctagagcaacgtgggcaactaacattcaagtggcgataaatcaagttagaagacttatcggcaacgagaactatttggattacatgacaagtatgaaacggtttaaaaacgaatcggatccagaaggcgcactctggtaa

SEQ ID NO: 21249 - RNA, 9879 nt, synthetic construct
  misc_feature 1..9879: note = derived and/or modified CDS sequence (opt6) from DENV-1__GU131970__SS-prME
  source 1..9879: mol_type = other RNA
agcgttactatgttattaatgttgttgcccacagctcttgcctttcatcttacgacgcgtggaggagagccacatatgatagttagtaaacaagaaagaggaaaatcgttactatttaaaacatccgcgggagtaaatatgtgcacactcatagccatggatttaggcgaactatgtgaagatacaatgacatacaaatgtccgcagataacagaagctgaacctgatgatgttgactgctggtgtaacgcaactgatacatgggtgacgtacggaacatgcagtcagacaggcgaacatcgacgggagaaacgaagcgtagcacttgctcctcatgttggtctaggacttgaaacgagaacagaaacttggatgagttcagaaggcgcatggaaacaaatccaaagagtggaaacgtgggcattacgacacccgggcttcacagtaatcgcattgtttcttgctcacgcgatcggcacttcaataacgcaaaaaggcataatctttattttattaatgctagtaacaccttcaatggctatgagatgtgtagggatcggaaatagagattttgttgaaggactctcaggcgctacatgggtcgacgtagtactggagcatggcagttgtgtaacgacaatggctaaaaacaaaccaaccttggacatagaactactaaaaacggaggtgactaaccctgcaatcctaaggaaactctgtatagaagcaaaaattagcaatactacgacagattcaagatgtccaacccaaggggaagcaaccctagtcgaagaacaggatgcaaatttcgtatgtcgaagaacattcgtagatagaggatggggtaacggttgcggtttgttcgggaaaggatcacttttaacatgtgctaaatttaaatgtgtcaccaaattggaaggtaaaatcgtgcaatacgagaatcttaaatattcagttatcgtaacggttcacacgggtgaccaacatcaggtgggtaacgaaacaactgaacatggcacaattgctacaatcactcctcaggctccaacatcagaaattcagttaaccgactacggagcactaacattagattgcagtccacgaacggggttggacttcaacgaaatggttcttttgactatgaaagaaaaatcttggttagtccataaacagtggttcctggatctcccacttccatggacaagtggagcgtcaacgtcgcaggaaacatggaatcgacaggaccttttagttacatttaaaacagcccatgcgaagaaacaggaagttgtggtgctaggatcacaagaaggagctatgcacacagccttaacaggagctaccgagattcagacaagtggaacgaccactatctttgcgggccatctaaaatgccgactcaaaatggataaattaacattgaaaggtacatcttatgttatgtgcacaggtagttttaaattagagaaagaagttgcagaaacgcagcatgggacagtattggttcaagtaaagtatgagggaacagatgctccatgtaaaatcccctttagcacacaagacgaaaaaggagtaacccaaaatggtcggttaataacagccaatccaattgttactgataaggagaagccggtaaacatcgaaactgaaccaccttttggagaatcctacatcgtggttggtgccggcgagaaagccctcaaattatcttggtttaagaaaggtagtagtataggcaaaatgtttgaggctacggcgcgcggagctagacgcatggcgatacttggggacactgcgtgggattttggtagcatcggcggagtatttacttcagtaggcaaattggtccatcaagtctttggaacagcatatggtgtattattttcaggtgtgtcgtggacaatgaaaataggcataggaatattactaacttggttaggtttaaattccagaagtacaagtctttctatgacctgtattgcagttgggatggtaactttgtacctcggagttatggtacaagcagatagtggctgtgtcattaattggaagggtcgggaattaaagtgcggtagcggtatatttgtaacaaacgaggtacatacatggacagaacaatataaatttcaagcagactctccgaaaagattatcagctgcaataggaaaagcgtgggaagagggggtatgtggtattagatcggctacgagattggaaaatatcatgtggaaacaaataagcaatgaattaaaccatatactactagaaaacgacatgaaatttacggtagtggtcggagatgcaaacggaatacttgcacaggggaagaaaactataagaccgcagccaatggaacataaatattcctggaaatcgtggggaaaagctaaaattataggagcggatatccaaaataccacattcattattgacggaccagacacaccagaatgtccggataatcagcgagcttggaatatctgggaagtagaggattatgggtttggaatatttacgacaaatatttggttaaagctgagagactcctatactcaaatgtgcgatcatcgactgatgtcggccgccataaaggacagcaaggcggtacatgcggatatgggctattggatagaaagcgagaaaaatgagacttggaagttagcccgagcctctttcatagaggtaaaaacgtgcacatggccaaaaagccacacactttggtcaaacggtgtgcttgaatcagaaatgattatcccaaaaatatatggcggtcccatctcacagcataactatagacccggttactttactcaaacggcgggaccctggcacctaggaaaacttgaattagattttgatttatgcgaaggcaccacagtggtagtggacgaacattgcggaaacaggggaccttctttgagaactacaacagtaacaggtaaaatcatacacgagtggtgttgcagatcctgtaccctaccaccactgcgctttaggggagaggatggatgttggtatggaatggaaataaggccggtgaaagaaaaagaagaaaatcttgtacgaagtatggtatctgccgggagcggtgaagtagattcattctctcttggtatattatgcgtatcaattatgatagaggaagtcatgagatccagatggtcaagaaaaatgttgatgacaggcacactcgctgtatttttattattaataatgggtcaattaacgtggaaggacctgattcgtctatgcattatggtaggcgccaacgcttcagataggatggggatgggcactacatacctagcattaatggcaactttcaagatgcgacctatgttcgccgtcggattactgttccgacggctaacgtctcgtgaagttctattattgactattggactatctctagtagcgtccgtagaattgccaaactctttagaagaactaggagatggactcgcgatggggattatgatgttaaagttactaacggaatttcatccacaccaactttggacgacattgctaagcctcacttttatcaaaacaacgctttcactagattacgcttggaagactacagcaatggcgttaagcatagtgtcgcttttcccgctgtgccttagcacaacttcccagaaaactacatggcttccagtattacttggttcatttgggtgcaaacctttaacaatgttcttgataactgaaaataaaatatggggcagaaagtcttggcccttaaacgaaggaataatggctataggaatcgtaagcatattactttcatcactacttaagaatgatgtcccattggccggcccgttaattgcgggaggtatgcttatagcttgttatgtgatctcgggatcaagtgcagatttatccctagaaaaagcagcagaagtaagttgggaacaagaagcggagcactccggaacctcacataatattttagttgaggtgcaagatgatggcacaatgaaaataaaagacgaggagagagatgatacattaacgatactattaaaagcgacattattggctgtgagtggagtttacccaatgtcaatacctgccacactctttgtttggtatttttggcagaagaagaaacaacggtcgggtgtactctgggacacaccctcaccgcccgaagtcgaaagggcggtcctagacgatggaatatatagaatattgcagaggggactgcttggaagatctcaggtcggcgtcggagtttttcaagatggagttttccacacaatgtggcatgtcaccaggggagcagttttaatgtatcaaggaaaaagattggagccttcgtgggcctcagtaaagaaagacttaatcagttacggcggcggatggcgatttcaaggatcttggaatacaggtgaagaagtgcaggtcatagcagtcgaacctggtaaaaatcccaaaaatgtacaaaccacgccaggtacattcaaaacgccagaaggagaagtgggcgcgattgcactggattttaaacccggaactagcggtagtcctatcgtcaacagagaaggcaagatagtcgggctatacggaaatggagttgtaaccacgtctggaacatacgtgtcagcaattgcacaagcaaaagcaagtcaagaaggacctttaccggaaatcgaagatgaagtatttaagaagagaaatctgacaatcatggatttacatcccggatcaggaaaaactagacggtatctgccggctatagtacgcgaggcaatcaaacgaaagctacgaacgttaattttagcgcctactagagttgttgcgagcgagatggctgaagctctcaaaggcatgccaattagataccagacgacagcagtcaaatctgagcacacaggtagagaaatcgtagatctaatgtgccacgcaacatttactatgaggttgctgagtccagtaagagtaccaaattataatatgataataatggacgaagctcattttacggatcccgcttccattgctgcgaggggatatatttccacacgtgttggtatgggagaagcggcagccatttttatgacagcgactccacctggatcagttgaagcgttcccgcaatcgaatgcagtaattcaagatgaagaaagggatatccctgagaggtcatggaactctggttatgattggatcacagatttccccggaaaaacagtgtggttcgtgccatccataaagagcgggaatgatatagctaactgtctaaggaaaaacggcaaaagagttatacaattatcacgaaagacattcgatacagaataccagaagaccaaaaacaatgactgggattatgtggtaaccacagatatatcagaaatgggagctaattttcgagcggacagggtcatcgatccacgacgttgcttaaaaccagtaatattaaaagacggacccgaacgagtgatattagccgggccaatgcctgttacagtggcaagtgcagcacaaagaagaggacgaataggacgaaatcagaataaagaaggtgaccagtatgtatacatggggcaaccccttaacaacgacgaagatcatgcccactggaccgaggctaaaatgttattagataacataaatactccggaaggtattatccccgcgctctttgaaccagagagagagaaaagcgctgccatcgatggtgagtatagactccggggagaggcacgtaaaacatttgtagaactaatgcgaagaggagatttgccagtatggctatcatacaaagttgcatcagaaggattccagtattcagatagaagatggtgctttgacggagaaagaaacaatcaggtactagaagaaaatatggatgtcgaaatatggaccaaagagggcgaaaggaagaaactaaggccccggtggctagatgcaaggacctatagcgacccgttagcattaagggaatttaaagaatttgccgcaggacgccgctccgtctccggggacttaatcctcgaaattggcaaactacctcaacacttaacgttaagggcacaaaacgcattagataacctagttatgttgcacaattcagagcaaggcggaaaagcatatcgccatgctatggaagaattgccggacacaatagaaacacttatgctgttagcacttattgctgttttaacagggggagttacgctgttctttttgagtggaaaaggcttgggcaaaacgagcattggactactatgtgtcacagcctcatccgcactattatggatggcatcagtggagcctcattggatagcagcgagcattatactagagttctttttaatggttttattaataccggaaccagaccgtcaaaggactcctcaggataatcagttggcctatgtagttataggattacttttcatgatattaacagtagctgccaacgaaatggggcttttagaaaccactaagaaagatctcggaataggccacgtagcagccgaaaatcatcaacacgccacgatgttagacgtagatctacgacctgcaagcgcatggactctttatgccgttgcgacgactgtcataacgcccatgatgcgacacacaatagaaaatactacagcaaatataagtttaacagcaattgcaaatcaagcagcaatcctgatgggattggataaagggtggcccatctcaaaaatggacataggagttccactactcgcgttagggtgctattcccaggtcaatccacttacactaacggcagctgttttaatgctagtagcacactacgcaataataggacccggattgcaagccaaagccactcgcgaagctcagaagcgtacagccgcaggaataatgaaaaatcctacagtagatggaatagtcgcaattgatttagaccctgtagtttacgatgcaaaatttgagaagcagctaggacagataatgttactaatattgtgtacctctcaaatccttcttatgagaacaacgtgggcgttatgtgagtccataacgttagctactggcccgctgacaactttatgggaagggagccctggtaaattttggaacactactatagctgtaagtatggctaatatatttcgaggaagttacctagcaggagcaggcttggcattttcattaatgaaaagccttggaggcggtaggagagggaccggtgcacaaggggagacactaggtgaaaagtggaaacgacaattaaatcaactatcaaaatcagagtttaatacatacaaaagaagcgggattatggaagtcgacagatctgaagctaaagaaggtttaaaaagaggagaaaccactaaacacgcagtgagccggggcacagcaaaactgaggtggtttgttgaacgtaacttagtaaagccagagggcaaagtcatagatctagggtgcgggcggggaggatggtcgtactattgtgcaggcctgaaaaaggtaaccgaagtaaaaggatacacaaaaggcggaccaggacacgaagaaccaataccgatggcgacatacggctggaacctagttaaacttcattcgggcaaagatgtattctttatgccacccgaaaaatgtgacaccctattatgcgacataggggaaagtagtccgaaccccacaattgaagagggccgtacactcagagtattaaagatggtcgagccgtggctccggggaaaccagttttgtattaaaatattgaatccatacatgccgtcggtagtagaaaccttagaacaaatgcagcgcaagcacggaggaatgcttgttaggaacccactctcaagaaattcaactcacgaaatgtattgggtgagttgcggaacaggtaacattgtaagtgcagtgaatatgacatcacgaatgctactaaatcggtttacaatggcgcaccgaaagcctacatatgagagggacgttgacctaggcgctggtacacgtcacgtcgcggttgaaccggaagtggcaaatcttgatataatcggtcaacgcatcgaaaatattaagaacgaacacaagtcaacttggcactacgacgaggacaacccatataaaacatgggcgtatcacggatcatacgaagtaaaaccatctggctcagcaagctctatggttaacggcgtagtacgcttacttacaaaaccttgggacgtcatacctatggttactcaaatagcgatgaccgacacgacgccattcggacaacagcgtgtttttaaggaaaaggttgatacacgaacccctagagctaaaagaggaaccacgcagattatggaggtcacagcgaaatggctatgggggtttctatctcgcaacaagaaaccaagaatctgcaccagagaagaatttactcgcaaagttagatctaacgctgcaattggcgcagtattcgtcgacgaaaaccaatggaactctgcaaaagaagcggttgaagacgaacgtttctgggatttagtccatagagagagggaactacataagcaagggaagtgtgcgacctgcgtatataatatgatgggaaaaagagaaaagaaactcggagaatttggtaaagcaaaaggtagtcgggccatatggtatatgtggctaggagcgaggttcctggagttcgaagcgctgggattcatgaatgaagatcactggtttagtagagaaaatagcttatcaggagtggaaggtgaagggttgcataaattgggatatatcttgcgcgacatatcaaaaatacctggtggtaatatgtatgctgacgataccgcgggctgggacacaagaataacggaagatgatcttcagaatgaagcaaaaataacagacataatggaacctgaacatgcactactcgcgacatcaatcttcaaactcacatatcaaaataaggtagtacgtgtgcaaagacccgctaaaaatgggacggtgatggacgtcataagtcgaagggatcagcgtggttcaggacaagtaggaacgtacgggcttaatacattcaccaacatggaagtccagcttataagacaaatggaatcggaaggaattttcctgccaagtgaattagagacacccaacttagcagaaagggtcttagattggttagaaaaacacggtgcagaaagattaaaacgaatggccatttccggcgacgattgtgtagtaaagccaatagatgacagatttgcaaccgctcttactgcgctcaacgatatgggaaaagtaaggaaagacatccctcagtgggagccttccaagggatggaacgactggcaacaagtacctttttgctcgcatcacttccaccaattgataatgaaagatggccgagaaatagtggttccatgtaggaaccaagacgaactggtaggtcgcgctcgcgtgagccagggtgcggggtggagtttgaaagagacagcatgtttagggaaaagttatgcgcaaatgtggcaattgatgtacttccatagaagagacctacgactcgcagcaaatgcgatctgttccgccgtaccagtagattgggtaccgacaagcaggaccacttggagtatacatgcacaccatcaatggatgacaactgaagatatgttatctgtatggaaccgagtttggatcgaagagaacccttggatggaagataaaacacacgttagttcatgggaagaggtaccttacctaggcaaaagagaggaccaatggtgcggttcactaattggtttaacagctagggcaacgtgggcgacaaatatacaagtggccattaatcaagttcgacgtctcataggaaacgaaaactatcttgattatatgacatcaatgaaacgttttaaaaatgagtctgatcctgaaggagctctgtggtaa

SEQ ID NO: 21250 - RNA, 9879 nt, synthetic construct
  misc_feature 1..9879: note = derived and/or modified CDS sequence (opt6) from DENV-1__KF955427__SS-prME
  source 1..9879: mol_type = other RNA
tctgtgactatgttacttatgctattgccaacagcgctagcatttcacttgactactcgaggcggagaaccacatatgatagtgtctaaacaagaaagaggaaaatctttattgtttaaaacatctgcaggagtaaatatgtgtactttaatagcgatggacctaggtgaattatgcgaagatactatgacctacaaatgccctcaaatcacagaggcggaaccagatgatgtagactgctggtgcaatgcaactgatacctgggtaacatatggaacatgttcacagacgggtgaacatagaagagacaaacgaagcgtagcgttggcaccacacgtgggcctagggttggaaactagaacggaaacatggatgtcctcggaaggagcttggaaacaaatacaaagagttgagacatgggcactacgacatccaggcttcaccgtaatagctctattcctagcacacgcaataggtacctcgattacacagaaaggtattatattcatactattgatgctggttacaccatcgatggcgatgcgatgcgtaggaattggtaacagagattttgtagagggtttaagcggagcaacatgggtagatgttgtactagaacatggaagttgcgttacaaccatggccaaaaataaaccaacgctggatatagaacttcttaaaactgaggtaacaaacccagctattttacgtaaattatgtattgaagcaaaaatatcaaacacaacaacagattcacgatgtcccactcaaggtgaagctaccctagtagaagaacaagatgcaaacttcgtctgtagacgtacatttgttgatcgcggatggggtaatgggtgtggattattcggaaaagggtctttattaacatgcgcaaaatttaaatgcgttacaaaattagagggtaaaattgttcagtatgagaatcttaaatatagcgtgatagtaacagttcacacaggcgatcagcaccaggtgggtaacgaaactaccgaacatggaaccatagcaacaataacacctcaagctccaacatcagaaatccaattgactgattatggagcattgactttagactgcagtccaagaacaggactagactttaatgaaatggtgcttctgaccatgaaagaaaaatcatggcttgtacacaaacagtggttcctagatttgccactaccatggacgagtggagcttcaacttcgcaagagacatggaatcgtcaagacttgcttgtaacattcaagacagcgcacgcaaagaagcaagaggtagttgtcctagggtcacaagaaggtgcaatgcatactgcttggactggtgcgacggaaatccaaacgtcaggtacaactacaatattcgcgggacatctcaaatggagattaaaaatggataaactaaccttaaaggggacgtcatatgtgatgtgtaccggatcattcaaacttgaaaaggaggttgctgaaactcaacatggaacaggattagtgcaagtaaaatatgaaggaacagatgctccctgcaaaataccttttagcgctcaagatgaaaaaggagttactcaaaatgggagattaattactgctaaccccattgtcactgacaaagaaaaacccgtaaatatagaaacggagccaccatttggtgaaagttatatagtcgttggggccggtgaaaaggcacttaagttgtcctggtttaagaaaggaagttcgatagggaaaatgttcgaggcaacggctagaggggcccgaaggatggccattttaggcgacactgcgtgggatttcggaagcattggtggagtgttcacaagtgttggcaaattagtacaccaagtattcggtactgcctatggagtactattttctggtgtctcatggaccatgaagataggcatagggatactactaacatggctaggattaaatagccgttcaacaagtttgtcaatgacgtgcatagccgtaggaatggtgacgttgtacctgggagttatggtacaagctgatagtggttgtgtcataaactggaagggtcgagaattaaaatgcggctcaggaatattcgtcacgaacgaggttcatacctggactgagcaatataaattccaagcggattcaccaaaaaggctcagcgctgcaataggaaaggcatgggaggaaggcgtctgtggcattagatcagcaacacggctagaaaacatcatgtggaaacagataagtaatgaattaaaccacatattgttagaaaacgatatgaaatttacagtagtagtaggagatgctaacggtattcttgctcagggtaagaagatgattcgcccacagcctatggaacacaaatatagttggaaatcctggggaaaagctaagataataggcgctgacatacaaaatacaacattcattatcgacggtcccgataccccagagtgtccagataatcaaagagcgtggaacatatgggaggtcgaagactatggcttcggtatttttacaacaaatatctggttaaaactccgggattcatatacccagatgtgcgaccacagactaatgtcagcggctattaaggattcaaaagccgtgcatgccgacatgggatattggatcgaaagtgaaaagaacgaaacgtggaaacttgccagagccagttttattgaggttaaaacatgcacttggcctaagtcgcacactctttggtcgaatggcgtcctagagagtgaaatgatcataccgaaaatttacggaggacctataagtcaacataactatcgaccgggttactttacgcagactgctgggccatggcatcttgggaagttagaacttgacttcgatctttgcgaaggaacgacagtagttgttgacgagcattgtggtaatagaggccctagcctaaggacaacaacagtgactggaaaaattatacacgaatggtgctgtcggtcatgtactctaccaccattacggtttcgcggtgaggacggttgttggtacggaatggagattcgacctgtaaaggaaaaggaagaaaatcttgtaagaagcatggtttccgcaggatcaggtgaggtagatagtttttctttagggattctatgtgcgtcgataatgatagaggaggtaatgcgttctaggtggtcgaggaagatgctaatgactggaacgttagcggtattccttctcctcgtcatgggccaattgacttggaatgacctgattcgattgtgcattatggtaggagccaacgcatcagacagaatgggcatgggaacaacgtacctggcattgatggctacattcaaaatgcgaccaatgtttgcagttggtctattatttaggcgacttacatcaagagaagttttgttgttaaccataggtcttagcttggtagcatcagttgaattaccaaattcacttgaggaactcggagacggactagccatgggaataatgatgctgaaacttcttacggaatttcaaccacatcagttatggacgaccttattaagtttgacattcattaagacgactctgagtcttgattatgcatggaagacgacggcaatggctttgtctatcgtctcgctattcccgttatgtttgtcgactacttcccaaaagaccacttggcttccagtattacttggctcatttggatgcaaacctttaactatgtttcttattacagaaaataaaatttggggaagaaagtcctggcctctcaatgaaggaattatggcgatcggtatagtgtccatattactatcgtcattattaaagaacgatgtcccactacccgatccgcttatcgccggtggtattttgatagcgtgctacgttatctcaggcagttcagcggacttaagccttgaaaaagcggctgaaatgtcatgggagcaggaagcggagcattcaggaacgagtcataacattcttgtggaggttcaagacgacggaccaatgaaaataaaagatgaagaacgcgatgacacactcactatattgttaaaggcaactctgctcgccgtatccggtgtttacccgatgtcaattccaggcacattgttcgtatggtacttttggcagaagaagaaacaaagatcaggggtattatgggatacaccctctccacctaaagtcgaaagggctgtattggatgacggaatatacagaatcctccaacgaggactcctaggtcgctcgcaagtaggtgtaggcgtgttccaagatggagtgtttcatacaatgtggcatgtaacaaggggagctgtgttaatgtaccaaggcaaaagactggaacctagttgggcatcggtcaagaaagatttaattagttatgggggaggatggagatttcaaggctcatggaatacaggtgaagaagttcaagttatagcggtggaacctggaaagaatcctaagaacgtccaaacaacacccggaacatttaaaacgcccgaaggtgaggtgggggcaatagcattagatttcaaaccaggtacaagtggaagcccaatagtaaaccgagaaggaaaaattgtaggactatatgggaacggtgtagttactacaagtggaacgtacgtttcggctattgctcaagcaaaagcaagtcaggagggtcctttacctgaaatagaggacgaagtctttaagaaaagaaatctaacgataatggaccttcatccgggttcgggtaaaacccgcagatacctaccagctattgtgagagaagcaatcaagagaaaattacgaaccctaatacttgcgccaacaagagttgtagcgagcgagatggccgaagctctgaagggaatgcccatccgctaccaaaccacagcagtgaaatcggaacatacaggccgagaaatagtagatcttatgtgtcacgcaactttcacgatgcgactgctcagccccgtacgggtcccaaactacaacatgattataatggatgaggcccattttacggatccagccagtattgcggcgagaggatatatatcaaccagagttggtatgggcgaagctgcggcgatatttatgacagcgactcctccaggctctgttgaggcttttcctcaaagtaacgcagttatccaggatgaagaacgagatatcccggaacgtagttggaatagtggttatgattggattacagatttccctggtaaaacagtatggttcgttcctagtataaaatcaggaaatgacattgctaactgtctccggaagaatggtaagagagtgatccagttaagtaggaaaacttttgacacggagtatcagaaaaccaaaaataatgattgggattacgtagtaaccactgatatttctgaaatgggagcgaacttccgagcagaccgagtaatagatccaaggcgatgtttaaagccagtgattctaaaagatggacctgagagggtgatacttgcaggcccaatgcctgtaacagtggcttctgccgcccaacggcgaggaaggattggaagaaatcaaaataaggaaggagatcaatacgtatatatgggacaaccattaaacaacgatgaagatcacgcgcactggacagaagctaaaatgttacttgacaacatcaatactccagagggtattataccggcattgtttgagcccgaaagagagaaatcggccgcaatagatggtgaatatcgattaaggggtgaagcaagaaagaccttcgtcgaactgatgcgaagaggtgatctccctgtatggctatcgtacaaagtcgcctcggaagggtttcaatatagcgatagaagatggtgcttcgatggagaaagaaacaatcaagtattagaagaaaatatggatgtcgaaatatggacaaaagagggcgaaaggaagaaattgcgtcctaggtggttggatgcaagaacgtactcagacccacttgcattacgcgagtttaaagaatttgcagccggccgtagaagtatttcaggagacttaatacttgagataggaaaactaccgcaacatctaacactgagagctcaaaatgcattggacaacctagtgatgttacataattctgagcaaggtggtaaagcgtacaggcatgcgatggaagaactaccggacacgatagaaacattaatgctcttagctcttattgcagtattaaccggtggagttacattattctttttatcaggaaaaggtttaggaaaaacatccattgggttactatgcgtaacagccagtagtgcactattatggatggcttcagtcgagccacactggatagcagcaagtataatcctagagttcttcttaatggttctactaattcctgaaccagatcgtcaaagaacaccccaagataatcagttagcgtatgttgtgataggattattgtttatgatattgacagtcgcagctaacgaaatgggcttattggaaacgactaagaaagacttaggaataggacacgtagctgcggaaaatcatcaacatgccacaatgctagatgtagatcttagacctgcaagtgcatggacattatatgcagtcgccacgacagttatcacaccaatgatgaggcacacaatcgagaacacaaccgcaaatatatcattaacggcaatcgcaaaccaagcagcaatccttatgggattagataagggatggcctatatcaaaaatggacattggtgtacctttgctagctctagggtgctactctcaagtcaaccctttgaccctgaccgcagcagtcttaatgctcgtagcacattatgcaataatcggaccgggactacaggcaaaagccacacgcgaggcacagaaaagaactgctgcaggaataatgaaaaatccaacagttgacggtatagtcgctatagatttggatccggttgtctatgacgcaaaatttgaaaaacaactagggcagataatgttgttaatcttgtgtacatcacaaatactgctcatgagaacaacatgggcactatgtgaatcaatcacacttgcgaccggcccattgacaactttatgggaaggatcgcctgggaagttttggaatactactattgccgttagcatggccaatatctttcggggatcttatttagccggggcagggctagcgttttcgcttatgaaaagcctaggcggagggagaagaggtacaggcgcccagggcgaaactctaggtgaaaaatggaaacgacaactcaatcaattaagcaaaagtgagttcaatacatacaaacgaagtggaattatggaagtagacagaagcgaggcgaaagaaggactaaaacgaggggaaacaacaaagcacgccgtgagcagaggcaccgcgaagttacgatggtttgttgagagaaacttggtgaaaccagaagggaaagtaatagacttaggttgtggtcgcggtggatggagttactattgtgctggactcaagaaagtgacggaagtaaagggatatacaaaaggaggtccaggacatgaggagcctataccaatggccacgtacggatggaatctggttaaattacacagtggcaaagatgtgttctttatgccgcccgaaaaatgtgatactttactttgtgacattggtgagagtagccccaatccaacaatcgaggaaggacgtacattgagggtgttaaagatggtagaaccgtggctcagaggcaatcaattttgtattaaaatcctgaatccctatatgccttctgtcgtcgagactttagagcaaatgcaaagaaaacatggtggaatgttggtaagaaatccattaagtagaaactcgacacacgaaatgtattgggtttcatgcgggacagggaatatagtaagtgcagtaaatatgacctcacgcatgttattaaacagatttaccatggcacatagaaaaccaacgtatgagcgggatgtcgacttgggagcaggaacacgtcacgtggctgtggaacccgaggtagcaaatttagatataattggacaacgaatcgagaacataaagaacgaacacaaaagcacctggcactatgacgaggacaatccttacaagacatgggcctatcatggtagttatgaagttaagccgtcaggtagcgcatcatcaatggttaacggggttgtaagattactaactaaaccatgggatgtaataccgatggttacgcagatcgcaatgaccgatacgacaccatttggtcagcaaagggtttttaaggaaaaagtagatacccgtacaccgagagcaaaaagaggaactactcaaattatggaagtcacagctaagtggctatggggatttttgagtagaaacaagaaaccccgcatttgtacgcgagaagaatttacaagaaaagttcgaagtaatgctgcaattggggctgtattcgtagatgaaaaccaatggaactcagctaaagaagcagtggaagatgaaagattctgggatcttgtacatagggaaagagaattacataaacaaggcaaatgcgcaacgtgtgtatataatatgatgggaaaacgagagaagaaacttggtgagtttggaaaagccaaaggtagtagggcgatatggtatatgtggctaggagcaaggtttctagaatttgaagccctggggttcatgaacgaagatcactggttctctagagaaaatagtctttcaggtgtagagggagaaggattgcataaacttggctatattttacgagatatttcaaaaattcctggtggcaatatgtatgcagacgacaccgcgggatgggacaccaggataactgaagatgaccttcaaaacgaagccaaaataactgaaatcatggaaccggaacacgcactcctcgctacctcaattttcaaattgacatatcaaaacaaagtggtaagagtacaaagaccagccaaaaacggcactgtaatggatgtgataagtagacgcgaccaacgaggtagcggacaggtaggcacttacggactaaatacgttcacaaatatggaggtacagctcataaggcagatggaaagtgagggcatattcttaccatcagaacttgaaacgccaaacttggcagaaagggtcttggactggttagaaaaacatggtgcagaaagattaaaacggatggcgataagtggggatgattgtgtagtaaaaccaatcgacgatagatttgcaactgcattaacagcgcttaacgatatgggtaaggtaagaaaggatatacctcaatgggagccaagcaaaggatggaacgattggcaacaggtaccattttgttctcaccactttcatcagctgataatgaaagatggacgagaaatagtggtgccttgtagaaatcaagatgaactggtaggcagagcaagagtaagtcaaggcgccggatggtcactgcgtgaaactgcatgtttagggaaaagctatgcgcaaatgtggcaacttatgtatttccaccgtagggacttgcgtttagccgcgaacgccatatgtagtgctgtgcctgtagattgggtccccacgtctcgaacaacgtggtcaatacatgctcatcaccaatggatgacaaccgaggacatgttgtcagtttggaacagagtctggattgaagagaatccttggatggaagacaaaacgcatgtcagcagctgggaagaagttccttacttaggtaaaagagaagatcaatggtgtggtagtctgattggtctgacggcaagggcaacatgggcgacaaacatacaagtagctatcaatcaagtcaggagattgatcggaaatgaaaattatctcgattacatgacttcgatgaaacgcttcaaaaatgaaagcgatccagaaggggctttatggtaa

SEQ ID NO: 21251 - RNA, 9879 nt, synthetic construct
  misc_feature 1..9879: note = derived and/or modified CDS sequence (opt6) from DENV-1__GQ868513__SS-prME
  source 1..9879: mol_type = other RNA
tccgttactatgcttctcatgctgctgcccactgctttagctttccatttgactactagaggtggagaaccccacatgatagtatcaaaacaagaacgcgggaaatctttactattcaaaacatctgctggggtgaatatgtgtacattaattgctatggatcttggagaactatgtgaagatacaatgacctacaaatgcccccaaataactgaagcagaacccgacgacgttgactgctggtgtaacgctacagacacatgggtaacctatggcacgtgctcacaaacaggtgagcatagacgggataaacgcagcgtagcactggcaccacatgtaggactaggtttagaaaccagaaccgagacctggatgtcctcagaaggagcatggaaacaaatacaacgagtagagacttgggcacttcgacatccaggattcaccgtaatagctttgtttttagcgcatgcaataggcacgtcaataacccaaaaaggaattatatttatcctacttatgctagttactccatcgatggccatgaggtgtgtaggtattggaaatcgtgacttcgtagagggactaagtggagcgacgtgggttgatgttgtactcgaacatggatcttgtgtaactactatggcgaaaaacaaaccaacattagatatagaattacttaaaacggaagtaaccaaccctgcgatattacgaaaactatgtatagaagcgaaaatctcaaatacaactacggactcacggtgtcctacccagggcgaggccacacttgtggaagaacaggatgccaactttgtttgtagacggacttttgtagatagagggtggggtaatggatgtgggttattcgggaaaggctctctactaacttgtgcaaaatttaaatgcgtgacaaaattggaaggcaaaattgttcagtatgaaaatcttaaatattcagttatcgttacagttcataccggcgatcaacaccaagtcggaaacgaaacaacagagcacggaacaattgctacaataacaccacaggcacctacaagtgaaatccaactaactgactatggcgcattaacgttggactgttcaccaagaacaggtctagacttcaatgaaatggttctacttactatgaaagagaaatcttggcttgtacataaacaatggtttttagatcttccccttccctggacatccggagcatcaacaagtcaggagacctggaatcggcaagacctattagttacgttcaaaacagctcacgcaaagaaacaagaagttgtagtactagggtcacaagagggagccatgccaaccgcgttaacaggagcaacagagatacaaacaagtgggaccacaactatattcgctggtcatctaaaatgtaggttaaaaatggataagttaacgttaaaaggtaccagctatgtaatgtgtacaggatcattcaaactagaaaaggaggtagccgaaactcaacatggtacagttctggtacaggttaaatacgaaggaacagatgcgccatgtaaaattcctttttcaacccaagatgaaaaaggagttacacagaatggacgtctaatcacagcaaaccctatagttacagataaagaaaaaccagtaaacatagagactgagccgcctttcggcgaatcatatatcgtagtaggtgcgggagaaaaagcattaaagttgtcatggttcaagaaaggctcaagtataggtaaaatgttcgaagctacagcccgtggagctagaagaatggcaatcttgggagatacagcctgggactttggatcaataggaggggtatttacgtccgttggcaaactggttcatcaagtctttggaacagcttacggtgtactttttagtggagtttcttggactatgaagataggaattggcattctcttgacgtggttgggactaaattcccgcagtacgtctctttctatgacttgtatagcagtcggtatggtaactctatacctgggtgttatggtccaagccgattccggatgtgtaattaactggaaaggacgggaattaaagtgtggctcaggaatattcgttaccaatgaagtccacacatggacagaacaatacaaattccaagcggactcaccaaaacgcctcagcgcagcaatcggtaaagcatgggaagaaggcgtatgtggaatccgaagcgctaccagactggaaaatataatgtggaaacagattagcaatgaattaaaccatattttgttagagaacgatatgaagtttactgtcgtggtgggtgacgcaaatggtatactcgcccaaggtaagaaaatgataagaccgcaacccatggaacataagtactcatggaaatcatggggaaaggccaaaattataggggcagatatacaaaatactacattcattatagacggccctgatacaccagaatgccccgataaccaaagagcctggaatatctgggaggtagaagactacggattcggaattttcacgacaaacatatggttgaaattaagggattcatatacacagatgtgcgatcacaggctaatgtcagcagcgattaaagacagcaaggcagttcacgcggacatgggttattggatagaatcggaaaagaatgaaacgtggaaactagctagagcttccttcatcgaagtcaaaacttgtacctggccaaagtctcatactttgtggtcaaacggggttttagaatcggaaatgataatacccaaaatatacggaggacctatatcacagcataattatagaccgggatacttcactcaaacagcgggtccatggcatttaggaaaattagaacttgactttgatctttgtgaaggaacgactgtagttgtggacgaacattgcggaaatagggggcctagcctacgcacaacaactgtgacaggcaagatcatccatgaatggtgctgtcgctcttgtacactcccaccgcttagattccgaggcgaagatggatgttggtatggtatggaaatacgccccgtaaaagaaaaggaggaaaatttagttaggtcaatggtatctgctggatccggagaagtcgattcattttcgcttggaatactttgcgcaagtattatgattgaagaagttatgcgttcaagatggtcacgaaaaatgcttatgaccggtacattagctgttttcttactactggtgatgggccaattaacatggaacgacttgattaggttatgtataatggtaggtgctaacgcatctgaccgaatgggaatggggacaacatacttagcattaatggctacgttcaaaatgagaccaatgtttgccgtagggttattatttcgcagactaacatcacgagaagtgttattactaacgatcggattgtctctagtagcgtcagtagaacttcccaactccttagaggaattaggagatggccttgcaatgggaataatgatgttgaagctgctgactgagtttcaaccccaccaactatggatcactttgttgtcactgaccttcatcaaaactacattatcgttagactatgcctggaagactaccgccatggccctaagcatagttagcctattccctttgtgcttaagcaccacaagtcaaaagactacatggttaccagtattattaggatcatttggctgcaagccgctaacgatgtttctaataaccgaaaataaaatatggggcagaaaatcttggccgttaaacgagggaataatggcaatcggaattgtttctatcttgttaagttcactcctcaaaaatgatgtgccactggcaggacccttaatagcaggaggcatgttaatagcatgctacgtgataagtggtagctcggcagatttatccttagagaaagcggctgaagttagctgggaacaagaggctgagcattctgggacgtcccataacatattagtagaagttcaagatgatggtactatgaagattaaagatgaagaacgtgacgatacactaactatactgctcaaagccacattgctagctgttagcggagtgtatcccatgagcattcctgccacattattcgtatggtatttttggcagaagaagaaacaaagatcaggagtattgtgggacacaccgtcaccacctgaagtcgaacgcgcagtcttagacgatggaatatacagaatacttcaaagaggattattaggtcgaagtcaagttggagtaggcgtttttcaagatggagtatttcatacaatgtggcacgttacgcgaggagcggtcttaatgtaccaaggtaagcgccttgagccatcttgggcaagtgttaagaaagatttaatcagctatggaggcggatggagatttcaaggatcgtggaataccggtgaggaagtacaagttatagccgtagaaccgggtaaaaatcccaaaaatgtacagacgatgcctggtaccttcaagacgcctgagggtgaggtgggcgcgattgctctggactttaaacctgggacgtctggatctccaatcgtcaatagagaaggtaaaatagtgggtttgtatggtaacggggttgttaccactagcggtacgtacgttagtgcaatcgcgcaagcgaaagcaagtcaggaaggaccgctccctgagatagaagacgaagtgttcaagaaacgtaacctaaccataatggatcttcaccccggatcgggtaaaaccagacgctacctaccagcgatggtcagggaagcaattaaaaggaaattaagaacgctaattttagcgcccactagggtcgtagcttctgaaatggcagaagcgctaaaaggaatgccgattaggtatcaaacaacagcagtcaaaagtgaacatacgggaagagagattgtagacctaatgtgccacgcaacttttaccatgcgtctactttccccggtaagagtacctaactacaacatgattataatggatgaagcgcattttactgatcctgcttcaatagccgcgaggggctatatttcaacaagagttggtatgggtgaggctgctgcaatatttatgacagcgacacctccaggatcagtggaagcatttcctcaatccaatgcagtgattcaagacgaagagagagatatcccggagcgaagttggaactcgggctatgattggatcactgatttcccaggtaaaaccgtttggtttgtgccctccatcaaatctggaaatgatatcgctaattgcctaaggaaaaatggcaaacgcgtaatacaattaagcaggaaaacattcgacacagagtaccagaaaaccaaaaataatgactgggattacgtggtaacgacagacatatccgaaatgggagcaaattttagagcagatcgagtaattgacccccgacggtgccttaaaccagtcatacttaaggatggacctgaacgtgtgatcctcgcgggaccaatgccggtaaccgtagcttcagcggcccaaagacgtggaagaattggaagaaatcaaaacaaagaaggagatcaatacgtgtacatggggcaaccattgaataatgatgaggatcatgcccattggacagaagccaaaatgcttctggataatataaatactccagaaggaataataccagcattgtttgaaccagaacgtgaaaagtccgcagcaatagatggagaatacagacttagaggagaagctaggaaaacttttgttgaactaatgcgacgaggtgacctacctgtctggctatcatataaagttgccagcgaaggcttccaatactctgatcggcgttggtgtttcgatggcgagagaaacaatcaagtgcttgaagagaatatggatgtggaaatatggactaaggagggggaaaggaagaaactgcgccctagatggttagacgctcgcacatactctgatccgttggcacttcgagaatttaaagagtttgctgctggacgtcgttcagtttctggggatctgatactagaaattggaaagttacctcagcatctaaccttaagagctcaaaatgcattggacaatttagtaatgttacacaatagtgaacaagggggtaaggcctatcgtcacgcgatggaggaacttccggatactatcgaaacattaatgctattagctctgattgcagtacttactggaggagtcacactatttttcctaagtggtaaaggtctcggcaaaacgtctataggattattatgcgtaacagcatctagcgcactgttatggatggcgagtgtcgaaccacactggatagccgcctccattatcttagaatttttcctaatggtacttttgatacccgaaccagatagacagcgcacgccacaagataatcagttggcttatgttgttattggattgttgtttatgatacttactgtcgcagctaacgaaatgggactattagaaacaacaaagaaagacttaggcataggacatgtagcggcagaaaaccaccaacacgctacgatgctagatgtggatttgcgcccagcctcagcatggacactctatgcagtcgctacgacggttataacacccatgatgagacataccatcgaaaacaccacagcaaatatatccttaacggcaatagcaaatcaggcagctatattaatggggctagacaaaggctggcctatatcaaagatggacataggcgtccctcttctagcattaggatgttactctcaggtcaatcccttaacattaactgccgcggtcttaatgttagtagcacactatgctattattggccctggcttacaagcaaaagcgactcgcgaagcgcaaaagagaacagcagcaggtataatgaaaaacccgacggtagacggaatagtagcaattgacctcgacccagttgtgtatgacgccaaatttgaaaaacaactaggacaaataatgcttttaattttgtgcacttctcaaatcctgctcatgcgtacaacttgggccctgtgcgaatccataactttagccactgggcctttaactacactttgggagggatctccaggtaaattttggaatacgaccattgcagtatcaatggcaaacatattcaggggttcttacttagcaggggcaggattagctttctccttaatgaaatcattaggaggagggagacgggggacaggagctcaaggagaaacattaggagaaaagtggaaacgtcaacttaatcaactgagtaaatcagagttcaatacatacaaacgatcaggaattatggaggttgataggtcagaagctaaagaaggtttaaaaagaggggagacaacgaaacatgccgtatctcgggggacggcaaagctgagatggtttgtagaaagaaatctcgttaaacccgaaggaaaagtaatagatctcgggtgcggtagagggggttggtcatattattgtgcaggtctaaagaaagtaaccgaagtaaaaggttatactaaaggaggccctggccatgaagaacccatccctatggcaacatatgggtggaatttagtgaagttacattcgggaaaggatgtatttttcatgccacccgaaaaatgtgatacacttctatgtgatataggagagtcttcccctaaccctacaatcgaggagggaagaacattacgagttttgaagatggtagaaccttggctgagagggaaccaattctgtattaagatattgaatccatacatgccgagtgtagttgaaacacttgaacaaatgcaaaggaaacacggtggcatgctagtgcgaaatccactatcacggaacagcacacatgaaatgtattgggtatcgtgtggtacaggtaacattgtatctgcagtcaatatgacaagtagaatgctactcaataggttcacaatggcacaccgaaaacccacttacgaacgcgatgttgatctaggagccggcacaagacacgtagcagtggaaccggaagtagcaaatttggatattattggtcaaagaatagagaatattaaaaatgaacataaatccacatggcattatgatgaagataacccatacaagacttgggcctatcatgggtcatacgaggtaaaaccgagtggaagtgcctccagtatggtgaatggtgtcgtgcgtctactcactaaaccctgggatgttatacctatggttacacaaatagcaatgaccgatactacaccgttcggacaacaacgagtatttaaagaaaaggtcgacacaagaacacccagagcaaagcgaggcacaacacagattatggaagtaacagctaaatggctatgggggtttctatctagaaacaagaaacccagaatttgcacacgagaagaatttacccgaaaggtaaggagcaatgctgctattggagcagtttttgtagatgaaaaccaatggaacagcgcaaaggaagcggtagaggacgaaaggttttgggacctggtacaccgagaaagagaactacacaagcagggtaaatgcgctacctgtgtttacaacatgatgggaaagcgcgagaagaaattaggagagttcggtaaagctaagggtagtcgagcaatatggtacatgtggttaggcgctagatttctagaatttgaagcactaggatttatgaatgaggaccattggtttagtagagaaaatagcctaagcggagttgaaggcgaaggactacataagctaggatatatcctccgtgacatatcaaagatcccaggtggtaacatgtacgctgatgatacggcagggtgggatacacgtataactgaagatgaccttcaaaacgaggcaaaaataacagaaataatggaaccagaacatgccctacttgcgacctctatatttaaattgacatatcaaaataaagtagtaagggtgcagcggccggctaaaaatggaactgtcatggacgtaatatcaaggagggaccaacgaggtagcggtcaagtcggtacgtatggcctaaatacatttactaacatggaagtacaactgattaggcagatggagtctgaaggaatatttttacctagtgagttagaaaccccgaacctagccgaacgtgttctggattggttagaaaaacacggggctgaaagattaaaaagaatggccatcagcggagacgactgcgtcgtcaagccgattgatgataggtttgctactgctttgaccgcactaaatgacatgggaaaagtaagaaaagatattcctcaatgggaaccttcaaaaggctggaacgactggcaacaagttccgttctgttcgcatcactttcatcaattaatcatgaaagatggtcgagagattgtggttccatgtcggaatcaagacgaactcgtaggccgggcgcgtgtctcacagggggccggatggagcttaagagaaacggcctgtctcggtaaaagctatgcgcagatgtggcaacttatgtactttcatcgaagagatcttaggctggcggcaaatgcaatatgcagtgccgttccggtcgattgggtcccaacaagtcgcactacatggtctatacacgcacatcatcaatggatgaccacagaggacatgttaagcgtttggaacagggtatggattgaagaaaatccttggatggaagacaagacacatgttagctcgtgggaagaagtaccatacctaggaaaacgagaagatcaatggtgtgggtccctcattgggctaaccgcaagggctacatgggcaacaaacatccaagtcgcaattaatcaggttaggcgtctgatagggaacgagaattatttggactacatgacatctatgaagcgctttaaaaacgaaagcgacccagaaggggctctatggtag

SEQ ID NO: 21252 - RNA, 9879 nt, synthetic construct
  misc_feature 1..9879: note = derived and/or modified CDS sequence (opt6) from DENV-1__GU131973__SS-prME
  source 1..9879: mol_type = other RNA
agtgtgacgatgctcttgatgttactaccgacggctttggcatttcatttaacaacaagaggaggagaaccccatatgattgtatcgaaacaagaacgcggtaaaagtttactattcaaaacaagcgcgggagtaaatatgtgtacgttaatcgcaatggatctgggagaactttgtgaagacacgatgacctacaaatgtccacaaataactgaagcggaaccagatgacgtggactgctggtgtaatgctactgacacttgggtcacgtatggaacatgttcgcaaactggggaacatcgaagggataaaagatccgtcgcgttggcaccgcatgtaggattaggtcttgaaactagaactgaaacatggatgagctcagaaggagcatggaaacaaatacaacgagtagaaacgtgggcattacgacatccagggttcactgtcatagcactttttcttgcacatgcaataggcacatcgataacgcaaaaaggcataatctttattttactaatgttagttactccatcaatggcaatgagatgcgtgggcattggaaatcgagattttgtcgaaggcttaagtggggcaacatgggttgatgtggtactggaacatggtagttgtgtaactacgatggcgaaaaataagccaacactagatatcgaattattgaaaactgaagtcacaaatcctgcaatactaagaaaattatgcatagaagcaaaaatttctaatacaacaacggatagtcggtgtccaacacaaggagaagctacgttggttgaagaacaagatgcgaattttgtatgtagaaggacgttcgtagatagaggctggggaaatggttgcggactgttcggaaaaggttccttgttgacctgtgcaaaatttaaatgtgtcacgaaactggaggggaaaatcgtacagtatgaaaacttgaaatattctgttatagtgactgtacacacaggagatcagcatcaggtaggaaacgagactacagagcatggcacaattgcaacgataaccccacaagcgccaacatcagaaatccaattgactgattatggggccctaactttggattgcagcccaagaacgggcctagactttaatgagatggtactacttaccatgaaagaaaaatcgtggttagttcataagcagtggttcttggatctgccactaccatggacgagtggagccagtacctcacaagaaacgtggaatagacaagacttgctcgttacctttaaaactgcacatgccaagaaacaggaagtagttgtactaggatcgcaagaaggagcgatgcataccgcattgacgggagcaacagaaatccagacaagtgggacaacgactatttttgccggtcatctaaaatgtagattaaaaatggataaattaacactaaagggtacgtcatatgtaatgtgtaccggttcattcaaattagagaaagaggttgcagaaacacaacacggtaccgtattggttcaggtcaaatacgaaggaactgacgcaccgtgcaaaatcccattctcaacacaagacgagaaaggggtaacacaaaacggaagattaataactgcaaatccaatcgttactgataaagaaaaaccggtaaacattgaaactgaaccgccatttggagaatcatacattgttgttggggccggggaaaaagcattaaaactcagttggtttaagaaaggatctagtatagggaaaatgtttgaagcaaccgcaagaggcgcacgacgaatggcgattttaggagacacagcatgggatttcggttcgattggaggggttttcacatccgttggaaaattagtgcaccaagtttttggtacagcatatggagttttattctctggtgtatcgtggactatgaaaataggcataggaatactattaacctggttgggattaaattcaaggagcacaagcctcagtatgacatgtattgctgttgggatggtgaccctttatttaggagtcatggtacaggcggactctggctgcgttattaattggaagggaagagaattaaagtgtggaagtggaatatttgtgacaaacgaggtacacacatggacagaacaatataagtttcaagctgatagtcctaaacgattgtcagctgcaataggcaaggcttgggaagagggcgtttgcggtattagaagtgctacaagactggagaacataatgtggaaacaaatatcaaatgaattaaaccatatccttttagaaaatgatatgaaattcactgtagttgtgggagacgccaatggaatattagcacaaggtaagaagatgataagaccacaaccgatggaacataaatatagttggaagtcctggggtaaagctaaaattattggtgctgatatacaaaacactactttcattatagacgggccagatacaccggaatgccccgataaccaaagagcgtggaatatatgggaggttgaagactatgggttcgggatattcactacaaatatatggttaaaattaagagacagctatactcaaatgtgtgaccataggctcatgagcgctgcaatcaaagacagtaaagcagtacatgcagacatgggttattggattgaaagcgaaaagaatgaaacttggaaacttgctagagcaagtttcatagaagtcaaaacctgtacttggccaaaaagtcatacactatggagtaacggtgttttggagtcagaaatgattattccaaagatctacgggggaccaataagccaacacaattatcgtccaggttatttcacgcaaaccgcaggaccatggcacctaggtaaactggaattagattttgatttgtgtgaaggaaccactgttgtagtagacgaacattgcggtaatagagggccttcattgcgcacaacgactgtaactggaaaaattatccacgaatggtgttgtaggtcatgtactctgccgcctttgcgtttcagaggcgaagacgggtgttggtatggcatggagataaggcccgtaaaagaaaaggaggaaaatttggtacggagtatggtaagcgccggatctggcgaagtagactcattctcactggggatactttgcgtcagcataatgatagaggaagtcatgcgctctcgttggagtcgcaagatgctaatgaccggcactttggctgtgtttcttttacttgtaatgggtcaattaacatggaacgatttgataaggctctgcatcatggtaggagccaatgcgagtgatcgaatgggtatgggaactacttatctcgctctaatggcaactttcaaaatgagaccaatgtttgcggttggcttgttatttcgcagattaacgagtagagaagttttactgctaacaattggtttgtcactcgtagcaagtgttgaactaccaaattcattagaagaactaggagatggattagcgatgggtataatgatgttaaaacttctcactgaatttcaaccccaccaattatggacaactttgctcagtttgacatttataaaaaccacactgtcattggattacgcctggaaaactactgcaatggccctaagtattgtatccctctttccactgtgcttaagtaccacgtcacagaaaactacttggctgccggtattactcggcagctttggctgtaagccgctaaccatgttcttaatcacagaaaacaaaatctggggtcgaaaatcttggccattaaacgaaggtataatggcaataggaatagtaagcatattactatccagtcttctgaaaaacgacgtaccattagctggcccccttattgcgggcggtatgctcatagcgtgctatgtcatatcaggatcttctgcggaccttagtctggagaaagcagcagaagtatcatgggagcaagaagcagaacatagcggtacaagtcataacatcttggtcgaggttcaagacgatggcacgatgaagataaaagatgaagagagagatgacacactgacaattttactaaaagcaaccttactcgctgttagcggtgtttaccctatgagtattccggccacacttttcgtttggtatttttggcagaagaagaaacaacgatcaggtgttctatgggatacaccttcgcctcctgaagtcgaacgagctgtactagatgacggcatatataggatcctgcagcgtgggctactgggtcgttcacaagtaggtgtaggagtattccaggatggagtatttcacaccatgtggcatgtaacgcgtggggcggtgctcatgtatcaaggcaaacgtttagagccttcttgggcaagcgtcaagaaagaccttatatcatatggcggtggatggcggttccagggatcatggaacaccggggaggaagtccaagtcattgctgtagaaccgggtaaaaacccgaaaaatgttcaaacaaccccaggtacgttcaaaacgccggaaggagaagttggagcgattgcattggatttcaaacccggaacgtcaggtagtccaatagtcaatagagagggaaaaatagttggcttatatggtaacggcgttgtaacaacatcagggacatatgtatctgcgatagcacaggcaaaagcaagccaagaaggtccactacctgaaatagaggacgaagtattcaaaaagaggaaccttacgatcatggatttacacccgggatcgggtaaaactcggagatatttacctgcaattgtacgagaagcaatcaaacggaaaatgagaacactaatactagcacctacaagagttgtggcgagtgaaatggctgaagccttgaagggtatgccaattcgatatcaaacaactgccgtgaaaagcgaacatacaggaagggagatagtggatctcatgtgtcacgctacgtttactatgcggcttttaagtccagttagagtgccaaattataacatgatcattatggatgaggcacatttcacagatccagcatccatagcagcgagagggtacatatcaaccagagtagggatgggagaagcagctgctattttcatgacagctactcctccgggatctgtagaagcctttccgcaatcaaacgcggtcatacaagacgaagaacgagacattcctgaacggtcatggaactctggatacgactggattacagatttcccaggaaaaacggtatggtttgtaccatctataaagtcagggaacgatatagctaattgcttgcgtaaaaatggtaagcgtgtaattcaattatcaagaaaaacctttgatacagaatatcagaaaacgaaaaataacgattgggattacgtagtcacaactgacatttctgagatgggggcgaattttagagcagacagagtcattgatccaaggcgatgtttgaagcctgttatactaaaagatggaccggaaagagtaatcttggctggacccatgcccgtgactgtagcgtcggcagcccaaagacgaggtaggatagggagaaatcaaaataaggaaggggaccagtatgtatatatgggtcaaccattgaataatgacgaagatcatgcacactggaccgaagctaaaatgttattagacaatataaacaccccagaaggaataattccagcgctatttgagccagaaagagaaaagtctgccgctatcgatggagagtataggttaagaggggaagcaagaaaaacattcgtagaattaatgaggcgtggtgatttgccagtctggctaagttataaggtggctagtgaaggtttccaatatagtgatagacgctggtgttttgacggagagcggaataatcaagtattagaagaaaatatggatgtagaaatctggactaaggagggggaaaggaagaaactacgacctagatggcttgatgctaggacctattctgaccctctagccctcagagaatttaaggagtttgccgccggtagaagatcagttagtggagacctaattcttgagataggcaaactacctcaacatctaacactaagagcccaaaatgccttagataacctggtaatgttacacaatagcgaacaaggtggcaaggcgtacagacatgcaatggaagaattgccggatacaatagaaacactgatgctattggcgctaatagcagtgcttacaggcggagtcactcttttctttttatccggcaaaggactaggaaaaacctcaataggactactctgcgttactgcttcgtcggcactattgtggatggcgtcggtcgaacctcattggatagctgcttccattatactagaatttttcttaatggtattattaattccagaaccggacagacagcgcactccacaggacaatcaactggcatatgtagtaataggccttttatttatgattctaacagtcgccgccaatgaaatgggactacttgaaactactaagaaagatttaggtatagggcatgtggcagccgagaatcatcaacacgctactatgttagatgtggacttaagaccggcaagtgcatggaccctgtacgcagtagcaactaccgtaattacccccatgatgagacatactatagagaatacaacagcaaatataagccttacggctattgctaaccaagctgcaatattgatgggcttagataaaggttggcccatatctaaaatggacattggggttcccctcttagctctgggctgttattctcaggtcaacccactgacactaacagcagctgttctaatgttggttgcccactacgccataataggtccgggactacaagcgaaagcaacacgtgaagcgcagaaaaggacagcagctggtataatgaaaaatcccacagtggatggcattgttgcaatcgacctagaccctgtcgtttatgacgcaaagtttgaaaaacaattagggcaaatcatgttactaatactctgtacgtcgcaaattttactcatgaggacaacttgggccctatgcgaaagcattaccctagccacgggtcccttaactacactctgggaaggcagtcctggcaagttttggaacacgacaattgcagtaagtatggccaatatatttagggggtcatatctagcgggggcaggactcgcattctcccttatgaaaagtcttggcggcgggcgtaggggaactggcgctcagggggaaaccctaggcgaaaagtggaagcggcagttaaatcaattaagcaaatcagagttcaatacttacaaaagatcaggtatcatggaagtggataggtcggaagcaaaggaaggtttaaagagaggtgaaactacaaaacatgccgtaagtagaggaacggcaaaactacgatggttcgtagagagaaacctggtaaaaccggagggtaaagtaatagaccttggatgtggcagaggcggttggtcatattattgcgccgggctgaagaaagtaacagaggtaaagggatacactaaaggtggtccaggacatgaagaacccatacctatggcaacatatggatggaacctagtaaaactacattcagggaaagacgttttctttatgccacctgaaaaatgcgatactttactatgcgatatcggtgaatcttccccgaatccgacgattgaggaaggacgcaccttacgagttctaaagatggttgaaccatggcttcgcggaaatcaattttgcataaaaatactaaacccctacatgcctagcgtagttgaagcgttagagcaaatgcaacgaaagcacgggggtatgctcgtgagaaacccattatcaaggaactcgacacacgaaatgtattgggtctcgtgcggaactggaaatattgtatcggcagttaacatgacaagcaggatgttgttaaatcgctttacaatggcgcatcgaaagcccacatatgaaagagacgttgacttaggagctggaaccagacacgtagcagtcgaacctgaagtcgctaacttagacataattgggcaaagaattgaaaatatcaaaaacgaacacaaaagcacgtggcactatgacgaagataatccatataaaacttgggcgtaccatggcagttatgaagtaaagccatccggttcggcatcatcgatggttaatggggtcgttaggctcctaactaaaccttgggacgttataccgatggtgacacaaatcgcaatgactgatactacgccttttggacaacaacgggtctttaaagaaaaagttgatacacgtacaccacgcgccaagcgcggtactacccaaataatggaagtaaccgctaaatggctatggggtttcctctctagaaataagaaacccagaatttgcacgagagaagaatttacgagaaaagttcgaagcaatgcagcaatcggagcggtatttgtcgatgaaaatcaatggaactcagcaaaagaagcagttgaagacgaaagattttgggatctagtgcaccgagaaagggaactacataagcaaggaaaatgcgcgacttgtgtttataatatgatgggtaaaagagagaagaaattgggggaatttgggaaagcaaaaggatctagagcaatatggtatatgtggttaggagcacggtttttagagttcgaggcgttagggtttatgaacgaagaccattggttctcaagggaaaacagcctatccggtgtagaaggtgaagggctacacaaattaggatatatattaagagacatcagcaaaattcctggaggaaacatgtacgccgacgatacagccggatgggatacgcgaatcacagaggacgacctgcagaacgaggcaaaaataacggaaataatggagccagagcatgccctcctagcaacatcaatctttaaattaacataccaaaataaagtggtacgagtccaaagaccagctaaaaacggcacagtaatggatgtcatcagtcgacgcgaccagcgaggaagtggacaagttggcacctatggtctcaatacttttacaaatatggaggtacagctgatacggcaaatggaaagtgaaggcatatttttgcccagcgagctagaaacaccaaacttagcggagagagtgctagattggctagaaaagcatggagccgaaaggctaaagagaatggcaatctcgggtgatgattgcgttgtaaaaccaatagatgatagatttgctactgcgctaaccgcactcaatgacatgggaaaggtaagaaaagatatcccccaatgggagccttcaaaagggtggaatgattggcagcaggtccctttttgctcacaccactttcaccaattaataatgaaagacggaagggaaatagttgttccatgtagaaatcaagacgaactggtgggcagagctcgggtatcacaaggagccggatggagtctccgggaaactgcttgtttaggtaagagttatgctcaaatgtggcaacttatgtattttcacaggagagatctcagattagcggcaaatgccatttgctcggcagtgcctgttgattgggtaccgacaagcagaactacttggtcgatacatgctcatcatcaatggatgactactgaggatatgctgagcgtatggaaccgcgtgtggattgaggagaatccttggatggaagataaaacacacgtctcgagctgggaggaagtaccatatctaggtaaaagagaagaccaatggtgtggttccttaataggattaacagccagagcaacctgggctactaatatacaagtagctataaatcaagttagaagattaataggcaacgaaaattatctagattatatgacatcaatgaagcggttcaaaaatgaatcagatcctgaaggtgcactgtggtaa

SEQ ID NO: 21253 - RNA, 9879 nt, synthetic construct
  misc_feature 1..9879: note = derived and/or modified CDS sequence (opt6) from DENV-1__GQ868517__SS-prME
  source 1..9879: mol_type = other RNA
tcggttacgatgctcttgatgctcctccccactgcactagctttccatctaaccacccgtggaggagaacctcacatgattgtgtctaaacaagagaggggtaaatcattactattcaaaacaagcgctggggtgaatatgtgtacgctcatcgcaatggatcttggagagctatgtgaagatactatgacatataaatgtccgcaaattactgaagcagaaccggatgatgtagattgttggtgtaacgcaactgacacttgggtgacatatggaacatgttctcaaacaggggagcacagaagagataaaagatccgttgcattagctcctcacgtaggactgggcttggagactagaacggagacatggatgtcctctgaaggggcatggaaacaaatccaacgcgtggagacctgggcgctacgtcacccaggatttacagtcatagcactattcttagctcatgcaataggtacctcgattactcaaaaagggataatctttattctactaatgttggttacaccatcaatggcaatgaggtgtgtaggaattggtaacagagattttgttgaaggattgagtggtgcgacatgggtggacgtggtgctagaacacggtagttgtgtgacaacaatggcgaaaaacaaacccaccttggacatagaactcctcaaaacagaagttacaaatccagcgatactcagaaaactttgcatagaagctaaaataagtaacacaaccaccgattctagatgcccaacacaaggggaagccacattagtcgaagaacaagatgcaaacttcgtttgtcgacgaactttcgttgaccgagggtggggaaatggatgcggactatttgggaaaggctctctacttacttgcgccaaatttaaatgcgtgacaaaacttgaagggaaaatagtacaatatgaaaatctaaaatactctgtcatagtcacggttcatacaggagaccagcatcaagttggaaatgaaactactgaacacgggacaattgccacaataactccacaagcaccaacttcagagattcaactcacggactacggtgccttgacattagactgctcaccgagaacaggcctagacttcaatgagatggtattactaacaatgaaagagaaatcgtggcttgtgcataaacaatggttcctagacttaccgctgccttggacctccggggcatcaacatcacaagaaacatggaatagacaagatctgctagtaacatttaaaactgcccacgccaagaaacaggaagttgttgtattaggttcacaagaaggagcaatgcacaccgcactaaccggagcaactgaaatccaaacgtcaggaacaacgaccatattcgcaggacatctaaagtgtcggctaaaaatggataagttgacattaaaaggaacatcttacgtaatgtgtacaggcagttttaaactagaaaaagaagtggcggaaactcagcacggaacagtattagtacaagtaaaatatgagggaactgatgcgccttgtaaaattcccttcctaactcaggacgaaaaaggggtaacacaaaatggtcgtttaataactgcaaatcccattgtaacagataaggaaaaacccgtaaacatagaaacagaacctccatttggagaaagttacatagtagtaggagctggtgaaaaggcactaaagctctcttggttcaagaaaggttcgagtatagggaaaatgtttgaagcaacggctcgaggggcacgacggatggccatactaggcgacacagcatgggatttcgggagcattggtggagtctttacaagtgtaggaaagctagtccatcaagtatttggaacagcgtacggtgtactgttctcgggtgtatcttggacgatgaaaatagggataggcatccttttaacatggctaggattgaatagtagatccacttctctgtccatgacatgtattgcagtaggcatggtgactctttacctaggcgtcatggtacaagcagacagtggatgtgtcataaattggaagggacgcgaattgaaatgcggctcggggattttcgtgactaatgaggtacatacatggacagagcagtataaatttcaagcagactctccaaaacgcttatcagcagcaatcggtaaagcctgggaagaaggtgtatgcggcattcggtcggccactcgtttagagaacataatgtggaaacaaataagtaatgaactaaaccatatcttgttagagaatgacatgaagtttacagtagtagtaggcgacgcaaatggaatacttgcgcaaggtaagaaaatgatcagaccgcaacccatggagcacaaatacagttggaaaagttggggaaaggcaaagataataggtgcagacatccaaaataccacgttcatcattgacgggccggacacgccggaatgtccagataaccaacgagcctggaatatttgggaggtagaggattatggatttggcatatttactacgaacatttggttgaaacttagagacagttatacacaaatgtgcgatcataggctaatgtctgctgccataaaagatagtaaagctgtacacgcagacatgggatattggattgaatcggagaaaaatgagacatggaaattagcaagagccagctttattgaagtgaaaacctgtacatggccaaaaagtcatacattatggtcgaatggtgtgcttgagtccgaaatgattataccgaaaatctatggtggtcccatatcccaacacaactacagaccgggatactttacacaaacagctggaccttggcatcttggcaagctagagctcgattttgacttgtgcgaaggtactactgtagtagtcgacgaacattgcgggaacagggggccatcactccgcacgactacagtaacaggaaaaattatacatgaatggtgttgcagatcatgtactctacctccattacggtttagaggggaggacggctgctggtacgggatggaaataagaccagtaaaagagaaagaagaaaatctcgtacgatcaatggtatcagcagggagcggtgaagttgattctttttcattgggaattttatgcgcaagtataatgattgaagaggtaatgagatcacgatggagcagaaaaatgctaatgacagggacactagcagtattcttattattaattatgggtcagctgacatggaacgatttgataagactatgcataatggtcggagcgaacgctagtgatcgtatgggaatgggcaccacatacttggcgcttatggcgacctttaaaatgagacctatgttcgcggtaggacttttgttcagacgactgacctctagagaagtcctcctgttgacaatcggattatctttggtcgcttcagttgaattaccaaattcgctagaggaactgggggacggtttggcaatgggaatcatgatgctaaaactgttaacagaatttcaaccccaccagctatggacgacacttctttctctaacttttattaaaaccaccctaagcctagattatgcttggaaaacaacggcaatggtattaagtattgtatctctattccctctatgcttgtcaacaactagccagaaaactacatggctaccagtccttttgggttccttcggatgcaaaccgctcacaatgtttcttatcacagaaaacaagatttggggaagaaaatcctggccgttaaatgaaggaataatggcaataggcatagtatctatattacttagttctctattgaaaaatgatgtgcccctagcagggccgttaattgcaggaggcatgttaatagcatgttatgtaatatccggatcgtcggccgatctaagcctagagaaagccgcggaagtcagttgggagcaagaagctgagcattccggaacaagtcataatattctcgtagaagtacaggatgacggaaccatgaagattaaagatgaagaaagagacgacacactaaccatcttattgaaggctacattgttagctgtgtcaggtgtatatccaatgtctattcccgctacgttgttcgtctggtacttctggcagaaaaagaaacagagatcaggcgttttatgggatacaccgagcccaccagaagtagaacgcgcggtactcgatgatgggatctatagaatactgcaaagaggattacttggaaggtcccaagtaggagtaggcgttttccaggatggtgtttttcatacaatgtggcacgtaacccggggtgcagtattaatgtaccagggcaaaaggttagaaccgagttgggccagtgtaaagaaagacttgatttcatacggtggaggttggagatttcaaggtagttggaatacaggtgaggaggtccaagtaatagccgtcgaacccggcaaaaaccccaaaaacgtacaaaccacaccaggtacatttaaaactccagaaggggaagtcggtgcaatagcattagactttaaacctggaacttcagggagtcccattgttaaccgagaaggaaaaatagttggattgtacgggaatggagttgttacgacatccggaacgtatgtttccgcaatcgcccaagcgaaagcatcacaagagggaccgttgcctgagattgaggatgaagtatttaagaaacggaatctaacaatcatggatctccacccaggttctgggaagactcgaaggtatttaccggctattgtaagagaagcaataaaacgaaagctaaggactttgattctggctccaaccagagttgtggcctcagaaatggcagaagccctaaagggaatgccaataagatatcaaaccaccgcagtcaagagcgagcatacgggtagagaaatcgttgatctaatgtgtcatgcaacattcactatgagattactctcacctgttagggtgcctaactataatatgataattatggacgaagctcatttcaccgatccggcctctattgcagctaggggctatatctctaccagagtagggatgggtgaagcagcggcaatttttatgacggcaacgccaccgggttctgtagaagcgtttcctcaatcaaatgcagttattcaagatgaagaaagagatatacccgaaagatcctggaactcgggatatgattggatcactgactttcccggaaaaacagtttggttcgtcccatcgataaagtcaggtaatgatattgccaattgtttacgaaagaatggaaagagggttatacaactaagtagaaagacatttgatactgaataccagaaaactaaaaataatgattgggactacgtagtaacgacagatataagtgaaatgggagcaaatttccgcgctgaccgagtcatcgatccccgacgttgccttaagccagtaatattgaaagatggaccagaaagggtgatactagcaggacccatgcctgtaactgtagctagtgcagcgcaacggagaggaagaattggaagaaatcaaaataaggagggcgaccaatatgtatacatggggcaaccattgaataacgacgaagatcatgcacattggacggaagctaaaatgttactagataatatcaacactccagaagggataataccagccctatttgaacccgagcgagaaaagagcgccgcaatagacggtgaatatagattgagaggtgaagcgagaaaaacgtttgtggaattgatgaggagaggtgacctacctgtttggttatcctataaagtggcatcggaaggtttccagtactctgatcgtcgatggtgctttgacggtgaaaggaataatcaagtattggaggaaaatatggatgtagaaatttggactaaagaaggagagagaaagaaacttagaccgagatggctcgacgcacgaacctactccgacccattagcattaagggagttcaaagagtttgctgcaggacggcgtagtgtttcgggagatctaatacttgaaataggaaagttacctcaacatttgacgttaagagcacaaaatgctttggataatcttgtgatgttgcacaatagtgagcaaggcggaaaggcttaccgtcacgcaatggaggaattgcccgacacaatagaaacattgatgctgttagcgttaatagcggttctaacaggaggtgtaacattattctttctctccggaaaaggattaggtaaaacgtcaataggtttattatgcgtaaccgcctcaagcgccctcttgtggatggcctccgtagagccacattggatagctgcttcaattatactcgagtttttcctaatggtcctattaatacctgaaccggatagacaaagaactcctcaagacaatcaattagcatatgtcgttattggtcttttattcatgattcttaccgtggcagccaatgaaatgggcctgcttgaaaccacgaagaaagacctaggtattggacatgtagcggcagaaaatcaccaacacgcaacaatgttagacgtagatcttcgtccagcgtccgcatggactctatatgcagtcgcgactacagtaattacccccatgatgcgtcatactattgaaaatacaactgcgaatatctcacttaccgcaattgcgaatcaggcggccatcttaatgggtctagataaaggctggcccatatcaaaaatggatattggcgttccattgctagcattaggttgttattcgcaagttaatccattaacattaactgcggcagttttaatgttagtcgcccattacgcaattataggcccaggactacaagctaaagctacgagagaagcacagaaacgaacagctgccggtataatgaagaatccaacggtagacggcatagtagctatagatttagacccagtagtatacgacgctaaattcgagaagcaactagggcaaataatgctattaatcctttgtacatcccaaatattattaatgagaactacctgggcgctctgcgaaagtataactcttgctacgggaccgttgacgaccttatgggaaggaagtcctggtaagttctggaatacaactatagccgtttcgatggctaatatttttcgtggatcatatttagcgggcgctggcctagcattctccctgatgaaatcgctgggcgggggtaggagaggaacgggcgcccaaggagaaacattgggagagaagtggaaacgccaactgaatcagttatcgaaatctgaatttaacacatacaaaagatctggaataatggaagtagataggtccgaagccaaagagggcctgaaaaggggtgaaacaactaaacacgcggtcagccggggcaccgcaaaattgagatggtttgtagaaagaaatttagttaaaccggaaggaaaagttattgatctcgggtgtggaagaggaggctggtcctattattgcgctggtctcaagaaggtgacagaagtaaaggggtacacaaaaggtggcccaggccatgaggaacctataccgatggcaacttatgggtggaatctggtaaagctacatagtggaaaagatgtattctttatgccaccagagaaatgtgatacattactctgtgatatcggcgagagttcaccaaatccaacaatcgaagaagggagaacactccgtgtcctaaaaatggtggaaccatggttgcgcggtaaccagttctgtatcaaaatattgaacccatacatgccttcagtagttgagacactagaacagatgcaacgaaaacacggaggaatgctggttagaaatccattaagtagaaattctactcatgaaatgtattgggtcagctgtggcaccggcaatattgtaagtgcggtaaatatgacatccagaatgctactaaatagatttacaatggcgcatcgaaaaccgacattcgagagggatgtagacctgggggctgggaccaggcatgtcgctgtagaacctgaagtcgcaaatctggatatcataggtcagcgtatagaaaacattaaaaacgaacataaatcgacttggcactatgatgaagataatccatacaagacatgggcataccacgggtcttacgaggtaaaaccatcaggatctgcctctagcatggtgaacggggtagttagactattaacaaaaccgtgggatgttataccaatggtaactcagatcgcgatgacggatacaaccccgtttggtcaacagcgggtcttcaaagaaaaggttgatacaagaactccacgtgctaaaaggggaacgacgcaaataatggaggtaacagcaaaatggttgtggggctttttaagtagaaataaaaagccccgaatttgcactcgagaagaatttactagaaaagtcagaagcaatgctgcaattggtgccgttttcgtggatgaaaatcagtggaactcagctaaagaggcggtagaagacgaaagattttgggatttagttcatagggaaagagaattacataaacaaggaaaatgtgcaacatgtgtatataatatgatgggtaaacgtgagaagaaacttggtgagtttggtaaggcgaaagggtctagggccatatggtatatgtggctaggagcaagattccttgagttcgaagctctcggattcatgaatgaggatcattggttctcacgcgaaaattcattgtctggggtagagggtgagggcctgcataaacttggttatatattaagagacatatcaaaaattcccggaggcaacatgtacgctgacgatacagctggttgggataccagaataacagaggacgatctacaaaatgaagcaaaaatcacagatattatggaaccagaacatgcacttctcgccacaagtatattcaaacttacttatcagaataaggtagtgcgcgtccaacgaccagcgaagaacggcaccgttatggatgttataagcagacgggatcaaagaggatctggtcaggtcggaacttacggactgaacacttttacaaatatggaagtacaattaataaggcagatggaatcagaagggattttccttccatcagaactagaaaccccaaacctcgctgaacgagtactagattggcttgaaaaacatggcgccgaacggctcaagcgaatggcgataagtggggatgactgcgtcgtaaagccaatagatgatcgattcgccacagcacttactgctctcaacgacatggggaaagtaagaaaagatataccacaatgggaaccatctaaaggctggaacgattggcaacaagtacctttctgtagccaccatttccaccaactcatcatgaaagatgggcgtgaaatcgtggtaccttgtaggaatcaagatgaattagttggccgagcccgagttagtcaaggcgcaggatggtcactgcgcgaaacagcatgccttggaaagtcatatgcacagatgtggcagttaatgtattttcatcgaagagaccttagacttgctgcgaacgccatttgctcggcggtaccagtggattgggtgcctacctcacgaacgacatggtcaattcatgctcatcaccaatggatgacaacggaagacatgttatctgtatggaacagggtatggattgaagaaaatccgtggatggaagataagacacacgtatcgagttgggaagaagtaccatatctaggtaaacgcgaagatcaatggtgcggttctctaatagggttgacagctagagctacttgggcaaccaatattcaagtagcaatcaaccaggtaaggagattaataggaaacgagaattatttagattacatgacttctatgaagagattcaaaaatgaatccgatccagaaggcgctttgtggtaa

SEQ ID NO: 21254 - RNA, 9879 nt, synthetic construct
  misc_feature 1..9879: note = derived and/or modified CDS sequence (opt6) from DENV-1__GU131976__SS-prME
  source 1..9879: mol_type = other RNA
tccgtaactatgttacttatgctcctaccgaccgcactggcattccatttaacaaccagagggggagaaccccatatgatagtgtctaaacaagaaagaggaaaatcactactattcaaaacgagcgcaggggtaaatatgtgtactttaatcgcgatggatttgggtgaactatgcgaagacactatgacttacaaatgtccgcaaataacggaagcagaaccggacgacgtggactgctggtgcaatgcaaccgacacttgggtaacctatggtacatgttctcaaactggggaacatcggagggacaaacgatccgtcgcacttgctccccatgtaggactaggactcgaaacaaggacagaaacttggatgtcaagtgaaggagcatggaaacaaatacagagagtagaaacttgggcgctccgccacccaggatttaccgtgattgcactcttccttgctcatgcaatcggtacttcgatcacacagaaaggaattatctttatcctactgatgcttgtgactccaagcatggcaatgcggtgtgttggtattggcaacagagacttcgttgaagggttaagtggagctacgtgggtagatgtagtactagaacatggcagttgcgtaactaccatggccaaaaataaaccaactctagatatagagttacttaaaaccgaggtaacaaatccagctatattacgaaaactctgtatagaggcaaaaataagcaatacgacaaccgattctagatgccctactcagggcgaagcaactttagtagaagaacaagacgcaaactttgtgtgtagacggacttttgttgaccgcggttggggaaatggatgcggtctctttgggaaagggagcctattaacgtgcgccaaatttaaatgtgttactaaattggaagggaaaatagtacagtatgagaatctcaagtattcggttatagtaacagtacacacaggcgatcaacaccaagtaggaaatgagacgaccgaacacggtactatagcaacaattacaccccaagctcccacctcggaaatccaactgacagattacggcgcattaacattagattgtagtccaagaacagggctcgatttcaatgaaatggtattgctcacaatgaaggagaaaagttggctggtgcacaaacaatggtttttggatctcccattaccgtggacatcaggagcatcgacctcccaggaaacatggaaccgacaggacctactggttacatttaaaacggcacatgcaaagaaacaagaagtcgttgtactaggatcacaggaaggtgctatgcatacggccctaacaggtgcaaccgaaatacaaacttcaggtaccaccacaatcttcgcgggtcaccttaagtgtcgcttgaaaatggataaactcacgctaaaagggacatcgtacgtaatgtgcactggtagctttaaacttgaaaaggaagtcgctgagacacaacacggcacagtattagtccaagtcaaatatgagggcactgatgccccttgtaaaataccattctcaacacaagatgaaaaaggagtcacacaaaatggacgtctaattacagcaaaccccattgtcactgacaaagaaaaaccagtaaatatagaaactgagcctccttttggggaaagttatatagtagtcggagcgggcgagaaagcgctcaaattgagttggtttaaaaagggaagcagtataggaaaaatgtttgaagcaaccgcaagaggcgcacgtagaatggcaatactaggtgataccgcttgggactttggcagtattggaggcgtattcacatccgtgggaaaactcgttcatcaggtattcggaacagcctacggtgtactatttagcggagtttcatggacaatgaaaataggaataggaatattgctcacttggttaggcttaaattcacggtctacatcactgtcaatgacatgcatagcagtgggaatggtaacattatatttaggtgtgatggttcaagccgattcagggtgcgttattaactggaaaggaagagagcttaaatgtggctcaggcatatttgttactaatgaagtccacacatggacggagcaatataagttccaagcggattcacctaaacgattaagtgctgccataggaaaagcatgggaagaaggcgtttgcggtattcgttcagcgacacgcctggaaaacattatgtggaaacaaatatcaaacgagctcaaccacatactactagaaaatgacatgaaatttacagtagtagtcggagacgctaacggcatattagcccaaggcaagaaaatgataagaccacaaccaatggaacacaaatattcatggaaatcatggggaaaggctaaaattatcggagccgacatacaaaatacaacattcataattgacggtccggatacaccggaatgcccggataaccagagagcatggaacatctgggaagtagaagattatggttttggcatttttacaacgaacatttggttaaaactcagagattcatacacgcaaatgtgcgatcaccgcttgatgagtgcggcgataaaagatagtaaagcggtacatgcagacatgggatattggattgaatcggagaaaaatgaaacctggaaactcgctagagcttcttttatagaggttaaaacatgtacgtggccgaaatctcatacactatggagtaatggggttttagagagtgaaatgataatacccaaaatatacggagggcctatatcccaacataattacagacctggatacttcacacagaccgcaggtccatggcatctaggtaaattggaactagacttcgatttatgcgaaggaacgacggtagtagtagacgaacattgtggaaataggggtccttcgttaagaacaaccacagtcacgggtaaaataattcatgaatggtgttgtcgtagttgtacattacccccgctgagattccgtggtgaggacggatgctggtacggtatggaaattagaccagtcaaagaaaaagaggagaatttggtcagatcgatggtatcagccggatcaggagaagttgactccttttctttgggcatattatgtgcatctttaatgatcgaagaagtaatgaggagtagatggtcaagaaaaatgttaatgacgggaacgctcgctgtgttcttattactaatcatgggacagctaacatggaatgacctgattcgtttatgtataatggttggagctaatgcaagtgatcgcatgggcatgggaaccacatacctggcactaatggccacttttaaaatgcgaccaatgtttgcagttggactacttttcagacgcctcacaagtcgtgaggtgcttctgttaacaatcggattatctttagtagcaagtgtagaacttccaaactctttagaagagttaggagacggacttgccatgggaataatgatgttgaaactattgacagagtttcaaccacaccaactatggacgaccttactctcactaaccttcattaaaactaccttgagcctcgattacgcttggaagacgacggccatggcattatcaatcgttagcttatttccattgtgtctgagcacaactagccagaagacgacgtggttgccagtgttattaggttcttttggatgtaaaccgcttactatgttccttataacagaaaacaaaatttggggacgtaaaagttggcctttgaacgaaggcatcatggcaattggaatagtgagtatattgttaagctcattacttaaaaacgatgtgccattggctggaccgcttatagcaggaggcatgttgatcgcttgttacgttattagcgggtcttccgcggatctatcactggaaaaagctgctgaagtaagttgggagcaagaagcagaacattcaggaacaagccataacatattggttgaagtacaggatgatggaaccatgaaaattaaagatgaagaaagagacgacactcttacaatattgcttaaagcgacactattggccgtctctggggtatacccaatgtccatacccgcgacactattcgtgtggtatttctggcagaagaagaaacaaagatctggtgtcctctgggacaccccatcccctcctgaggtcgagagagctgttttagacgatggaatatatcgcattcttcaaagagggttgttgggtagatcacaagttggcgtgggcgtctttcaagatggagtttttcacactatgtggcacgttactagaggcgctgtgcttatgtatcaaggcaaacgactagaaccatcatgggcaagcgtcaagaaggacctaataagttacggcggaggatggagatttcaagggtcttggaacacaggagaagaagtgcaagtgatcgctgtcgagccggggaaaaacccgaagaatgtgcaaacaacacctggcacgttcaaaacccctgaaggagaggtaggtgcgatagcattggatttcaaacctggtacatcaggctcacccatagtcaatagagaaggaaaaatcgtcggattgtacggaaacggcgtcgtcacaacaagcggcacatatgtatctgcaatcgcgcaagccaaagctagtcaagaaggaccgttaccagaaatagaggatgaagttttcaagaaaagaaatttgacaattatggatctgcaccccggttcaggtaaaacacgtcggtaccttcccgctatagtacgagaagccataaaacgtaaattacgcaccctcatccttgcacctacaagggtggtagcttcagaaatggcagaggcactaaagggtatgccaatacgttaccaaaccacagctgtaaaaagcgagcataccggaagagaaattgttgacttgatgtgccatgctaccttcacaatgcgattattgagtccagtaagagttccaaattacaatatgataattatggacgaagctcatttcacggaccctgcaagcattgccgctcgaggatatataagtacaagagtaggcatgggtgaggccgctgctattttcatgactgctacacccccagggtctgtggaggcttttccccaatctaatgcagtgatacaggacgaggagcgagatattcccgaacgatcatggaacagcggatatgactggataacggattttccagggaaaacagtgtggtttgtaccctcaataaaatccgggaatgatatagcaaactgtctcaggaaaaatggcaaacgagtcatacaactatcaagaaagacttttgatacagaatatcagaaaactaaaaataacgactgggactacgtggtaacaacggatatttctgagatgggagccaatttcagagcagatagggtaatagacccgcgtaggtgccttaaaccagtgatattgaaagacggaccagaaagagtgatcctggcgggtcccatgccagtgactgtagcatccgcagctcaacgacgtggtagaatagggagaaaccaaaacaaagaaggagaccaatatgtttacatgggacagcctttgaataacgacgaagatcacgcgcactggacagaagcgaaaatgctacttgacaatatcaatactcccgaagggataattccagccttatttgagccagaacgagaaaaatcagctgcgatagacggggagtatagactaaggggagaagcccgtaaaaccttcgttgaactcatgcgaagaggggacttaccggtctggttatcttataaagttgcttccgagggatttcaatacagcgatcgccgttggtgttttgacggtgagcggaataatcaggtgctagaagaaaatatggacgtggaaatttggaccaaagagggcgaacggaagaaattacgaccacggtggctagatgctcgcacgtactcggacccattggcactaagagaatttaaggaatttgcggccggtcgacgatccgtaagcggtgacctgatattagaaatcggtaagctaccccaacacttaacacttaaggctcagaacgcactcgataacctagtaatgctacacaactctgaacagggaggaaaagcatataggcacgcaatggaagaactaccagacacaatagaaacactaatgttacttgcacttatagcagtcctgacgggaggtgtcacactattctttttgagtgggaaaggacttggaaaaacaagtatagggttgttatgtgtgaccgcgtcttccgcgttgttatggatggcttctgtggaacctcattggatagctgcttcaatcattcttgagttctttcttatggttctgctaattccagaacctgatagacaaagaactccgcaagacaatcaactagcctacgtagttataggtttactttttatgattttaacagtcgcggcaaacgaaatgggactcttagaaaccacaaagaaagatttaggtatagggcacgtagctgccgaaaaccatcaacacgcgaccatgttagatgtagatttgagacccgcatccgcatggacactatatgctgtagcaacaaccgtaattactccaatgatgcggcatacgatcgaaaacactactgctaatatatcgttaaccgcaatagcgaaccaggctgcaattctcatgggactagataaaggatggccaataagcaagatggacataggtgtgccattgcttgccttaggttgctattcccaagttaatcccctaacactaactgctgctgtattgatgctggtagcacactatgccataattggtccgggcttacaagctaaagctaccagggaagcacagaaacgaaccgcggcgggcatcatgaaaaatcctacggtagatggaatagtagcaatagacttggatcctgtggtctacgatgctaaatttgaaaaacaattgggacagataatgttattaatactatgtaccagccaaattctcttaatgagaactacgtgggccctatgtgaatcaataacactagcaacaggtcctcttacaacattgtgggaaggctcaccgggaaaattctggaacaccacaatagccgtatccatggctaacatcttcagaggaagctacttggctggagccggtttagcgttttccctaatgaaaagtctaggtggcggaagaagaggtacgggcgcccaaggtgaaacacttggtgaaaagtggaaaagacagttgaatcaattatctaagagcgaatttaatacttataagagatcaggaattatggaagtagacagatccgaggctaaagagggactaaaacggggagagactaccaaacatgcagtatcacggggtactgcaaaactaaggtggttcgttgagaggaacctagttaagccagagggaaaagtaatcgaccttggttgcggtaggggaggctggagttactactgtgcagggttgaaaaaggtaacagaagtaaaggggtacaccaaagggggaccaggtcatgaagaaccaataccaatggcaacctatggttggaatttagttaaactacactccggtaaagatgtatttttcatgccacccgagaagtgcgacacattattatgcgatatcggtgaaagtagtccgaatccgacaattgaagaagggcgcaccttacgagttctaaaaatggtggagccctggcttagaggcaatcaattttgtatcaaaatcttgaacccctatatgcctagcgtggttgagacattagagcaaatgcagagaaaacatgggggcatgctcgttagaaaccccctatcgcgaaacagtacgcacgaaatgtactgggtatcgtgtggtaccggcaacatagttagcgcagtaaatatgacgtctaggatgctgcttaacaggttcacgatggcacatcgaaaacctacatttgaacgagacgtagaccttggcgcaggaacacgacacgtagcagttgaacctgaggttgcaaatcttgacataatcggacaaagaatagaaaatatcaaaaatgaacacaaaagcacatggcactatgatgaagataacccatacaaaacgtgggcatatcacggatcatatgaagttaagcccagtgggtctgccagctctatggtaaacggcgtagtaaggctattgacgaagccatgggacgtcattccaatggtaactcagatagcaatgaccgacacaaccccattcggccaacaacgagtttttaaagaaaaagtcgacactagaactcccagagccaagagggggacaactcaaataatggaggtaacagcaaaatggttatggggatttttatcacgcaataagaaaccaagaatatgtacacgagaagaatttacaagaaaagttagaagcaatgctgctatcggtgcggtattcgtagatgaaaatcaatggaacagcgccaaagaagcagtcgaagatgaaaggttttgggatctagtgcatcgcgagagggaactccataaacaaggaaagtgtgctacatgcgtttacaatatgatgggtaaacgcgagaagaaactaggcgaatttggaaaggcaaagggatcacgtgcaatctggtatatgtggttaggcgcaagattcctagagttcgaagcgctagggttcatgaatgaggatcattggtttagtcgagagaactcattatcaggcgtagaaggagaaggtcttcataaactgggctacattttacgagacatttccaaaatcccaggcggcaatatgtacgctgacgacacagcgggttgggacacaaggatcacagaagatgacttgcaaaacgaggccaagatcacagatattatggaacctgaacatgcgctgttagcaacatcaatattcaaactaacttaccaaaataaagtagttagggtccaaagaccagccaaaaatggtacagtaatggatgttatatccagaagagaccaaagaggctcaggacaagtaggcacttatggacttaacaccttcacaaatatggaagtccaactaatcagacagatggaatctgagggcatatttttaccgtcagaattagagacccctaatctggcagagcgagtgttagattggttggagaaacatgggacagagcgattgaaaagaatggcaatctcaggggatgattgcgttgttaaacctatagatgacagattcgctactgctctaacagctctaaatgatatgggcaaagttcggaaagatatacctcagtgggaaccatctaaaggatggaacgattggcagcaagtccccttttgtagtcaccactttcatcaactaataatgaaagacggacgagaaatagtagttccttgtagaaatcaggacgagttggtgggtcgggctagagtcagccaaggcgcaggttggagtcttcgggaaactgcatgtctaggaaagtcatatgcgcaaatgtggcaattaatgtatttccacaggcgtgacctgcgattagctgcaaatgccatctgttcagcagtacctgtagactgggttcctacatcaagaacgacatggagcatacacgcccatcaccaatggatgactacagaagatatgctctcagtatggaatagagtatggatagaggagaacccgtggatggaagataaaacacatgtttcatcttgggaagaggtaccatatctaggtaaacgtgaagaccaatggtgtggtagtctaatagggcttacagcgcgagccacatgggctaccaacattcaagttgcaattaatcaagtgcgacgcctaattggtaacgaaaattatttagattacatgaccagtatgaagagatttaaaaacgagagtgacccagaaggagctttatggtaa

SEQ ID NO: 21255 - RNA, 9879 nt, synthetic construct
  misc_feature 1..9879: note = derived and/or modified CDS sequence (opt6) from DENV-1__GQ868518__SS-prME
  source 1..9879: mol_type = other RNA
tcagtaaccatgttattgatgcttttaccgacagcacttgcatttcacctgaccacacgcggaggagaaccacatatgatagtctctaaacaagaaagaggtaaaagccttctattcaaaacgtctgcgggagtaaatatgtgcaccttaatcgcaatggacttgggagaactgtgtgaagacacgatgacctataaatgtccccaaataacagaagcggaaccagacgacgtagattgctggtgtaatgcaacagacacatgggtaacctatggcacatgctctcaaacgggagaacaccgacgtgacaaacgaagcgtagccctggcaccacacgttggtttaggacttgaaacacgaactgaaacctggatgtcaagcgaaggagcatggaaacaaatccaacgggtcgaaacatgggctctgcggcacccaggctttacagtgatcgcacttttcctggcacacgcaataggaacttcaattacacaaaaaggaattatcttcatattactaatgctcgtaacaccatcgatggcaatgcgttgcgtggggatagggaaccgtgatttcgttgaaggtctttcaggagcaacttgggtcgatgtggtattggaacacggatcatgtgtaacaactatggccaaaaataaaccaacacttgacatagaacttttaaaaacagaagttacgaatcctgcaatactacggaaattatgcattgaagccaaaatatcaaacacaacaacggattcacgatgcccaactcagggagaagccacattagtggaagaacaagacgccaatttcgtttgtcgaagaacattcgtggaccgtggctggggtaatggttgtgggttattcgggaaaggctctctattgacatgcgctaaattcaaatgtgttacaaaactagaagggaaaattgtacaatacgaaaacttaaaatactcagtaatcgttacagttcacacaggggatcaacatcaagtaggaaatgagacaacagaacatggaacaatagcaacgatcacgccgcaggcacccacttcggagatacaactaactgattacggagctctaacactagattgcagcccccgtactggcttagattttaacgaaatggtgctgctaaccatgaaagaaaaatcctggctagtacacaaacaatggttcctcgacctccctttgccatggacaagtggcgcgtcgacaagtcaagaaacgtggaaccgacaggacttgctggtcacattcaaaactgcgcatgctaagaaacaagaggtagtagtattaggcagccaagagggtgcaatgcacacagcattgacaggtgcgaccgagatccaaacctctggtactactactatcttcgcaggtcacttaaaatgtcgacttaaaatggataaacttacattaaaaggaacttcatacgtcatgtgtacaggtagcttcaaactagaaaaagaggtggctgaaacacagcatggaacggttctagtccaggtcaaatatgaaggcacagacgcgccctgcaaaatacctttttcaacacaagatgagaaaggagtaactcaaaacggaagattaataactgcaaatccgatagtgactgacaaagaaaaacccgttaatatagaaacagaaccaccctttggtgaatcttacatagtagtcggggccggcgagaaagccctcaaactcagctggttcaagaagggatcctcaattggaaagatgtttgaagcgacagcgcgaggtgcacggaggatggccatcttaggcgatacagcatgggattttggcagcattggaggtgttttcacgtctgttggtaagctagtacatcaagtttttggaaccgcatacggggttttattttcaggcgtatcttggaccatgaagataggaataggaatattactgacatggctaggactcaactctcgtagtacatccttatcaatgacttgcattgcagtggggatggtcacactgtacctgggggttatggtacaagcagattcaggatgtgtgattaattggaagggaagggagcttaaatgcgggtcagggatatttgtgacgaacgaagtccatacctggacagaacaatataaattccaagcagacagcccaaaaaggctatcagcagctataggtaaggcttgggaagaaggagtatgcggtataaggtcagcgactcggctagaaaatatcatgtggaaacaaatatcaaatgaattgaatcacatacttttagaaaatgacatgaagtttactgttgtagttggagatgctaatggtatattagctcaaggtaagaaaatgatacgacctcaaccaatggagcataaatatagttggaaaagttggggcaaagccaagataataggagcagatattcagaataccacgtttatcatagatggacccgatacgcctgaatgcccagataatcagcgcgcatggaacatttgggaagtagaggattacggcttcggaatattcactactaacatatggttgaagctaagagactcatatacccagatgtgcgatcatcggttaatgtcggcagcgattaaggattccaaggcagtacatgcagacatgggatattggatagaatctgagaaaaacgagacatggaaacttgctcgggcgtcgtttatcgaagtaaagacatgtacctggccgaaaagtcatacactttggtcaaacggggtacttgagtcagaaatgataataccgaaaatatatggtggtcctataagtcaacacaattacaggcccgggtattttacccagaccgcagggccttggcatttgggtaaactagagttagattttgatctctgtgagggtacgactgtggttgtagacgaacactgtggtaatcggggcccaagcctccgtaccacaacagttactggtaaaataattcacgaatggtgttgcaggagttgtactctacctccgcttaggttcagaggcgaagatgggtgctggtacggaatggaaataaggccagtaaaggagaaagaagagaatctggtacgctcaatggtcagcgctggtagcggtgaagtggatagtttctcactgggcatactatgcgcgtcaatcatgatagaagaagtaatgagaagccgatggtcacgcaaaatgttaatgacaggtactttagcagtcttcctgttattagttatgggacaactaacttggaacgatttgattaggttatgcataatggtaggcgcaaacgcatcagatcgaatgggaatgggaaccacttatctagccctaatggcaacttttaaaatgcgccccatgttcgcagtaggactactatttagaaggctaacatccagagaagtgttactcttaacaataggcctttcactcgtggcttcagtagaattgcccaattcactcgaagaacttggagacggtcttgcaatgggaatcatgatgctaaaacttctcacagaatttcaaccccaccaactatggactacattattgtcgctcacatttataaagaccacccttagcttggactatgcctggaaaacaaccgcaatggcactgtcgatcgtatccctattcccgttatgcttaagcacaacctcacaaaagaccacttggttgccagtattactaggatcctttggatgtaaaccgctaacgatgttcctgatcaccgaaaacaaaatatggggcagaaagagttggcccctcaacgaaggtatcatggctattggtatcgttagtattctattgtccagcctactgaagaatgatgttcctctagcaggacccctgatagccggaggaatgctgatagcctgctatgtcataagcggttcaagcgctgatctatcactagaaaaggcggcagaagtatcctgggaacaagaagcggaacattccggcccatcacataatatattagtggaagtacaagatgatggaacaatgaagattaaggatgaggaaagggacgacacactaaccattctgttaaaagcgacattactagcagtctccggggtataccctatgagtatccccgcaacattattcgtgtggtatttctggcaaaagaagaaacagcgtagcggagtattatgggacacacctagtccaccggaagttgagagggctgtcttagacgatggaatatacagaatacttcaaagaggcctattaggtagaagtcaggtgggagtgggagtctttcaagatggtgtattccacacgatgtggcatgttaccaggggtgccgttctaatgtaccaaggcaaaagattagaaccaagctgggcatctgttaagaaagacttgatctcatatggtggtgggtggcgattccgaggatcatggaatacaggtgaggaggtgcaagtcatcgctgttgaacctggtaagaaccccaagaacgtccagacaaccccaggtacatttaaaacgccagagggagaagtcggggccattgctttagatttcaaacccggtacatctggatcaccaattgtaaatagagagggaaagatagttggattatacgggaacggagtagtgacaacttcggggacctatgtatctgcaattgcgcaagctaaagccagccaagaaggtccattacctgagattgaagacgaagtttttaagaaaaggaatttaactataatggatttacacccaggtagcggaaaaactaggagatatttaccagccatagtccgagaagccattaaaagaaaactaagaactttgatcctagcaccaacaagagtagttgcatctgaaatggctgaagcgttaaaagggatgcccattcgataccagacaactgctgtcaaaagtgaacacacaggtagagagatcgtagatttgatgtgccatgcaaccttcactatgcgcttgctatcgcctgtgcgagtccccaattacaatatgattattatggatgaagcacacttcaccgaccccgcatccattgcggccagaggctatataagcacgcgagtaggaatgggcgaagcggcagcgattttcatgacagccacacccccgggctcagtggaggcttttcctcagtcaaacgccgtaatccaagatgaagaaagagatattccggaacgttcttggaactctggatacgattggataactgattttcctggaaagactgtgtggtttgtgcctagtattaaaagtggcaatgatattgctaactgtttgcgaaagaatggaaaaagagttatacaactatccaggaagacgttcgacacagagtaccagaaaacgaagaacaacgattgggactacgtcgtaacaacagatatcagtgagatgggcgctaactttagggcagaccgagtcattgacccccgtagatgcttaaaacctgttattcttaaggacggccccgagagagtaattctagccggcccgatgccagtgacagtagcgtcagccgcacaacggcggggcagaatcgggcgtaaccaaaataaagaaggcgatcaatatgtatatatggggcaacctctgaacaacgacgaagaccacgcacactggaccgaggccaaaatgctactagacaatataaacacaccagaaggcataatacccgcactatttgaaccagaaagagagaaatcagcggctatagatggtgagtaccggctacgcggagaagcgcgtaaaacgtttgttgaattgatgagaagaggcgatcttccggtgtggttatcgtacaaggtagcgagcgaaggtttccagtactccgacagacgatggtgcttcgacggggaacgaaataaccaagtactagaagaaaatatggacgttgaaatatggacaaaagaaggagaacgtaagaaactgcgtccccgatggctagatgcaagaacgtacagtgatccacttgccttgcgtgaatttaaagagttcgccgctgggcggagatcagtatccggagatctgattttagaaattgggaaacttccacaacatttgacaagccgagcgcaaaatgcgttggataatttagtaatgttacataatagcgaacagggcggcaaagcatatcgacatgcgatggaagaattacctgatactattgaaactttgatgttacttgccttaattgcagttttaacagggggtgtgacattgttctttttatccgggaaaggcctcggaaagacaagcataggcctattatgtgttacagcttcaagtgcattgttgtggatggccagcgtggaaccccactggatagctgcgtccattattttagaatttttccttatggtgcttctaatacctgaaccggaccgccagaggacgccccaagataaccagttagcctacgtagtgataggattactattcatgatactaactgtggctgccaatgaaatgggattactagagacaaccaagaaagatctaggaataggacacgtggccgccgaaaaccatcaacacgcaacgatgctcgatgtggatttgaggccagcgtctgcatggacattatatgcagtcgccaccactgtgattactccaatgatgaggcatacaattgaaaacactaccgctaacataagtttgacggcgattgctaaccaggccgccatcctaatgggacttgataaagggtggcctataagcaaaatggatatcggtgtaccattattagcattaggttgttattctcaagtaaaccccttaacactgacggcagcggtactaatgttagtagcacattatgcgatcataggaccgggtttacaggcaaaagcaacgcgggaagcccaaaaacgaactgccgcaggtatcatgaaaaacccaacggtcgatggcatcgtagcaatcgacttagaccccgttgtttacgatgctaagttcgaaaaacagctgggtcagattatgttattaatcctatgtaccagccaaatacttcttatgcgcacaacttgggcgctctgcgaatctattacattagctacagggcctttaacaacgctttgggaggggagtccaggaaaattttggaacactacgattgcagtaagcatggcaaatatctttaggggatcatacctcgcaggggcggggctggcgttttccttaatgaagagtttaggaggaggaagacgaggaacaggagctcaaggtgaaacattgggagaaaaatggaaacgacaattaaatcaattaagcaaaagcgaatttaacacttataagagatctggaataatggaggttgatcgatcagaagcaaaggaaggtttaaaacgaggtgaaaccacaaaacatgctgttagtaggggaacggctaaactaaggtggtttgtagaacgaaatctagtaaagcccgagggcaaggttatagatttaggatgtggtcgaggtggatggtcatattactgtgctggtttaaagaaagtaactgaggtaaaaggatataccaaaggaggtccgggacatgaggaaccgataccgatggccacatatggatggaacttggtcaaacttcatagtggcaaagacgtgttctttatgcccccagaaaaatgcgataccctcctatgcgacattggtgaaagtagtcctaatcccacaatagaagaaggccgaactctgagggttcttaaaatggtggaaccatggctcagaggaaatcaattctgtataaaaattttgaatccatatatgccttctgttgtagagacgttagaacaaatgcaaaggaaacacggaggtatgttagtaagaaatcctttgagtaggaacagtacacacgagatgtattgggtatcgtgtggtactggaaatattgtcagtgccgtcaacatgacaagcaggatgttattaaaccgtttcacgatggcacatcgaaaaccaacatatgaaagagacgtggatcttggagcaggaactaggcatgttgctgtcgagccagaagttgcaaacttggatataataggacagaggattgagaatatcaaaaatgagcacaaaagtacttggcattacgacgaagacaacccatataaaacctgggcatatcacgggtcgtacgaggtaaaaccgagtggaagtgcatcgagcatggtgaatggcgttgtgcgcctcttaaccaaaccgtgggatgtgataccgatggtcacgcaaatagctatgacggacacgacccctttcggccaacaaagagtctttaaagaaaaagtagacactagaacacctagagcaaagagaggaaccacgcaaataatggaagtaactgcaaaatggctttggggttttctttctaggaataagaaacctagaatatgtacaagagaagagttcactagaaaagtcagatcaaacgctgcgattggagcagtatttgtcgacgagaatcagtggaatagtgctaaggaagcagtagaagacgaacgattttgggatctggtacacagggagcgtgaactgcacaaacaaggtaagtgtgcaacttgtgtctataatatgatgggaaagagagagaagaaattaggtgagtttggaaaagcgaaaggatctagggcaatctggtatatgtggttaggtgcccgtttcttagagttcgaagctctcgggttcatgaacgaagatcattggtttagtcgtgaaaattccttaagcggggtcgaaggtgagggactacataaactaggttatattttgcgcgacatttcaaagattccagggggcaatatgtacgctgatgatacagcaggatgggatacaaggataactgaggatgacttacagaatgaagcaaagataacagaaataatggaacccgagcacgccttgctagctacgagcatctttaaactcacataccaaaacaaagttgtcagagtacaacgacctgcgaaaaacggtacagtaatggacgtaattagccgccgcgaccaacggggatctggacaggtagggacctatggcttgaatacttttacaaatatggaagtacaactaatccgacagatggaatcggaaggcatatttttgccgagcgaattggaaactccaaatcttgcggaaagagtattagactggcttgaaaagcatggagccgaacgactgaaaagaatggctatatcaggtgacgactgcgttgtaaaaccaatcgatgacagattcgccacagctttaacagcactgaatgacatgggtaaagtaaggaaagacattccgcagtgggaaccaagtaaagggtggaacgactggcaacaagtcccattctgcagccaccattttcaccaactaataatgaaagatggtcgcgaaatcgtagtgccttgccgtaatcaggatgaattagtcggacgagcgagggtgagccaaggagcaggatggtcgctccgagaaactgcgtgtctcggaaaatcatatgcacaaatgtggcagttaatgtattttcatcggagagatttaaggttggccgcaaacgcaatttgttcggcagtgcccgtggactgggtgcctacgtcaagaactacttggtcaattcatgcacaccaccaatggatgacaaccgaagatatgttatcagtatggaatagggtatggatagaagagaatccctggatggaggacaagacacatgtgagctcgtgggaagaagtaccatatctaggaaaaagagaagaccagtggtgcgggagcttaattggattaacagcaagagcaacatgggcaacgaatatacaagttgccatcaatcaagtacgtagactaatcggaaatgagaattacttagattatatgacttctatgaaaagatttaaaaatgaaagcgacccggaaggagccctctggtaa

SEQ ID NO: 21256 - RNA, 9879 nt, synthetic construct
  misc_feature 1..9879: note = derived and/or modified CDS sequence (opt6) from DENV-1__GQ868519__SS-prME
  source 1..9879: mol_type = other RNA
agcgttactatgttgctaatgcttctgcccactgcattagcgttccacttaacaacaaggggaggtgaacctcacatgattgtgtctaaacaagaacgtgggaaaagtcttctgtttaaaacttcggctggagtaaacatgtgtacactgatagcaatggaccttggtgaactatgcgaagatacaatgacatataaatgtccgcaaataacggaagcggaacccgacgatgtagattgttggtgcaacgcgacagatacgtgggtaacgtatggaacgtgttcacaaactggagaacacagacgagacaaaagatctgttgctctcgctccacatgtaggattaggattagaaacacgaactgaaacgtggatgagcagtgaaggagcatggaaacaaattcaacgagtagaaacttgggcgctgagacatccaggatttacggtaatagctctctttctagcacatgcaattggaacgtcgataacgcaaaaaggaataatatttattttgctgatgctagtgaccccttctatggcgatgaggtgcgttggtattgggaaccgagactttgtagaaggactctcaggtgcaacatgggtagatgtagtacttgaacacggttcttgcgtcacaacgatggccaaaaataaacctactctcgacatagaattgcttaaaactgaagtcacaaacccagcaatcttaagaaaattgtgtatagaagctaaaataagcaacactaccacagatagcagatgtccgacgcaaggcgaagcaactttagtagaagaacaagacgctaattttgtgtgtagaagaacgtttgtcgatagaggttggggtaatggatgcggtctattcggaaaaggttcgctcctaacgtgcgctaaattcaaatgtgtaacaaaactagaaggcaaaatagtccaatatgagaatctcaaatatagcgtaattgtcactgtgcatactggagatcaacaccaagtcggcaatgaaacaacagagcatggaaccattgctacaataactccccaagcccccacgtcagaaattcaactgactgattatggtgccctaactttagattgctccccacgaaccggattggatttcaacgaaatggtattgctgacaatgaaagagaaatcgtggctcgttcataaacaatggttcctggacctacctttaccatggacatcaggagcatctacttcccaagaaacgtggaacaggcaagacctactggtcactttcaaaactgcccatgccaagaaacaagaggttgttgtcctcggatcacaagaaggagcaatgcataccgccctaactggagcaacagaaatccaaacaagtggcacaacaactatctttgccggtcatcttaaatgccgtctcaaaatggataaattaacattgaaaggtacatcatatgtaatgtgcacagggagttttaaactagaaaaagaggtagcggaaacacagcatggtacagtcctagtacaagtcaaatatgaaggcacagacgctccttgtaaaataccattcttaactcaagacgaaaaaggggtaacacaaaatggaaggctcatcaccgccaatcctattgtgacagataaagaaaaacccgttaacattgaaactgaacctccgtttggagaaagttatattgttgttggagctggagaaaaagcgttaaaattatcgtggtttaagaaaggatcttcgatcggaaaaatgtttgaagcaacagctcgaggagccagaagaatggcaatactaggtgataccgcgtgggatttcgggtctatagggggagttttcacgtcagtaggaaagctagtgcaccaagtattcggaaccgcatatggtgttctattcagcggtgtcagttggaccatgaagataggaataggcattttattgacgtggttgggtttaaattcacggtctacaagtttatcaatgacatgtatagctgtaggaatggtcacattatatcttggagttatggtacaagcggactcaggatgcgtcataaattggaaaggtagggaattaaagtgcgggtcaggaatatttgtaacaaacgaagtacatacctggactgaacagtataaattccaagcagatagtcccaaaagactaagcgctgccatcggaaaggcgtgggaagaaggcgtgtgtggtatacgttctgcaacaagattagaaaatataatgtggaaacaaatatcgaatgaacttaatcatatcctactagaaaatgacatgaagtttactgttgtcgtcggcgacgcaaacggcatactagctcaaggcaagaaaatgattagaccccaaccaatggaacacaaatactcgtggaaatcgtgggggaaggccaaaataattggggcggatattcaaaacactacatttatcattgatggcccggacacacctgaatgtcctgacaatcaaagggcatggaacatttgggaagtcgaagactatggattcggaatattcactaccaacatatggctcaagctacgagactcatatacacaaatgtgcgaccacagattaatgtcagctgcaataaaggactcaaaggcagtccatgcagatatgggttactggatagaaagtgagaaaaatgaaacctggaaactagcccgagcatcatttatcgaggtaaaaacatgtacttggcccaaaagccacacgttatggagtaacggagtattagagagtgagatgataataccgaaaatatacggtgggcctatctcacaacataattacagacctggctatttcacccagaccgcaggcccgtggcatcttggtaaattggaacttgactttgacttatgcgaagggactactgtagtagtggacgaacactgcggaaatagaggtccatcactccggacaaccaccgttacagggaagataatacatgaatggtgttgcagaagttgtactttacctccactgagatttaggggtgaagacggatgctggtatggaatggagatcagacctgtgaaggaaaaagaagaaaatcttgttcgttccatggtaagcgcagggtctggagaagtagattccttcagcctaggtatcttatgtgcgtctataatgattgaagaggtaatgcggtccagatggtcgcgaaaaatgctgatgacagggactttagccgtctttctacttctagttatgggacaattaacatggaatgacttaatcagactatgcataatggtcggcgcaaacgcctccgatcgcatgggaatggggacaacctatttagcgctaatggcaacttttaaaatgagacccatgtttgcagtaggtttgctttttcgacgattaacaagtcgagaagtattgttattgaccataggcttaagccttgtggcttccgttgaattaccaaacagcctggaggaattaggagatggactcgcgatgggaattatgatgctaaaattattaacagaatttcagccccaccaactgtggataaccttgttaagtcttacgttcataaaaaccacccttagtctggactacgcttggaagacgacagcaatggctctgtcgatcgtctctttatttccgctatgcttgagtacaacatcgcagaaaactacttggttaccagttcttctcggttcattcggatgtaaaccactaacaatgttcttaataacagaaaacaaaatatggggaagaaagtcatggcctttgaatgaagggataatggcaataggtattgtatcaatattattatcttctttactcaagaacgatgtccctttggcgggtccgttaattgccggtggaatgttaatagcatgctatgtgatatcgggtagctcagcggatctatccttagaaaaggcggcagaagtgagttgggagcaagaagcagaacattcaggtacctcccataatattttagtagaggtgcaagacgatggaacgatgaagattaaagatgaggaacgagatgacacactgactatcttacttaaagcgacgttattggccgtatccggagtttacccgatgtcgatccctgcaacgctgttcgtgtggtacttttggcagaagaagaaacagagaagtggagtattatgggacacaccctctccaccagaagttgaacgagcagttttagacgacggtatttatagaatacttcaaagagggctactagggagaagtcaagtgggagttggagtttttcaagacggcgtcttccacacaatgtggcatgtcacaagaggtgcagtgctaatgtatcaaggaaaaaggctagagccatcatgggcgagtgtgaagaaagacttaattagctatggaggcggttggaggtttcaaggatcatggaacaccggggaagaggtacaagtaattgcagtagaaccgggcaaaaaccctaaaaatgtacaaaccatgcccggcacctttaagacacctgagggcgaagtaggggctatcgccttggactttaagccggggaccagcgggtcaccaatcgtgaatcgagaaggtaagatagttggtctgtatggaaatggagttgtaacaacttcaggcacatatgtctctgcaatcgcgcaggccaaggcatcacaagagggacctctgccagagattgaggacgaagtttttaagaaaagaaatcttaccattatggatcttcatccaggatcagggaaaacccgtagatacctcccggcaatggtccgtgaggcaataaaaagaaaactgagaaccctgatattagcaccaacacgggtggttgcgtcagagatggcagaggcgctaaaaggtatgccaatacggtatcaaacaacagcagtgaaatctgaacacaccggaagagaaatagtagatttaatgtgccacgcaacattcactatgagactactctcacctgtccgagtaccaaattataacatgataataatggatgaagcacactttactgatccagcgagcatcgccgcgcgcgggtacattagtactagagttggaatgggggaggcagccgcaatttttatgacggctacaccacccggctcagttgaggccttcccgcagtcaaatgctgtaatccaagatgaggaaagagatataccagagcggtcatggaactcaggttacgactggatcaccgatttcccaggtaagacagtctggtttgtaccaagtataaaatcaggtaatgatatcgcaaactgtctaaggaaaaatggcaagagagtaattcagctgagtagaaaaactttcgataccgaataccagaaaaccaaaaataacgattgggattatgtagtcacgacggacattagtgaaatgggagccaactttagagctgatcgggtgattgatccaagacgatgcctcaagcctgttattttaaaagacggacctgagagggtaatacttgcggggcctatgcccgtcacggtagcttctgctgcccagcgacgtggacgaatagggagaaaccaaaataaagaaggagatcaatatgtttatatgggacaacctctaaacaatgacgaggaccatgcacactggactgaagcaaagatgttattagacaatattaatacacccgaaggcataataccagctttgttcgagccggaaagagagaaaagtgccgcaattgacggagagtatagacttagaggtgaagcaaggaagacgttcgtagaactgatgcgacgcggggatctcccagtctggctatcatacaaagtagccagcgaaggattccaatattccgatcgccgctggtgtttcgacggagagagaaacaatcaggttttagaagaaaatatggacgttgaaatctggactaaggagggtgagcggaagaaactgcgaccacgctggctagacgctagaacttactcagatccgcttgcgttacgtgagtttaaggagttcgcagctggcagaaggtcagtctcaggagacttaattttggaaatcggtaaacttccacaacacctaactttaagagcccaaaatgcattagacaatctcgtaatgttgcataatagtgaacaagggggaaaggcttacagacatgcaatggaggaattacctgacacaatcgaaacacttatgctactagcacttatagcagttttgacaggaggggtcacactcttctttttatcaggaaaaggtttaggtaaaacttcgatcggtctactatgtgtgacagctagctcagcccttttgtggatggcgtcagtagagcctcattggatagcagcttctattatcttagagttctttttaatggtgttattaattccagaacccgacagacagaggactccccaagacaatcagttagcttatgtagttatagggttattgtttatgattctgactgtcgcagctaatgaaatggggttattggagactaccaagaaagatctcggaataggtcacgtagctgcggaaaaccaccagcatgcgactatgctagatgttgatttaagaccagcttcggcgtggaccttatatgcagttgcaactacagtgataacgcctatgatgcgacacaccattgaaaacacgacagccaatatatcacttaccgctattgctaatcaagcagctattctgatgggacttgataaaggctggccaattagcaaaatggacataggagttccactattagccttggggtgctactctcaagtcaatccgctcaccctaacagccgcagttttaatgttagtagctcattatgcgatcatcggccctggcttacaggcaaaagcgactcgagaagctcaaaaacggacagccgctggtataatgaaaaatcctactgttgatgggatagtagccattgacttagacccggtagtatacgatgcgaaattcgaaaaacaactgggtcaaatcatgcttttaattctatgcacttctcaaatactcttaatgagaaccacttgggccttgtgtgaatcaatcactctagctactggcccactaacaacgttatgggagggtagcccagggaagttctggaatacgactatagcagtgtccatggcaaatatttttcggggttcatatcttgccggtgcaggtttagccttttcactgatgaagtcactagggggcggccgcagaggtaccggagcacaaggagaaactctaggagagaaatggaagagacaattaaatcaactctcaaaaagtgaatttaatacatataaaagaagcggaattatggaagtcgacaggagtgaagctaaagaaggtttaaaaagaggtgaaacaacaaaacacgcagtaagtcggggtacagcaaaacttaggtggttcgttgaacggaatttagttaaacctgagggcaaggtaatagacttaggatgtggcagaggaggctggtcttattactgtgcaggactaaagaaagtaactgaagtaaaaggttatacaaaaggcggacccgggcatgaggaaccaatcccaatggcaacatacggttggaatttagtaaagctacattcagggaaagatgtatttttcatgcccccagaaaaatgtgacacgctgctttgtgacataggcgaatcatctcctaaccccacaatagaggaaggacggactttaagagtgttaaaaatggttgaaccttggctacggggaaatcaattttgcattaaaatattgaatccgtatatgccatcagtggtcgagacattagaacagatgcaacggaaacatggcggaatgttagttcgaaacccattatctcgaaactcaactcatgaaatgtattgggtgtcatgcggaacgggaaatatagtgtctgctgtaaatatgacaagtagaatgttattaaatcgattcacaatggcccaccgaaaacctacatatgaacgtgacgttgatctaggagcaggaacgcgccatgtagcagttgaaccagaagtggcaaatcttgatattatagggcagagaatagaaaacattaaaaatgaacacaaaagtacttggcactacgatgaggataatccctataaaacttgggcataccatggaagttacgaagtaaaacctagtggatcagcctccagcatggtgaatggtgtagtgcgacttcttaccaagccttgggacgtaattcccatggtaacacagattgctatgacagacacaacaccattcggccaacaaagggtattcaaagaaaaggtcgacacacgaacaccccgggctaagcgaggtacgacacaaatcatggaagtgacggcaaaatggttatggggatttctcagtagaaataagaaacctcgcatatgtacaagagaagaatttacccgaaaagtaagaagtaatgcagctataggagcagtctttgtagacgaaaaccagtggaacagtgcaaaagaagcagttgaagatgaaagattctgggatctagtgcatcgcgaacgcgaattacacaagcaaggaaaatgcgctacgtgtgtatacaacatgatgggaaaacgagaaaagaaattaggtgaatttggcaaagccaagggatcaagagctatatggtatatgtggttgggagctcggttcttggagttcgaggctttggggttcatgaatgaagaccactggttcagcagagagaactcactatctggcgttgaaggagagggactacacaaattgggatacattctgagagatataagcaaaatcccgggaggtaacatgtacgcagatgatactgccggttgggatacccgaatcacagaagatgatctccaaaatgaggcgaagataaccgaaataatggaacctgaacacgcccttctggctacaagtatttttaaattgacatatcaaaataaagtggtacgagtgcaaaggccggccaaaaatggcaccgttatggatgttatctcgaggagagatcaacgggggagtggtcaagtgggtacgtatgggctaaacacgtttactaacatggaagtacaactgataaggcagatggaatcagaaggaatatttctaccgagcgaactagagactccaaatcttgctgaacgggtcctcgactggttggagaaacacggagcagaacgacttaaaagaatggctataagtggagacgattgcgttgttaaacctattgacgataggttcgccacagcactaactgctttaaacgatatgggaaaagtacgaaaagacattccgcaatgggagccctccaaaggatggaacgattggcaacaagttccattctgcagccaccactttcatcagctaattatgaaagatggtagagagattgtggtcccctgtaggaaccaagacgaattagtcggtcgagctcgtgtatcacaaggtgccggctggtctcttcgtgaaacagcctgtttaggcaagtcatacgcacaaatgtggcaattaatgtattttcaccgtcgcgatctaaggctcgcagcgaatgccatatgctctgctgtaccagtagactgggtacctacaagtcgcaccacatggtcaatacatgcacaccaccagtggatgacaaccgaagacatgctatccgtctggaatagagtatggattgaggaaaatccatggatggaggataaaacacacgtgagtagttgggaagaagtcccatatctaggaaaaagagaggatcaatggtgtgggtctttaataggtttaaccgctcgagctacctgggctacgaatatccaggtagcaattaaccaggtacgacggttgattggcaatgaaaattacctagattatatgacatcaatgaagcggttcaagaacgagtcggatccagaaggtgcactatggtga

SEQ ID NO: 21257 - RNA, 9879 nt, synthetic construct
  misc_feature 1..9879: note = derived and/or modified CDS sequence (opt6) from DENV-1__KF955443__SS-prME
  source 1..9879: mol_type = other RNA
tcagttactatgttgcttatgttattacccactgcactagcatttcacttaacgactcgcggtggtgaaccacacatgatcgtctcaaaacaagaacgaggaaaaagtttattgtttaaaacttctgcaggcgtaaacatgtgcacacttattgcaatggatttaggagaattatgcgaagatacaatgacttacaaatgtccacaaattacagaagcagaacccgatgatgtagattgttggtgtaatgcaacagatacatgggtgacatatggcacgtgtagtcaaacaggtgaacataggcgagataaacgatctgtcgcacttgcaccacatgttggtttaggattagaaacacgaacagaaacttggatgagtagcgaaggagcatggaaacaaatccaacgcgtagaaacctgggcattaagacatccaggatttaccgtcatagcattatttttagctcacgcaataggtactagcattacacaaaaaggtattatattcatattgttgatgctggtaacaccaagcatggcaatgaggtgtgtcggaattgggaacagggactttgtggagggattgtctggagctacatgggtagacgttgttttagaacatggttcctgtgtaactaccatggcgaaaaataaaccaactcttgatatcgagttattaaaaacagaagtcactaacccagcaattctaaggaaactttgcattgaagcaaaaattagcaatactacaacagatagcagatgcccaacacaaggagaggcgactctggtggaagaacaagatgctaattttgtatgcagaagaacgtttgtcgatcgaggttggggcaacggctgtggattattcggtaaaggttcattattaacgtgtgctaaatttaaatgtgtaactaaacttgaaggtaaaattgttcaatatgaaaatctaaaatattcagttattgtaacagtgcatacaggcgatcaacaccaggtgggaaacgaaaccacagaacatggtacaattgcgacaataacaccccaagctcctacaagtgaaattcagctcacagactacggtgctttgaccctggactgtagtccacgtactggcttagatttcaacgaaatggtattactaacaatgaaagagaaaagttggttggtacataaacagtggtttctggatctacccttaccatggacatctggggcatctacaagtcaggaaacgtggaatagacaggatctgttggttacttttaaaactgcccatgccaagaaacaagaagtggtggttttgggttcacaagaaggggcaatgcacactgcgttaactggagccacggagatacaaatgtccggcactactacgatttttgcaggccacctaaaatgcagattaaaaatggacaaattaaccttgaaaggcacaagttatgttatgtgtacaggctcatttaaattagaaaaagaggtcgcagaaacacaacacggcactgtattagttcaggtaaaatatgaaggaacagacgctccatgcaaaataccattttccacgcaagatgaaaaaggcgttactcaaaacggtagactgattaccgcaaatccaatcgtaactgataaagaaaaacctgtgaatatagaaactgagccaccctttggagaaagttatattgtagttggggctggagagaaagccctaaaactaagttggtttaaaaagggatcctccataggtaaaatgttcgaagcaacggcaagaggagcaagacgaatggcaatactaggggacaccgcatgggattttggctctattggaggcgtttttacttctgtggggaagctagtacatcaagttttcggtacagcatatggtgtgctattcagcggggttagttggacaatgaagatcgggataggaatattactaacatggttaggattaaatagtagatcaacatcactctcgatgacatgtattgcagtcggcatggtcacactttaccttggggtaatggttcaagctgattctggttgtgtgatcaattggaaagggagggaactcaaatgcggaagtgggatatttgtgacgaacgaagttcatacttggactgaacagtataaattccaagccgattcgccgaaacggttgagtgctgcaataggaaaagcatgggaagagggtgtttgtggaattaggtcagtcacgagattggaaaatataatgtggaagcagatctcgaacgaattaaaccatatattattagagaatgatatgaaattcactgtcgtcgtaggagatgctaacggtatattagcacagggcaagaaaatgatacgaccacagccaatggaacataaatactcatggaaatcctggggaaaggcgaaaataatcggtgcagatatccaaaatacaacctttattatagacggtccagatacgcccgaatgtccagataaccaaagggcctggaacatctgggaagtcgaggattatgggttcggtatatttactacaaacatatggttgaaattaagagattcttatacacaaatgtgtgatcatcggcttatgagtgcggccatcaaggattctaaagctgtacacgcagacatggggtactggatagaatctgagaaaaatgaaacatggaaattagctcgcgcttcattcatagaagtaaaaacgtgcacatggccaaaaagtcacacactttggagcaatggtgtacttgaatccgagatgatcattcccaaaatatatggtggaccgatatcgcagcataattatagacccggttattttacacaaaccgcaggcccttggcacctcggaaaactggaattagattttgacttgtgcgaaggaactaccgtggtagtagatgaacattgtggaaaccgtggcccctcactcagaacaacaaccgtaactgggaaaattatacatgaatggtgctgtcgaagttgcactctaccacccctcagattccgcggagaggacgggtgctggtatgggatggagataagaccggtaaaagagaaagaagaaaatctagttcgaagtatggtttcagcaggatccggcgaagtggatagcttctcgttaggaatcttatgcgcaagtattatgatagaagaggtcatgcgtagtagatggtcgagaaagatgttaatgacaggaacattagccgtatttttacttttaatcatggggcaactcacttggaatgacttaattaggctgtgtataatggtcggtgccaacgcgagcgatagaatggggatgggtaccacatatctagcattaatggccacattcaagatgagacctatgtttgcagtagggttgctttttcgacgactaacttctagagaggtattactattaaccataggacttagtctggttgcaagcgtagaactacctaacagtttagaagaactgggtgatgggttggcaatgggaataatgatgctaaagttgttaaccgaatttcagccgcatcagctctggactacactactaagcctgaccttcataaaaactactcttagcctggactatgcatggaaaacaacagccatggctctaagtatagtttcactattcccattgtgcttatccacaacatcccaaaagactacgtggttacccgtactactagggtcattcggttgtaaacctctaacaatgttcttaattacggaaaataaaatatggggacgcaaatcttggccattaaacgagggaataatggcaataggaatagtttcaattctcttatccagtctgttgaaaaatgatgtacccttagcaggtccacttattgccggcggaatgctcatagcttgctacgttattagcgggtcatctgcggacctgtcgttagaaaaagctgcagaagtttcttgggaacaagaagcggagcattcagggacatcacataacattctggttgaagtacaggatgatggtaccatgaaaattaaagatgaagaacgcgatgatactctcacgatattattaaaggctacattattggcagtatcaggagtgtatcctatgtcaatcccagcgacactgtttttatggtatttctggcagaagaagaaacaaagatcaggagttttgtgggataccccctcaccgcctgaagtggagagagccgtgttagatgatggaatatatcgtattttacaacgcggcctacttggccgttcccaggtgggagtaggagtgttccaggacggtgtattccatacaatgtggcacgtcactagaggtgcagttctcatgtatcaaggcaaacgcctagaaccatcttgggctagtgtaaagaaagacttaatatcttatggaggcgggtggagattccaaggcagttggaatactggagaggaagttcaagtaattgcagtagaaccggggaagaacccaaagaatgttcagacaacacccggaacattcaaaacgcctgaaggggaggtaggagcgatcgctctagattttaaaccaggaacgagtggatcacctatagtcaatcgtgagggcaaaattgtaggcctttatggtaacggagttgtgactacctccggtacatatgtgtcagctattgcacaagcaaaggcttctcaagagggaccgctaccagagatagaagatgaagtttttaaaaagcggaatctcacaataatggacttgcatccagggtcaggtaaaacaagaagatatttacccgctatagttcgtgaagcaattaaaagaaaacttagaacgctaatacttgcgccgaccagagtcgtagcctctgagatggcagaagcgttaaagggtatgccaattagatatcaaaccactgctgtcaaaagtgagcatactgggcgtgaaatcgtagacttaatgtgccatgctacttttacgatgcgacttctcagtccggtacgggttccaaactataatatgataataatggacgaagcacattttacggatcctgcttcaatagctgcccgaggatatatatcaactagggtaggtatgggggaggctgcagccatatttatgactgcgaccccaccgggatcagttgaggcatttccccaatcgaatgctgtaattcaagatgaggaaagagatattcccgagagatcgtggaatagcggctacgactggataaccgatttcccgggaaagactgtatggttcgttccaagtataaaatccggaaacgatattgcaaactgtttacgcaaaaacggaaaaagagttatacaacttagtcgaaaaacttttgatacggaatatcagaaaacgaaaaacaatgattgggattatgtggtaacaacagatatttccgaaatgggagcgaactttagagccgatcgagtgattgatcctaggcgctgtctaaaaccagttatattaaaagacggaccggaaagggtcatactagccggcccgatgcctgttaccgttgcatcggcagcacaaagacgtgggcgtataggcagaaatcagaataaggaaggcgaccaatatgtgtacatgggccagccactcaataatgatgaggaccacgcacactggacggaagcaaaaatgttactagataatataaatactccagaaggtataatacctgcattattcgaaccagaacgcgagaaaagtgcagcaatcgatggagaatatagattgagaggtgaagcaagaaagacatttgttgagctaatgagacgtggagacttaccagtttggctatcgtataaagtcgcctcagaagggttccagtacagtgatcgacgatggtgtttcgatggcgaaaggaacaatcaagttttggaagaaaatatggacgttgaaatttggacaaaagaaggggaacggaagaaactgagaccccgttggctagatgcacgtacttatagcgatccactggcattacgtgaatttaaggaatttgccgcgggtagaagatcagtttcaggcgatttgattctagagatcggaaaacttccccaacacttaacattacgagctcaaaatgcactagacaatcttgtgatgttacataattctgaacaaggcggaaaggcttatcgccacgcaatggaagaattacccgacaccatcgaaacacttatgttactagctctaatagccgtcttaacaggtggtgtaacgttgttctttttaagtgggaaaggtctaggtaaaacgtctataggtctgttatgtgtaactgcgagctccgcactgctatggatggcatccgtggaaccacattggattgccgcatcgattatacttgagttctttctcatggttttgctgataccggaaccggatcgacaaagaacgccccaagacaatcaattggcctacgttgtaattggtcttctattcatgatcctaacggtagcagcaaacgaaatggggttgctggaaactaccaagaaagacttggggattggacacgtagccgccgaaaaccaccaacatgctaccatgttggatgttgatctgaggccggcaagtgcgtggacgttgtatgcagtcgctacgacggtcataacaccaatgatgcgacacactattgaaaacacaactgcaaacatttcacttaccgcaatagcaaaccaagcagccattctcatgggtctcgataaagggtggccgattagtaagatggacataggtgtaccattactggcattaggttgctacagtcaggtaaatccactcactcttactgctgcagtactcatgctagtagcgcattacgcaataattggacctggactgcaagcaaaagccacacgcgaggcgcaaaaacgaacagctgctggtattatgaaaaatcctacggtagacggaatcgtcgcaatagatcttgaccctgttgtctatgatgcaaagtttgagaaacagctcggtcaaatcatgctactaatattatgcacatcacaaattctgcttatgcgaaccacctgggcattatgtgagagtataacactagcgacagggccacttacaacactgtgggaaggttcaccaggtaaattttggaacacaacaatagctgtgagtatggcaaatatcttcagaggatcatatttagctggagcaggtctagcattcagtttgatgaagtcgctgggaggcggaagacgaggcacaggtgcccaaggcgaaacacttggagagaaatggaaacgacaactaaatcaattatcaaaatcggaatttaacacatacaagagatcaggaataatggaagtcgaccgatccgaagcaaaagaaggactaaaacgtggcgaaacgacaaagcatgcagttagtcgaggaacggcaaaactaaggtggttcgtggaaagaaatttggtcaaacccgaaggaaaggtgattgaccttggttgtggacgaggtggctggtcttactactgtgcaggactgaagaaagtaaccgaggttaaaggctacaccaagggcggaccaggccatgaggaaccaatacccatggcgacatacggatggactcttgtaaagttgcatagtggaaaagatgtcttcttcatgcccccagaaaagtgcgatactttactatgcgatatcggtgaatcatctccaaaccctacgatagaggaaggccgcacgttaagagtactaaaaatggtagagccatggttaaggggaaatcaattttgcatcaagatactgaatccatatatgccttccgtagtagaaacattagaacaaatgcaacgcaaacacgggggcatgcttgtccgcaatccactgagtagaaattcaacgcatgagatgtactgggtgagttgcggtacgggaaatattgtatcagcagttaacatgacgtccagaatgctgctaaaccgttttactatggctcaccgtaagccaacgtttgaacgtgatgtagacctaggtgcaggcacccggcacgtcgctgttgaaccggaagtggcaaatctagatataattggacaaagaatagaaaatatcaaaaatgaacataaaagtacatggcactatgatgaagacaatccttacaaaacatgggcatatcatgggtcatacgaagtaaagccaagcgggagtgcatcaagtatggtcaacggcgtggtccggttattaactaagccctgggatgtgattcctatggttacgcagatagcaatgacagacaccacaccattcggacaacaaagggtattcaaggagaaagtagatacaagaactcccagagcaaaaagaggaactacccaaataatggaagtaacagccaagtggctatggggatttttaagcagaaataagaaaccgagaatctgtactcgagaggaatttactcgtaaagtccgttcaaacgcggcaataggtgctgtgtttgtagacgagaaccaatggaacagcgcgaaggaagcggttgaggacgaaagattctgggatttagtacatagagagagggagcttcacaaacagggcaagtgtgctacatgcgtatataatatgatgggaaaaagagagaagaaactaggggaatttgggaaggcaaaaggatcaagggcaatctggtacatgtggttaggagccagatttctggagtttgaggctttagggttcatgaatgaagaccattggttctctagagaaaattcactatcgggcgtggagggagagggccttcataagttgggatacatcttacgagacatctcaaaaataccaggtggtaatatgtatgcggatgatactgccggttgggacacacggattacagaagatgacctccagaatgaagccaagatcacagatatcatggaaccggaacatgcgctcttggcaacatctatttttaaattaacctatcaaaataaggtagtaagagttcaaagacctgccaaaaatggaactgtgatggatgtaatatctagaagagaccaaagaggatctggccaagttggaacttatggcctaaacacgttcacaaatatggaggttcaactcattagacagatggaatctgaaggaatatttcttccaagtgaattagagacacctaacctggcagaaagggtactagactggttagaaaagcacggagccgagagactaaaaagaatggcaatttccggggacgattgcgttgtgaagcctattgatgaccgtttcgccacagcgttaactgcactaaatgatatgggaaaagtaaggaaagacataccacagtgggaaccaagtaagggctggaatgactggcaacaagtaccgttttgttctcatcatttccaccaattaatcatgaaagatggaagagaaatagtcgttccgtgcagaaatcaagacgaattagttggtagagctagggtgtctcaaggagcaggatggtctctgagagagacagcctgtcttggaaaatcatatgcgcaaatgtggcaactaatgtacttccatcgaagggatctgagattagccgccaatgccatttgttcagcagtccccgttgactgggtaccaacatcacgaacgacatggagtatacatgcacaccaccaatggatgacaacagaagacatgctcagcgtttggaatcgagtatggattgaagaaaacccatggatggaggacaaaacacacgtgtcttcgtgggaagaggtaccttacttaggtaagagagaggaccaatggtgtggatctttgattggcctaacagcgcgagcaacctgggccaccaatattcaggttgctattaatcaggtacgacgattaattggaaatgaaaattacctagattatatgacctctatgaaaagattcaaaaacgaatctgatcctgaaggggcactatggtaa

SEQ ID NO: 21258 - RNA, 9879 nt, synthetic construct
  misc_feature 1..9879: note = derived and/or modified CDS sequence (opt6) from DENV-1__GQ868520__SS-prME
  source 1..9879: mol_type = other RNA
tctgttactatgctgttgatgttattacctactgctctagcatttcacttaactactcgcggaggagaaccacatatgatagtgagcaaacaagaacgaggaaaatcactgttgttcaaaacttcagcaggagtgaatatgtgcacactaatcgctatggatttaggtgaactatgtgaagatacgatgacttataaatgtccacaaataactgaagcagaaccagacgacgtagactgctggtgtaacgcaaccgatacttgggtaacctatgggacatgtagccagacaggtgaacatcgccgagataaacgtagtgttgcacttgcaccccatgttgggctgggattagaaacacgaacggaaacatggatgtctagtgaaggggcatggaaacaaatccagagagtggaaacttgggcacttcgccaccctgggtttacagtaatagcacttttcctggcacatgcaataggaacaagtatcacccaaaaaggaattatttttatcctcttaatgttagttacaccttccatggctatgcggtgtgtgggaattggaaatagagattttgtggaaggtttaagcggagcaacatgggttgacgtagtattggaacacggttcatgcgttacgacaatggccaaaaataaacctaccttagatattgaattattaaaaactgaagttaccaatccagctatccttagaaaattatgtatagaagcgaaaatatcaaatactacgacggatagtagatgtcctactcaaggtgaagcgacactggttgaagaacaggacgcaaacttcgtatgtcgtcgcacatttgtagaccgcggatggggaaatggatgcggtctttttggtaaaggctcactcttaacctgtgcaaaattcaaatgtgttactaaactagagggaaaaatagttcagtatgagaatctgaaatattcagtaattgtcacggttcacaccggagaccaacatcaggtaggcaatgaaactaccgagcacggtactatagcgacaatcactccacaagcacccacctcggagattcaacttacagactatggagcattgacactagactgctcacctagaactggtttagattttaacgagatggtattactaacaatgaaagagaaaagttggttggtacataaacagtggtttcttgatttacctctaccttggacctcaggtgcctcaacaagtcaggaaacctggaatcgccaagacttattagtgacatttaaaactgcacatgcgaagaaacaagaagtcgtcgtattgggttcacaagaaggtgcaatgcatactgctttgacaggcgcaacggaaattcagacttcgggtacaaccacaatatttgctggccatttgaaatgccgacttaaaatggacaaactaacattaaaagggacttcgtatgttatgtgtactggctcgttcaaactggaaaaagaagtagctgaaacccaacacgggacagttttggtacaggtaaaatacgaaggtacagacgcgccctgcaaaatcccgttttccacgcaagacgaaaaaggtgttacccaaaacggacgtcttattacagcaaatcctattgttactgataaagaaaaaccggtgaatatagagaccgaaccaccatttggcgaatcatacatagtagtaggagcaggagaaaaagcactgaaactgtcatggttcaagaaagggagctcaataggaaaaatgtttgaggcgactgcgagaggcgctcgaagaatggcgatattgggggacactgcatgggacttcgggagtataggaggagtattcacatcagtggggaaattagttcaccaagttttcggaacagcatatggtgtactgtttagtggagttagttggacaatgaagataggcattggaattttattaacctggctaggattaaattcccggagtaccagtctatcgatgacatgcattgcagtcggcatggttactttatacctaggtgtaatggtgcaagctgattccggctgtgtcattaactggaaagggcgggaattgaaatgcggtagcgggatattcgttactaacgaagtgcatacatggacagaacaatacaaatttcaagccgatagccctaagcgtttatcggcagccataggtaaggcttgggaagaaggtgtttgcggcataaggagcgccactcgactagaaaacattatgtggaagcaaatatcgaacgaacttaaccatatactgctagaaaacgatatgaaattcacagttgtagttggtgacgcgaatggaattttagcacagggcaagaaaatgatacgacctcaaccaatggaacataaatattcctggaaatcatggggaaaagcaaagataatcggagcagatatacagaacaccacgtttatcatcgacggtccagataccccggagtgccccgataatcaacgagcctggaatatatgggaagtggaagactatgggtttggtatatttacgacaaacatttggttaaaacttcgcgacagttatacccagatgtgcgaccataggctgatgagcgctgctataaaagactctaaggctgttcatgctgatatgggatattggatcgaatcagagaaaaatgagacatggaaattagcccgagcctcattcatagaagttaaaacttgtacctggcccaagtcacacacgttgtggtcaaatggtgtgctggaatctgagatgattatcccgaaaatatatggaggaccgatatcacaacataactatagacctggttattttacacaaactgctggaccatggcatttaggtaaattagaattagatttcgacctttgcgaaggaactacagtagtagtagatgaacactgtggtaaccgcgggccctccttaagaactacaacagtaacaggaaagataatacacgaatggtgttgtagatcctgtacattaccaccacttagattcagaggggaagatgggtgttggtatgggatggaaataaggcccgtgaaggaaaaggaagaaaacttagtccgctccatggtcagtgctggcagtggagaagtcgactctttttctcttggtatactatgcgcaagtatcatgatagaggaagtcatgaggtcacgatggtcaagaaaaatgctaatgacaggaactttggcagtattcttgttattggttatggggcaactcacatggaatgatttaattcgactatgcatcatggttggtgcaaacgcatcagaccgtatgggaatgggtacaacctacctagctctaatggcgacttttaaaatgcggcctatgtttgcagtaggattgttattcagacgactaacatctcgtgaagtcttgctactaactataggtctgtctctagttgcatctgtagagttaccaaacagcctagaagagttaggagacggcctagcgatgggcatcatgatgctaaaactactcaccgaatttcaaccacaccaattatggactacattactgtcattaaccttcattaagaccacgctctcactagattatgcatggaaaacgactgccatggcacttagtatcgtaagcctatttccgctatgcctatccactacaagtcagaaaacaacatggctgccggtattactaggatcatttggctgtaaaccactaacgatgttccttattacagaaaacaagatctggggccgaaaaagttggcctttgaatgaaggaattatggctatcggtatcgtatccattctcctgagcagcctattaaagaatgacgtcccactggctggtccgctaatagcaggaggaatgttgatagcctgttatgtgattagtggaagctcagcagacctaagcctcgagaaggcggctgaagtgagttgggaacaagaagccgaacatagtggaactagccacaatattctagttgaagttcaagacgatgggactatgaaaataaaagatgaagaaagagacgacacattgacaatattactcaaagcaactttattagcagtgagtggtgtttaccctatgagtatccccgccaccctcttcgtatggtatttttggcagaagaagaaacaaagaagtggtgttttatgggatacgcctagtcccccagaagtggagagggcggtcctcgacgatggtatatacagaattttacaaaggggtctattaggacgatctcaagttggtgtcggggtattccaagatggtgtattccatacgatgtggcatgttacccgcggcgcagttctgatgtatcagggaaaaagactagagccttcatgggcaagcgtcaagaaagacctaatatcgtatggaggcggctggaggtttcaagggagttggaataccggtgaagaagtacaagtaatagctgtcgaaccaggaaagaaccccaaaaatgtacagacaatgcctggaacatttaagacgcccgaaggagaagtcggggcaattgctttagactttaagccaggcacgtctggctcaccaattgtaaatagagaaggaaaaattgtgggcttatacggaaatggagtagtaacaacaagcggcacgtacgttagcgcgatagcgcaggcgaaggcttcgcaagaaggaccacttcccgaaatagaagatgaggttttcaagaaaaggaatttaacaattatggatctgcatccgggatcgggtaaaacacggagatacttacctgctatggtgcgcgaagctattaaacgcaaattaaggacactaattttagcaccaacaagggtagtggcaagcgaaatggcagaggccctaaaaggcatgcccatcagataccaaaccacggctgttaagagtgagcatactggaagagagattgtcgacttaatgtgccatgcaacgttcacgatgcgactcttatctccagttagagtaccaaattataatatgataattatggatgaagcacactttacggaccccgcatcaatagcagcaagaggctacattagtactcgagtaggcatgggtgaagcagcagcaatattcatgacagctacacctcctgggagtgttgaggcttttcctcaatctaatgccgtgatccaagatgaagaaagagacattcctgaaagaagttggaactctggatacgattggattacagactttccaggaaagactgtgtggtttgtaccctctataaagtccggcaatgacattgcaaactgtttaaggaaaaatggaaaaagagttatacagttatcccgaaaaacttttgacaccgagtatcagaagacgaaaaacaatgactgggattatgttgttacaacagatatcagcgaaatgggagctaattttagagcagatagagtaatagatccaagaagatgcctaaaaccagtgatactgaaagatggaccagaaagggtaatattggctggtcctatgccggttactgttgcatcagcggctcaaaggagagggcgtataggaagaaatcaaaacaaagaaggggatcaatacgtatatatgggacaaccactaaacaatgacgaagatcacgctcactggacagaagcaaagatgctcttagataatattaacactccagaaggtataataccagcgctgtttgagccagaaagggagaaaagcgcagcgattgatggagaatacagattacgaggtgaagctagaaagacattcgtcgagcttatgagacgcggagacctaccagtctggctatcttacaaagtcgcatcagagggatttcagtattccgaccgaagatggtgtttcgatggggagaggaataatcaagtattggaagagaatatggacgtcgagatatggacaaaagagggtgaaaggaagaaactcaggcctcgttggttagacgccagaacatatagtgatcctcttgccctccgtgagttcaaagaatttgctgccggcagaagatcggtaagcggggatttaatcctagagataggaaagctcccacaacatctaaccttgagggcacaaaatgcattagataaccttgtcatgttacataacagtgagcaaggaggcaaagcatatcgacacgccatggaagaattaccggatacaatagaaacgctcatgttactggcactaatagctgttttaacgggaggagtaactctattctttctcagcggaaaaggacttggaaaaacgagcattgggctactttgtgttacagcatcatcagcattattatggatggcatcagttgaaccccattggattgcggcatctattatactagagttcttcttaatggttctattgattcccgaaccagatagacagcgtacccctcaagacaatcagctagcatatgtagtgataggtttattatttatgattctaactgtagctgcaaatgaaatgggactactcgaaacaaccaaaaaggatcttggaattggccatgtcgcggcagagaaccatcaacacgccacgatgctagatgtcgatctacgaccagctagtgcttggactttatacgccgtagccacaacggttattacgcccatgatgcgacatacgattgagaatactacagcaaatatatcgttaacggctatcgccaaccaggcagctattttaatggggttagataaaggttggcctatatcaaaaatggatataggtgttccattattagcattaggctgctacagccaagtaaatccactgacactaactgcggctgtcttaatgttagtagcacactatgcgataataggacccggtcttcaagcaaaagcaaccagagaagctcagaaacgtacggcggctgggatcatgaaaaatccgacagttgatggaatagtagcaatagacctggacccggtcgtatatgacgctaagtttgaaaagcaacttggtcaaatcatgttattgattttatgtacatcacaaatcttactaatgagaacgacttgggcgttatgcgaaagtattacgttagcaacaggaccattgacgacactatgggaagggtccccaggaaaattttggaacacgactattgccgtatcaatggctaatatatttagaggctcgtatttagcaggagcaggactggcatttagcttgatgaaatctcttggcgggggtagaaggggcacaggtgctcaaggagaaacacttggagaaaaatggaagaggcaacttaatcagttatcgaaatcagagttcaatacatataaacgatctggtatcatggaggttgatcgatcagaagcaaaagaaggcctcaaaaggggagagacaacaaaacatgctgttagtagggggacggccaaattacgttggtttgtagagagaaacctagtaaagcctgaaggaaaggtaatagatctcggctgtggacgtggaggatggtcttactattgtgctggactcaagaaagtcactgaagtaaaagggtacaccaaaggcgggcctggacacgaagaacctatcccgatggcaacttatggatggaacctcgtaaaattacacagtggaaaagatgtgtttttcatgcctccagaaaagtgtgataccctgctatgcgacatcggtgagtcatcacccaacccaacaatagaagaagggcgaacacttcgcgtgcttaaaatggtagaaccatggttaagaggtaaccaattttgtattaaaatattgaatccatacatgccctctgtagttgaaactctcgaacagatgcagcgtaaacatggagggatgctagttcgaaatccactctcacgaaattcgacacacgaaatgtattgggtcagctgcgggacaggaaatattgtttctgcggtcaatatgaccagccgtatgttactcaatagattcactatggcacatagaaaacctacatatgagagagacgtagatttaggtgccggaacaagacacgtggctgtagaacccgaagttgcaaatttagacattattggtcaacggatagaaaacatcaaaaatgagcataagtcgacatggcattacgatgaagacaatccctacaaaacatgggcatatcacgggtcatatgaagtaaaacccagtgggagtgcatcaagcatggttaatggagttgttaggcttcttacaaagccttgggatgttattcctatggtaactcaaatcgccatgactgacacgacaccttttggtcaacagagagtattcaaagaaaaggtcgacacaagaacgcctcgtgcaaaaaggggaaccacgcaaataatggaagtaacagcaaaatggctctggggctttttgagcagaaacaagaaaccgcgaatctgtaccagggaagagttcacaaggaaagtgcgatcgaatgcggcaataggtgctgtcttcgtagatgaaaaccaatggaatagcgcaaaggaagccgtagaagacgaaagattttgggacctagtccaccgggaacgagaacttcacaagcaagggaaatgtgcgacctgtgtctataatatgatggggaagcgagagaagaaactcggagagtttggaaaagcaaaaggctcaagggccatttggtacatgtggttaggcgcacggtttctagaatttgaagcattaggatttatgaatgaagatcattggtttagcagagaaaactcactatcaggtgttgaaggagaaggattacataaactaggttatatactcagagacatatcgaaaatacccgggggaaatatgtatgctgacgatacggccggttgggataccagaattactgaggacgacttgcagaacgaagcaaaaataactgaaatcatggaacccgagcatgcacttttagccacctcaatctttaaattaacatatcagaacaaagtagttagggtacaacgcccagccaagaatggaacagtcatggatgtaataagtagacgagaccaacgcggatcagggcaagtgggaacatacggcttgaacacattcacaaacatggaagtacaattaatccggcagatggaatctgaaggaatttttctaccttctgaattagaaacacctaatttggccgaaagggtattggactggttagagaagcacggagcagaacgcctaaaacgaatggcaatcagcggcgatgattgtgtagttaaaccaattgacgacaggtttgcgaccgcattgaccgctttgaatgacatgggtaaagtgaggaaagatatacctcaatgggaacccagtaaaggatggaatgattggcaacaagtccctttttgtagccatcattttcatcagctgattatgaaagatggtcgagaaatagttgttccctgcagaaatcaagacgagctagttggtagggcacgcgtatcgcaaggagcagggtggtcgctacgagaaacagcatgtctggggaaatcatacgcacaaatgtggcaattaatgtactttcaccgaagggacttaagattagcggcaaatgccatatgttcagcagtacctgtggactgggtaccaacaagccgcacaacttggagcatccatgctcaccatcaatggatgactacagaggatatgttatcagtgtggaacagggtatggatagaggaaaacccatggatggaggataaaacacacgtaagcagttgggaagaagtgccttatctcggaaagagggaagaccaatggtgtggtagcttaataggactgaccgctcgtgctacctgggccacaaacattcaggttgcaataaaccaagtaaggcgactaatcggtaacgaaaattatctcgactacatgactagcatgaagaggtttaagaacgagtcagaccctgaaggtgctttatggtaa

SEQ ID NO: 21259 - RNA, 9879 nt, synthetic construct
  misc_feature 1..9879: note = derived and/or modified CDS sequence (opt6) from DENV-1__GQ868522__SS-prME
  source 1..9879: mol_type = other RNA
tctgtgactatgttgcttatgttactacccacggcactagcattccatttgacgactagagggggagaaccacatatgattgtgtctaaacaagaacgaggtaaaagccttctatttaaaacaagtgctggtgtaaatatgtgtactcttattgctatggacctaggcgaactatgcgaggacacaatgacttacaaatgtcctcaaattaccgaagcagaacctgatgacgtagactgctggtgcaacgcaacagacacctgggtaacatacggaacctgctcccaaactggagagcaccgacgggacaaaaggtccgttgcgttggcacctcatgttggcttaggtctcgaaacacgtacagagacctggatgagtagcgaaggtgcttggaaacaaatacaaagagtagaaacgtgggcactacgacatccaggcttcacagttatcgctttattcttagcacatgcaataggtacgtccataactcaaaaagggattatatttatattactgatgttagtgacgccatctatggcgatgagatgtgtagggattggcaacagagattttgttgaaggtttatcaggagcgacatgggttgatgtggttcttgagcacgggtcctgcgtgacaacaatggccaaaaataaaccaactttagacatagaattattaaaaacggaggtcaccaatccagcaatacttcgtaaattatgcattgaagcaaaaatatcgaacacaacaactgacagtcgatgtcccacgcaaggagaagccacactggttgaggaacaagacgcaaattttgtttgtagaaggacttttgtagaccgcggatggggaaatggatgtggcctattcggtaaaggttctctcttaacttgtgctaaattcaaatgtgtgaccaaactagaaggaaaaatcgtccaatacgaaaatctgaaatattcggttatagtcacggtccatacaggcgatcaacaccaagttggcaatgaaacgacagagcatggtacaatcgcaacaataactccccaagcccctacaagtgagattcaattaactgactatggtgccttgacgcttgattgctctcctagaacaggattagattttaacgagatggtcttactgacaatgaaagaaaaatcctggctagttcacaaacaatggttcttagacctcccattaccatggacttctggagcctcaacatcacaagagacttggaacagacaagatctcctagtaacatttaaaaccgcacatgccaagaaacaagaagtcgttgttctcggaagtcaagaaggagcaatgcacacagcgcttaccggtgctactgaaattcaaacctccggaacgacaaccatatttgccggccatctgaaatgccgcttaaaaatggacaaattaacactgaaaggcacgtcttatgttatgtgcacgggttcgttcaaacttgaaaaagaagtggccgagacacaacatggaacagttctagtgcaagttaaatacgaagggacagatgccccttgcaaaatcccgttctccactcaagatgaaaaaggtgtaactcaaaatggaagacttataacagccaatccaatagtaacagacaaagagaaaccagtcaacatagagacagagcccccgtttggtgaatcctacatagttgtaggagcaggagaaaaggctttaaaactatcatggttcaagaaagggtcttcgattggtaaaatgttcgaagccacagcacgtggagcaagacgaatggcaatacttggagacactgcttgggatttcgggtcaataggaggagtgtttacatctgtagggaaattagtacaccaagtatttggcacagcttatggcgtattattctcaggcgtatcctggacaatgaaaatcggaatagggattctgctaacatggttaggcttaaacagtagaagcacaagtcttagtatgacatgcatagctgtcggcatggtaacgttatatttaggtgttatggtacaagcggattccggatgcgtgatcaattggaaaggaagagaattgaaatgcggatctggaatctttgtcacaaacgaagtacatacgtggacagaacaatataaatttcaagcagactctccaaaacgcctgtcggctgctatagggaaagcatgggaagaaggcgtctgcggtataagatccgcaacacggctagaaaacataatgtggaaacaaatatcgaacgagctcaatcatattctattagaaaatgatatgaaattcactgtggtagttggagatgctaatgggatacttgcacagggcaagaaaatgattcgaccgcaacccatggagcacaagtactcctggaaaagttggggaaaagcaaaaattataggagcagacatccaaaacacaacttttattatcgacggccccgatacccccgaatgcccagataatcagagagcgtggaatatatgggaagtagaagactacggttttggaatttttactacaaatatctggcttaaattaagagactcgtatacccagatgtgcgatcacagattaatgtcagcggccattaaagattcaaaagcggttcatgctgacatgggctattggatcgaaagcgagaaaaacgaaacatggaaattggcgcgagcaagttttatcgaagtcaagacatgtacatggccaaaaagtcatacactttggtctaatggtgttcttgagtcagaaatgattattcccaaaatatacggaggacccattagccaacacaactacagacctggttatttcacgcaaacggccggaccttggcatcttgggaagttagagttagatttcgatttatgcgaaggcacgactgttgttgttgatgaacattgtggcaacaggggtccgtctttaagaacaactacagtaactggaaaaataatacatgaatggtgttgtagaagctgcacacttccaccattacgatttaggggagaagacggctgttggtatggaatggaaattcgacctgtcaaggagaaggaagaaaacctcgttaggtcgatggtaagtgcagggtctggtgaggtcgattcgttttctctagggatcttatgtgcaagcattatgatagaagaagtaatgcgttcaagatggagtcgaaaaatgcttatgacaggtacgcttgccgtgtttttactcctggtgatgggccaactaacatggaatgatttgatacgtctgtgtattatggtaggagctaacgcgtcggaccgaatgggaatgggaacaacatacttggcactgatggcaactttcaaaatgcgtccaatgtttgcggtaggacttcttttcagacgtttgacatcgagggaagtcctgctattaactattggccttagtttggtagcctcagtagaattaccaaattcactagaagaactaggagatggtcttgcaatgggaattatgatgttaaagctactgactgaatttcaaccgcaccagttatggataacattattatctctgacattcataaaaacaactctaagtttggattacgcctggaaaacaacggcgatggctttatcaatagtatcgctttttccattatgtctatcgaccacaagtcagaaaacaacatggctaccagtactacttggcagttttggttgtaaacctttgacaatgtttttaatcacagaaaataaaatatgggggcggaaaagttggccactaaacgagggaattatggcaattggaatcgtaagtatactgttatcttctttactgaagaatgacgtacctctcgcagggccactaattgctgggggtatgctgatagcttgttatgtaattagcggatcttcggctgacttaagtctcgaaaaagccgcagaggtctcctgggagcaagaagcagaacactccgggacaagtcacaacatattagtagaagtgcaagatgacgggacgatgaaaatcaaagatgaggagagagacgatacactgacaatattattgaaagcaacattacttgctgttagtggcgtatatccaatgtcaataccagctactctctttgtctggtatttctggcaaaagaaaaagcagaggtcaggagtgctctgggacacaccttcgccacctgaggtcgaaagagctgttcttgatgacggtatctatcggatattgcagcgcggtctcttaggacgaagtcaagttggtgtgggggtttttcaagatggtgtatttcatacaatgtggcatgtgactcgaggtgctgtcttaatgtaccaaggaaaaagactggagccatcttgggcaagtgtcaagaaagacctaataagctatggtggtgggtggcggtttcaaggatcgtggaacacaggtgaggaagtacaagtgattgctgtagaaccaggcaaaaatccaaagaatgtacagacaatgccaggtacattcaagacacccgaaggagaagttggcgctatagctttagactttaagcccggtacttcaggaagtcctatagtgaatagagagggtaaaatcgtcgggctatatggaaatggtgtcgtcactacaagcggtacttatgtatctgcaatagcacaagcaaaagcaagccaagaagggccacttccggaaatcgaagatgaagtttttaagaaaaggaacctgactatcatggatctacatccaggttcgggaaaaacaagaagatacctcccagcaatggtacgagaggcaataaaaagaaaattaagaaccttaatactagcacccacgcgcgtagttgcaagtgaaatggcagaggctctcaaagggatgccaataagatatcaaacaacagcggttaaatcagaacacacagggcgagagattgtagacttaatgtgccatgcgacatttactatgcgtctgttatctcccgtacgggttccaaactacaatatgatcataatggacgaagctcactttacagaccctgcttcaattgcggctcgaggctacatttcgacacgtgtcggcatgggagaggcggcagcgattttcatgacagcaacaccaccaggaagtgtagaagcattcccgcaatcaaacgctgtgatacaggatgaagaacgcgacataccagaaagaagctggaactcgggttacgattggattacagactttcccggtaaaacagtatggttcgtaccctctatcaaatcaggaaacgacatagcaaactgtctaagaaagaatggaaagagggtaatacaattatccagaaaaacatttgacacagaataccagaaaaccaaaaacaacgattgggactacgtagttaccactgatatatcagaaatgggagcaaattttagagcagatagggttatcgacccaagacgttgcttgaaaccagttatccttaaagacggtcccgaacgtgtgattttggcgggtcccatgccagttacagtcgcctccgcagcacaaagaagaggtaggataggtaggaaccaaaataaggaaggagatcaatatgtatatatgggacaaccattaaataacgatgaggatcacgcccactggactgaggccaaaatgttactagataatataaatactcctgaaggtattatacccgcattattcgagccagaaagagagaaaagtgcagcaatagatggagaatatagactgcgaggagaagcaagaaagacatttgtggaattaatgagaagaggagacttacctgtgtggctatcctacaaggttgcaagcgaaggatttcaatatagcgatagacgctggtgctttgatggtgaacgtaataatcaggtattagaagaaaatatggatgtagaaatatggaccaaagaaggcgaaaggaagaaattaagaccaagatggctagacgccagaacgtatagtgacccgctcgcgttaagagaatttaaagaatttgcagcaggaagaagatcagtgtcaggggacctaatacttgaaatcggcaaacttccgcaacacctgacattaagggcccaaaatgctctagataatctagttatgcttcataattcggaacaaggcgggaaagcgtatcggcatgcaatggaagaactcccagatacgatagaaacactaatgctgctggccctaattgcggtgcttactggaggggtgacgttgttctttctttctggaaaaggactagggaaaacatcaataggacttttatgtgtaaccgcctcctcggccctactatggatggcaagcgtagagccacattggattgcggcatctattatcttggagttctttctcatggttttgcttataccggaacctgaccggcaaagaacacctcaagacaatcagttagcgtatgtcgtgattggattgctatttatgatactaacagtagccgccaatgaaatgggccttcttgaaaccacgaagaaagacctcggaatcggtcacgtagcagctgaaaaccatcaacatgcaactatgttagatgttgatctaagaccggctagtgcatggacattatatgcggtagcaactacggtcataaccccaatgatgcgtcacacaatagaaaacactacagcgaatatctccctgacagctatagcgaaccaagctgccatcctaatgggattagacaaaggctggcccatatctaaaatggacataggagtccccttattagcacttggatgctactctcaagtaaatccactaacactaaccgcagctgtcctaatgttagtcgctcattatgcaataataggtcccggattacaagctaaagccacccgcgaagctcagaaacggaccgcggcaggtattatgaaaaatcccactgtagatggaatagttgcaatcgacctagaccctgttgtatatgatgcaaaattcgaaaaacaacttggacagataatgttattaatattatgcacctcacaaatactgctcatgaggacaacatgggcgctatgtgaatcgataaccttagcaacaggaccattaactacactatgggaaggttcccccggcaaattttggaacacgaccatagcagttagtatggctaacatatttcgcggatcatacttggcgggtgcaggacttgctttttccctcatgaaatctctaggcggaggcagacgcggtaccggagcccagggtgaaaccctaggagaaaaatggaaaagacaattaaaccaattaagtaaatcggagtttaacacatacaaaagaagtggcataatggaagtggaccgatcagaggctaaagaagggctaaaacgcggtgagaccacaaagcatgcagtctctcgcggcacagctaaattacgttggtttgtagaacgcaatttagtcaaaccagagggtaaggtaatcgatttagggtgtggtcgcggcggatggtcctattattgcgctggacttaagaaggtaacagaggtgaaaggatacactaaaggcggaccagggcacgaggagccaataccaatggctacatatggatggaatcttgtaaaacttcacagtggcaaggatgtgttctttatgccaccagaaaagtgtgacacgttactatgtgacataggcgaatcctctcccaatcccactatagaagaaggtcgaactctacgggtacttaaaatggttgaaccttggcttcggggtaatcagttttgcatcaaaattctaaatccatacatgcctagtgtagtggaaactctagaacaaatgcaaagaaaacatggtggaatgctggtgcgtaacccactctctagaaatagtacgcacgaaatgtattgggtcagttgtggaactggaaacatcgttagtgcagtgaacatgacttcaagaatgctattaaatagatttacaatggctcatagaaaaccaacgtatgagcgagatgtagatctgggagccggtacgaggcacgtcgcggtagaaccggaagtagcaaatttagatatcattggccaaaggatcgagaatattaaaaatgaacataaatccacgtggcattacgatgaggacaacccgtataaaacttgggcgtaccatggaagttacgaagtaaagccgtcaggttccgcgagtagtatggtaaatggagtagtaagacttctgacaaaaccatgggacgttattccaatggttacgcaaattgctatgacagatactactccatttggtcaacaaagagtttttaaagaaaaggtagataccagaacaccccgggccaaacgtggtacaactcaaattatggaggtaacagctaaatggctatgggggtttcttagtagaaacaagaaaccccgaatttgtacccgtgaagaatttactagaaaagtccggagtaatgctgctataggggccgtattcgtagacgagaatcaatggaactctgcaaaagaagcggtcgaagacgagcgattttgggatcttgtacaccgagagcgagaactgcataagcaaggcaagtgtgcaacttgtgtctataatatgatgggtaaaagggagaagaaattaggagagtttggcaaagctaaagggtcccgagctatctggtacatgtggttaggggcaaggtttttagaatttgaggctttgggttttatgaacgaagaccattggttctccagggaaaattccttatcaggtgtagaaggtgaggggctacacaaattgggttacattctcagagacattagtaagatacccggtgggaatatgtacgcagacgacacggctggttgggacacaagaataacggaagatgatctgcagaatgaggcaaagatcactgaaataatggagcctgaacacgcattacttgccacaagtatattcaaattaacctaccagaataaggtagttcgcgttcaacggccagccaaaaatggaacggtaatggacgttatttcacgaagagatcaacgaggcagtggtcaagtagggacttatggcctaaatacatttacaaatatggaagtccaactaatacgacaaatggaaagtgagggcatcttcttaccaagtgaattggaaacacccaatttggcagagagagtattagattggttagaaaaacatggggcagaacgattaaagcgaatggcaatttccggtgacgattgtgtagtaaagccgatcgatgataggtttgcaactgcattaacagctttgaatgatatgggaaaagtaagaaaggacattcctcagtgggagccttcaaaaggttggaatgactggcaacaagctcccttctgcagccatcatttccaccaattaatcatgaaagacggtcgagagatagtagtgccatgtagaaaccaagacgaactggttggaagggcacgggtgtcacaaggtgccggctggagtctgagggagactgcgtgtcttggaaaatcatatgcgcaaatgtggcagcttatgtacttccacaggcgagacttgcgccttgccgcaaatgcaatctgttctgcggtacccgttgactgggttccaacaagtcgcaccacgtggtccatacatgcgcaccatcagtggatgaccactgaagatatgttgagcgtgtggaacagagtatggattgaggaaaacccctggatggaggataagacccatgtatcttcatgggaagaagtaccatatcttggaaagagagaagaccagtggtgcggatcactgattggattgacggcacgagcaacatgggcgactaatatacaagtagcgatcaatcaagtccgaagattaattgggaacgaaaattacctagactacatgacatcaatgaaaagattcaaaaacgagtctgatccggaaggcgctttgtggtga

SEQ ID NO: 21260 - RNA, 9879 nt, synthetic construct
  misc_feature 1..9879: note = derived and/or modified CDS sequence (opt6) from DENV-1__HQ166036__SS-prME
  source 1..9879: mol_type = other RNA
agtgtaaccatgttattgatgttattgccgacagcattggcatttcaccttacaacgagagggggagaaccacatatgatagtaagtaaacaagaacgcggaaaatcactcttgtttaaaacatcagcaggggttaatatgtgtactttaattgccatggatttaggagaactatgtgaagatacgatgacctataaatgcccacaaattacagaagcagaacccgacgacgtagactgctggtgcaacgctactgatacatgggtaacatatggaacctgttcccaaacaggtgaacaccggagagataaacgttctgtcgcgcttgcaccgcacgtaggtctagggttagaaacaagaacggaaacttggatgtcgagtgaaggtgcatggaaacaaattcaaagggtagaaacatgggcgttaagacatccaggtttcacagtaattgcattgtttctggctcacgctattggaacaagtataacccagaaaggcataatcttcatattgctaatgttagtaacaccctcaatggcaatgaggtgtgttggaatagggaatcgagattttgttgaaggtttaagcggcgccacatgggtcgacgtagttctagagcatggaagctgtgtaacgacgatggctaaaaacaaaccaactttggacatagagctattaaagacagaagttacgaatccggcaatactccgtaaactatgtatagaagcaaaaatatcaaacacaacaacagactctagatgtccaacacagggagaagcgactctagtagaggaacaggatgcaaacttcgtatgtcgaaggacatttgtagatcggggttggggaaatggctgtgggttatttggtaaaggatcgctgctaacttgcgcaaagtttaaatgtgtaacaaaattagaaggcaaaatcgtacaatacgagaatctaaaatatagtgtcatagtgacagtacacactggggaccagcatcaggttggaaacgaaacaacagaacatggtacaatagctacgattacacctcaagcaccaaccagtgaaatacaattaacagactatggagctcttacactagactgctctcctagaacaggtctagactttaacgaaatggtgctgctaactatgaaagagaaatcatggttagtacacaaacagtggtttttagaccttccgcttccctggacatctggagcatccacatctcaggaaacttggaatagacaagatttacttgttacctttaaaacggcacacgcaaagaaacaagaagttgttgttctaggttctcaagaaggagctatgcataccgccttgactggagctacggaaatacaaacctccgggacgacgaccattttcgctggccatctaaaatgcagattaaaaatggacaaattaactctaaaaggcacaagttatgttatgtgtacaggtagttttaaattagagaaagaggttgccgaaactcaacatggcacagttttggttcaagttaaatatgaaggaactgacgctccttgtaaaataccattttccactcaggacgaaaaaggtgtcacacaaaacggaaggcttataacagctaacccaattgttacagacaaagaaaagcctgtaaacatcgaaacagagcccccttttggcgaatcctatatagtggtgggagccggtgaaaaggcattaaaactatcatggtttaagaaaggatcatcaattggtaaaatgttcgaagcaacggcacgtggagccaggcggatggcgatccttggagataccgcatgggactttggatcaataggtggcgtttttacttcggtagggaaactcgtacatcaagtattcggaaccgcctatggagttttgttctctggggtatcttggaccatgaagatcggtattgggatcctacttacatggctcggcctgaatagcagatcaacatctctctcgatgacttgcatcgcagtcggtatggtgacattatatttaggtgttatggtacaagcagattcagggtgtgtcataaattggaaagggcgtgaactaaaatgcggatcaggaatatttgtaactaacgaggtgcatacttggaccgaacagtacaaattccaagctgattcccccaaaagactttcggcagccattggaaaagcatgggaggaaggtgtgtgcggcatacgctcggctacgagattggaaaatattatgtggaagcaaatctccaatgagctaaaccatattttactggaaaatgacatgaaatttacagtagtcgtaggagatgctaatggaattttggctcagggcaagaaaatgatccggccgcagccgatggagcataaatatagttggaaaagttggggaaaagcgaagataataggggctgatatacaaaatacaacgttcataatagatggtccggatacacctgagtgccccgacaaccaaagagcatggaatatttgggaagtagaagactatgggtttggaatatttacaacaaatatatggctaaaacttagggattcatatactcaaatgtgtgatcatagactaatgagtgcagctataaaagactctaaagccgtacacgcagacatgggctattggatcgagtcagagaaaaacgagacttggaagctagcaagagcgtcattcatagaggttaaaacttgtacgtggccaaagagccatacactatggagtaacggtgtactagaatctgaaatgattattcccaagatatacggaggccctataagccagcataattataggccgggttacttcacacagacagcgggcccatggcacctaggaaaacttgaattagattttgatctctgtgaggggacgaccgtcgtagttgacgaacattgcgggaacagaggaccatctttacgcacgacaactgttactggtaaaattatacacgaatggtgctgccgttcatgtacactaccaccacttagattccgcggggaggacggatgttggtacggaatggaaatcagaccggtaaaggaaaaagaagaaaatcttgttcgatcaatggtgtcagctggatctggagaggttgatagcttttcattaggaatattatgtgcatcgattatgattgaagaagtaatgaggagtagatggtcaaggaaaatgttaatgactgggacgttagcagtattcctcctcttagttatgggccaactaacatggaatgatttaatacgcctgtgtattatggtaggtgccaatgcgagcgacagaatgggaatgggcactacttacctcgcattaatggccacgttcaaaatgagaccaatgtttgcagtcgggttgctgttccgaaggttaacaagtcgagaagtcctattattgacgattggactttcattagtagcatccgtggaactcccaaattcgctagaggaactcggagatggactcgcaatggggatcatgatgttaaagctcctcactgagtttcaaccccaccaattgtggacaactctattgagtctaactttcatcaaaaccacattgtcactggattacgcctggaaaaccactgcgatggccttaagtatagtatctttattccccttatgtctaagcactacatcgcagaaaaccacatggctgccagttttactcggttctttcggatgtaaacccttgacgatgtttcttataacagaaaacaaaatatggggacgaaagtcgtggccactaaatgaaggcataatggccatcggtatagtatccattttacttagctcacttcttaaaaatgacgttcccttggcaggtcccctgattgcaggagggatgcttattgcgtgttacgtaatttccggctcctctgctgacttatcgctagaaaaagctgcagaagtctcatgggaacaggaggctgaacactcaggaacaagtcataatattcttgtggaggtacaagacgacggaacgatgaaaatcaaagatgaagaaagagatgatacacttaccatacttctgaaagctaccttattagccgtttcaggggtatatcctatgtccatccccgcaactttattcgtatggtatttttggcaaaagaagaaacagaggagcggagtgctatgggacaccccgtcgccgcctgaagttgaaagagctgtattggacgatggtatctatagaatcttgcaacgggggctattaggtaggtcgcaagtgggggtgggagtcttccaggatggtgtatttcatacgatgtggcatgtaacgagaggagccgtactaatgtatcaaggtaaaagattagaaccgtcgtgggcttccgtgaagaaagatctaataagttatgggggaggctggagattcagaggctcttggaatactggtgaagaagtacaggtaattgccgtagaacctggaaagaaccccaaaaatgttcaaaccacgccaggaacttttaaaacaccggaaggagaggtcggggcaatcgccctagatttcaagcctgggacatcagggtcacctattgtaaacagagaaggaaaaatcgtgggattatatggaaatggggtagttaccactagcgggacatatgtgagtgcgatagcacaggctaaagcgtcccaagaaggacccctaccagaaatagaggacgaggtttttaagaaacggaacttaacaatcatggatttacatccaggaagtggaaaaactagaagataccttcccgcaatagtcagagaagcaataaaaagaaaacttagaactcttattctggctccaacaagagtggttgcaagtgagatggccgaagcgttaaaaggaatgcccatccggtaccagaccactgcagttaaatcggagcacactggccgagaaattgtggatttaatgtgtcacgcgactttcacgatgagattacttagtcctgtaagagtaccgaattacaatatgattatcatggatgaggcacatttcactgaccctgcttcgatagcagcaagaggatatatttccacaagggtcggaatgggcgaagcagcagcgattttcatgacagcgacacccccaggatcggttgaggcttttccacagtcaaacgcggtaatacaagatgaggagcgagacatcccagaacggtcctggaatagcggatatgattggataacggactttcccggaaagacggtttggtttgtaccttcaatcaaaagcggtaacgatattgccaattgtttgaggaaaaatggtaaaagagtgatccaactctccagaaagacgtttgatactgaatatcagaaaactaaaaataatgactgggattatgtggttaccacagatataagtgagatgggagcaaatttccgagcagaccgagtaattgatcccaggaggtgtttaaaaccagtaatattaaaggatggtcctgagagggtaatactagccgggcctatgccagttacggttgctagtgcagcacagaggagaggaaggataggacgaaatcaaaacaaagaaggggatcaatacgtgtacatgggtcaaccactgaacaacgatgaggaccacgcgcattggactgaagctaaaatgctactcgacaatataaacacaccagaaggaataatacctgcgttattcgaacctgagagggaaaaatcggctgccatagacggtgagtatagattgcgaggcgaagcaagaaaaactttcgttgaattgatgaggagaggagacctcccagtttggctaagttataaggttgcctcagaaggattccaatactcagaccgccgttggtgctttgacggggaacgtaacaatcaagttttggaagaaaatatggacgtagagatatggacaaaagaaggcgagagaaagaaactaagaccaagatggctcgacgcaagaacatattcagatccactggctttaagagagttcaaagagttcgcagcgggaagacgatcggtctctggagatctcatattggaaattggcaaactaccacaacacctaacttcacgggctcagaatgctctagacaacttagtaatgttgcataactcagaacagggaggaaaggcctaccgtcatgcaatggaagaattaccagacacaatagagaccttaatgttattagccttaattgctgtactcactggaggagtaacactgtttttcctaagcggaaagggactgggaaaaacctcaataggactcctatgcgtaacagccagttcagctctattatggatggcatctgtagaacctcattggattgcggcatcaataatcctagagttcttcctaatggtcctattgataccagaaccagatcgacaaagaacacctcaagataatcaactcgcatacgtagtaatcggactattattcatgattctcaccgtagcagcaaatgaaatgggcttgctagaaacaacaaagaaagatttaggaatcggtcatgtcgcagcagaaaaccatcaacacgcgactatgttagacgtagacctaagaccagctagcgcatggacactatatgcggtggcaactacagtaattacaccaatgatgagacacactatagaaaatacaactgccaacattagtttaactgcaatagcaaatcaagcggctatattaatgggattagacaaaggatggcctatatcaaaaatggacataggggtacctttactggcccttggttgctatagccaagtgaatccattaacattaacggcggctgtattaatgctggtcgcccactacgcaataataggcccaggcctacaggctaaagcgacaagagaagcccagaaacgaacagctgcaggaatcatgaagaatcctacagtagatggaatcgtcgcaattgaccttgatcctgtagtatacgacgctaaattcgaaaagcaattgggtcagataatgctactcatcttatgcacttcgcaaatattactgatgcggacaacatgggcactctgtgaatcaataacgcttgcaactggcccccttaccacgttgtgggaaggaagtcctgggaaattctggaatacaacaatagcggtatcaatggcgaacatattccgtggatcttatctggcgggagcaggattagcattttctcttatgaaatcattgggtggaggacgcagaggaactggggcgcagggggagactttgggagaaaagtggaaacgacaattaaatcagttatctaagagtgagttcaatacatataaacgctcaggtattatggaagtagatcggtccgaagcaaaggaaggtctgaaaaggggagaaactacaaaacatgctgtcagtagaggtacggcaaaacttagatggttcgtagaaaggaacttagtgaaaccagaaggtaaggtaatagacttaggctgtggacgaggaggctggtcttattattgcgcggggctcaaaaaggtaacagaagtgaaaggttataccaaaggaggaccaggtcatgaagaaccaattcctatggccacgtatggctggaacctggtaaaactacatagtggaaaagatgtcttcttcatgccccctgagaaatgcgatacacttctatgtgacataggggaaagttcgcctaatccaacaatagaagaaggacgcacactacgagtgctgaaaatggtagaaccctggctcaggggaaatcagttctgcatcaaaatattgaacccgtatatgccatcagttgtcgagactctagaacagatgcaaagaaaacacggtggaatgttagtcaggaatccactaagtagaaattcaacacacgaaatgtactgggtctcgtgcggaacgggtaatatagtctccgctgtcaatatgacttcacgaatgctattaaacaggttcacaatggcgcacagaaaacccacttatgagagagacgtagatttaggtgcgggaactaggcacgttgccgttgagcctgaggtcgctaacctggatatcataggacaacgcatagaaaacatcaaaaatgagcacaaatcaacgtggcactacgatgaagataacccgtataaaacttgggcttaccacggaagttacgaagttaaaccgtccggatcggctagctcgatggtgaatggggttgtaagactattaactaaaccatgggatgttatacctatggttactcaaattgcaatgacagatactacacctttcggacaacagcgagtgtttaaggaaaaagtcgatactcgaacaccaagagcgaaacggggaacaactcaaataatggaagtgactgcgaaatggttatggggatttttatcacgaaataagaaaccacgaatatgtacaagagaggaatttactagaaaagtacgcagcaatgctgcaataggagcagtcttcgtagatgaaaatcaatggaacagtgcaaaagaagctgtggaagatgagagattttgggatctcgtgcacagagagcgagaactacataagcagggcaagtgtgcaacatgcgtatacaacatgatgggaaaacgggagaagaaattgggagaatttggcaaagcgaagggttcccgcgcaatctggtatatgtggcttggtgcacgatttctagagttcgaagcgttaggttttatgaatgaagatcattggttttcaagggaaaatagtttaagcggtgtagaaggcgaaggactgcacaaattagggtacattctcagagacattagtaagataccaggaggaaatatgtatgctgatgacaccgcaggctgggatactagaatcacagaagatgacttacaaaacgaagctaagataaccgagataatggaaccggagcatgcgctacttgccacatccatctttaagttgacttatcaaaataaagtagttcgagtacaaagaccggccaaaaacggcacagtaatggatgttataagcagaagggatcagagaggatcagggcaggttggcacatatgggttgaatacttttacaaatatggaggtccaactaatccgtcaaatggaaagcgaaggtatatttctgccgtccgagcttgagacaccaaatttagcagaaagggtgctagattggttagaaaaacacggagcagagcggttaaaacgaatggcaatctctggtgacgattgtgtcgttaagcctatagatgatagattcgcaactgcattaacagcgctaaatgacatgggtaaagtaaggaaagacatcccacaatgggagccgtccaaagggtggaatgattggcaacaagtacctttttgtagccaccatttccatcaactgattatgaaagacggtcgagaaattgtagtgccttgccgaaatcaggatgagctagttggacgtgcgagagtctcgcaaggggcgggttggagcttacgagaaacagcgtgcctaggaaaaagctatgcacagatgtggcaattaatgtatttccatagacgggatttgcgtctggcagcaaacgcaatatgtagtgccgtgcccgtagattgggtccctacttcaagaacgacctggagtattcacgcgcatcatcagtggatgacaaccgaggacatgttaagtgtctggaaccgcgtttggatcgaagaaaacccttggatggaagataaaacccatgtaagttcgtgggaagaggttccgtacttaggaaaaagagaagaccaatggtgtggatctctgataggtttgactgctagggctacctgggccacgaacatccaggttgctatcaatcaggttcgacggttgataggaaacgaaaattatcttgactatatgacctcaatgaagcgctttaagaacgagtctgatccggagggagcactttggtaa

SEQ ID NO: 21261 - RNA, 9879 nt, synthetic construct
  misc_feature 1..9879: note = derived and/or modified CDS sequence (opt6) from DENV-1__GU131981__SS-prME
  source 1..9879: mol_type = other RNA
tcagtaacaatgttacttatgctcctgcctacagcactcgcattccaccttacgacaagaggaggtgaacctcatatgattgtatctaaacaagaaaggggaaaaagccttctgttcaaaacaagtgcaggcgtaaatatgtgcacattaatcgcaatggacttaggagaattgtgcgaagacacaatgacatacaaatgtccccaaataacggaagcagaaccggatgatgtagattgttggtgcaatgccacagatacgtgggttacatacggtacatgtagccaaacaggcgaacacaggcgtgataaaagatctgtggcattagcacctcacgttggccttggtcttgaaacacggacggaaacatggatgagcagtgaaggggcctggaaacaaattcaacgagtggagacttgggctttgagacatcctggatttaccgtgattgctctatttttggcacacgcaataggcacgtccattacgcaaaaaggaatcatttttattttgcttatgctcgttactccctcaatggcgatgaggtgtgtaggaattgggaacagagatttcgtagagggattatctggagcaacttgggtagacgtcgtgttagaacacggaagctgcgtaacgacaatggccaaaaataaaccaaccttagatatcgaactacttaaaactgaagttacaaacccagccattctccgaaagctatgtattgaggctaagatctccaacactaccactgattcaaggtgtcccacgcaaggtgaggccaccttagtagaggaacaagacgcaaatttcgtctgcaggcgtacattcgtagatcgagggtggggaaacggctgcggactttttggaaaaggtagtttactaacgtgcgccaaattcaaatgcgtcacaaaactagaaggaaaaatagtgcaatacgaaaacctgaaatacagtgtcattgttacggtacataccggagatcagcatcaagtaggtaatgaaactacagaacatggaacgattgctacaattacgccacaggctccgacctcggaaatacaactcacggattacggcgctttaactttagattgttcacctcgaaccggattagactttaatgaaatggtattgcttacgatgaaggaaaaatcatggttggttcacaaacaatggtttttagatttaccactgccatggacatccggcgcatcaacttcgcaagaaacttggaatagacaagatcttcttgttacatttaaaactgcgcacgcaaagaagcaagaagttgttgttctagggtcacaagagggagcaatgcatactgcactcacgggagcaacggaaattcagacatccggaacgaccacaatcttcgcgggtcacctaaaatgccgactcaaaatggacaaactgactttaaaaggtacttcatatgtaatgtgtacaggatcgttcaaattagaaaaagaagtggcggaaacccagcatggtacagtcttagtccaagtgaaatacgagggaactgacgcaccgtgtaagatccccttcagtacacaggatgaaaaaggcgtcacacaaaatggaagacttataacagctaatcccattgttaccgataaagaaaagccagttaatatcgaaaccgaacctccgttcggcgagtcgtacattatggtaggtgcaggagaaaaagcactgaaactttcgtggtttaagaaaggcagtagcataggaaagatgtttgaagctacagcccgaggggctcgaagaatggcgatcttaggcgatacggcatgggatttcgggtccataggtggagtctttacaagtgtaggtaaacttgttcatcaagtctttgggacagcttacggagtattatttagcggcgtctcatggactatgaaaattggaatagggatattacttacctggttaggacttaatagtcgatcaacctccctctctatgacatgtatcgctgttggcatggtgactctttacttaggagtaatggtccaagccgattctggttgtgttatcaattggaaagggagagaactgaaatgcggatcgggcatatttgtaacaaacgaagtacatacatggacagaacaatataaattccaggcagatagtccaaagagacttagtgcggcaataggcaaagcatgggaagaaggtgtttgtggtataagaagcgccaccagattggagaatatcatgtggaagcaaattagtaacgaattaaaccacatccttctagaaaacgatatgaaattcacggttgtagttggagacgcaaacggaatactggctcaaggaaagaaaatgattaggcctcaaccaatggagcacaaatacagttggaagtcttggggaaaggcaaagattattggtgcagacattcaaaataccacattcattattgatggtccagatacgcccgagtgcccagacaatcaaagagcatggaacatttgggaagtcgaagattatggtttcggaatctttacaacaaacatttggttaaagctgcgagattcatacacacaaatgtgcgaccaccggctaatgtcagcagcaataaaagattccaaagccgtacatgccgatatgggctactggattgagagcgagaaaaacgagacgtggaaattagcaagagcttctttcatagaagtaaagacttgtacatggccgaaaagtcatacactctggtcgaacggtgtactagaatctgaaatgattattccaaaaatctacgggggtccgatatcacaacataactatcgtccgggctactttactcaaaccgctggtccatggcacttaggtaagctagaacttgactttgatctttgtgaaggaactacggtcgtcgtcgatgaacactgcggtaaccgtggaccatcactaagaacaactaccgtgacgggtaaaattatccatgaatggtgttgtcggagttgtacattaccccctctccgtttccggggtgaagatggatgttggtatggaatggagatcagacctgtaaaggagaaggaagagaatctggtaagatcaatggttagtgcgggttccggcgaggtagacagtttttcgttgggaattttgtgtgctagcataatgatagaagaagttatgagatccaggtggtctagaaaaatgctaatgacaggcacattagcagtatttcttctattagtaatgggacaactaacttggaatgatctaattcgactatgtatcatggtaggagcaaatgctagtgatcgaatgggaatgggcaccacatatctagccctcatggctacattcaaaatgagaccgatgtttgccgtaggactactctttagaaggttaacatcaagagaagtcttattgctcactattggattatcattagtagcgagcgtagagctgcctaattcattagaagaactcggagacggactagctatgggtataatgatgctcaaattactaaccgagtttcagccccaccaattatggattactctcctgtccttaacctttataaaaacgacgctatctcttgactacgcatggaaaaccactgcaatggctttgagcatcgtatcattattcccactgtgtcttagtacaacaagtcagaaaacgacatggttaccagttctacttggttcgtttgggtgtaaaccactaacgatgtttctgattacagaaaataaaatatggggaaggaagtcttggccgttaaacgaaggtattatggctatcggaatcgtaagcatattgctatcctctctactgaagaatgatgtgcccttagccggacctctaattgcaggcggtatgttaattgcgtgttacgtaatatccggcagctcagcggacttaagcctagagaaagccgctgaggtaagttgggaacaagaggctgagcattctggaacaagtcacaacattctcgtagaggtgcaagacgacggaactatgaaaataaaagacgaagaacgagatgatacattgacgatacttctgaaagcaacattactagcggtctcaggtgtatatccaatgagcatacctgcaacactgtttgtatggtacttttggcagaaaaagaaacaaaggagtggcgtactttgggacacaccctcccctcctgaagtcgaaagagcagtcttagacgatggaatttatcgcatattacagcgtggtttgctaggaagatcacaggttggagtcggggtgtttcaagatggggttttccatacaatgtggcatgtaacccgcggagcagtacttatgtaccagggtaaacgccttgaaccgtcttgggcatcagttaaaaaggacctcataagttatggaggtggatggcgttttcaaggatcatggaatactggtgaagaagtacaagttatcgctgttgaaccagggaaaaatcctaaaaatgtacaaacaatgccaggtacattcaagactccagaaggcgaagtaggagcgattgcattggactttaaacctgggacatcgggaagtcccatagttaacagggagggaaaaatagtgggactatacgggaacggcgttgtgactacaagcggaacatacgtcagcgcaatcgcgcaagcaaaggcctcacaagagggaccgctaccggaaatagaagatgaagtgttcaagaaacgaaacctaaccataatggatcttcatccgggaagtggcaaaacgagaagatatttgccggctatggtacgtgaggccataaagcgtaaacttagaacactaatcctagcacctactcgtgtagtggccagtgaaatggcagaggcattgaagggtatgccgatcagataccagactacggctgttaaatcggaacatacgggtagggaaattgtagatttgatgtgccacgcaactttcacaatgagactattatcaccagttagggtgcccaactataatatgattatcatggacgaagcgcacttcactgacccagcatcgattgcagccagagggtatatctcaacaagagtcggaatgggcgaggcagccgccatatttatgaccgcaacaccgcctggatcagtagaggcttttccgcagtctaacgccgtgatccaagacgaagagagggatataccagagcgtagttggaatagcgggtacgactggataacagattttccaggaaagactgtatggtttgtaccctcaattaagagtggaaatgatatagcaaactgtcttcggaaaaatggaaaaagagtcatccaacttagtaggaaaacgtttgatacagaataccagaaaaccaaaaacaatgattgggattatgtagtcacgacagatattagtgaaatgggtgcaaatttcagagccgatcgagttatagaccctagaagatgtttaaagccagtcatactaaaagacgggccggagcgagtaatattagccggtccaatgcctgtgactgtagcaagtgcagcacaacgacgaggaaggataggacgtaatcaaaataaagaaggcgaccaatatgtttacatgggacaacctttaaacaacgatgaagaccacgcgcattggacagaagcgaagatgttattagataacataaacacccccgaaggaataattccagcattatttgaacctgagcgagaaaaatcggcagcgatcgacggagagtatcgattacgaggagaggcaaggaagacatttgttgagttaatgcgaagaggcgatcttcctgtttggttatcctacaaagtagcatcagaggggtttcagtatagcgatagacgatggtgttttgatggtgaaagaaataaccaagtcttagaagagaatatggatgtagaaatttggacgaaggaaggagaaagaaagaaattaagaccacgatggctagatgcgcggacatacagtgatccattagcactaagagaatttaaagaatttgctgctggtagacgaagtgtgtcgggtgatcttatacttgaaatcggcaaacttccacaacacctgactctgagagctcaaaatgccctggacaaccttgtaatgctacataacagtgagcaagggggtaaagcctacaggcatgctatggaagaacttccagacactatagaaacattaatgttattagcacttatagctgtactaactggtggcgtaacactattctttctatcaggtaaaggtttgggcaaaacttccatcggacttttgtgcgtcacagcgtcttccgcattattgtggatggcgtcagttgaaccgcactggatcgcggcttcaatcatactagaatttttccttatggttttgttgataccggaaccggatagacaaagaactccacaagataatcaactagcatatgtagtaataggattattatttatgatcttaacggtggcagccaacgaaatgggattgctcgaaacaacgaagaaggatctaggtatcggacatgtggcggcagaaaatcaccaacatgcgacaatgttagacgttgacctaagaccagcatctgcatggactctatacgctgtcgccacgaccgtaataactccgatgatgagacacactatagaaaatacaaccgcaaacattagcctcacggcaattgccaatcaggccgctattctcatggggttagataaaggttggccaataagtaaaatggatataggtgtgccattacttgccctagggtgttatagtcaagttaatcccttaacactcacagcggcagtattgatgctagtggcgcactacgctattattggaccagggctacaagcgaaagcaacaagggaggctcagaaacgcactgcagcaggaataatgaaaaatcctactgttgacggtatcgtagcaatagaccttgatccggttgtatacgacgccaaatttgagaaacaattgggccaaataatgttgcttatactatgtacatcccaaatattactaatgcgcaccacatgggcattatgtgaatcaataacgttggccactggaccgctcacaacgttgtgggagggatcaccgggcaagttctggaacacgaccatagctgtaagcatggctaacatttttcgaggatcttatctcgcaggagctggattggcctttagtttaatgaaaagtctcgggggaggtcgaaggggaacaggagcgcagggcgaaacattgggagaaaaatggaaacgtcagttgaatcaactgtctaaaagtgaatttaacacatataaacgaagtggtattatggaagtcgacagatcagaggctaaggagggactgaagagaggagaaacaaccaagcacgccgttagccgtggaacggcaaaactgcgttggtttgtggaacgaaaccttgtgaaaccagaaggcaaagttatcgacctaggatgtggacgaggtggctggagttattactgtgcaggtctaaagaaagtaacggaagtgaagggttataccaaaggtggaccagggcatgaagaaccaatcccgatggctacttatggatggaatttagtcaaattacactctgggaaagacgtattctttatgccaccagaaaagtgtgacacgcttctctgtgatattggagaatcatctccaaatccgacgatcgaagagggtcgtaccctaagggtcctgaagatggtagaaccttggttacgtggtaatcaattctgcatcaaaatactaaacccatatatgccgtctgtagttgagacacttgaacaaatgcaacgaaaacatggcggaatgctagtaagaaaccccttgtcaagaaactctactcacgaaatgtattgggtctcttgtggaacgggaaacattgtgtcagccgtaaacatgacttctaggatgttattaaatcggttcactatggcacatcgtaagcctacttacgagcgagacgtcgatctaggagctgggacacgtcatgtcgccgtagaaccggaagtagcaaacctagacataataggacagagaatagaaaacattaaaaatgaacataaatcaacttggcactatgatgaggacaacccatacaagacatgggcataccacggatcttacgaggtcaagccaagcggatctgcatcatcaatggtaaatggcgtagtgcggctgttaactaagccttgggacgtaatcccaatggtaacccaaatagcgatgacagacacgactccatttggtcaacaaagagtatttaaagaaaaggtagatacgcgaactccgcgtgcgaaacgtggaacaacacagatcatggaagttacagcaaaatggctatggggtttccttagtcgaaataagaaacctaggatttgcactcgcgaagaatttacaaggaaggtacgctcaaacgcagctataggggcagtatttgtggatgaaaaccaatggaactcagcaaaagaagctgtggaagatgaaagattttgggatttagtacatcgagagcgcgagcttcacaaacaaggtaaatgcgccacatgcgtatataatatgatgggtaaacgcgagaagaaactcggagaatttggcaaagcaaagggaagccgagcgatttggtacatgtggttaggagcgagatttcttgagttcgaagctctaggattcatgaatgaagatcattggtttagtcgggaaaatagcttatcaggtgtagaaggagaaggacttcacaagctaggttatattctgagggatatatctaaaataccaggaggtaacatgtacgcggatgatacagccggttgggatacgagaataacagaagacgatcttcaaaacgaggcaaaaattacagaaatcatggaaccagaacatgcgcttttggctacaagtattttcaagttaacctatcaaaataaagtggttagggtccaaagaccggccaaaaatggaaccgtaatggatgtaatatcacgccgggatcaaagaggatcaggacaagttggaacatatggtctaaatacgtttacgaacatggaggtccaacttataagacaaatggaaagcgaaggaatctttctgccaagtgaactagaaacaccaaacttggcagaaagggtactagattggctggaaaagcatggagctgagagattaaaacgtatggccataagcggggacgattgcgtggttaaaccaatagatgacagatttgcgacggccctaacggctctcaacgatatggggaaagttagaaaagatataccacaatgggagccaagcaaaggttggaatgattggcaacaggttccgttctgttcccatcattttcatcagctcataatgaaggatggcagagaaatagtagtaccctgtcgtaatcaggacgaattggttggtagggcacgagtatcacagggcgcgggatggtcactaagagaaactgcttgtttgggaaaatcctatgcccaaatgtggcaactaatgtatttccatagacgagacctaagattggcagccaatgctatatgttcagccgtaccagtggattgggttccaacaagccgaaccacttggtctatccatgctcatcatcagtggatgaccacagaggatatgctatcggtctggaacagggtttggattgaagaaaatccgtggatggaagataagacccacgtatcgagctgggaagaagtcccctacctaggcaaacgagaagatcaatggtgtggttcactaattggcttaacagccagagccacctgggcaacaaatatacaggttgctatcaaccaggtaagacgattaatcggtaacgaaaattatcttgattacatgacatccatgaagagatttaaaaacgaaagtgatcccgaaggagcattatggtaa

SEQ ID NO: 21262 - RNA, 9879 nt, synthetic construct
  misc_feature 1..9879: note = derived and/or modified CDS sequence (opt6) from DENV-1__GQ868529__SS-prME
  source 1..9879: mol_type = other RNA
tcggtcactatgttactcatgttacttcctactgctttagcgttccatttaaccacgagaggaggggaaccccatatgatagtttctaaacaagaaagaggtaaaagcctgcttttcaaaacgagcgccggagttaacatgtgtacactcatagcaatggatctaggagaattgtgtgaagatacaatgacttacaaatgcccgcagattacggaagccgaacccgacgacgttgactgttggtgtaacgccaccgatacgtgggttacttatggaacgtgttcacagactggcgaacaccgtcgagataaaaggagcgtcgctttagcaccccatgtaggtttgggattggaaacgcgaactgaaacatggatgagctcagaaggtgcgtggaaacagatacaaagggtggaaacttgggcattacgacacccaggcttcacagtcatagcattctttttagctcatgcaataggaaccagcattactcaaaaaggtataatatttattttattaatgttagttactcctagtatggctatgagatgtgtaggaataggaaacagagacttcgtagaaggattgtcaggggcaacttgggttgacgtcgtactcgaacatggaagttgcgtaaccacaatggctaaaaataaaccaacgcttgacatagaactgctaaagacagaagtcacgaaccccgcgatattgagaaaattgtgcatagaagcgaaaatttcaaatacaacaacagatagtaggtgtccaacacaaggcgaagccacattggtggaagaacaggatgccaattttgtatgccgtcgtactttcgtagataggggttggggaaatggatgtggtttatttggcaagggctccctattgacgtgtgcaaaatttaagtgcgttacaaaacttgaaggtaaaacagtacaatacgaaaacttaaaatattcggtcattgttacagttcatactggggatcaacatcaagttggcaacgagacaactgaacatgggacaatagcaactatcacaccacaagcacctacaagcgaaatccaattaacggactatggggcccttaccctggactgttcaccaagaacaggattggattttaacgagatggtcttattaacgatgaaagaaaaatcttggttagttcacaaacaatggtttctggatctgccattaccgtggacgagtggtgcttcgacatctcaggagacctggaaccgacaagacctgttagtgacatttaaaaccgcacatgctaagaaacaagaagttgtcgtcttggggagccaggaaggtgcaatgcacacagctctaacaggtgcgacagaaattcaaacatcaggaacaaccacaattttcgctgggcatttaaaatgcagacttaaaatggataaattgacactgaaaggcacatcctatgtaatgtgtacagggagctttaaattggaaaaagaagttgcagaaacgcaacatgggacagtattagtgcaagtaaaatatgaaggtactgatgctccttgcaaaattccattctcaacacaggacgaaaaaggggttacccaaaacggaagattgatcacggctaatcccatagttacagacaaagagaaaccagtaaacattgaaactgaaccaccctttggtgaatcttacatagttgtaggggcaggcgaaaaagccttgaaactgtcctggtttaagaaaggtagcagcataggaaaaatgtttgaggccacagccagaggcgcaagacgtatggctattttaggcgacaccgcttgggactttggttcgattggaggggtctttacaagtgttggaaaacttgttcaccaggtatttggcactgcctacggagttctttttagtggggtatcatggacgatgaaaattgggataggtatattacttacgtggttgggtctaaacagcagaagtacatcattaagtatgacttgtatagccgtcggtatggtaacactttatctaggcgtaatggtccaagcagattcagggtgcgtaataaattggaaaggccgtgagttgaagtgcgggagtggaattttcgtgacgaacgaagtgcatacgtggacagaacagtataagtttcaagcagactctccgaaaagattgagcgcagcaataggaaaagcctgggaagaaggcgtatgtggcattcgatctgcaactcgtctcgaaaacataatgtggaaacagataagtaatgaattaaatcatatactattagaaaacgatatgaaatttacagttgtagttggcgacgcaaacggtatactcgcgcaaggcaagaaaatgataaggccacaacccatggaacacaagtacagttggaagtcatgggggaaagcgaaaattataggtgctgatatccaaaacacgacatttataatcgatggtccagatactcctgaatgtcccgacaatcagagagcttggaatatctgggaggtagaagattacggatttggaatctttacgacgaacatttggctaaaattacgagatagttacacccaaatgtgcgaccacaggctcatgagcgcggcaataaaagatagtaaggcagttcatgctgacatgggttattggatagaatcggagaaaaatgagacatggaaattagctagagcctcctttattgaagtaaaaacgtgcacttggcctaaatcccatacattatggtctaatggtgtccttgaatcggaaatgataatcccaaagatatacggagggccaatcagccaacataactatagaccaggctactttacacaaatagcgggtccatggcatttgggcaagttagaattggactttgatttgtgtgaaggtacaaccgtagttgtagatgaacattgtggtaatagagggccatctttgcggaccaccaccgtcacgggaaaaataatccatgaatggtgctgtcgatcatgcacccttccacctctacgatttagaggagaagatggctgttggtatggaatggaaataagaccagtaaaagaaaaagaagaaaacctcgtgagatcaatggtatcagcaggatcaggagaggttgatagtttcagccttggtattttatgcgctagcattatgattgaagaggtaatgcgatctagatggagcagaaagatgttaatgaccggaacactggcagtatttttgttattggtcatgggtcaattaacttggaatgacttaataaggttatgtataatggtcggagctaatgctagtgatagaatgggtatgggaacaacgtacttggctttaatggcaaccttcaaaatgcggccgatgttcgcagttgggctactttttagaagactgacaagtagggaagtccttttgctgaccatcggcttatctcttgtagcgagtgtagaattgccaaattcgttagaagagttgggagacggcctagcaatgggaattatgatgttaaaactgctaaccgagttccaaccccatcaactatggactaccttactatccttaacatttatcaagacaactctcagtttggattatgcttggaaaacaacggcgatggcactaagtatagtatcgctatttccattatgcctctctacaacaagtcagaaaacgacgtggttgccagttttattagggagctttggctgcaaaccactgacaatgtttctcataaccgaaaataaaatctggggtcgtaaaagctggccgttaaatgaaggaatcatggcaataggaatagtatctatattgttatcctccctccttaaaaatgatgtcccgctagccggtcctcttattgcgggaggaatgctaattgcatgttacgtcatctccggttcgtcggcagatttatcgttagaaaaggcagccgaagtatcgtgggaacaagaagcagaacatagcggaacaagtcacaacatattagtagaagtacaagacgatggtaccatgaagattaaggatgaagaacgtgatgataccttaacgatccttttaaaggccactctcctagctgttagtggagtctaccctatgtcaatccctgccacgctatttgtatggtatttttggcagaaaaagaaacaaagaagtggtgttctttgggatacaccgtcaccaccagaagtagaaagggcggtattggatgatgggatatatagaattttacagaggggactgctgggtcggtcacaagtgggtgttggagtttttcaagacggagtatttcatactatgtggcatgttacaaggggagctgtattgatgtaccagggtaaaagattagaaccaagttgggcatctgtaaagaaagatttaatcagttatgggggcggatggagattccaaggcagctggaatactggagaagaagtgcaagtgattgccgtggaaccaggtaaaaacccgaaaaatgtacaaacaacaccgggaacttttaaaactccagaaggtgaagtaggggcaatcgcccttgatttcaaacccggaacgtcagggtctcctatcgtaaatcgggagggcaaaattgtggggctttatggaaatggtgtggtaacaacatcgggaacctatgtaagcgcaatagcacaggcaaaagcatctcaggaagggccccttccggaaatagaagatgaagtattcaagaaacgcaacttaactataatggatttgcaccccgggtcaggtaaaacaagaaggtacttacccgctatggttagagaagctataaaacgaaagttacgaaccctgatcttagcacctacgagagtagtagcctcagagatggccgaagctctaaaaggcatgcctattcgataccaaactacagcggtcaaatcagaacacacagggagggaaatcgtagaccttatgtgccatgcaactttcacaatgagactactttcgcctgtgagagtgccaaattacaatatgataataatggacgaggcacatttcactgatccagcatctatagcggccagaggatatataagtacaagagtgggcatgggcgaagcagctgcaatatttatgactgcgacaccgcccggttccgtagaggctttccctcaatcaaatgctgttatacaggatgaagaaagagatattcctgaacgctcttggaactccggttatgactggatcacagattttccaggaaaaaccgtatggtttgtcccctcaataaaaagtggtaacgatatcgctaactgtttacgtaaaaacggaaaaagggtgatccaattaagtagaaagaccttcgatactgaataccagaagactaaaaataatgattgggactatgtagtgacaacagacatatcagaaatgggtgcgaatttcagggccgaccgtgtaattgatccaagaagatgcttgaagcccgtgattctaaaggatggaccggaaagagttatcctggcggggccgatgcccgttacagtagctagcgcagcgcaaagaaggggtagaataggtagaaatcagaacaaagaaggcgatcaatatgtgtatatgggacagcctctgaataatgacgaagatcatgcacactggacagaagcaaaaatgcttttagacaacataaatactccagagggaattataccagccttgttcgaaccagaaagagagaaaagtgcagccatcgacggcgagtacagacttcgtggtgaagctagaaaaacatttgttgaactaatgagaagaggagacctaccagtatggttatcatacaaggtcgcgtctgagggatttcaatacagtgatcggagatggtgtttcgacggagaaagaaacaaccaagtattagaagaaaacatggatgtagaaatttggaccaaagaaggtgagaggaagaaattgagaccaagatggctagacgcaagaacatacagtgatccactcgcgttacgagaatttaaagaatttgcagccggaaggagatccgtaagcggagatcttatgttagaaattggaaaattaccacaacatttaactctaagagcacaaaatgcccttgataatctggttatgctacataacagtgaacaaggcggaaaagcatatcgacatgcaatggaagaattgccagataccatcgaaactttaatgttgttggcattaatagcggttctgaccggcggtgtaacactatttttcttatctggaaaagggctcgggaagacctctattgggcttctctgcgttactgcgtcctccgcattgctatggatggcctcagttgaaccacattggatcgcagcatctataatcctggagttcttcttaatggtactactcataccggaaccggatagacaacgtacacctcaggacaatcaattagcatacgtggttataggactactatttatgatattgacagttgctgctaatgagatgggcttactagaaaccactaagaaagacttaggaatcggacatgttgctgctgaaaatcatcaacacgcgaccatgctagacgtagatctacgacctgcatcagcctggactctatacgccgttgcaactactgtcatcacaccgatgatgcgtcacacgatcgaaaacaccacagccaacatcagtttgactgcgatcgcgaatcaagcggcaatattaatgggcctcgacaaaggatggccaatttctaagatggatatcggagtaccgttattagcacttggatgttactcacaagtaaatccattgacactgaccgctgcggtcctaatgctagtcgcacattacgcaattattggcccgggacttcaagccaaggccacacgtgaagcacaaaaacggacggcggccgggataatgaaaaatcctaccgtcgatggcatcgttgcaatcgacttagacccggtggtatatgacgcgaaatttgaaaagcagttgggacagattatgttattaatactttgtacttcccaaattttactgatgcggactacgtgggcgttatgcgaatcaataacactggcgactggccctctcactacattatgggagggatctcccggaaaattttggaacaccacgatcgcggtgagcatggccaacattttccgagggtcatacttggccggggccgggttggccttttcactgatgaaaagtctaggtggcggaaggaggggcacaggagcacaaggagaaacattgggtgaaaaatggaagcgacaacttaaccaattgagtaaaagcgagttcaacacctacaaaagatcgggtataatggaagtcgatcggagtgaagcaaaagagggtctaaagcgcggagaaacgacgaaacatgcggtttctcgaggaacggcaaaattgcgttggttcgtggagcgaaatcttgtaaaacccgaaggcaaagtcattgacttaggctgcggaagaggagggtggtcgtactattgtgctggcctaaagaaagtgacagaggtaaaaggttatacaaaaggaggtcttggtcatgaagacccaatacccatggctacatatggatggaaccttgtaaagttactagccggaaaagacgtattctttatgccccctgaaaagtgcgatacgcttttatgcgatataggagagtcgtcgccgaaccctacaatagaagaaggtagaacattacgagtactgaaaatggttgaaccgtggctgaggggaaatcagttctgtataaagattctaaacccgtacatgccaagtgtcgtcgaaactctagaacaaatgcaaagaaaacacggaggcatgttagtccggaatcctttaagccgcaatagcactcacgaaatgtactgggtttcatgtggtactggaaatatcgtctctgctgttaatatgactagcagaatgctattaaatcgctttactatggcccataggaagcctacttacgaaagagatgtcgacctaggcgctggaacacgtcatgtagcagtagaacccgaggttgcgaatttggatataattggacaaaggatcgaaaacatcaaaaatgaacataaatcaacatggcattatgatgaagacaacccgtacaaaacatgggcataccatggaagctacgaagttaaacctagcggaagcgcctcgtcaatggtcaatggggtcgtccgactattaactaaaccatgggatgtaatacctatggtcacacaaatcgctatgactgatacaacacccttcggacaacaaagggtttttaaggaaaaagtagacacgcgtacacctagagctaaacgaggtacaacacaaatcatggaagttaccgcaaagtggctttggggatttttgtcacgaaataaaaagcccagaatatgcacaagagaagagttcacgaggaaagtacgcagcaacgctgctattggcgcagtatttgttgatgagaatcaatggaactctgctaaggaagcggtcgaagatgaacgattttgggacctagttcatagagaaagagaacttcacaaacaaggaaaatgtgcaacctgtgtttataacatgatgggaaaaagagaaaagaaattaggtgagttcggaaaggcaaaaggtagccgagcaatatggtatatgtggttaggtgcgcgatttctagagttcgaagctctaggattcatgaatgaagatcattggttttcgagagaaaatagtttaagtggggtagaaggtgaaggattgcataaacttggttatattttgagagatataagcaaaattccaggcgggaatatgtacgcagatgacacggcagggtgggatactagaataacagaagacgatttacaaaacgaagcaaaaataacagagattatggagccagaacacgcattgttagccacttcaatctttaagctaacgtaccagaacaaggtggttcgggtacagagacctgcaaagaacgggacagtcatggatgtaatatctagaagagatcaaagaggatcgggacaagttggaacatatggattaaatacttttaccaatatggaagtacagctaattcgacaaatggaatccgaaggtatattcttacctagcgagcttgaaacgccaaatttagcagaacgtgtacttgattggcttgaaaaacatggtgcagaaagactaaaaagaatggcaatttcaggcgatgattgtgtcgtaaaacctatagatgaccgtttcgcgacagccctgaccgctctcaacgatatgggcaaagtcagaaaggacatacctcagtgggagccaagcaaaggctggaacgattggcaacaagtaccattctgctcccatcatttccatcaattaataatgaaagacggaagggaaatagttgtcccatgtcgtaaccaagacgaacttgtaggacgagcaagagtgagtcaaggagctggatggagtctcagagaaacagcttgtctaggaaaatcctatgcccaaatgtggcaactaatgtattttcaccgacgtgacctgagattagcagcgaatgcgatatgtagcgctgtgccggtcgactgggtgcctacaagccgcactacttggtcgatacacgcccaccatcaatggatgactacagaagatatgctaagcgtctggaatagggtgtggatagaggagaatccatggatggaggataaaactcatgtatcctcatgggaagaagtaccatatctaggtaagcgggaggaccaatggtgtggaagtctcataggtctaacagcccgagcaacgtgggcgacgaatatacaggttgcgataaatcaggtccggcgattgatagggaacgaaaattatctagattatatgacttctatgaagcgatttaagaatgaaagtgacccagaaggagcgctgtggtaa

SEQ ID NO: 21263 - RNA, 9879 nt, synthetic construct
  misc_feature 1..9879: note = derived and/or modified CDS sequence (opt6) from DENV-1__GQ868531__SS-prME
  source 1..9879: mol_type = other RNA
tctgttacgatgctcctaatgctcctacctactgcacttgcttttcatctaaccacgagaggaggagaaccgcacatgattgtgtcgaaacaagaaagaggaaagagcttattatttaaaacaagtgctggagtaaacatgtgtaccttaatcgcaatggatttaggagaactatgtgaagatacgatgacatataaatgtccacaaataactgaagcagaaccagacgatgtagattgctggtgtaatgcgacagatacatgggtaacatacggaacctgttctcaaacaggcgaacatcgccgtgataaacgatcggtagcattagcgccccacgttggacttggattagaaacgcgaacagaaacttggatgtcgagtgaaggggcatggaaacaaatacaacgcgtagaaacctgggcgctaagacacccaggatttacggtaatcgctctcttcttggcacacgccattggaacgagcataactcaaaaagggataatatttatcctcttaatgttggtcacacccagtatggcaatgcggtgcgtaggaattggaaaccgagatttcgtcgaaggacttagtggagcaacatgggtcgatgtagtcctggaacatggatcttgcgtaactaccatggccaaaaataaacctactttggatatagaattgttaaaaacagaagtgacgaacccagccatacttagaaaactttgcatagaagcaaaaatatccaacactactactgattcgcggtgtccaacacaaggagaagctacattggtagaagaacaggatgcgaacttcgtttgcagaagaacctttgttgatagaggttggggaaacggttgtggtctctttggaaaaggcagcctcctgacttgtgctaaattcaaatgcgtaacaaaactggaaggaaaaatagtccagtatgagaatctaaaatactcagttatcgttactgtgcatacaggcgatcaacaccaagtgggaaatgaaactacagaacatggtacgatagctacgataacgcctcaagctcctacgtcagaaatacagctgactgattacggagcattaacattagactgttcaccccgaacaggacttgactttaatgaaatggtactgctaacaatgaaagaaaaatcttggctagttcataaacaatggtttttagatctgccattgccgtggaccagtggagcttcaaccagtcaagaaacttggaatcggcaagacttactggtaacatttaaaaccgcacatgctaagaaacaagaagtcgtagtgctcggaagccaggagggagcaatgcatacggcattgaccggagcaactgaaatacagacaagtggcacaaccaccatcttcgcaggccatttgaaatgcaggctaaaaatggataaattgaccttaaaaggcactagctacgtcatgtgtacaggcagcttcaaactagaaaaagaagtggctgaaacgcaacacggaacagtgctagtacaagtaaaatatgaaggcacagatgcgccatgtaaaattcccttttcaactcaagatgagaaaggggtaacccaaaatggacgattgattacagcaaacccgattgtcacggataaagagaagccagtaaatatcgaaacggaaccaccatttggagaatcatacatagttgtaggcgcaggagaaaaggcactaaagctctcctggtttaagaagggatcctctatagggaaaatgttcgaagcaacggcaaggggcgccagaaggatggctattttaggagacacagcgtgggattttggtagtataggtggtgtatttacttcagttggtaagctagtccatcaagtttttgggactgcatatggcgtattgttcagtggcgtatcttggaccatgaaaattgggattggtatattactaacctggttgggccttaattcacggtcaacatcacttagcatgacgtgtattgctgttggaatggttacattatatttaggcgttatggttcaggccgacagtggctgcgtaattaattggaaagggagagagttaaaatgtggttcagggattttcgtcacaaatgaagttcacacttggacagaacaatacaagttccaagcagactcgcctaaacgtcttagtgcggctatcggaaaggcttgggaagagggagtttgtggcatcagatccgcgactagattagagaatattatgtggaagcagatcagtaatgagttaaaccacatattacttgagaacgatatgaaattcacagtagtcgtaggcgatgcaaatggaatattagcgcaaggcaagaaaatgataaggccccaacctatggaacacaaatattcatggaaaagttggggaaaggcaaaaataattggagctgatattcaaaacacaaccttcatcatcgacggccctgatactccggaatgtcccgataaccaacgagcttggaatatctgggaggtagaggactacggattcggcatatttacaacgaacatctggttaaagctaagagactcgtacacgcaaatgtgcgatcacagattaatgtcagctgctataaaagatagtaaagcagtccacgctgatatgggatattggatcgagagcgagaaaaatgagacttggaaattggctagagcctcgtttatagaagtaaaaacatgtacttggcccaaatctcatacactatggtctaacggggtgttagaaagtgaaatgatcatacctaagatttacggtggccccataagccagcataactataggcccggatattttactcaaaccgcaggcccttggcatttaggaaaattggaacttgacttcgatctttgcgaaggaactaccgttgtagtagatgagcactgtggaaatcgtggaccgagtcttcgcacaacaactgtaacaggcaaaataatacacgagtggtgttgcagaagttgtacattacccccgttaaggtttcgaggagaagatggatgttggtatggcatggaaattcgcccagtaaaagaaaaagaggagaatctagttcgatcaatggtgagcgctggatccggggaggtagattcattttcactaggaatcttatgtgtctcgataatgatcgaagaagtaatgagatcccggtggtctagaaagatgttaatgaccggcacattggcagtattcctgttgttagtaatgggccaactaacatggaatgacctcatacgcctttgtataatggtaggcgcaaatgcatcagacagaatgggaatggggacgacgtatctagcgttgatggcgaccttcaagatgagaccgatgtttgcggtaggactcttatttagacgtctaacatcgagagaggtactacttttaaccataggactatctctagtagctagcgttgaattaccaaactcacttgaagaacttggggatggtctagccatgggcattatgatgcttaaattgctaaccgaatttcaaccccatcagttatggactactctcttatcactcacatttataaaaactacactaagtttagattatgcatggaagacaaccgcaatggccttgtccatcgtatcattatttccactttgtctttcaacgacaagtcagaaaacaacatggttacccgtgctattaggttcatttgggtgcaaacctttaacaatgtttttgataacggaaaataaaatctggggccgcaagtcgtggccattaaatgaaggtataatggctattgggattgttagcattttgctgtcctctctattaaagaatgatgtacctttagccggtccattgatcgcaggaggaatgctcatcgcctgctatgttattagtggatctagtgctgacctgtcattagaaaaagcagcggaagtaagctgggaacaagaggctgaacactcaggaacttctcataatatactggtagaagtacaagatgacggtactatgaaaatcaaagatgaagagagagatgatactctaactatacttttaaaagcgacgttgttagcagtaagtggtgtctatccgatgtcaatcccagcaactctatttgtttggtatttttggcagaagaagaaacaaagaagtggggttctctgggatacaccaagtccacctgaagtagaacgcgccgtacttgacgacggaatctatagaatacttcagcgaggtcttctaggtagaagccaagttggtgtaggagtatttcaagatggggttttccatactatgtggcatgtaactagaggagccgttttaatgtaccaaggaaaacgtttagaaccatcctgggcatcagtgaaaaaggacttaataagctacggtggtggttggcgttttcagggatcatggaacactggagaggaggtccaagttatagctgtggaacctggcaaaaatcccaaaaatgtccaaactacccccggaacatttaagactccagagggtgaagtgggggctatagcattagattttaaacccgggacaagtggaagccctatagtaaaccgagaaggtaaaatagtaggattatacggcaatggagttgtcacaacatcaggaacctatgtatcggctatcgcacaagcaaaagctagccaagagggtccgttgcctgaaatagaagatgaagtattcaagaagagaaatttaacgataatggatctgcacccgggatcaggtaaaactcgacgatatttgccagcgatagtcagagaagcaattaagagaaaactccggactctgatactcgcccctacgagagttgtagcgagtgaaatggcggaagctctaaaaggtatgccaatcagatatcaaacaactgcagtaaaatctgaacatacaggacgtgaaatagtagatttaatgtgtcatgcaacttttacaatgcgattgctttctccagtaagagtcccaaattataatatgataataatggatgaggcgcattttactgatccggcatcgatagccgcacgcggctacataagtacccgtgttggaatgggggaagcagctgcaatatttatgacagcaacgccacccggaagtgttgaagcattcccgcagtcaaatgcagtaatacaggacgaggaacgggacattcccgaaagaagctggaacagcggctatgattggataactgactttcctggtaaaactgtctggtttgtgccttctattaaaagcgggaacgatatagcgaattgcttaaggaaaaacgggaagcgtgttattcagttaagtcgtaaaacatttgatacggagtatcagaaaacaaagaataatgactgggattacgtagtaacaacggatattagtgaaatgggcgccaactttcgtgcggacagagtgatagatcctagaaggtgcctgaaaccagtaatattaaaagacggaccagaacgcgtaatattagcaggtccaatgcctgtcactgttgcctcagctgcacaacgtcggggaagaataggcagaaaccagaataaagagggagaccaatacgtatacatgggacaaccactaaacaatgacgaagaccatgcccattggaccgaggccaagatgcttctagataatatcaatacaccagaaggaatcattcctgcattatttgaacccgaacgtgaaaaatcagcagctattgatggggaatataggcttcgtggagaagcacgtaagacatttgtcgaattgatgaggagaggagatttgcctgtgtggctcagttacaaagttgcaagcgaaggctttcagtactctgataggcgttggtgtttcgacggtgaaaggaataatcaggtattagaggaaaatatggatgttgagatatggacaaaagaaggtgaaaggaagaaattaagaccaagatggctagatgcccgcacatactctgacccactagccttaagggaatttaaagaatttgcagcaggtagaaggagtgttagcggcgatctgatacttgaaatcggaaaacttcctcagcatctaacattgagggcacaaaatgctctggataaccttgttatgttacacaatagtgaacaagggggtaaagcgtatcgtcacgcgatggaagaattaccggatactatagaaacgctaatgttactagcactgatagcagtgctaaccggaggagtcacattattctttctatcaggtaaaggcttaggaaaaacatcaattggcctgttatgtgttacagcgtcgtcagcattactgtggatggcatctgtagaaccacattggatagcggctagtatcattcttgaatttttcttgatggtgttattgatacctgaacccgatagacaaagaacaccacaagacaatcaacttgcttatgtagtaataggtttgttatttatgatattgactgtggctgctaatgagatgggtctgctcgagacgacaaagaaggacttaggaataggacatgtagctgctgaaaatcaccaacatgccacgatgctagacgttgacttgagacctgcatctgcgtggacgttatatgcagtggctacaacagttataacacctatgatgcgccacacaattgaaaatacaacagccaatattagtttaacagctatagctaatcaagctgcaatattgatgggattagacaaagggtggccgatcagtaagatggatataggagtccccctattagctctaggatgttattcacaagttaatccattaactttaacagctgcagttttaatgttagttgcgcattacgcaattataggacctggattacaagccaaagccaccagggaagcacagaaaaggacagccgcagggataatgaaaaaccctacagtagatggaatagtcgcaatcgacttggaccctgtcgtctatgacgcgaagttcgaaaaacaactaggtcaaattatgttactaattttatgcacatctcaaattttgctaatgcgtactacttgggcattatgtgaatcaattactctggcgactggaccactcacaacactttgggagggatctcccggaaaattctggaacactacgatcgcggtaagtatggcaaatatatttcggggctcgtatttggcgggagctggactagcattctcacttatgaagtcattgggaggaggtagaagaggcacgggagctcaaggggaaacgttgggcgagaaatggaaacggcaactaaatcaactgagcaaatccgagttcaacacatacaaaaggtctgggattatggaggtagatcggtcggaagccaaagaggggcttaaacgtggcgagacgacaaaacatgctgtttcaagaggcacagcaaaactacggtggtttgtcgaacgtaatttagttaaaccagaaggaaaggtaatagatttaggatgtgggcgaggcggctggtcgtactactgtgccggcctcaagaaagtaacggaggtaaagggatacacaaagggtggtccggggcatgaagaaccaatcccgatggcaacttatggatggaacttagtgaagttgcatagcggtaaagatgtattctttatgcctcctgagaaatgcgatacactattatgcgacattggggagtcatctccgaacccaacaatagaagaaggacgtaccctgcgagtactcaaaatggtagaaccctggctaagaggaaatcaattttgtattaaaatccttaacccatatatgccatcggtcgtagaggcattagaacagatgcaacgaaagcacggtggaatgttggtgcgaaatcctttgagcagaaattctacacatgaaatgtattgggtgtcctgtggcactgggaatatcgtttcagccgtaaatatgacgagtaggatgttacttaatagatttacgatggcccaccgaaagccaacttatgaacgagacgtggacctgggggctggaacgcgacatgttgcggtagaaccagaagtcgcgaatctagacatcataggtcaacgcatagaaaacatcaagaacgaacataaatcgacatggcattatgatgaagacaacccttacaaaacgtgggcatatcacggctcgtatgaagtaaaaccttcaggatcagcctccagtatggttaatggagtagtcagactacttacgaagccatgggacgttatccctatggtaacccaaatagcaatgactgatacaactcctttcggacaacaacgagtgttcaaagaaaaggtagataccagaacaccaagagctaagcgaggaaccactcaaataatggaagtcacagctaaatggctatgggggtttctaagcagaaataagaaacctaggatttgtacaagggaagagttcacaagaaaagtcagatcaaatgcagcaataggggccgttttcgtcgacgagaatcaatggaactcagctaaggaggcagtagaagatgaaagattttgggacttagtacatagggaacgagagctccataagcaggggaaatgtgctacgtgcgtatacaacatgatgggaaaaagagagaagaaacttggagagttcgggaaagcaaaaggttcgagagccatttggtatatgtggttaggcgctagatttttggagtttgaggcattggggtttatgaacgaagaccactggtttagccgagaaaattcactcagcggcgtagaaggagaaggactacacaaacttggttatatccttcgtgatatttctaaaataccaggaggtaatatgtacgccgacgatacagccggttgggacactagaattaccgaagatgaccttcaaaatgaagccaaaataactgaaataatggagcccgagcacgccctactagcaacgtcaatattcaaacttacatatcagaacaaggtggtaagagtccagagaccagccaaaaatggtacagtaatggacgtaatctctagaagggaccaacggggatctggacaagtaggtacatatggtttaaatacctttactaacatggaggtacaattgatccgacagatggaatcggagggtatttttctaccgagcgaacttgagacaccaaacctagcagaacgcgtattggattggctagagaagcacggggccgaaagattaaagagaatggccatttcaggagacgactgtgttgtaaagccaattgatgatagattcgcaactgcattgacagctctaaacgatatggggaaagtcagaaaagacatcccacaatgggaaccgtccaaaggttggaacgattggcagcaagtgccgttttgtagtcatcacttccatcaattgataatgaaggatggaagagagatagttgtgccgtgcagaaaccaagatgaattagtaggcagagcgcgagtgtctcagggcgcaggctggagtttacgggaaacggcatgtttagggaaatcgtatgctcaaatgtggcaattaatgtattttcataggcgagatctaaggcttgcggcaaatgccattagtagtgccgttccagttgactgggtacccacttcacgtactacgtggtccatacatgcacatcatcaatggatgacaaccgaggacatgctctcagtttggaacagagtatggatagaagaaaatccctggatggaggacaagacccacgtgtcatcatgggaagaagtcccatatctgggcaaacgtgaagaccaatggtgtggtagccttatcgggttgacagcaagagcaacatgggccactaatatacaggtagccataaatcaagtacgaaggctcatcgggaatgaaaactatttggactatatgacttccatgaaacggttcaaaaatgaatctgaccctgagggggcactatggtaa

SEQ ID NO: 21264 - RNA, 9879 nt, synthetic construct
  misc_feature 1..9879: note = derived and/or modified CDS sequence (opt6) from DENV-1__GU131983__SS-prME
  source 1..9879: mol_type = other RNA
agcgtaacaatgctattgatgttactgccaactgctttagcattccacttaacaactcgaggaggtgaaccacatatgatagtcagtaaacaagaacgagggaaaagccttctatttaaaacaagcgcaggagttaacatgtgcacattaatagctatggaccttggagaattgtgcgaagacacaatgacctataaatgtccgcaaataacggaagccgaaccggacgatgtggactgttggtgtaatgcgactgatacgtgggttacatatggcacatgtagtcaaactggcgaacatagaagagacaaacgatccgtagcattagcaccccacgtcggactaggactagaaacgcgaaccgaaacctggatgtcgagtgaaggtgcatggaaacaaattcaacgagtggaaacttgggctttacgacacccaggatttaccgtcatagcactatttctagctcatgccattggaacatcgataacccaaaaaggcataatattcatacttttgatgctggttacaccgagtatggcgatgcgttgtgtaggaataggcaatcgtgacttcgtagaagggctttctggtgccacatgggtagatgttgtactagaacatggttcgtgcgtaactacaatggccaaaaacaaacctacattagatatagaacttcttaaaaccgaagtaaccaatcccgcaatactaagaaaactatgcatagaagctaaaatttccaacacaacgactgattcacggtgtcccactcaaggtgaagccactctcgtcgaggaacaagatgcaaatttcgtgtgtagaagaacattcgtggacagggggtggggaaatggatgcggattatttggaaaaggatccctattaacttgcgctaaattcaaatgtgtaactaaattggagggaaaaattgttcaatatgaaaacctcaaatactccgtcatcgtgacagtacacacaggagatcagcaccaagtcggtaatgaaacaacagaacacggaaccatcgcaacaattacaccgcaggcacccacatccgagatacaattaactgattacggcgctcttacgctcgactgcagtccccgaactggtctggatttcaatgaaatggtattacttacaatgaaagaaaaatcatggctagtacataaacagtggtttctagatttaccattgccgtggacaagtggtgcatcgacatcgcaagaaacatggaatagacaggatttattagttacatttaaaacggctcatgcgaagaaacaggaagtagttgtacttggatcgcaggaaggagcgatgcatactgcgttaactggggccactgaaatccaaactagcggaaccacgacaatattcgctggtcacttgaaatgtcgtttaaaaatggataaattaactttaaaaggtacgtcttatgtcatgtgtactggatcattcaaacttgagaaagaagtggcagaaacacagcacgggacggtacttgttcaagtcaaatatgaaggtacggatgccccatgtaaaattccattttcaacacaagatgaaaagggcgtaacccagaacggacgattaataacagctaacccgatcgttactgacaaagaaaagcctgtgaatatcgaaacggaacccccgtttggagagtcttacattgttgtaggagccggcgaaaaggcactgaaattatcgtggttcaaaaagggatcgagtatcggaaaaatgttcgaagcaactgcaaggggtgcacgccgaatggcgattttaggcgataccgcgtgggacttcgggtcaatagggggagttttcaccagcgtcgggaaattagtccatcaggtattcggtaccgcgtatggtgttctcttttcaggggtatcttggactatgaaaattggaattggaatactactgacttggctcggcctaaattcaaggagtacatctctaagtatgacctgtatagcggtaggtatggtgacattatacttaggcgtaatggttcaggcggatagtggttgtgtaataaactggaaaggacgcgagttaaaatgtgggtcagggatattcgtcacgaatgaagtccatacatggacagagcaatacaaatttcaggctgacagcccaaaaaggctttcggcagcgataggcaaagcatgggaagaaggagtatgcgggattagatcagcaaccagactggaaaacattatgtggaaacaaatatcgaatgaattaaatcatatattactagagaacgatatgaagttcaccgtggttgtaggcgatgctaatggaatcttagcccaagggaagaaaatgattagaccccaacctatggagcacaagtacagctggaaatcgtggggaaaagcaaagataataggcgcggacattcagaatacaactttcatcatcgacggaccagatacacccgaatgtccagacaatcaaagggcctggaatatatgggaagtagaggattatgggttcggaatattcaccacgaacatctggcttaaattaagagattcttatactcagatgtgtgaccacagactgatgagtgctgctattaaggacagtaaggccgtccatgcggatatgggttattggatcgaatcagaaaagaatgaaacgtggaaactcgctcgtgcgtcctttatagaagttaaaacctgtacatggccaaaaagtcataccctctggtctaatggagttttagaaagtgaaatgataatccccaagatatatggaggacctataagtcaacacaattatcgcccgggatattttacacaaacagccggaccatggcacttaggtaaactcgagttagattttgacctatgtgagggtactacagtagtcgtagacgaacattgtggaaatagaggacccagtctcagaactaccactgttacaggaaagataatacatgaatggtgctgtagatcatgtaccctacccccacttagattcagaggagaagacggatgttggtatgggatggaaatcaggccggtaaaagagaaggaagagaatctagtccggagtatggtgtccgcaggctctggtgaagttgattcgttttcactaggaatcttatgcgcttccattatgatagaggaagttatgagaagcagatggtctcgaaagatgctaatgattggcacactagctgtcttcctactactggtaatgggacaactaacgtggaatgatcttatacggttatgtataatggtaggagcgaatgcaagtgaccgaatgggaatgggaacgacttacttagctctaatggcaacatttaaaatgagacccatgttcgccgtgggactattattccgaaggttaacatctagagaagtattattactaacaataggtttgtcgttagtagcgagcgtcgaactccccaactcccttgaagaattaggcgatggtcttgcaatgggtattatgatgctcaaattgctaacagaatttcaaccacaccaattatggacgacgctactttcgctaacttttataaaaactaccttaagtctagactacgcgtggaaaacaacagccatggcattaagtatagtgtcattgtttccattatgcctaagcacgactagccaaaagactacatggttaccggtactgctaggatcttttggctgcaaaccattgacgatgtttctaatcactgaaaataaaatatggggaaggaaaagctggcccttaaatgagggaattatggcaatcgggattgtttccatattactatcatcgcttttgaagaatgatgtacccctggccggtcccctgattgcgggagggatgctgattgcgtgttacgtaatatctggttcttccgcggacttgtcgctcgaaaaagcagctgaagtatcgtgggaacaagaagcggaacacagtgggacttcccataatattttggtcgaagttcaagacgatggaacaatgaaaataaaagatgaagagagagatgatacgttaacaatacttctaaaagcgacattacttgccgtgagcggtgtctatcctatgtcaatcccagccactttatttgtatggtatttttggcagaaaaagaaacaaagatcaggggttctttgggacacgccgtcacctcccgaagtcgaaagggccgtcttagatgatggaatataccgaattttacaacgcggcttgcttggaagaagtcaggttggagtaggtgtttttcaggatggtgtatttcatacaatgtggcacgtaacaagaggagcggttttaatgtatcaggggaaaaggttggagccaagctgggcgtcggtgaagaaagatcttatatcttatggtggtgggtggaggtttcaaggaagttggaacactggcgaagaggtccaggtaatcgcagtagaacctgggaaaaatccgaaaaacgttcaaacaacaccaggcactttcaaaacaccagaaggggaagtaggggctatagcactagactttaaacctggaacatccggatctcccatcgtaaacagagaggggaaaatagttggtctttatggaaacggtgtcgttactacctccggaacgtatgtaagtgcgatcgcacaggccaaggctagtcaagaggggcctctaccagaaattgaagatgaagtttttaagaaacgaaatttaaccatcatggacttacatcctgggagtgggaagacgcgtaggtacttaccagctatagtaagagaagctataaaacgcaaattaagaaccctaattcttgcaccaactagagtggtcgccagtgaaatggcagaagcccttaagggcatgcccatacgataccaaacaaccgctgtaaaatctgagcacacgggtcgcgagatagtagatctaatgtgtcatgcgacattcacaatgagacttctgagtccagtaagagtaccgaattataacatgatcatcatggatgaggcgcattttacagaccccgcttctatagctgctagggggtacatatctacaagggtaggtatgggggaggcagccgctatattcatgacagcgacacctccgggttcagtggaagcattccctcaatctaatgcagtaattcaagacgaagaacgagacattcctgagaggtcttggaactcaggatacgactggattactgattttcccggaaaaacagtatggtttgtgccttcgattaaatctgggaacgatatagcaaattgccttaggaaaaatggaaagagggtaatacaactaagccgcaaaacatttgatacagaatatcagaaaaccaaaaacaatgattgggattatgtcgttactacagatatatccgagatgggcgccaacttcagagcagatcgagtaattgaccctagacgatgtttaaaaccagtaatattgaaagacggtccagaaagagtgatattggcaggacccatgcccgtcactgtggcctcagctgcacaacgcagagggaggatcggccgtaatcaaaacaaagaaggagaccaatatgtctatatggggcaaccactgaacaacgatgaagatcatgcacattggaccgaagcaaagatgcttttggacaacataaatactccggaaggtattataccggcgttgtttgaaccagaaagagagaaaagcgcagcaatagatggcgaatatagactaagaggtgaagccagaaagacattcgtagaattaatgagacgaggggacctgcctgtttggctatcgtataaagtggcttcagagggatttcaatatagcgaccgaagatggtgctttgacggtgaaagaaataatcaagttctcgaagagaatatggatgtagaaatatggaccaaggaaggcgaaagaaagaaactcaggccaagatggttagacgcaagaacatattccgaccctctggctttacgagaatttaaggagttcgccgctgggcgtagatccgttagtggagacctaatattagaaatagggaagctaccccaacacttaacactgcgggcacagaatgcattagacaatctagtaatgttgcataattcagaacaaggtggcaaagcatatcggcatgctatggaagaattacccgatactatagaaactttaatgttactagctctgatagcagtcttgacaggaggtgtaaccctattctttttatctgggaagggactcggtaaaacatcaataggcttgctatgtgtaacggcctcaagcgcacttttatggatggctagtgtggaaccacactggattgctgctagtataattctagagttcttcttaatggttttactcataccagaaccagataggcaacgcactcctcaggataaccaactagcatatgtggtcatcggactcctcttcatgatacttaccgtagcggcgaatgaaatgggtctgctcgagacaacgaagaaagacctaggaatagggcatgttgccgcagaaaaccatcaacatgcgacgatgttggatgtagatttaagaccagccagcgcgtggacactctacgcagttgcgacgacagtaatcactccaatgatgagacatacgattgaaaacaccacagctaatataagtcttacagccatagcaaaccaagctgcgatcttaatgggtctcgacaaaggttggccaatctctaagatggatatcggcgtacccctcctagcgctaggatgctatagtcaagtaaatccacttactttaacagctgcagtgctaatgttagttgcccactatgcgattattggacccggactgcaagcaaaagctacccgagaagcacaaaagcgaacagctgctggaatcatgaaaaatccgactgtggacggaattgtggcaatagatctagatcctgttgtttatgatgcaaaatttgaaaagcaactaggacaaataatgctattgattttatgcacctcacaaatcttactgatgagaacaacctgggctctttgcgaaagtataacacttgcaactggtccactgaccacgttgtgggagggtagtccaggtaaattttggaacactacaatagctgtatctatggccaacatctttcgaggaagttacctggctggagccggccttgccttttccttaatgaaatcgctcggtggaggtcgccggggaacaggcgcacagggcgaaaccctcggagaaaagtggaaaagacagttaaatcagctatccaaaagtgagttcaatacttataaaagatcaggtataatggaagtcgatcggagtgaagccaaggagggattgaagagaggtgaaactacaaaacatgcagtaagccgtgggactgcaaaactccgttggtttgtagagaggaatttagtaaaacctgaagggaaagttattgatttaggatgcgggcgaggcggctggagttattattgcgcggggctcaagaaagttacagaagtcaagggatacacaaaaggaggtccaggtcatgaagaaccgattccgatggcaacctacgggtggaatttagtaaagctacattcgggaaaagatgtattctttatgccacctgaaaaatgcgatactcttctatgtgatataggtgaaagtagcccgaacccaacaatagaggaaggtagaacactacgtgtactgaaaatggtagaaccctggttacgaggcaaccaattctgcatcaagatattgaatccatatatgccttcagttgttgaaacactagaacaaatgcagagaaaacatggcgggatgttagtaagaaatccattgtcccgaaattctactcatgaaatgtattgggtttcatgcggaaccggaaatatagtaagtgcagttaacatgacaagccgcatgcttctcaacagattcacaatggcacatagaaagccaacatatgaaagagatgtagatttaggagctggtactagacacgtggcggtagaaccagaagtcgcaaacctagacattattggtcaacgaatagaaaatatcaaaaatgagcataaatccacatggcactatgacgaagacaatccatataagacttgggcatatcatggcagttatgaagttaaacccagtgggtctgctagcagcatggttaatggggttgtcagactattaacaaaaccttgggacgtaatacccatggttacacaaatagcgatgactgatactactccattcggtcaacaacgcgttttcaaggaaaaagtcgataccagaacgccacgcgcgaagaggggtactacgcaaatcatggaggtaaccgccaaatggctctggggctttctaagtcggaataagaaaccaagaatatgtacaagggaagagttcacgcgaaaagtaagaagtaatgctgcaattggagctgtatttgtggacgaaaaccaatggaatagtgcaaaggaggcggtcgaagatgagcgattttgggatctagtacatagagaacgggaactacacaaacaggggaaatgtgctacatgcgtatataatatgatgggcaaaagggagaagaaattaggtgagttcggaaaagcaaagggatcgagggctatatggtatatgtggcttggagcacgcttcctagaatttgaagcactaggttttatgaatgaagaccattggtttagcagagaaaactctttgtcgggggtggaaggtgaaggcctacataaattagggtacatactacgggatatatcgaaaatacccggtggaaatatgtacgccgatgacactgctggttgggacactagaataacagaagacgacctccagaatgaagccaagataacagaaatcatggaacccgaacacgccttattagcaacgtcaatcttcaaattaacttatcaaaataaagtagtaagagtacaaagacctgccaaaaatggaacagtcatggacgtaatatcacgtagagaccaacgagggagtggacaggtcggaacatatgggctgaacacgtttacgaacatggaggtacaattgatacggcagatggaatcagaggaaatatttctaccgtcagaattggaaacacctaaccttgcagaaagagttctagactggctcgagaaacatggggcagaaagactaaaaagaatggctatttcaggtgatgattgcgtggtaaaaccaattgacgaccgctttgcaactgccttaacagcattaaatgatatgggcaaagttcgaaaagacataccacaatgggaaccttctaaaggctggaacgattggcaacaagttccattttgcagtcatcattttcaccaattgattatgaaagatggaagagaaatagtggtaccctgccgcaatcaagatgaacttgtcgggagagcacgagtgtcacaaggtgccggctggagtctcagagagactgcttgtttaggaaagagctatgcacaaatgtggcaactaatgtacttccatcgaagagatttaagattagcagcaaacgcgatttgttcagcagtaccagttgattgggtgccaacgtcacgaactacgtggtcaatccatgcgcaccatcagtggatgactacagaggacatgttgagcgtctggaatagggtatggattgaagaaaatccttggatggaggataaaacccatgtgagcagctgggaggaagtaccttacttgggaaaacgtgaggaccaatggtgcggaagtctgataggattaaccgctcgggcaacttgggctacgaatatacaagttgcaattaatcaggtacgcaggttaattggtaatgaaaattatctagattacatgacgtctatgaaacgctttaaaaatgaaagcgaccctgaaggagcgctgtggtaa

SEQ ID NO: 21265 - RNA, 9879 nt, synthetic construct
  misc_feature 1..9879: note = derived and/or modified CDS sequence (opt6) from DENV-1__GQ868532__SS-prME
  source 1..9879: mol_type = other RNA
tctgtaacgatgttgctcatgttattacccacggcattagcattccatctaacaaccaggggaggagaaccgcacatgatcgtatctaaacaagaaagggggaaatctcttttatttaaaaccagtgctggtgttaatatgtgtacattaatagcaatggatttaggagaattatgtgaagatacaatgacttataaatgtccacaaataacagaagcagaaccagatgacgtagattgctggtgtaacgctacagacacatgggtaacatacgggacttgtagtcaaaccggtgaacatcggcgtgataaacgcagcgtagctctagctccacatgtgggactcggtctcgaaactcgtacagaaacatggatgagctcagaaggagcttggaaacaaatccaacgtgtagaaacttgggctttaagacacccaggttttactgttatagcgctatttttagcccatgcgatcggaaccagcataacacaaaagggaattatcttcattctactaatgctagtaacaccatctatggcaatgagatgtgtaggcataggaaatagagattttgttgagggactcagcggtgcgacatgggtagatgtggtgctagaacatggcagctgtgttaccacaatggccaaaaataagcctaccttagatattgaactactaaagacagaagttactaatccagccatactacggaaactttgcatcgaagccaaaataagtaacactacaacagactcacgttgtccaacacaaggagaagctacacttgtggaggaacaagatgcgaattttgtttgtcgacgtacctttgtagacagagggtggggaaatggctgtggtcttttcggtaaagggtccctcttgacctgcgcaaaattcaaatgtgtaaccaaactcgaaggcaaaatcgtacaatacgagaatttgaaatactccgttatagtaacagtgcacacaggcgaccaacatcaagttgggaacgaaacaactgaacacggcacaatcgcaactattacgcctcaggcaccaacgtcagaaatacaattaacagattatggcgcgttaacattggactgttctccaagaacaggtcttgattttaacgagatggtactcctaactatgaaagaaaaatcatggctagttcacaagcaatggttcttagacctgcctctgccatggacttctggagctagtacttcccaagagacatggaacagacaagatctattagtaacatttaaaacagcacacgcgaaaaagcaggaagtggtagtcttgggctctcaagaaggtgccatgcatacagccctcaccggagctacggagatccagacaagtggaactactaccatcttcgcgggacatctcaagtgtcgcttaaaaatggataaacttaccttgaaggggacttcatacgttatgtgtacgggtagttttaaattggagaaagaagtagcggaaactcaacatggcacggtgttagtacaagtaaaatatgaagggacagacgcaccgtgtaaaattccattctcaactcaagacgaaaaaggggtgactcaaaacggacgactaattactgcaaatccaatcgtgaccgataaagaaaaaccggttaacatagaaacggagccaccattcggtgaatcatatattgtagtgggcgcaggagaaaaagcattaaaattatcttggttcaaaaagggaagttcgatcggaaaaatgttcgaagcaactgcccggggagcacgaagaatggctatccttggagatacagcgtgggattttggttcaatcggaggagtattcacaagtgtaggtaagctagtccatcaagtatttggaacggcatacggcgtattgtttagtggagtttcatggacaatgaaaataggcattggtatattactgacttggcttggtctaaacagtcggtctacaagcctatctatgacttgtatagccgtcgggatggtcactttataccttggtgtcatggtacaagccgactcgggatgtgttataaattggaagggacgagaattaaaatgcggatcgggaatttttgtgactaatgaagtacacacttggacagaacagtataaatttcaagcagattcacctaaaagattatcagcggcaataggaaaggcttgggaagaaggtgtatgcggtataaggagcgcaactagactagaaaatataatgtggaaacaaataagcaacgagctaaatcatatattattggaaaatgacatgaaattcacagtggttgtgggtgacgctaacggtattctagcacaagggaagaagatgataaggccccaaccaatggaacataagtatagttggaagtcatggggtaaggcaaaaattatcggcgcggatatacaaaacacaacttttataatagatggcccggatacaccggagtgtcctgataaccaaagagcttggaatatttgggaagtcgaagactacgggttcggaatatttacgacaaacatctggcttaaattacgagacagttacacgcaaatgtgcgatcacagattaatgagtgccgcgattaaagactccaaagcagttcatgcagacatggggtactggatcgagtctgagaaaaatgagacgtggaagctggctcgagcctcgtttatagaagtgaaaacatgtacatggcctaaatcacatacactctggagtaatggcgtactcgagtccgaaatgatcattccaaaaatatacggaggtcctatatcccaacataattacaggcctggttactttacacaaacagccgggccatggcatctaggaaaacttgagttggactttgacttatgtgaaggaactactgttgtggtggatgaacattgcggaaacagaggtcccagtttaagaacgacaactgtgaccggaaagataattcatgagtggtgctgcagaagttgcacccttccacctctacgcttccggggtgaggatggttgttggtacggaatggaaattcgacctgtcaaagaaaaggaagaaaatttggtcagaagcatggttagcgccggtagtggagaagttgacagtttcagcttaggtatactatgcgcttcaataatgatagaagaagttatgagaagcagatggtcaagaaaaatgttaatgacaggcactctagcagtttttctgttattagttatggggcaattgacttggaacgaccttataaggttatgcataatggtaggggctaatgcctcagacagaatgggaatgggaaccacatatttagctttaatggctacattcaagatgcgcccaatgttcgctgtaggcctattatttcgaaggttaacaagtagggaggtccttcttttaactatcggtctatccttagtcgcctcagttgaactaccaaatagcttagaggaattaggtgacggactcgctatgggaatcatgatgcttaaattgctaaccgaatttcaaccgcatcagttatggatcaccttgttatctctcacatttatcaaaactactctgtctttggactatgcatggaagaccacagccatggctctatcaatagtatcactttttccattatgtctaagtacgacaagccaaaagacaacatggttacccgtcttactaggatcattcggttgtaaaccattgaccatgtttctcatcacggagaataagatatggggacgcaagagttggcccttgaacgaaggcataatggcaataggtatagtatcgatattattgagctcattacttaagaatgacgttccactagcgggcccattaattgcaggcggtatgttgatagcctgctatgtaattagcggaaactctgcagatttaagtttggaaaaagcggctgaggtttcttgggaacaagaagcagaacattccgggacatcccataatatattggtagaagtacaggatgatggcactatgaaaataaaagatgaggaacgcgacgatacacttactattttattaaaagcaacccttctagcagtatcaggagtatacccaatgagtatacctgctacattatttgtctggtacttctggcagaagaagaaacaacgatctggggttttatgggacactccttcccctcctgaagtagaacgggcggttttggatgacggaatttaccgcatcctacagagaggactactaggtagatctcaagtaggtgtgggtgtctttcaggatggagtatttcatacaatgtggcatgttacgagaggggcggtattaatgtaccaaggaaaaaggctcgaaccgtcttgggctagtgtcaagaaagacctgataagctacggaggaggttggagattccaaggatcgtggaatactggagaagaagtacaggtaattgccgtagaaccagggaaaaaccccaaaaacgtccagactatgcctggaacatttaaaacacccgagggggaagtcggagcgatagctctagattttaaacccggtacaagcggttcgccaatcgtgaatcgagaaggcaaaattgtaggcttatatggaaatggtgtagtcacaaccagcggtacgtatgtttcggcaattgcacaagcaaaggcaagtcaagaaggtccacctcccgaaatagaggacgaggtctttaagaaaaggaatctcacaataatggatttacatccgggaagcggaaaaactcgtcgatatctacctgcaatggttagagaagctataaagcggaaattgaggacattaatcctcgcgcccacaagagttgtcgcttccgaaatggcagaagccttaaaaggtatgccaatcaggtatcagacaaccgctgtcaaatcagaacatacgggcagagaaattgtagatctaatgtgccacgcaacttttactatgaggttacttagtccagtacgagtgccaaattataatatgattattatggatgaagctcactttacggacccggcaagcattgcagccaggggctatatatcaacgcgcgttggaatgggcgaagcagcggcaatatttatgaccgctacgccgccgggatctgtagaggcttttccgcaatcaaatgcagtgatacaggatgaagaaagggatatacctgaaagatcctggaacagtggttacgactggataactgactttccgggtaaaaccgtttggttcgtacctagtattaaatctggcaacgatattgcaaattgtttaaggaaaaatgggaaacgcgtcatccaattgtctagaaaaacattcgatacagagtaccagaaaactaagaacaatgactgggattacgttgtaactaccgatattagtgagatgggagcaaattttcgagcggacagagtgattgaccccagaagatgcttaaaaccagttatcctcaaagatggaccggaaagggttatcttagcgggccccatgccggtaactgtagcaagtgcagcacaacgcagaggtaggatcggaagaaaccaaaacaaggaaggagatcaatacgtatacatgggacaaccgctaaataatgacgaggatcatgcgcattggacggaagctaaaatgttgttagataacatcaacacacctgagggtataattccagccctatttgaaccggaaagggagaaaagtgcagcaatagacggtgaataccgtcttagaggcgaagctaggaaaacatttgtggaactcatgcgtagaggagatttgccagtatggctcagctacaaagtagctagtgaaggttttcagtactccgatagaaggtggtgctttgatggtgaaagaaacaaccaagtactagaagaaaacatggatgttgaaatctggactaaggagggggaaaggaagaaattaagaccgagatggttagacgcacgaacatattctgatcccctggccttacgagaatttaaagaatttgcagcaggccgtcgtagtgtctccggcgatctaatattggaaataggaaaattacctcagcacctaacgctccgagcacagaatgcactcgacaatctagtcatgttgcataactctgagcaaggtgggaaagcatatagacacgcaatggaagaattacctgacacaatcgagacactaatgttgcttacattaattgctgttctaactggaggcgtaactttatttttcctgagtggcaagggtctaggtaaaacatctatcggacttctatgtgtcactgcgagcagtgcactactatggatggctagtgtcgaaccgcactggatagcagcttcaattattctagagttctttctaatggtgctattaatcccagaaccagaccgtcaacgaacaccacaagataatcaattagcttatgttgtaataggcctcttatttatgattcttaccgtagcggctaacgaaatgggtcttctggaaacgactaaaaaggacctcggtattggacatgtggcagcagaaaaccaccaacacgctacaatgctagatgtagatctcagacccgctagtgcgtggacattatacgcagtcgcaacgactgtcattacaccaatgatgagacacactatagaaaatacaacagcaaatatcagtctaacagccatagcgaaccaagcagcaatattaatgggcttagataagggttggcccatttcaaagatggacataggagtacccctcctagctctcggctgttattcacaggtaaacccattaacgcttacggcagcggtactaatgcttgtggcccattacgcgataattggtccgggcttgcaggcaaaagctaccagagaagcgcaaaaacggactgcagccggtatcatgaaaaatccaaccgtggacggtatcgttgcaattgacctagaccccgtagtctacgacgcaaaatttgaaaaacaactgggtcagattatgctgttaatattgtgcacttctcaaatcttattaatgagaaccacatgggcactttgtgaaagtataacacttgctacagggccattaaccaccttatgggagggatcgccaggtaaattttggaacaccacaatcgccgtatccatggcgaacatctttcgcggtagctatttggccggggcaggattggcattttctctaatgaaatcgctagggggaggaaggcgaggaactggagctcaaggagaaactttaggcgaaaaatggaagcggcagctaaatcaattatccaagagtgaatttaatacatataaaagatcaggtatcatggaggttgaccgttcagaagcgaaggaaggtcttaagcgaggtgaaacgactaaacacgcagtaagcaggggaacggcaaaattaagatggtttgtagagagaaatctagtaaagccagaaggaaaagtaatcgacttagggtgtggtcgaggcggatggagttattactgcgcaggtcttaagaaggtaaccgaagttaaaggatataccaagggtgggccaggacatgaggagcctataccgatggctacatatggatggaatttagtcaaactgcattcgggtaaagacgtattctttatgccaccagaaaaatgcgatactctgctgtgtgacataggtgaatccagccccaaccccacgatagaagaaggtagaacacttcgagtcctaaagatggttgaaccatggttacgtggaaatcaattttgcataaaaattttaaacccctacatgccaaatgtagtagaaacattggaacagatgcaaagaaaacatggagggatgttagtacgaaatccgttatcacgtaattcaactcatgaaatgtattgggtaagctgtggaaccggaaatattgtttcagcagtaaatatgacctctcgcatgttattaaataggtttacgatggcgcaccggaaaccgacctatgaacgcgacgtcgatttaggagcgggaaccagacatgtagccgtagagcctgaagtcgcaaacctggatatcataggacagcgtatcgaaaatatcaaaaacgaacataaaagtacctggcactatgatgaagataacccatacaaaacttgggcttaccatggctcatacgaggttaaacccagcggatctgcttcttctatggtcaatggcgtagtaagactgttaacaaaaccttgggatggtattcccatggtcacacagatagccatgaccgatacaacaccgtttggacaacaaagagtatttaaagaaaaagtggacaccagaactcccagggcaaaaagaggaacaactcagattatggaggtaaccgctaaatggttatgggggtttctaagtcgaaataagaaaccccgaatctgtaccagggaggagttcaccaggaaggttagaagtaatgcagcaataggtgctgtttttgtagatgagaatcaatggaactctgccaaggaggcagtagaggacgagagattttgggatctcgttcaccgagaaagagaattacacaaacaaggaaaatgtgctacctgtgtatacaacatgatgggtaaaagagagaagaaactaggagaatttggcaaagccaaggggagtcgagccatatggtacatgtggttaggagcaagattcttagaatttgaggcgcttggttttatgaatgaagatcattggttttcaagagaaaattcacttagtggcgttgaaggagaaggactccataagttaggatatatcctccgagatatatcgaagatcccaggtgggaacatgtatgcggacgacacagcggggtgggatacgcggattacagaagatgatctacaaaacgaggcaaagatcacagaaattatggaaccggagcatgcattgttagctacctcaatttttaaactaacttatcagaataaagtagttcgtgtacaaaggcctgcgaaaaacgggaccgtgatggatgtgatttctagaagagatcaacgcggaagcggtcaagtagggacttatggcttaaacacatttactaatatggaagtgcagttaatcagacaaatggaaagtgagggtatattcctaccttcggaactcgagacacccaatctggctgaacgagtcctagattggttggaaaaacatggagccgagcgactgaaaagaatggcaataagtggtgatgattgtgtggtcaaacccattgacgacagatttgctactgctcttactgccttaaacgacatggggaaggtcagaaaagatattccgcaatgggagccatcaaaaggatggaatgattggcaacaagttccattctgttcccaccattttcatcaattaataatgaaagatggccgagaaattgttgtaccttgtagaaatcaagatgagctagtcggccgagcacgagtttcccaaggtgccggatggtcgctaagagaaactgcctgtctcggtaaatcctacgcgcaaatgtggcaattgatgtactttcatcgacgggatctcagacttgctgccaacgcaatctgttcggctgtcccggtagattgggtccctacctcgaggacaacttggtctatccatgcacatcatcagtggatgaccaccgaagatatgctttctgtgtggaatagagtatggatagaggaaaacccgtggatggaggacaagacgcatgtatcttcatgggaagaagtcccttatctcggaaaaagagaagatcaatggtgcggaagtctaattggactaactgcgcgtgcaacttgggctacgaatatacaagtagccattaaccaggtgagaaggttgataggtaatgaaaattacctggattatatgacatctatgaagagattcaaaaacgagtcagacccagaaggagctctctggtga

SEQ ID NO: 21266 - RNA, 9879 nt, synthetic construct
  misc_feature 1..9879: note = derived and/or modified CDS sequence (opt6) from DENV-1__GQ868533__SS-prME
  source 1..9879: mol_type = other RNA
tcagtaacaatgcttttaatgctcttaccgaccgccttggcatttcatttgacaacacgaggaggggaaccacacatgatcgtgtctaaacaagaaagaggaaaaagcctgctttttaaaacgtcagcaggagtcaatatgtgtacattaatcgcgatggatctaggagaattatgtgaagacacaatgacctataaatgtccacaaattacggaagcagaacccgatgacgtcgattgttggtgtaatgcgactgacacatgggtaacttacggcacgtgtagtcaaaccggcgaacaccgtcgagacaaaagatcggttgccttagccccacacgtaggattaggcctggaaacgcgcaccgaaacgtggatgtcatctgaaggtgcatggaaacaaatccaacgagtcgaaacgtgggcattaagacaccctgggtttacagttattgccctatttttggcacatgcaataggcacttcaatcacccaaaaaggaataatctttatactattaatgctcgtaacgccgagcatggcaatgaggtgcgtcggtatagggaacagagatttcgtcgaaggtctgagtggtgctacgtgggttgatgtggttctagaacatggctcctgcgttacaaccatggccaaaaataaacccacacttgacatagaattactaaaaacagaggtcactaacccagctatattgaggaaattatgtatagaagccaaaatatcaaatactacaactgattcaagatgtccaacgcaaggcgaagcaacattagtagaggaacaagacgctaacttcgtctgtcggagaactttcgtagaccgcggatgggggaatggttgcggactgtttggcaaaggttcactcctaacctgtgcgaaattcaaatgcgtcacaaaattggagggtaaaatagttcaatacgaaaatctaaaatattctgtaatagtaaccgttcatacgggggaccaacatcaggtaggaaacgaaactacagaacacggcactatcgccacaatcacgccgcaagcacctacaagcgagatacaattaacggactatggcgcattaactctagattgctcccccaggaccggattagattttaacgaaatggtcttgctaaccatgaaagagaaatcgtggctagtccacaaacaatggttcctagacttgcctctaccgtggacaagtggagcctctacttcacaagaaacatggaatcggcaagatcttttagttacttttaaaacggctcacgccaagaaacaagaagtggtggtgcttggttcccaggaaggtgcaatgcacacagccttaacgggagctactgagattcaaacatcaggtacaactaccatatttgctggacatctaaaatgtcgtttgaaaatggacaaattaaccctaaaagggacgagttacgtaatgtgcacaggctcctttaaacttgagaaagaagtcgcggaaactcaacatgggactgttctagttcaggtcaaatacgagggaacagatgccccatgtaaaataccctttagtacacaagacgaaaaaggggtcacccaaaatggacgattaataactgccaaccctatagtaacagataaagagaaacctgttaatatagaaactgagccccctttcggagagtcttacattgtggttggtgctggtgaaaaagcactgaaattaagttggtttaagaaaggaagcagcatcgggaaaatgtttgaagcaacagcacgtggtgcgagacgcatggcaatattaggggacacagcgtgggattttggtagcattgggggtgtgtttacctcagtaggtaagctagtacatcaggtattcgggactgcgtacggtgtgttgttctctggagtttcttggacaatgaaaataggtattggaatactactaacttggctcggattaaattctagatcaaccagtttgtcaatgacatgcattgcagtaggaatggtaactttatatctgggagtaatggtccaagctgattctgggtgcgtaataaactggaaaggccgtgaactaaaatgcggtagtggaatttttgtaacgaacgaagtacatacatggactgaacagtacaaatttcaggcggattcgccaaaaaggttatctgctgccatagggaaggcttgggaagaaggcgtctgtggaattaggtcagcaactagactggaaaatatcatgtggaaacagatttctaatgaactaaatcacattctgcttgaaaatgatatgaaatttacagttgttgtgggagacgccaatggaatattagcacaaggcaagaaaatgataagacctcaacctatggagcacaagtactcatggaaatcgtggggaaaggccaaaataattgaagctgatattcaaaatacaacttttattatagatgggccagacactcctgaatgccctgataatcaacgagcgtggaatatatgggaagtcgaagactatggatttggaatatttacaacaaatatatggttgaaactaagagactcctatactcaaatgtgtgatcatcgcttaatgagtgcagctataaaagacagtaaagctgtccacgcagatatggggtattggatagaaagtgagaaaaatgaaacatggaaattagcgagggccagcttcattgaagtgaaaacttgtacgtggccaaagagccatactctatggagtaatggggtactcgagtccgaaatgatcatacctaaaatatacggtggcccaataagtcaacataactaccgtcccggttactttactcagactgccggcccctggcacctgggaaaactggaattagattttgacctatgtgaaggaaccacagtagtagtagacgagcactgtggaaaccgaggccctagtctacgtacgaccacggtaacgggcaaaataattcacgaatggtgttgtaggagctgcactctgccgcccttaagatttcgaggagaagatggatgttggtatgggatggaaataagaccagtgaaagaaaaagaagaaaatcttgtaagatcaatggtatcggcaggatcgggcgaagtagatagttttagtttgggaatattgtgcgcgtccataatgattgaggaagtcatgagaagtaggtggtcaaggaaaatgctaatgaccggaacattggccgtgttcctacttctagtcatgggtcaacttacatggaacgacttaattagattgtgcatcatggttggtgcgaacgcatcagacagaatgggcatggggacaacatacctagcactaatggcaacatttaaaatgcgcccaatgtttgccgtgggattgctttttcgacggctcacctcacgagaagtcttacttcttacaatcggactatcattagttgcgagtgttgaattacctaactcgttagaggaattgggagacggcttggctatgggaataatgatgttaaaattgctaacggagtttcaaccccatcaactttggactacattattatcacttacgttcataaaaacaacccttagcttggattatgcgtggaaaactaccgcaatggccttgtcaatagttagtttatttcccttatgtctaagtaccacctcacagaaaacaacctggctgcccgtattattaggatctttcgggtgcaaaccgctaacgatgttcttaataacagaaaacaaaatatggggaagaaaatcttggccattgaacgaaggaataatggctataggcatcgtttctattcttctttcctcactgcttaaaaatgatgttcctctggctggtccactaatagcgggagggatgttgatcgcctgttatgtaatcagcggtagcagcgcagatttatcactagaaaaagcagccgaagtatcctgggaacaagaagcagaacattcgggaacgtcacacaacattttggtagaggtacaagatgacggaacaatgaaaattaaggacgaagaacgggatgacactctaacgatcctcttaaaagcgacacttttggccgtatccggtgtgtaccccatgagcataccagcaacactattcctctggtatttttggcagaagaagaaacaacgttcaggtgtactctgggataccccgtcaccgccagaagttgaaagggccgttcttgatgacggtatataccgtatattacaaagaggactattaggaagaagtcaagtaggagtgggcgtgtttcaagatggtgtattccatactatgtggcatgtaactagaggtgcagtattaatgtatcaaggaaaacgactagaaccttcctgggcatcagtcaaaaaggatctgattagttatggcggcggttggaggttccaggggagttggaatacaggagaagaggtacaggtgatagctgtggaacctggcaagaaccccaaaaacgtgcaaactacacctggaactttcaagacgcccgaaggagaggtaggtgcaatagccttggattttaaaccggggacctcaggctcaccaatagtaaacagagaagggaaaattgtaggtctttatggaaacggagtggttacaacatctgggacatatgtatcagcaattgcacaggccaaggcgagccaggaggggccgcttccggaaatcgaagatgaagtatttaaaaagcgtaacctgactataatggacttacatccagggagtggtaaaacaaggcgctacctaccagcaatagttcgggaggccataaaacgaaaactccgtaccttgatacttgcccccactagagtagtggccagcgagatggctgaggcgcttaaggggatgcccattcgttaccaaacaactgcagtaaaatcagaacataccggacgcgaaatcgtagatctaatgtgtcatgcgacctttacaatgcgcttattatcgccagtaagggtccctaactataacatgataataatggacgaggcacactttaccgaccctgcatctatagccgctagaggctatataagtactcgtgtgggtatgggcgaggctgcagctatttttatgacggccacaccaccaggaagtgttgaggcttttccccaatcaaatgctgtaatacaagatgaagaaagagatattcctgaaagatcatggaatagtggctacgactggataacagattttccaggtaaaactgtatggttcgtgcccagcattaagtcgggaaacgatatagcaaattgcctgaggaaaaatggtaagagagtaattcaactctcaaggaaaaccttcgataccgagtatcaaaagactaaaaataatgactgggactacgtggtaactaccgatatatctgaaatgggtgccaacttcagagcagacagagtaattgatccaagacgatgccttaaaccagtgatattaaaggatggccccgaaagagtaatcttggccggaccaatgccggtcaccgttgcatctgccgcccagcgtcggggcagaataggaagaaatcaaaataaagaaggggatcagtacgtatatatggggcaaccattaaacaacgatgaagatcatgctcattggacagaggctaaaatgttacttgataatataaatacaccggaaggaataattcctgcattattcgaacctgaaagagaaaaatcggctgcgatcgatggagaatacagactacgaggtgaagctcgaaaaacattcgtggaattaatgagacgaggagatttaccggtatggttaagttataaagtggccagtgaaggatttcaatactccgataggcgatggtgctttgatggggaaaggaacaatcaagtcctcgaagagaacatggatgtagaaatatggactaaagaaggggaacgcaagaaactaagacctaggtggttggatgccagaacatactccgatccacttgcacttagagagtttaaagaatttgctgctggtagacgtagtgttagtggtgatcttattttagaaataggaaagctacctcaacaccttacatcaagagcacaaaacgccttggataacctagttatgttacacaattccgaacaaggtgggaaggcttatcgccacgctatggaagaactgccagatacgatcgaaacattgatgttgttagcgctaatcgccgtcttaaccgggggtgtcacactctttttcctatcaggcaaaggacttgggaaaactagcataggactcctttgtgttacggcgtcttcggctttgttatggatggcaagtgtcgagccccactggattgcggcatcaataatattagagttctttttaatggtccttctaataccggaacccgacagacagaggacgccacaggacaatcaactagcatacgttgttataggactactgtttatgatactcacagttgcagcgaacgagatgggattactagaaactacaaagaaagacctaggaataggacacgtggctgcggaaaatcatcaacatgctaccatgttggatgtagacttacggccggcttcagcttggacgctgtatgcggtagcaacaaccgtgattacacctatgatgagacatacaatagaaaacaccacagcaaatatctcactaactgcgatagccaatcaagcagcgattttaatgggcctagataaaggctggcctattagcaaaatggatataggagtcccattactggctctgggatgctattcacaagtaaatcctcttacattaaccgcggcagtattaatgcttgtagcacattatgcaattattggtccgggattacaggccaaagcaacacgtgaggcgcaaaagaggactgccgccggcataatgaaaaatccaacagtcgatggaatagttgcaatagacttagatccggtagtctacgacgccaaatttgagaaacaactaggtcaaataatgttattgattttatgtacatctcaaattctgcttatgagaacaacatgggcactgtgcgaatcaatcactctcgcaacaggacccctaacaacgttatgggaaggcagccccgggaagttttggaatactacgatagcagtctcgatggcgaatatattccgtggttcatatctcgctggtgcaggcctggcttttagtcttatgaaatccttaggaggaggaagaagaggtacaggagctcaaggcgaaacgttaggagaaaaatggaagcggcaactgaatcaattgtcgaaatcggaatttaacacttacaaacggagtgggataatggaggtcgatcgttcagaagcaaaagaaggattaaaaaggggagaaacaacaaaacacgcagttagtcgtggaactgccaaattgagatggttcgtagagagaaacctcgtgaaaccagaaggaaaggttatcgatctaggctgcggcagagggggctggtcatattactgcgcaggactcaagaaagtgacagaagtcaaagggtacacaaaaggaggaccaggacacgaggaacccatccctatggcaacttatggatggaacctagccaaattacatagtggtaaagatgtattcttcatgcctccggaaaaatgtgacacgttgctgtgcgatataggagaaagttctcctaacccaactatagaagagggaagaacgttaagggttctaaaaatggtcgaaccttggttacgaggaaaccaattttgcattaagatcttaaacccatacatgcccagtgttgtagaaacactagaacaaatgcaaagaaaacatggagggatgctcgtaagaaaccccctctctaggaatagtacgcatgaaatgtattgggttagctgcggaactggtaacatagtttcagcagtaaatatgacatcaagaatgcttttaaataggttcacgatggcacatagaaagcctacttatgagagagatgtagatctcggagcagggacacgacatgtagcggttgaaccagaagtcgcgaacttagacataattggacagcgaattgaaaatattaaaaacgaacacaaatccacctggcattatgatgaagataatccttataagacttgggcttatcacggaagctatgaagtaaaatcttcaggatccgctagtagcatggtgaatggggttgtacgattgttgacaaagccttgggacgtgataccaatggttacacagattgcaatgactgatacaactccctttggacaacagcgggtattcaaagaaaaagtcgatacaagaacaccaagagccaaaagaggaacaactcaaattatggaagtaaccgcaaaatggctgtggggctttcttagcagaaataagaaaccgcgaatatgtacacgggaagaatttacacgaaaagtaagatcaaacgctgctatcggagccgtttttgtggatgagaaccagtggaactctgcaaaagaagccgtagaagatgaacgattttgggacttagttcacagagaaagagagcttcataagcagggaaaatgcgcaacttgcgtttataatatgatgggaaaaagagagaagaaactaggagagttcggaaaggcgaaaggaagccgcgccatatggtatatgtggcttggagccagatttttagagttcgaagcattgggttttatgaacgaggatcattggttctcaagagaaaactcactttcaggcgttgaaggtgaaggactgcataaattggggtacattttaagagatatttctaaaatccccggaggaaatatgtacgcggatgatacagctggatgggacactagaatcactgaagatgacttacagaatgaagccaaaataacggagatcatggagccagaacatgccctacttgccacttccatatttaaactaacttaccaaaacaaggtggttagagtacaacgtcctgccaaaaatggaacagtcatggatgttatatcgcgaagagatcaaagaggaagcggtcaagtgggaacctacggactgaatacatttacgaacatggaagtacaactaatccgtcagatggaatcagaaggtattttcttgccctctgaactagagacaccaaatttagcagaacgtgtactcgattggctagaaaagcacggagctgaacgactcaaaagaatggcgattagtggagatgactgtgttgtaaaaccgattgatgatagatttgcgacagcactaacagcgttaaatgacatgggtaaagtgcgaaaagacataccccaatgggagccatcaaaagggtggaacgactggcaacaggtaccattttgctcacatcattttcatcaactaataatgaaagatgggcgtgagatcgttgtcccttgtcgtaatcaagacgaacttgtggggagagcaagagtaagtcagggagccggatggtctctcagagaaactgcgtgcctaggaaaatcgtacgcacaaatgtggcagctaatgtactttcatcggagggatttacgactagcggcaaatgcaatatgcagtgcggtcccagtagattgggttccgacgagccgtactacttggtcaatacatgctcatcatcagtggatgactacggaggatatgttatcagtttggaacagagtgtggatagaagaaaacccttggatggaagacaagactcatgtctcaagttgggaggaagtgccctaccttggcaaaagagaagaccagtggtgcggatcgctaatcggcctgacagcgagagcaacatgggccacaaatatacaagtcgcaattaatcaagtgaggcgactaattgggaacgaaaattatctagactacatgacttcgatgaaacgatttaaaaatgaatcagaccccgaaggagcactctggtaa

SEQ ID NO: 21267 - RNA, 9879 nt, synthetic construct
  misc_feature 1..9879: note = derived and/or modified CDS sequence (opt6) from DENV-1__GQ868534__SS-prME
  source 1..9879: mol_type = other RNA
tctgtaacaatgctcctgatgctactacctaccgcccttgcatttcacctgactactcggggtggagaaccgcatatgatagtaagcaaacaagagcgcggcaaaagtctactttttaaaacctctgcaggagttaatatgtgtacgctaatagccatggatttgggagagctttgcgaagacacaatgacctacaaatgtccccagatcacggaggctgaacctgatgacgtggactgctggtgcaatgcgacagacacatgggtaacatatggaacatgcagccaaactggcgaacataggcgggacaaacgaagtgtagcattagcaccacatgtaggacttggtctagagaccaggacggaaacttggatgagcagcgaaggtgcttggaaacaaatacaaagagtcgaaacctgggcattaagacacccaggttttaccgtaatcgcactcttcttggcacatgcgattggaacctcaataacacagaaaggcatcatatttatattattaatgttagttacaccaagcatggctatgcgatgtgtaggaatcggtaacagggactttgtcgaaggacttagtggcgcgacatgggtcgatgtagtcctagaacatggttcctgtgttactactatggcaaagaataagccaacgcttgatattgaactcctaaaaaccgaagtgacaaatccagcgatcctgcggaaattatgcatagaagctaaaatatcgaataccacaactgacagccggtgtccaacacaaggggaggctacgttagtggaagaacaagacgcaaattttgtctgtcgtagaactttcgtagatcgaggctggggaaacgggtgcggtctgtttggtaaggggtcattactaacgtgcgctaaatttaagtgtgtcactaaactcgaaggaaaaatagttcaatatgaaaacctgaaatactcagtgattgtaacagtgcacaccggcgaccaacatcaagtcggaaatgaaacaaccgaacatggtacgattgcgaccattacaccacaggcacctacatccgaaattcaactaacagactatggtgctttgacattagattgtagcccacgcacaggtctagattttaacgaaatggtacttttaacgatgaaagaaaagagctggcttgtgcacaagcaatggttcttggaccttccattgccatggacttcaggagcaagtaccagccaggaaacttggaaccgacaagatttacttgtaacatttaagaccgcacatgcgaagaaacaagaagtcgtagtgttaggctcgcaagagggtgcaatgcatactgctttaacaggcgcaacagaaattcaaacatctgggactacaaccattttcgcgggacatctaaaatgtagactgaaaatggataaattgaccttaaaaggtacctcatacgtaatgtgtaccggaagttttaaactagaaaaagaggtggcagaaacacagcatggtactgtcctagtccaagtaaaatacgaggggacagatgctccatgtaaaatacctttctcaacccaagacgaaaagggtgtaactcagaatggacgtctcataacagctaatccaatagtaacagataaagagaaacctgtaaacatagaaacggagcccccatttggcgagtcatatattgtcgtgggagccggggaaaaagcccttaaactatcatggtttaaaaaagggagtagtataggaaagatgtttgaagctacagctagaggcgctagaagaatggctatactaggcgacactgcatgggacttcggaagtataggaggagtcttcacgtcagtaggaaaattggtccatcaagtatttggaacggcatatggagtcctattttcaggagttagctggaccatgaaaataggaataggcatcctattaacatggttaggcctgaactctagatcaacctccctatctatgacatgtattgccgtcggtatggttacactttacttgggtgtaatggttcaagcagattctgggtgcgtaattaactggaaggggagggaattaaaatgcggatcagggatatttgtaacaaatgaagttcacacatggaccgaacaatataaattccaagccgacagcccaaagcgactaagcgctgcgatcggcaaagcctgggaagagggagtatgcggaattagatcagctacaaggcttgaaaacataatgtggaaacaaataagcaacgagttaaaccatatattattagaaaatgatatgaaattcactgtcgtggtaggtgacgcaaatggaatactagcacaaggaaaaaaaatgattcgacctcagccaatggagcataagtattcttggaagagttggggtaaagcaaagataattggagcagatattcagaacactaccttcataattgacggaccagatactcctgaatgcccagataaccaaagggcatggaacatatgggaggtcgaagattatggattcgggattttcacaacaaatatttggttaaaactgagagatagttatactcaaatgtgtgaccaccgattaatgtcagctgctatcaaagactcaaaagcggtacatgcagacatgggttattggatagaatctgaaaagaatgaaacttggaaattggcacgtgcttcatttattgaagtaaaaacctgcacgtggccgaagagccatactctatggtcgaatggggttctagagtctgaaatgattataccaaaaatatatggtggacccataagtcaacacaattatagaccaggatactttacgcaaactgcgggaccatggcatctaggaaagctggaactcgattttgatctttgcgaaggcacaaccgttgtagttgatgaacattgtggtaacagaggtccgtctctacgaacaacaacagtaacgggaaaaataatccacgagtggtgctgtaggagttgcacattgccgccattacgattccgtggagaagatggatgttggtatggaatggaaattagacccgttaaagaaaaagaggaaaatctagtacgaagtatggtatccgctggctctggcgaagtcgacagttttagtcttggtatcctctgcgtcagcataatgattgaggaagtaatgcgctccagatggtcgaggaaaatgctaatgaccggcacccttgccgtttttctattgttagtaatgggccaactgacatggaacgatctgattcgattatgtattatggtaggagccaatgcaagcgaccgaatgggaatgggaacaacttatctggctttaatggctactttcaaaatgagaccaatgttcgccgtcggattactgtttagaaggctcacatcacgcgaagttttactattgacaattgggctgtctttagtagcatccgttgaattaccaaattcactggaagaattaggtgatggattggcaatgggcataatgatgctaaaattacttacagaatttcagccccatcaattatggaccaccttattaagccttacgttcataaaaacaacattaagccttgactatgcttggaagactacagcaatggccttaagtatcgtatcgctatttccgctctgcctatcaaccacaagccaaaaaacaacatggctccctgtattgctcgggagttttggctgtaaaccacttacaatgtttttaataactgaaaataaaatatggggtcgtaaatcctggccactcaacgaaggtataatggccatcggaatcgtttcaatacttttaagtagtctacttaaaaatgatgttccactggcagggcctttgatcgcaggcggaatgcttatcgcatgctacgtgatctcagggtcgtctgcagatctaagcctagagaaagcggccgaggtatcatgggagcaagaggcagaacattcaggcacgagtcacaatatactagtagaagtgcaagacgatggaacaatgaaaattaaagatgaagaaagagatgatacactcactatactactaaaagccacattactagcagtatccggagtttatccgatgagtataccggcaactttattcgtgtggtatttttggcaaaagaaaaaacaacggtcgggtgttctatgggacactccgagtccacctgaggtagaacgtgcggtactcgacgatggaatatatcgaatactacaacgaggtttactcggaaggtcacaggtaggtgtcggagtttttcaagatggagtcttccatacgatgtggcatgttactaggggagcagtattgatgtatcaaggtaaacgattagaaccttcatgggcatcagtaaaaaaagatttgatttcatacggaggcggttggagatttcagggcagttggaacactggggaagaagtacaagttatagctgtagaacctggtaaaaatccaaaaaatgttcaaacaactccgggtacatttaaaacgccagagggtgaggtgggagcaattgctcttgattttaaacccggtacaagtggatcccccattgtgaaccgagaagggaaaattgtagggctctatggtaacggcgttgttacgacttccgggacgtatgtttctgctattgcacaggcaaaagcatcccaggaagggcctctaccagaaatagaagacgaagttttcaagaagagaaatttaacaatcatggacctacatccaggcagcggaaagacaaggaggtacttgccagccatcgtgagagaggcaataaaacgaaaattaagaacgcttatcctagcccctacgagagtagtcgcgtctgaaatggccgaagctttaaagggaatgcctattagataccaaacaactgctgtcaagagtgaacatacaggacgggaaattgtagatctaatgtgccatgcaacattcacaatgcgacttttaagccccgtacgggtacctaattacaacatgattataatggacgaagctcatttcaccgaccccgcttcaatagcggctagaggttacatatctacaagagtgggtatgggagaggcagccgcaatcttcatgactgctacaccgccaggaagcgtcgaagcctttccgcagtcaaatgcagttattcaggatgaagaacgagatataccagaaagaagttggaattccgggtatgactggatcactgatttccctggaaagacagtctggtttgtaccctcgataaaatcaggaaatgatattgccaactgcctacgaaaaaacggaaaacgagtaattcaactaagtagaaaaacattcgatacagaatatcaaaagacaaagaataacgattgggattatgtagtgactaccgatatatcggaaatgggtgctaatttcagagctgatagggttattgacccaaggagatgtctcaaacccgtaatactcaaagatggtcctgagcgtgtgatactggcaggacccatgcccgtaacagtcgcatctgccgcccaacgcagaggtagaataggtaggaaccaaaacaaagagggggaccaatatgtctatatgggccaaccacttaacaatgacgaagatcatgcacactggaccgaagcaaagatgcttttagacaatattaacacccctgaagggattattcctgcgctgttcgaacccgagcgggaaaagaatgctgccatagacggagaatatagactaaggggcgaagcacgaaaaacattcgtagagctcatgagacgaggagatttaccagtgtggctgtcatataaggtagctagtgaaggatttcagtattccgacagaagatggtgctttgacggagagcggaataatcaagtactggaagaaaatatggacgttgaaatatggacaaaagaaggagaacgtaaaaaactcagacctcgatggctggacgccaggacttattccgatcctctggcattacgtgaatttaaagagtttgcagcaggaagaaggtcagtctcaggggacttaatattagaaataggcaagctgcctcagcatcttactctaagagcacagaatgcccttgataacctagtgatgctacataactctgaacaaggcgggaaggcatatagacacgcaatggaagaactgccggatacaatcgaaacactaatgttgctagcattgatcgcagtgttaacgggaggtgttacattattctttctctcaggtaaggggctaggcaaaacctcaatcggactattatgtgtgactgcatcaagtgccctcctatggatggcgtcggttgagccacactggatagcagcgtcaattatactagaattttttctaatggtactgctgattccggaaccggaccgacaacggacacctcaggacaaccagctagcctatgtggtgataggcctactattcatgatccttacagtagcagcaaatgaaatgggattgcttgaaacaacaaaaaaggacctaggcattggacatgtagcggcagagaatcatcagcacgcaacaatgctagatgttgatttgaggccggctagtgcctggacactatatgcagtagcgactaccgtaataaccccaatgatgagacatacgatagaaaatacgacggctaacattagccttactgcaatcgccaatcaagctgcaatactaatgggtttagataaaggttggcccatcagcaaaatggatatcggggttccattgctagcattgggctgttattcccaggttaaccctttgaccctaaccgcggcagtcttaatgctagtggctcattatgcaattataggaccaggtttacaggctaaagctacgcgcgaagctcaaaaacgtacagcagcaggtattatgaagaatccaactgtagatggtatagtcgccatcgacttggacccagttgtctacgatgcaaaatttgaaaaacaacttggacagataatgttgctaatactgtgcaccagtcaaatattacttatgaggaccacttgggcgttatgtgaaagcattacccttgccacaggaccactaacaacattatgggaaggaagccctggaaaattctggaataccacaatagccgtctcgatggcgaatatttttagaggaagctacttagcgggggcaggcttagcattcagcttaatgaaatcactagggggtggacgaaggggtacaggagcccaaggtgaaaccctaggggagaaatggaagaggcagttgaatcagttatcgaagtctgaattcaatacatataagaggtccggcatcatggaagtcgacaggtctgaagccaaagaaggtctaaaaaggggagaaacgacgaaacatgccgtaagtcgaggtactgcaaaactcagatggtttgtcgaacgtaacttggttaaaccggaaggtaaggtcatagacttgggctgtggtcgaggaggttggtcctactattgcgcaggacttaagaaagtaacagaggtaaaagggtacacgaaaggaggaccagggcacgaagaaccaatacctatggcaacatatgggtggaatttagttaaactccatagtggcaaggatgttttcttcattcccccggaaaagtgtgatacactgctatgtgacataggtgagtcaagtccaaacccaactatcgaagaggggaggactctcagagttttgaaaatggtagaaccttggttacggggaaaccagttctgcataaaaatactaaatccctatatgcccagtgttgtcgaggcattagaacaaatgcaaagaaagcacggcggcatgctcgtacgaaatccattaagccggaatagtacgcatgagatgtactgggtaagttgcggtacaggaaatattgtttcagcggtaaacatgacttcccggatgctcctgaataggttcacgatggctcaccgtaagccaacatacgaacgcgacgttgatctaggtgcgggaacacggcacgtagctgtcgagccggaagtagctaacctcgacataataggacaacgcattgagaatataaaaaatgaacataagagtacttggcactacgacgaagacaacccttataagacttgggcctaccatggctcctatgaggtaaaacctagcggatcagcatcctcaatggttaatggggtagtaagacttctaaccaaaccatgggacgtaatcccaatggtaacccaaatagctatgacggacacaactcctttcggccaacaaagagtatttaaggagaaagtagatacccgtacccctcgcgcaaagcgcggtacgactcaaataatggaagtaacagcaaagtggctttggggattcctctctagaaataaaaagccccggatatgtacgcgcgaagaatttacccgcaaagttaggagtaacgcagcaataggagcagtcttcgtcgatgagaatcaatggaactcagctaaggaagcagttgaagacgaacgcttttgggatctagtccacagggaacgggaattacataaacaaggtaaatgcgcaacatgtgtatacaacatgatgggaaaacgtgaaaaaaaactgggtgaatttggtaaagcaaagggttcaagagcgatttggtacatgtggttaggtgccaggtttctagaatttgaagcactggggttcatgaatgaggatcattggttttctcgcgaaaacagcctatctggcgtggagggtgaaggcttacacaaactgggatatatattaagagatataagtaaaatccctggcgggaatatgtatgcagatgacaccgcagggtgggacacgcgaatcacggaggatgatttgcaaaacgaagccaaaataactgagatcatggagcctgaacatgccttgctagctactagtatatttaaacttacctatcaaaacaaagtagtgagagtccaaagaccggctaaaaacggaactgtcatggatgtcatatctagacgagatcaacgaggttcaggacaagtaggaacatacgggttaaatacatttacaaacatggaagtgcagctaattcggcaaatggagagtgaagggatctttttgccctccgaattggaaaccccaaacctggccgaaagggcactagactggttagagaaacacggggccgaacgccttaaaagaatggcgatctcgggtgatgattgtgttgtaaaacctatagatgaccgctttgctacagctctaacagcattgaatgatatgggaaaagtaaggaaagatataccgcaatgggaaccttccaaaggttggaacgattggcaacaggtccccttttgcagccaccattttcatcagctaataatgaaagatgggagagaaatagttgttccatgtcgaaaccaagacgaattagtgggtcgggcaagagtaagtcaaggcgccggttggtcactacgagagaccgcatgccttggcaaaagttatgcacagatgtggcaacttatgtattttcatagaagagatttgagattagcagcaaacgcgatatgcagcgcagtacctgtagactgggtgccaacgtcacgtacaacatggagtatacacgctcaccaccaatggatgactactgaggatatgttgagtgtttggaatagagtctggatcgaagaaaatccatggatggaagataaaactcacgtcagcagctgggaagaggttccatacctaggaaaaagggaagaccaatggtgcggcagcctaataggtctaacggcacgtgctacttgggctacaaatatacaagtagcgataaatcaggtgcgcaggcttatagggaatgaaaactacctagattacatgacatcaatgaaacgctttaagaatgaatcagatccagaaggcgcgttatggtga

SEQ ID NO: 21268 - RNA, 9879 nt, synthetic construct
  misc_feature 1..9879: note = derived and/or modified CDS sequence (opt6) from DENV-1__GQ868535__SS-prME
  source 1..9879: mol_type = other RNA
tcagtaactatgttactgatgctactacctactgcgttagcttttcatctcacaacgcgaggaggagagccacatatgattgttagcaaacaagaacgcggaaaaagtctcctcttcaaaacaagtgcaggggtaaatatgtgtacattaatagcaatggacttgggcgaattgtgtgaagacacaatgacgtacaaatgtcctcaaattacagaagccgaacctgatgatgtagactgctggtgtaacgcaacagacacatgggtaacgtacgggacatgtagtcaaacgggagagcatcgtcgcgataaacggagcgtagcactcgctccacacgtagggcttgggttggaaacccgtactgagacatggatgtcctcagaaggagcatggaaacaaatacaacgagtcgagacctgggcacttcgacaccctggttttacagtaatagccctctttttggcacatgcgataggtacatcaataacccaaaaaggtataatttttatacttttaatgttagttactcctagcatggcaatgagatgcgtgggcatagggaatagagacttcgttgagggcttgagtggagccacatgggtagatgtagttctagagcacgggtcttgtgtaacaaccatggccaaaaacaaacccactctcgacatagaattactaaaaacagaagtagcaaacccagcaatattacggaaattatgtattgaagcaaaaatatcaaatacaactaccgattcacgttgcccaacccaaggcgaggccacattagttgaagaacaagatgcaaactttgtttgccgccgaacattcgtggacagagggtggggtaatggatgcggcttgttcggcaagggcagcttactaacatgtgcaaagtttaaatgcgtaacaaaactcgaaggcaaaatagttcagtatgaaaacttgaaatattcggtgattgtaaccgtccatacaggagatcaacaccaagtcggaaacgaaacaactgaacatggaacaatagcaacaatcactccacaagctcccacaagcgaaatacagttaactgattatggagcactaaccctcgactgttcgcctcgaactggtcttgatttcaatgaaatggtccttctaacaatgaaagaaaaatcctggctggttcacaaacaatggtttctcgatcttcctctaccgtggacaagtggagcatctacatcacaggaaacttggaatcgacaagatttgctcgtaacatttaagacagcccacgctaagaaacaagaagtagttgtccttggaagtcaggaaggtgcaatgcataccgcgttgactggtgcaacagaaattcagacaagtggcacaacgactatattcgcagggcatcttaaatgcaggttaaagatggacaagctaacgttaaaaggaacatcgtatgttatgtgcacagggagttttaagctcgaaaaagaagttgctgaaacacaacacggaacggtattggtacaggtgaaatacgaaggcacggacgcgccatgtaaaatccccttctcaactcaagacgagaagggtgtgactcaaaatggccgattaattacagcaaatccaatcgtaacagacaaggaaaaacctgtaaatatagagacggaaccgccttttggtgagtcgtacatagtcgtcggggcaggggaaaaagcgctaaaactctcttggtttaaaaagggcagctcaataggaaagatgtttgaagccacagctcgaggcgctaggaggatggcgattttgggggatacagcgtgggactttggaagcataggtggtgtatttacaagtgttggtaagttggtccatcaggtttttggaaccgcatatggcgtcttgttctccggagtcagctggactatgaagataggaattgggatactgctcacatggctcggactaaacagtagatcaacgtcactatctatgacatgcatcgcagtaggaatggtaacgttgtatttaggcgtaatggtacaggctgatagtggatgcgtaattaattggaaaggaagagaactcaaatgtggatcggggatattcgtaacaaatgaagttcacacatggacagagcaatacaaatttcaggccgactcgccaaaacgattatcagcagctataggaaaggcatgggaggagggggtttgcggtattagaagcgcaacaagactagaaaacattatgtggaaacaaatatccaatgaactaaaccatatcctgttagagaacgatatgaaatttacagttgttgtaggagatgcaaatggaatacttgctcaaggtaaaaagatgatacgccctcaacctatggaacataaatacagctggaagtcctgggggaaagccaagatcataggagcagatatccaaaatactacttttatcattgatgggcctgatacaccggaatgtccagacaaccaacgagcatggaacatttgggaggttgaggattatggttttggaatattcacaacaaatatatggctaaaacttagagattcatacactcagatgtgtgatcataggttaatgtcggcagccataaaagactcaaaagcggttcatgctgacatgggatattggattgaatctgagaagaatgagacatggaaattagcgagagccagctttattgaagtaaaaacctgcacctggcccaaatcacatacattgtggagcaatggagtattagaaagcgaaatgattattcccaaaatttacggaggaccaatatctcaacataattacagaccaggatattttactcaaacagctggaccatggcatttaggaaaattagaattggattttgacctgtgtgaaggtacaacagtagtcgttgacgaacattgtggaaaccgagggccgagcttgcgcacaactactgtcacgggtaagataattcacgaatggtgttgtagaagttgcactctacctccacttcggttcagaggtgaagacggatgctggtatgggatggagatacgaccggtgaaagaaaaagaagaaaatctggttcgatcaatggtgtctgctggaagtggcgaagttgatagcttctcgcttggcattttgtgtgcatctataatgatcgaagaagtaatgcgtagtcgctggagtagaaaaatgctgatgacgggaacattagctgtattcttactattaataatgggccaattgacgtggaatgacttaattcgcctgtgtatcatggtcggggcaaacgccagcgatagaatgggcatgggtaccacatacctggcacttatggcaacctttaagatgaggcctatgttcgcggtaggactactattcagacgccttaccagcagagaagttttactactaacaattggattgtcattagtagcctctgtcgaactgccaaactcgctcgaagagttgggagatggcttagctatgggtataatgatgctcaaattactaactgaatttcagccccatcagctttggaccacgctactatcattgacattcataaaaacaacattatctcttgattatgcatggaaaacgaccgcgatggcactcagtatagtgtcactatttcccttgtgtctatccacaacatcccaaaagaccacttggttaccagtattactaggatcatttggctgtaagccattaactatgtttttgattacagaaaacaaaatttggggaaggaaatcgtggcccctaaatgaaggtattatggcaataggcatagtgagcattttactatcttcactcctgaaaaacgatgtacccctagcaggaccattgattgctggaggcatgctaattgcctgttacgtgatctcaggatcatcagcagatttaagcctcgaaaaagctgctgaagtaagttgggaacaagaagcagaacattcggggacaagccataatatcctagtcgaagtacaagatgatggaactatgaaaatcaaggacgaagagagagatgatacactcacaatattattaaaggcaacactgctagcggtatccggagtgtatccaatgtcaataccggcgacactctttgtatggtatttttggcagaagaagaaacaacgatcgggagttttatgggatacaccaagtccccctgaggttgaaagggcagttttggatgatggtatttacagaatacttcaaagaggactgctaggacgctcgcaggtaggggtaggagtgttccaggatggcgtatttcatacgatgtggcacgttacaagaggggccgttttaatgtatcagggaaaaagactagaaccgagttgggcaagcgtgaaaaaggatctaattagttatggagggggatggaggttccaaggttcgtggaatatgggagaggaagtgcaagttattgcggtagaacccgggaaaaatccaaagaatgtccagactaccccggggacttttaagaccccggaaggggaagttggggccatagcgttggacttcaagccaggaacaagtggatctccaatcgtgaatagagaaggaaaaatcgttggactttatggaaatggagtggtaactacatctggtacttatgtttctgctatagcacaagcaaaggcgtcacaagagggaccacttcctgaaattgaagacgaggtctttaagaaaagaaacttaaccatcatggacctacatccgggaagtgggaaaactcgacgttaccttcctgcgatagtaagagaagcaatcaaacgaaaattacgaacgctaatcctagcgccaactagggttgtagcctccgaaatggcagaagccttgaaagggatgccaatacgataccaaacaacagcagtaaaaagtgaacatacagggagagagatagtagacctaatgtgtcatgcaacgtttaccatgagattactatctcctgtaagagtccctaactataatatgataataatggatgaagcgcacttcactgacccggcatccattgccgcacgaggatatattagcactagggtaggaatgggtgaagctgctgcgatttttatgactgcaacccctcctggctccgtggaggcatttccacaaagtaatgcagttatacaagacgaggaacgagacattcctgagagatcttggaactcagggtatgattggataactgacttccccggaaagaccgtatggttcgtaccatctataaaatctggaaatgacatcgcaaattgtctccggaaaaatggaaaacgagtaattcaactctccagaaaaacttttgacacagagtatcaaaagactaaaaataatgattgggattatgttgtgaccacagacatcagtgaaatgggcgctaacttcagagctgatagagttattgatcccaggaggtgccttaaaccagtaattctaaaagacggacctgaacgagttatattagcggggccaatgccggtgacagtcgcatctgccgcccaacgacgtggaagaatcggtcggaatcaaaacaaagaaggtgatcagtacgtgtacatgggccagccgctaaataacgatgaagatcatgcacattggacagaagctaaaatgctgttggataatataaatactccggaagggattatcccagccttattcgaaccagaacgtgaaaaatctgctgcaatagatggtgagtatcgcctaagaggagaggcgcgtaaaacatttgtggagttaatgagacgcggcgatttgccagtctggctaagctataaagtagcaagtgaagggtttcaatacagcgaccggcggtggtgttttgacggtgaacgaaacaatcaagttttggaagaaaacatggatgtagagatctggacaaaggagggtgagagaaagaaattgaggccccggtggctcgacgcaagaacttactctgatccgttagcattaagggaatttaaagaatttgctgcaggacgacgttctgtaagtggcgatctgatactagaaatcggcaaattacctcaacatttaaccctccgagcacaaaatgcactagataacctggttatgttacataacagcgagcaaggtggaaaggcttaccgtcatgctatggaagaactcccggatacaatagaaaccctcatgctactagccttaatagcagtattaaccggtggagtaactttattctttctatcaggaaagggcctagggaaaacatcaattggattactatgtgttactgcgtctagtgctctattgtggatggcttcagtcgaaccacactggatagcagccagtattatcctcgagttctttttaatggttcttttgatccctgaaccggatagacagcgtacgccccaagataaccagcttgcttatgtggtgataggcttacttttcatgatactcaccgttgcagctaatgaaatgggtctactagaaacaactaagaaagatttaggtataggccatgtcgctgctgaaaaccatcaacatgcgacgatgctcgacgtggatctcagaccagctagcgcatggactctgtacgcggttgccactactgtaataactccgatgatgcgacacactatagaaaacacaacagccaatatcagcttaactgcaatagcaaatcaagctgctattttaatgggactcgataaaggctggccaatttcaaaaatggatataggagtacccttactagcccttggatgctactctcaagtaaatcccttgacacttacggcagccgttttaatgctagttgctcactacgcaataataggacctggtctccaggccaaagctacccgagaagcacaaaagcgtacagcggctggtattatgaaaaacccaactgttgatggtatcgttgccattgatttggacccggttgtatatgacgcaaaatttgagaaacaactagggcagattatgttactaatactatgtacctcccaaatattgttaatgcgaaccacatgggctctatgtgaatcaatcactttagccaccggtccacttacaactctttgggaaggaagtccgggaaaattttggaacacgacaattgcagtttcgatggcgaatatttttcgaggaagttatctagctggagcaggtttagcgttttcactaatgaaatcgctaggtggtggtcggagaggaacaggggcacaaggtgagacattaggcgaaaaatggaagcggcaacttaaccaattatcaaagagcgagtttaatacttataaacggtcaggtataatggaggttgatcgcagtgaggcaaaggaaggcctaaagagaggagagacgacaaagcacgccgtaagtagaggcaccgcaaaactccgatggttcgtagaacgtaatttagtcaagcctgaaggaaaagttattgatctcggttgcggacgaggcggttggtcttactattgcgcaggcttaaagaaagtcactgaggtaaaagggtacaccaagggcggaccaggccacgaagaaccaataccaatggctacatatggatggaatctagtgaagctccatagtggaaaggacgtattctttatgcctcctgaaaagtgtgacacacttctatgcgatataggcgaaagcagtccaaatccaacaatcgaagaaggcaggacgctgcgggtacttaaaatggtagagccttggctgaggggtaaccaattttgtataaagatactaaacccatatatgccaagtgtggtagaaacattagaacaaatgcaaagaaaacacggaggaatgttagttagaaatccactctcgagaaattcgacacatgaaatgtactgggtatcttgcggaactgggaatatagtttccgcagtaaacatgacatcaagaatgttactcaatagatttacgatggcacatcggaaacctacatttgagagagatgtggacttaggggcgggtacgcgacatgtagcggtggaaccagaagtcgccaatttggatatcataggacaacgtatagaaaacattaagaatgaacataaatccacatggcactatgatgaagataatccatacaagacttgggcatatcatggttcctatgaggtgaaaccaagtggatcagcctcttcgatggtaaacggggttgtacgactgttgactaaaccatgggatgtcataccaatggtaacgcagatcgccatgacagacacaactccatttggacaacagcgagtatttaaagaaaaagttgatacacgaactcctagagcaaaacgaggaacgacacagataatggaagtcactgctaaatggttatggggtttcctcagtaggaataagaaaccaaggatatgtacacgtgaagaatttactagaaaagtacgaagtaacgctgcaattggcgcagtttttgttgacgaaaaccaatggaactcagccaaagaagcggtagaagatgaaagattttgggaccttgtccaccgtgaaagagaactgcacaaacaaggtaagtgtgccacatgtgtatataacatgatgggcaaaagagaaaagaaacttggagaatttgggaaggccaaaggatctcgggcgatatggtatatgtggttaggcgcgcgattcctagagtttgaagcattaggattcatgaacgaagatcattggttcagtagggaaaatagtctaagtggagtagaaggggaaggactacataaactcggatatatactcagagatattagcaaaataccagggggaaacatgtatgcagacgatacagcaggatgggatacccgaataactgaggacgatttacaaaacgaagccaaaattaccgatataatggagcccgagcatgccctattggcgacatctatatttaaactgacttatcaaaacaaagtagtcagagtacagaggcctgctaagaatgggacggtgatggatgtaatctccagaagagatcaaagaggtagtgggcaggtagggacatacggattaaatacatttaccaacatggaagtacaattgattagacaaatggagagtgaaggtatatttctgccaagtgaacttgaaactccaaatttggctgaaagggtactcgattggttagaaaagcatggtgcagaaagattgaaaaggatggccattagcggagacgattgtgtcgtaaaaccaatagatgatcgatttgcaaccgctttaaccgctttaaatgacatgggtaaagttcgtaaagatatcccccagtgggaaccgtctaaaggctggaatgattggcagcaagtcccattttgcagtcatcatttccatcaactcattatgaaggacggacgcgagatagtagtcccgtgcagaaatcaagacgaacttgtcggcagagcacgagttagtcagggggcagggtggagcctcagagagaccgcgtgtcttggaaaaagttacgctcaaatgtggcagttaatgtattttcaccgaagagatctaaggttagctgccaatgccatctgtagtgccgtgcccgtagactgggttccaacgtctcgcactacttggtcaatccacgcccatcatcaatggatgacaacagaagacatgctaagtgtttggaacagagtatggatagaagaaaatccctggatggaagataagacacacgtatcatcatgggaggaagtgccatacctgggaaagagagaagatcaatggtgtggttctctgattggtttaactgctcgagccacatgggcaactaacattcaagttgcgataaatcaagtgcgtcggctaatcgggaatgaaaactatctagattatatgacatcgatgaaacgattcaagaacgaatcagatccggaaggagccctatggtag

SEQ ID NO: 21269 - RNA, 9879 nt, synthetic construct
  misc_feature 1..9879: note = derived and/or modified CDS sequence (opt6) from DENV-1__KJ189306__SS-prME
  source 1..9879: mol_type = other RNA
tccgtcactatgttgttaatgttactacccaccgcgctcgcctttcatttaactactcgtggaggagaaccacatatgatagtttccaaacaagaacgaggcaaatcattattgttcaaaacctctgcgggtgtgaacatgtgtacactcatcgcaatggacctcggcgaattatgcgaagataccatgacttacaaatgcccacaaataacagaggcagagcctgatgacgtcgattgctggtgcaacgcgacggatacatgggtgacttacggcacttgtagccaaacgggtgaacatagaagagacaaaagatcagtagcgttagctccacatgtgggactcggactagaaacccgtactgaaacatggatgagttctgaaggtgcatggaaacaaattcaacgtgtagaaacctgggcgttacgtcaccctggattcactgtgatcgccctctttcttgcgcacgcaattggaacgtctattactcaaaaagggataatatttatattgttaatgcttgtcaccccatcaatggcaatgagatgcgtcgggataggaaatcgggactttgttgagggtctatccggagcaacgtgggtagatgttgtcttggaacatggaagttgtgtaacgacgatggccaaaaacaaacctactctggatatcgaacttcttaaaaccgaagtaacaaacccggctattctacgaaaattatgtatagaagctaaaatttctaacacgacaacagattccaggtgtccaacgcaaggagaagccacattagttgaggaacaagacgcaaatttcgtgtgtagacgaacctttgtggaccgtggttggggcaatggctgtggattatttggtaagggtagtctattgacatgtgctaaattcaagtgtgttaccaaactcgaaggaaagatcgtgcaatatgagaatttgaaatattcagtaattgtaaccgtacacactggtgatcaacaccaagtgggaaacgaaactacggagcacggtactatagcaactatcacaccccaagccccaacgagtgaaatacagctgaccgattacggggcattgacactggactgtagtccaagaacaggattagactttaatgaaatggtattattaacaatgaaagaaaagagttggctggtacataaacagtggttcctggatcttccacttccctggacgagtggtgcctcaaccagccaggaaacatggaacaggcaagatttgctagtcacatttaaaacagcacatgcaaagaaacaagaagtagtagttttggggtcacaggaaggagccatgcacacggcgttgaccggagcaacagaaattcaaactagcggaactaccactatttttgcgggtcatttaaagtgtcgacttaaaatggataagctaactctgaaaggaacttcatatgtgatgtgcaccggaccatttaaactagaaaaggaagttgccgaaacccaacacggtacagtgctagttcaagtgaaatacgagggtactgatgccccgtgcaaaataccctttttaactcaggacgaaaaaggagtcacgcaaaacggacgacttattactgcaaaccctatcgttacggataaagagaaaccagtgaacatagaaacggaacctccatttggcgaaagttacatcgttgtcggagctggtgaaaaagctctaaagctatcatggtttaagaaaggtagtagtataggtaagatgttcgaagccacagccagaggtgcccgtaggatggctatacttggagacacagcatgggattttggctctatagggggcgtattcacgagcgtgggaaaacttgtgcaccaagtgtttgggactgcctatggcgttctatttagcggtgtatcgtggactatgaaaataggtataggtatattactaacttggctaggtctgaatagcagatcaacttctcttagcatgacgtgcatagctgtgggaatggtgacattatatctaggtgtaatggtacaggctgattcaggttgcgtcattaattggaaaggtcgtgaactaaaatgtgggtcaggcatatttgtaactaacgaagttcacacttggactgaacagtacaaatttcaagccgatagtccaaaaagattgtcagccgctataggcaaggcttgggaagaaggtgtttgcggcattcgctctgccactagactagagaatataatgtggaaacagattagtaacgaactgaaccatatattactcgagaacgatatgaaattcacagtggtagtaggtgacgctaatggtatcttagcacaaggtaagaaaatgatacgaccacaacctatggaacataagtactcttggaaaagttggggcaaagcaaaaataatcggagcggacatccaaaacactacctttataatagacggtcctgatacacccgagtgtcctgacaaccaacgcgcttggaatatctgggaggttgaggattacggatttggcatttttacaacaaacatttggttaaaactaagggactcgtatactcaaatgtgtgatcaccgattaatgtcggcagctataaaggattcaaaagctgttcacgctgatatgggatactggattgagagtgagaaaaatgaaacttggaaactggcgagggcatcattcatagaagttaaaacatgtacatggccaaaaagtcacacactatggtctaatggagtccttgaaagcgaaatgataatccctaaaatctatgggggtccaatttctcaacacaactatcgaccagggtattttacgcaaaccgcaggaccttggcacttgggtaaattagaactggactttgatctatgtgaagggactaccgttgtcgtagatgaacattgcggaaatagaggacccagtcttagaacaacaactgttactgggaaaataatacatgagtggtgctgcagatcctgtactctgccaccattaagatttcgtggtgaagacggctgttggtacgggatggaaataaggccagtaaaggaaaaagaagaaaacttagtacggtcaatggtaagcgcgggaagcggagaggtagattcgttttcactgggaatcttgtgtgtatccataatgatcgaagaagtaatgcgttcgcgctggtcgcgcaagatgttaatgacaggtacattggcagtattcttattacttgtcatgggccaacttacttggaatgatcttatacgtttatgtataatggttggcgccaatgcatcagatcgtatgggcatgggaacaacgtatctagcactaatggcaacattcaaaatgagaccgatgttcgcggttggtcttttattccgtcgtttaacttccagagaagtactattgcttacaataggtctttcgctcgtagcctctgtggaactcccaaattcccttgaagaattgggtgatggattagcgatgggaataatgatgttgaaattactgactgaatttcagcctcatcaactatggactacattactaagtttaacatttattaaaacgaccttatccctagattatgcttggaaaaccaccgcgatggcattatctattgtttccttattccctctctgccttagcaccacctcgcagaaaaccacatggctaccagttctattaggtagtttcggttgcaaaccattaacaatgttcctgataactgaaaacaagatctggggaagaaaaagttggcccttgaatgaaggtataatggcaatcggaattgtaagtatacttttgtcttcgttacttaagaacgacgtaccactagctggaccactcattgcgggaggcatgttgatcgcttgttacgtaattagcggttcaagtgcagatttatcacttgaaagagcagccgaagttagctgggaacaagaagcagaacatagcggtacaagccataacatacttgtagaggtacaggacgacggcacgatgaaaattaaggatgaagaacgagatgacacactcaccattcttttgaaagctacgttactagctgtctccggggtatacccaatgagtattcccgctacactttttgtgtggtacttttggcaaaagaagaaacaacgatctggagtcctatgggatactcctagtccgccagaagtagaaagagcagttttggatgatggaatctataggattctgcagagaggcttacttggcagaagtcaagtaggagtaggagttttccaagatggagtttttcataccatgtggcacgtaacaagaggagctgtactaatgtaccaaggcaaacgcttggaaccatcctgggcaagcgtaaagaaagatttgatttcatatgggggaggttggcggttccagggctcgtggaatacaggcgaagaggtacaagtgatcgctgttgaacctgggaaaaatcctaaaaatgtacaaacaaccccaggcactttcaagacaccagaaggagaagtaggcgctatcgcattggactttaaaccaggtactagcggaagtccaattgttaacagggagggtaaaattgtagggctatacgggaatggagtggttacgacatctggaacctatgtgtctgcgatagcccaagccaaagctagccaagaaggacctttgccggaaatagaggacgaagttttcaagaagagaaacctaactattatggacttacacccaggatctggaaaaacaaggcgctatttacctgctatagtgcgggaagctattaaaagaaaacttagaacattaatattagcccctacaagggtcgtggcaagcgaaatggctgaagcactaaaaggtatgcccatacgatatcaaaccacagccgtcaaaagcgagcatactggacgagaaatagtagatctcatgtgtcatgctacatttaccatgcgcctgctgagcccagtgcgagtgccgaactataacatgataataatggatgaagctcacttcactgatcccgcttccatagccgctcgcggatatataagcacaagagttggcatgggagaggcggctgcgatatttatgaccgcaacgcctcctggaagcgtagaggcttttcctcaaagcaacgcagttatccaagatgaagaacgggatattccagagagaagttggaacagtggctacgattggataacagacttccccggtaaaactgtttggttcgtaccgtcgatcaaatcaggaaatgatattgcgaattgtttacggaaaaacggtaagcgagttattcagctctcacggaaaacatttgatacagaataccagaaaactaagaataacgattgggactacgttgtcactactgacatatcagaaatgggagccaattttagggctgatagggtgatagacccgcgacgctgtcttaagccagtaatcctcaaagatggccccgagagagtaattttagcgggcccgatgccagtcaccgttgcttctgcagcacaacgacgaggacgaattggacgtaatcaaaataaagaaggtgatcaatacgtctacatgggacaacccctaaacaacgacgaggatcatgcgcattggacagaagcgaaaatgcttctagacaacataaacacacctgaaggaataatccctgctctattcgaaccagaaagggagaaatccgccgcaatcgacggagaatatagattaagaggagaagctaggaagacgttcgttgagttgatgaggaggggagacttaccagtgtggctttcatataaagtggcatcggaaggattccaatactctgatagaaggtggtgcttcgacggggagcggaacaatcaagttttagaagagaatatggacgtagagatttggactaaagaaggcgaaaggaagaaacttagaccacgctggctggacgcgagaacatactcagatccactagcgttaagggaatttaaagagttcgcagcggggcgacgaagcgtctctggcgatctcatcctcgagatcggcaaattaccacagcatttgacacttagagcacaaaatgcactagacaatctggttatgttgcacaattcagaacaaggagggaaggcctaccgtcatgcgatggaagaattaccggatacaatcgaaacgcttatgctattagctttaatagccgttttgacaggtggagtcactctattctttctttccgggaaaggtttaggcaaaacatcaatcggcttactatgtgtaactgcttcatctgcgctactttggatggcttcagtcgaaccacattggattgctgctagtatcatacttgagttctttttaatggtgcttctaatcccggaacctgatagacaacgtacaccccaagacaaccaacttgcctacgttgttataggattattattcatgatactcaccgtggcagcaaatgaaatgggcttgctcgaaacgaccaagaaagacctgggtataggtcacgtggccgcagaaaatcatcaacatgcaacaatgctagacgtcgacttacgaccagccagcgcttggactttgtatgcagtcgcaactacagtcataacaccgatgatgcgacatactatagagaatactaccgcgaatataagtctgaccgcaatagcgaatcaagcggcaattttaatgggtctagacaaaggatggccgataagtaaaatggatattggcgtaccgctcttggcgcttggttgttactcacaggtaaatcctttaacactaacggcagctgtattaatgttagtggcgcactatgccatcataggacctggtcttcaagcaaaagccaccagagaagctcagaaaagaacagctgcaggaataatgaaaaatcccactgtagatggtattgtggcaatagatctagatcccgtggtgtatgatgcaaaattcgaaaaacaactaggacagataatgttgttaatcctttgcacttcccaaatattactgatgcgaaccacctgggctctatgtgaatctatcaccctagctactggcccgttaacaacactatgggagggctctccaggaaaattctggaacactacaattgcagtgtcaatggctaatatattcagaggatcatatctagccggtgcagggctagcctttagcttaatgaaatcgctgggcgggggaagaaggggcacgggagctcaaggagaaacattaggagaaaaatggaaaaggcaactaaatcaacttagtaaatctgaatttcatatatacaaaagaagtggaattatggaggtagatcggagcgaagcaaaagaaggattaaagcgaggagaaacaacaaaacacgcggtatctcgcggcaccgccaaacttcgttggttcgttgaaaggaacttggtgaaaccggaaggaaaagtaatagatttaggatgtggaaggggaggatggtcgtactactgtgcagggctgaagaaagtaaccgaggtaaaaggctacacaaaaggtgggcctggacacgaagaacccatacctatggccacatacggttggaatctagtaaaactgcatagtggtaaggacgtattctttatgccacccgaaaaatgcgacacgctactgtgcgatataggagaatctagtcctaacccaacaatcgaggagggacgtacacttcgggtactcaagatggtcgaaccatggctacgaggcaaccaattttgtataaagatattaaatccatatatgccttcagtggtcgaaacgctagagcaaatgcaaaggaagcacggaggtatgcttgtgcgaaatccactgtcacgaaactcaacgcatgaaatgtattgggtatcatgcggaactggtaatatagtttcggctgtaaatatgacgtcccgaatgctactaaataggtttacaatggcccatcgcaaaccaacatatgagagagatgtagacctaggagcaggtactcggcatgtggctgttgaaccagaggtcgcgaatctagatataatcggccagagaatagaaaacattaaaaatgaacataagagcacttggcactatgacgaggataatccatataaaacatgggcataccacgggtcctacgaggtcaagccatcaggatcagcatcttcgatggtaaatggagtcgtccgattattgacaaaaccatgggatgtaataccgatggtgacacaaatagctatgactgacaccacaccttttggacagcagagagtatttaaggaaaaggtggatacaagaactccaagagccaaaagaggtactactcagataatggaagttactgcgaaatggctctgggggttcctttcaagaaataagaaacctagaatatgtacaagagaggaatttataagaaaggtccgttccaacgcagccataggggcggtatttgtggatgaaaaccaatggaactcagcaaaagaagcagtagaagatgaacgattttgggacttagttcatagagaaagagaactacataaacaaggaaaatgcgcgacctgcgtatacaatatgatgggtaaacgagaaaagaaactgggagaatttggtaaagccaaagggtcacgagcaatctggtatatgtggctaggagcacgattcttagaatttgaagcgttaggttttatgaatgaagatcattggttttcaagagagaactcactaagcggtgtggagggagaaggtcttcacaaactaggttacatattacgtgatatatcgaaaattccgggtggcaatatgtacgcagatgacacagcaggctgggatactagaataaccgaagatgatttacaaaatgaggccaaaataactgaaataatggaacctgagcacgcattattagctacttcaatctttaaactaacttatcagaacaaagtggtaagagtgcaaagaccggcaaagaacggtactgttatggacgtaatatcgcgacgtgatcagcgtggtagtgggcaagttgggacatatggtctgaatacatttacgaatatggaagtacagctcattcgtcaaatggaatcggaaggaatctttctgcctagtgagttagaaacccctaacctcgcggaaagggtactagactggctggagaaacatggagcagagcgactaaaaagaatggcaatatccggagacgattgcgtcgttaagcctatagatgacagatttgccaccgctttaacagccttaaacgatatgggcaaagtaagaaaagatataccacagtgggaaccatccaagggatggaatgactggcagcaagtacctttttgttcacatcacttccatcaactgattatgaaagatgggcgcgaaatagtagtaccttgtagaaatcaagatgaattagtaggcagagcgagagtaagtcaaggcgcaggatggtcactaagagaaacagcttgtttaggaaagtcatacgcacaaatgtggcaacttatgtacttccatagaagagatcttcgtctagcagcgaatgcaatatgtagtgcagtgcctgttgattgggtcccgacttctcgaaccacttggagcattcatgcacatcatcaatggatgaccacagaagatatgttatctgtttggaatagggtctggatagaagagaacccctggatggaggataaaactcatgtaagttcttgggaagaggtcccatacctgggaaaaagagaagaccaatggtgcggatctctaatagggttaactgctagagctacatgggccactaatatacaagtagctattaaccaggtccggagacttatcggaaatgagaactacttagactacatgacctcaatgaaaaggttcaaaaatgaaagcgatcccgaaggagcattatggtga

SEQ ID NO: 21270 - RNA, 9879 nt, synthetic construct
  misc_feature 1..9879: note = derived and/or modified CDS sequence (opt6) from DENV-1__KJ189307__SS-prME
  source 1..9879: mol_type = other RNA
tccgtaacaatgctattaatgttactacctacagcactagctttccatctcactaccagaggaggggaacctcatatgattgtatcaaaacaagaacgaggtaaatctctattgttcaaaacaagcgctggcgtaaatatgtgcacgctaatagcaatggatctcggggaactatgtgaagacacaatgacttacaagtgcccccagataacagaagcggaaccagacgacgttgactgctggtgcaatgccacagatacatgggtaacttacgggacctgcagtcaaacaggagaacacagacgtgacaaaagaagtgtcgccttggcaccccacgtaggcctagggttagaaacaaggacagaaacctggatgagctcagaaggagcatggaaacaaatacaacgtgtggaaacttgggcgctgagacatccgggatttacggtaattgccttctttctagcacatgcaattggcacgagtataacacagaaaggaattatttttatacttcttatgctagtaacgccatcaatggcgatgcgatgcgtgggaattggaaaccgcgattttgtggaaggtttgtcaggcgcgacgtgggtcgatgtggtactcgaacatggctcttgcgtgacgaccatggctaaaaataaacctacgttggatattgaattactgaaaactgaagtgacaaatccagccatattaaggaaactgtgcatagaagcaaaaataagcaacactactacagactcccgatgcccaactcagggagaagcaaccttagtagaagaacaagacgcgaattttgtctgtcgaagaacattcgtggataggggctgggggaatggttgcggactttttggaaaagggagtctcctcacgtgcgcgaaatttaaatgcgttacaaaattagaaggcaaaatagtgcaatacgaaaacttgaaatactccgtcatagtaacagttcatacaggtgaccaacaccaagtgggtaacgaaacgacagagcatggaacgatagctactatcaccccacaagcacccacctcagagattcaacttactgattatggtgccttaacgctagattgtagcccacgcaccgggctcgattttaatgaaatggtcctattaacaatgaaggaaaaatcatggttagttcataagcaatggttcctagacctaccattgccttggacgagtggagcaagcacatctcaagaaacttggaacagacaagacttattggttacatttaaaacggcacatgccaagaaacaggaagtagttgtactaggcagtcaagaaggggcgatgcatacagcgctgacaggagcaacggaaatacagacaagcggtaccactaccatctttgcaggtcatttaaaatgtagactcaagatggacaaactgacgttgaaaggcacaagttacgtaatgtgtactggctccttcaagttagaaaaggaggtcgctgaaacacaacatggaaccgtcctagtacaggtcaaatacgaggggacggatgccccatgtaaaattccgttttcaacacaagacgagaagggagttactcagaatggaagattaataaccgcaaatcctatagtaacagataaagaaaaaccagttaatatcgaaacggaaccacccttcggggaatcatatatagtagtgggagctggagaaaaggcattaaaactaagttggtttaagaaaggcagtagcataggaaaaatgtttgaagctaccgcgcgaggtgccaggaggatggccatcttaggagatactgcatgggatttcggatcgataggcggagtttttacgtcggtggggaagttggtgcaccaagtgtttggaacggcctacggagtattgttttcaggtgttagttggacgatgaaaataggaatagggatactattaacttggttgggtctaaatagtagaagcacatcattgagtatgacgtgtattgccgttgggatggtaacattatatctcggagtgatggtacaagcagattcgggatgtgttataaactggaaaggaagggaattgaaatgcggttcgggaatatttgttaccaatgaagtccatacatggacagaacagtacaaatttcaagcagacagcccaaaaagactgtccgccgctataggtaaggcttgggaagagggcgtatgcggaatccgatcagcaacgcgattggaaaacattatgtggaaacaaatatctaatgaattaaatcatatattacttgagaatgacatgaaatttacggtggtcgtgggagacgcgaacggcatattggcacaagggaagaaaatgataagaccccagcccatggaacacaaatatagttggaaaagttggggaaaagccaaaataatcggtgccgatatacaaaatacaaccttcatcatagatggcccagacactccagaatgcccagataatcaacgtgcatggaacatttgggaagttgaagattacggattcggcatttttaccaccaatatatggttaaaattaagagattcatacacacagatgtgcgaccatagactcatgagtgctgcaataaaagactcaaaggccgtacatgcagatatgggatattggatagaatcagaaaagaacgaaacatggaaactagcaagagcaagttttatagaagtgaaaacatgtacatggcctaaatcacatactctgtggtcaaatggagtacttgagtctgaaatgataataccaaaaatatacggtggacccatctcgcaacataactataggcctggatattttacacagacggcaggtccatggcacctcggaaaacttgaactagactttgacttatgtgagggtaccacagtggtagttgacgaacactgtggaaatcgaggaccgagccttcgtacaactacagtaacaggaaagatcatacatgaatggtgttgcagaagttgtactttaccgccactgcgtttcaggggcgaagatgggtgttggtatggtatggaaatccgaccagtaaaggaaaaagaagaaaatctagttcgaagtatggtctctgctggtagtggtgaagtagattctttcagtctagggatattatgtgtatcgatcatgatagaagaagttatgcgtagtaggtggagccgaaaaatgttaatgactgggacattagcagtattcttattattagtaatgggccaacttacatggaatgatctgatccgattatgcataatggtgggagcaaacgcttcagatcggatggggatgggtacgacatacctagcattgatggcgacatttaagatgcgacctatgttcgccgtgggcctattgttcagacgactaaccagcagagaagtgttgctgttaacgataggactcagcctagtcgcgtcagttgagttaccaaattcattagaggaattaggagacggtttagccatgggcataatgatgttaaaactactaacggaatttcaacctcatcaattatggacaacattactatcattgacattcattaagacgactctatctcttgactacgcctggaaaaccaccgccatggcgcttagtatcgtgtcacttttcccactgtgtttgagtaccacttcccagaaaactacctggttgccggtgttactgggtagttttgggtgtaaaccgttgactatgttccttatcactgaaaacaagatctggggcagaaagagttggcctctgaacgaaggaataatggcgattggaatagtatctatattactttcgagtctgctaaagaacgacgtacccctcgcaggacctttgatcgcaggaggaatgttgatcgcctgctatgtgatctcaggatctagtgcagatctttcactcgagaaagcagctgaagtctcctgggaacaagaagctgaacactccggtacgtcacacaacataccagtggaagtccaggatgatggtaccatgaaaatcaaagatgaagaaagggatgatactttaactatcttgctaaaggccacattactagctgtaagtggcgtatacccaatgagtatccccgccacactttttgtttggtatttttggcagaagaagaaacagagaagcggtgttctttgggacacaccaagtccgccagaagtagaaagagcagtattagatgacggtatatatagaattttacaaagaggacttttaggaagatcgcaagtaggtgtaggagtcttccaggacggagtgtttcacacgatgtggcatgtcaccagaggagctgtattaatgtatcaaggaaaaagattggaaccctcttgggctagcgtaaagaaagatcttatatcgtacggtggcggttggagattccaaggatcatggaacaccggagaagaagttcaagtcatcgcagttgagccaggcaaaaaccccaaaaacgtacaaactacacccggaacatttaagacgccggagggcgaagtcggtgcaattgcgcttgacttcaaaccgggcacctcaggtagcccaatagtaaatagagaaggtaaaattgtgggactatatggcaacggcgtagtaactacgagcggaacatatgtcagcgcaatagcgcaggcaaaggcatcccaagaaggacccctacctgaaatagaagacgaggtcttcaagaaaagaaatctaactataatggatctgcatccaggtagtggaaaaacaagaaggtatttgccagcgatcgtaagagaggctattaagcggaaattgagaacactgatattagcgcccacccgagttgttgcttccgaaatggccgaagcattaaagggaatgcccattaggtaccagacaacagcggtaaagtctgaacatacagggagagaaatagttgaccttatgtgccatgctacgtttacgatgaggcttttgtcacccgttcgtgtgcctaactacaatatgataataatggatgaggcacatttcacggacccagcttcgattgcagcaagagggtatatcagtacgagggtaggaatgggtgaagcggcagctatttttatgacagctactccaccagggtccgtggaggcattccctcaaagcaatgcagtaatccaagatgaggaacgcgatattcctgaacgcagttggaatagcggttacgattggattacagactttccaggcaaaacggtatggttcgtgccatcaatcaagtccggcaatgatatcgcgaattgtttgcgcaagaatggtaaaagagtcatccagctaagtcgtaagacttttgatacagaataccagaaaactaagaataatgattgggattatgtggttactacagacatatcagaaatgggagcaaattttagggcagatcgtgtaattgacccaagacggtgtttaaagcccgtcattctgaaagacggtcctgaacgagttatactcgcaggaccaatgcccgtgactgtagccagtgcagcgcaaagacgaggaagaatcggcagaaatcaaaataaagagggagatcagtacgtctatatgggtcaaccactaaacaacgacgaagaccatgcgcattggaccgaagcaaaaatgctactcgataacattaacacgccagaaggtattatcccggcgttattcgagccggaacgtgagaaaaatgccgcaattgacggggaatataggctacgtggcgaagcaagaaagacattcgtagaactgatgcgacgaggagatctgcctgtttggttatcttataaagttgcgagcgaaggatttcagtacagtgacagaagatggtgctttgatggtgaaagaaataatcaagtactcgaagaaaacatggatgtcgaaatctggacgaaagaaggagaacgcaaaaagctaagaccgcgttggctagatgcaaggacatattcagatccacttgctctccgggaatttaaagagttcgcagcaggaagacgaagtgtctctggcgacttaatcttagaaataggaaaacttccccaacatttaacattaagagcacaaaacgcacttgacaatctagtcatgttacataatagcgaacaaggaggaaaagcgtacagacacgcaatggaagagttaccagacaccattgagacgctaatgctattggcattgattgcagtgctgacgggtggcgtaactctgtttttcttatccggaaaaggcctaggtaaaacaagcataggattactatgtgtaacagcaagttccgcactgttgtggatggctagtgttgaaccacattggatagcagcatcaattatactagagttctttctaatggttctacttataccggaaccagatcgtcagcgtacgcctcaagataatcaacttgcatatgtagtgataggactcctatttatgatcctgacagtagccgcaaatgaaatgggtctactcgaaacgaccaagaaagacctaggcataggacacgttgcagctgaaaaccatcaacatgctacaatgttagatgttgacctacgtccagcctcagcgtggactttatatgctgttgcaaccactgtaattacgccaatgatgcgtcacacaatagaaaatacaaccgcgaacattagtctaaccgcaatagcaaaccaagcagcaatattaatgggtctggataagggatggcctatttcgaaaatggatattggggtgccgttgttagcactaggatgctatagccaagtcaatccgcttactttaacggcggccgtccttatgttagtcgctcattatgccataataggtcctggtctccaagcaaaagcaaccagagaagcgcaaaagaggacggctgcaggaattatgaaaaacccgacagttgatggaatcgtagcaatcgacctagatcccgtggtgtacgatgcaaaatttgaaaaacaattaggccaaataatgcttttaattctatgtacatcacaaatcctccttatgcgaaccacgtgggcactgtgtgaatctatcacactcgctacaggaccattgaccaccctatgggaaggttctccaggaaaattttggaacaccacaatagcggtgagcatggcgaacatatttagaggtagttatttagcgggagctggactcgcatttagcctcatgaaaagcctaggaggcggaaggagaggtacaggagcacaaggagagacacttggcgagaaatggaaacgacaactaaaccaattaagcaaaagtgaatttaacacatataaaagatcaggaatcatggaagtcgatagaagtgaagcaaaagaaggactaaaacgaggtgaaacaacgaagcacgctgtatctcggggcactgccaagctaaggtggtttgttgagaggaatttggtaaaacctgaaggtaaagtaatagatctaggatgcgggaggggaggttggtcttattactgtgccggcttgaagaaagttacagaagtaaaaggatatacaaagggagggcctgggcacgaagaaccaattcctatggcgacttacgggtggaatttagttaagttgcatagcggcaaagacgtcttctttatgccgccggaaaagtgcgataccctattatgtgatatcggcgaaagcagtccgaatcctactattgaggagggcaggacgctaagagtcttgaaaatggtagaaccctggctaaggggaaatcaattttgtattaaaatccttaacccatatatgccaagtgtagttgagacactagaacagatgcaaaggaagcatggaggtatgttagtaagaaatccactctcacgcaacagtacacacgaaatgtactgggtctcatgcggtacagggaacatagtgtcagccgttaatatgaccagtcgaatgctcctaaacaggtttactatggcgcatcgtaaaccgacatatgagcgagatgtcgacctcggagcaggtactcgacatgtagcggtggaacctgaggtcgcgaatcttgatataatcggtcaaagaatcgaaaatatcaaaaatgaacataaatccacatggcattacgatgaagataatccatataagacgtgggcctaccacggcagttatgaagtaaaaccaagcgggtctgcttcatcgatggtcaatggtgtcgtacgattgctgactaaaccctgggatgtaatacccatggttacacaaatagccatgaccgacacaacaccatttgggcaacagagagtatttaaagaaaaagtagataccagaaccccaagagcgaaacgcggaaccacgcagatcatggaagtaacagcgaaatggctgtggggatttctttcccgaaataagaaaccaagaatttgtacaagggaagaatttacccgtaaggtgcgctctaatgcagcaattggagcagtttttgtagatgaaaatcaatggaactcagccaaagaagctgtcgaagacgagcggttctgggatttggtacatcgtgaaagagaattgcataaacaaggaaaatgtgctacttgtgtatataacatgatgggcaagagagagaagaaacttggagagttcggtaaagcaaaagggtctcgagccatatggtatatgtggctaggagcccgctttttggagttcgaagctctcggctttatgaatgaagatcattggttttctagagaaaattcattaagtggggtagaaggcgaaggtctacataaactagggtacatactacgtgatataagcaagataccaggaggaaatatgtacgctgacgatactgccggttgggacaccagaataaccgaggatgatttacaaaatgaagctaaaattaccgaaattatggaacctgaacacgccttgttggcgacgagcatatttaaacttacataccaaaataaagtagtgcgggttcaacgaccagccaaaaacggaactgtaatggacgtaataagtagaagagaccaaaggggatcaggacaggtaggaacctacggattaaatacgttcacaaatatggaagtccagctaattagacaaatggaaagtgaggggatatttctaccttctgagctcgagacgcctaatttagctgagagagttttggattggcttgagaaacatggagccgaacgtcttaagagaatggcgatatctggagacgattgtgtcgtaaaacctatagatgatagatttgcgacagcgttgaccgcattaaacgatatgggaaaggtaagaaaagatataccacagtgggaaccttctaaaggatggaatgattggcaacaagttcctttctgttcacatcactttcaccaactaataatgaaggatggacgagagattgtagtgccatgccggaaccaagacgagttagtgggtagggcacgagtcagtcaaggagcaggttggtctttaagagaaacagcctgcttaggtaaatcatatgcccaaatgtggcagttaatgtattttcatagacgtgacctgcggttggcagctaatgccatatgctctgcggttccagtagactgggtaccgacttctcgaactacatggtctatacacgcacatcaccaatggatgactacagaagacatgctgagcgtatggaatagggtatggatagaggaaaacccatggatggaagataaaacgcatgtaagcagctgggaagaagtcccctaccttggaaaaagagaagaccaatggtgtgggagcttaatagggcttactgctagagccacttgggctacaaatatacaggtagctataaatcaagtcagaaggttaataggaaacgaaaactatttagattacatgacaagtatgaagaggtttaaaaacgaatcggatccagaaggagcgttatggtga

SEQ ID NO: 21271 - RNA, 9879 nt, synthetic construct
  misc_feature 1..9879: note = derived and/or modified CDS sequence (opt6) from DENV-1__KJ189318__SS-prME
  source 1..9879: mol_type = other RNA
tccgtaacaatgttattaatgcttttgccaacagctttagcttttcacttaacaacgagaggaggagaacctcatatgattgtttcaaaacaagaaagaggaaaaagtctactctttaaaacaagcgccggtgttaatatgtgtacattaattgcgatggacctgggagaactctgtgaagataccatgacttacaaatgcccacaaataactgaagcggaaccagacgatgtggattgttggtgcaatgcgacagacacatgggttacttatgggacatgttctcaaactggagaacatagacgcgacaaacgcagcgtcgctttggcgccacatgtaggtttaggattagaaaccaggacagagacatggatgtcaagtgaaggtgcatggaaacagatccaaagagtagaaacatgggctctcagacatccaggattcacagtaattgcactgtttttggcacatgcgatagggacatcgattacccaaaaagggatcatatttatactgttaatgttagtaactccaagtatggctatgagatgtgttggaataggaaatcgagatttcgttgaaggactgtctggagcaacctgggtggatgttgtattggaacacggttcctgtgtgactactatggctaaaaataaacccactctagacatagaactattaaagacggaagtaacgaatccagctatcctaaggaagttgtgcatcgaagcaaagatttcaaatacaacgactgacagtagatgccccacccaaggagaagcaacgttagttgaagaacaagacgctaatttcgtctgtagaagaacatttgtggatcgcggatggggaaacggctgcggtctatttggaaaggggtcactacttacctgtgcaaagtttaaatgcgtaactaaattagaaggcaaaatagtgcaatatgagaatttgaaatattcggtaattgttacagtgcatactggtgatcaacatcaagtaggcaacgaaaccacagagcacggaaccatagcgactataacaccccaagcaccgacatccgagatacaattgacggactatggcgcacttactttggattgctcaccgcgaacaggtttagactttaacgagatggtcttattaacaatgaaagaaaaatcttggttagtgcacaaacaatggttcctcgacttaccattaccttggacgtcaggagcgtctacaagtcaagaaacatggaaccgacaagatttattggtgacttttaaaacagcacatgcgaaaaagcaagaagtggttgttctaggatctcaagaaggagccatgcatacagctctcactggggcaactgaaattcaaacgtctggcacaacaaccatctttgccggacatctcaagtgtcgtctgaaaatggataaactgactcttaaaggtacttcatatgttatgtgtacaggaagtttcaaacttgaaaaagaagtggcggaaacgcagcacggaacagtgttagtacaagtcaaatacgagggcaccgatgccccctgcaaaattccattctcaacacaagacgaaaaaggagtgactcagaacggcagattgataaccgctaatccaatagttactgataaagaaaaaccagtcaacatagaaacagagccgccattcggtgagtcatatatagttgtgggcgcaggagaaaaggctctcaagttaagttggttcaagaaaggctcgtcgataggaaaaatgttcgaagctaccgctcgtggagcccggagaatggctatcttaggagacacagcatgggatttcggaagtataggaggagtatttacatccgtggggaaattagtacaccaagtatttggaacggcatatggtgttctcttttccggagttagttggactatgaagattggcataggtatcttgttaacttggttaggcttaaattcaagaagcacaagcctgagtatgacttgtatagccgttgggatggttacactatatcttggcgttatggtacaggcagatagcgggtgcgtcataaactggaaaggacgtgaattaaaatgtggttctggtatattcgtaacaaacgaagtacacacttggaccgaacagtacaaatttcaggcggattcgccgaaacgattaagtgcagccattggtaaggcttgggaagagggagtatgtggcattcgtagtgccacgcgacttgaaaacattatgtggaaacaaatatctaatgagttaaaccacattctccttgaaaatgatatgaaatttacagtcgttgtaggagatgctaacgggatattagcacaaggcaagaaaatgattagacctcagcctatggaacataaatattcatggaaatcatggggcaaggcgaaaataataggcgcggatatacaaaatacaacttttatcattgacggaccagacacgccagagtgccctgacaatcaaagagcatggaacatatgggaggttgaagactacggctttgggatttttacaacgaatatatggcttaaactaagagactcttacacacaaatgtgtgatcatcgtctaatgtcagcagccattaaagattccaaagcagtacatgcagatatgggatactggatagaaagcgagaaaaatgaaacctggaaactagcgagagcgtcctttatagaagtgaagacgtgcacctggccaaaatcgcatactctctggtcaaatggcgtgctggaaagtgaaatgataatcccaaaaatttatggaggcccgatatctcaacataactatcgaccaggttatttcactcaaacagcgggcccatggcacttaggcaagctagagctagattttgatctatgcgaaggcaccacagtagtagtagatgagcactgcggcaaccgagggccttcactaagaacaaccacagtaacaggaaaaataatccatgaatggtgttgtcgaagttgcacacttcctccgctgagatttcgaggtgaagatggctgttggtatggaatggaaattagacctgtaaaagagaaagaagaaaatctcgtaagaagtatggtaagtgcgggaagcggtgaagttgacagcttttctctcggaatactgtgcgcttcaataatgatagaagaagttatgagaagtagatggtctaggaaaatgctgatgacgggaaccctggcagtattcttattgttgataatgggtcagctgacctggaacgacttaataagattatgcataatggtcggggcgaatgcaagtgaccgaatgggcatgggcaccacatacctggcacttatggctacttttaagatgcgaccaatgtttgctgtagggttattatttcggagattaacaagtcgcgaagtcttgctcctaactataggactgagtcttgtagccagcgtagaattaccgaactcacttgaagaattaggcgacggattagcgatgggtataatgatgctaaaattattgactgaatttcagcctcatcagctatggaccacactgctaagcctaaccttcataaagactacccttagtttagattatgcgtggaagactacggcaatggctctcagcatcgtcagccttttccctttatgtctctcaacaaccagccagaaaactacatggttgccagtactcctgggcagtttcggatgcaagcctctcaccatgtttctaataacagaaaacaaaatctggggtcgtaaatcttggccattaaacgaggggataatggcaataggaattgtatctattcttctatccagtttgcttaaaaatgacgttccactagcaggtcctctcatcgcgggtggtatgctaattgcatgttacgtaatatcaggatccagtgcagacctatccttagagaaaactgctgaagtcagctgggaacaagaagcagaacattcaggaacaagtcataatattctcgtggaagtacaagatgatggtactatgaaaataaaagacgaagaacgtgacgatacattaactattctcttaaaggcaacattattggcagtctcaggagtgtatccaatgagtattccggctacactttttgtgtggtacttttggcagaagaagaaacaaagatcgggcgtattatgggacacaccatcgccgccggaagtagagcgagcagtacttgatgatggaatctacaggattctacaaagaggactactaggacgctctcaagtaggagtcggagtctttcaagacggagtgttccacacgatgtggcatgtgacgcgaggggcggtgctaatgtatcaaggcaaaagattagaaccatcttgggcttcagttaagaaagacttgatatcctacggagggggatggagatttcaaggtagttggaatactggagaagaggtacaagtaatagcagtagaaccaggtaaaaaccccaaaaatgttcagactacaccgggaactttcaaaaccccagaaggagaagtaggggctatcgctttagattttaaaccagggacatctggatcgccgattgtaaatcgtgaaggcaagatagtcggactttatggaaatggggttgtaacaaccagcgggacatatgtttcagcaatagcccaagcaaaagcctcgcaagaaggcccactaccagaaatagaagacgaggtgtttaagaaaagaaatttgacgataatggacttacaccctggcagtggcaagacgcggcggtacctacctgccattgtccgagaggccataaaaaggaaattaaggactttaatactagcacctacaagagttgttgcatcagaaatggcagaggcactcaaaggaatgcctataagataccaaacaacggcagttaagagtgaacatacaggaagagagatagtcgatctgatgtgtcatgcaacttttacgatgagattgctatctccggttagagtaccgaattataacatgataattatggacgaagcacattttacagatcccgcatcgatagccgctcgtggctacatatcaactagagtaggcatgggcgaggcagcggccatattcatgacggctacaccgccaggaagtgtcgaagcatttccacagagtaacgctgtaattcaagatgaagaacgggatatccccgaaaggtcgtggaactcgggatatgattggattactgatttcccaggcaaaacagtttggtttgtcccgtcaataaaaagcggtaatgatattgccaactgcttaagaaagaatggtaaacgtgtaatccaactttctagaaaaacatttgacaccgaatatcagaaaaccaaaaataatgattgggactacgtagtaaccactgacataagtgaaatgggcgcaaactttcgggcggatcgagtaattgaccctaggagatgtcttaaacccgttatactcaaagacggacctgaacgagtgattttggcagggcctatgcccgtgaccgtagcatctgcagcccaacgaaggggtcgcataggaagaaaccaaaacaaagagggcgaccaatatgtatatatgggtcagccattaaataacgacgaggatcatgctcattggaccgaagcaaagatgctattagataatataaacactccagagggaatcatcccagcgctctttgaaccagaaagagaaaagagcgccgccatagacggcgaatataggttgcgcggtgaagcgcggaagacattcgttgaattaatgaggagaggagacttacccgtttggttatcatataaagtagcgtccgaaggttttcaatatagcgacaggcgctggtgtttcgatggtgaaagaaataatcaagttttggaagaaaatatggacgtggaaatttggactaaagaaggtgagaggaagaaactaagaccaagatggctggatgctagaacttattctgaccccttagcactcagagagttcaaagaatttgctgccggaagacgctcagtgagtggcgatctaatccttgaaatagggaaactcccgcagcatctgactctaagagcacagaatgctttagacaacctggttatgttacataatagcgaacaaggcggaaaagcatatagacatgctatggaagaattaccggatacgatcgagacattaatgctattggcactaatagcagtcctcaccggtggcgtaactttatttttcctaagcggaaaagggttaggaaaaactagcataggtcttctgtgtgtaacagcatcatccgcgctactatggatggcgagtgtggaaccccattggatagcggcatcaataatactcgaatttttcttgatggtattgttaattccagaaccagatcggcagcggactccgcaagacaatcaactagcatatgtggttataggtctactattcatgattttaactgtggctgccaatgaaatggggttactagaaacaaccaagaaagacttgggcataggccacgtagctgcagagaatcatcagcacgcaacaatgcttgatgtggacctaaggccggcgagcgcatggacactatatgcagtagctacaactgttattacgccgatgatgcgacatacaattgaaaacaccactgctaatatatcgttgacagctatagcgaaccaagcagcaattctaatgggattagacaaaggatggcctattagcaaaatggacattggagtccctctactagctttaggatgctactcgcaagtaaatcccttaactttaactgcggcagtactcatgttagtagcccactatgcaataataggacctggtctccaagctaaagctacccgcgaagcacagaaacgaacagctgcagggattatgaaaaaccccactgtcgatggcatcgtagctatagaccttgatccagtcgtgtacgatgcaaaatttgaaaaacagttagggcaaatcatgttattaattttgtgtacttcacagattttgctaatgcgtacaacatgggctctatgcgagagtattactcttgccactgggccattgactacgctatgggagggatcgccaggaaaattctggaatacgacaattgccgttagtatggcgaatatttttcgagggtcatatctagccggtgcaggactagcgttctctttaatgaagtcattaggtgggggaagacgcggtacaggggcacagggggaaacactgggcgagaaatggaaaagacaattaaatcaactgagtaaaagcgaatttaatacatataaaagaagtggtattatggaagtagatagaagcgaagccaaagaaggcttaaaaagaggtgagacaacgaagcacgcagtgtcaagagggacggctaagttgagatggtttgtagaacgaaacttagtcaaaccagaaggaaaagttattgatcttgggtgcggacgaggaggatggtcatactactgtgctggactaaagaaagtgacagaagttaaaggatataccaaaggcggaccaggtcacgaagaacctattccaatggcaacttacggctggaatctcgttaaacttcacagcggtaaagatgtcttctttatgccccctgaaaaatgcgacacacttctgtgcgacattggagaaagttcaccgaatccaacaatagaggaaggaaggactctgagagtgcttaaaatggttgaaccatggcttaggggaaatcaattttgcataaaaattttaaacccatacatgccatctgttgtggaaacactcgaacagatgcagagaaaacacgggggaatgcttgtgaggaaccctttaagtagaaattccacgcatgaaatgtattgggtatcttgcggaacgggcaacatcgtatcagctgtaaatatgacaagcagaatgttactaaacagatttacaatggctcatcgaaagccgacttttgaacgcgatgtcgatcttggtgctggcaccagacacgtagctgttgagcccgaggtagctaatctagacattataggtcaacgtattgaaaacatcaaaaacgaacataaatcgacttggcactatgatgaggataacccatataaaacgtgggcttaccacgggtcttacgaagtaaaaccatcagggtcagcctccagcatggtcaatggtgtggtaagactattgacgaaaccatgggacgttattccaatggtaacacagatagcgatgacagatacaactccgtttggccagcaacgagtttttaaagaaaaagttgacactcgcacccccagagcaaaacgagggaccacacaaattatggaagttactgccaaatggttatggggatttttatcgaggaataagaaacctcgcatatgcacacgagaggagtttacacgaaaggtaaggtcaaacgccgcgattggcgctgtatttgtagacgaaaatcagtggaatagcgccaaagaagcagtagaagatgaaagattttgggacctagtacatcgagaacgagaattacacaaacagggcaaatgtgcgacttgcgtatataatatgatgggcaaacgtgagaagaaattaggagaatttggaaaagccaaagggtcaagagctatatggtatatgtggctaggcgctaggtttctagaatttgaggctttgggtttcatgaacgaagaccattggttttccagagaaaattcactttcaggtgtagaaggggaaggattgcacaaactaggatacatactacgagatataagtaaaattccaggcggtaatatgtacgctgatgacacagccggatgggatacaagaataaccgaagatgacttacaaaatgaagctaaaataaccgatataatggaacctgagcatgcactactcgcaacctcaatatttaaactcacgtatcagaataaggttgttagggttcagcgacccgccaaaaacggcacagtcatggatgtaatttcaagaagagatcaaagaggttcgggtcaggtgggcacctatggattaaatacatttaccaatatggaggtacaactaatcagacaaatggaatctgaagggatatttttgccttctgagctcgaaactcctaatttggccgaaagagttctcgattggttagaaaaacacggtgcggagcgattaaaaaggatggctatttctggtgacgactgtgtagtgaaaccaattgacgatagatttgcaacagcattaacagctctcaatgacatgggaaaagttaggaaagacattccgcagtgggaaccttcaaagggatggaacgattggcagcaagtacccttttgttctcatcattttcaccaactgataatgaaagacggaagggaaatagtggttccatgtcgaaatcaagacgaactggtaggtagagcgagggtatctcagggtgccggctggtcactaagggaaacagcctgcctaggtaagagttatgcccaaatgtggcaattaatgtattttcatcggagggatctaaggttggcagcaaacgccatttgtagtgcagtaccggttgattgggtacctactagccgaacgacatggagcatacatgcgcaccatcaatggatgacgacggaagatatgctctcagtctggaatcgagtatggatagaagaaaacccatggatggaagataaaactcacgtttcctcttgggaagaggtgccgtaccttggcaagcgagaggatcagtggtgtggcagtttgatagggttgactgccagagccacatgggcaacaaatatacaagtagcaatcaatcaagttcgcagactgattggaaatgagaactacctggactatatgacaagtatgaagagatttaaaaacgagtcagaccctgaaggcgctctatggtga

SEQ ID NO: 21272 - RNA, 9879 nt, synthetic construct
  misc_feature 1..9879: note = derived and/or modified CDS sequence (opt6) from DENV-1__KJ189319__SS-prME
  source 1..9879: mol_type = other RNA
agtgtgactatgctactaatgctactacctactgctctagcgtttcatctcaccactagaggaggggaacctcatatgatagtgagcaaacaagaaaggggtaaatctttattgtttaaaacatcagcgggagtaaacatgtgtacattgattgccatggatctaggcgaattatgcgaagacaccatgacatataaatgtcctcaaatcacagaagcagaaccggacgacgtcgactgctggtgcaacgcaaccgatacatgggtaacatatgggacttgctcacaaacaggcgaacaccggagggataaacgctccgtagcattggctccgcatgttgggctaggtttggaaacgagaaccgaaacctggatgtcaagcgaaggagcatggaaacaaatccaaagggtagaaacgtgggcactccgacaccctggatttacagttattgccttattcctagcacacgccataggcacatcaatcactcaaaaagggataatttttatactattaatgctcgtaacaccgtcaatggccatgagatgtgtggggataggaaaccgcgactttgtagaagggctaagtggcgccacttgggtagacgtggtattggaacatgggtcttgtgtgacaacaatggccaaaaataaaccaaccctagacatagaactactgaaaaccgaagttactaaccctgctatactccggaagttatgtatagaagcgaagattagtaatactacaactgacagtagatgcccaacacaaggggaagctactttagtcgaagaacaggacgcaaactttgtgtgtagacgcaccttcgtagatcgaggatggggcaacggatgtggattattcggaaaggggtcactcctcacgtgtgccaaattcaaatgcgtcacaaaattagaaggaaaaatagttcaatatgaaaatctaaaatatagtgttattgttactgtacacacgggtgaccagcatcaagtcggaaatgaaacaacagaacacggaactattgcaactattacaccacaagcaccaacgtcagaaatacaattgacagactacggagcattaactctagactgtagcccaaggactggactcgactttaatgagatggtactattaacaatgaaagagaagtcgtggctagtccacaaacaatggtttctcgacctgcccctaccgtggacgtccggagcaagtacttcacaagaaacgtggaatagacaagacctgttagtaacattcaaaacggcacatgccaagaaacaagaagtagtggttctaggaagtcaagaaggtgctatgcataccgctctgacaggcgcgactgaaattcaaacctcaggaacaactacgatatttgctggccatttgaaatgtagattaaaaatggataagctaacactaaaaggaacaagctatgttatgtgtactgggagtttcaagttagagaaagaagtagctgaaactcaacacggaactgtattagtacaggttaaatatgaagggacagacgcgccatgtaaaattccttttagcacacaagacgagaaaggcgtgacacaaaatggaagattaatcacggcgaatccaattgtaacagataaggaaaaacctgtcaacatagagaccgaaccacctttcggtgaatcgtatattgttgtgggggcaggcgagaaggccctaaaattatcatggtttaagaaaggttcctcaataggcaagatgtttgaagcaaccgcaagaggggcacgcagaatggcgatactaggtgatactgcatgggattttggcagcataggaggcgtgtttacatctgttggaaagttagtacaccaagtatttgggacagcgtacggtgtactcttttcgggtgtaagttggacgatgaaaattggaataggaatactattaacctggttaggcctaaattcccgcagtacctcactatctatgacatgcatagcagtcggaatggtcacactctacttaggagtaatggtccaggcagatagcggttgcgtgataaactggaaaggcagggagttgaaatgcgggtcggggatttttgtgacgaatgaagttcacacttggacagaacaatacaaattccaggccgacagtcctaaacgattatctgcagcgataggaaaggcgtgggaggagggcgtctgcggaattagatcagctacacgactagaaaatataatgtggaaacagattagtaacgaattaaatcacatcttattggaaaacgatatgaagtttaccgtagtagtgggagatgcaaacgggatcttagcgcaaggaaagaaaatgatcagaccccaacctatggaacataaatattcttggaagtcctggggtaaagcaaaaataattggggcggatattcaaaacacgaccttcataattgatggccctgatactcccgaatgcccggacaatcaaagagcatggaatatatgggaagtagaagattatggatttggtatattcaccacaaatatttggctcaaacttcgagattcgtatacgcagatgtgtgatcatagattgatgtcagccgcaattaaggattcgaaggcagttcatgccgatatgggttattggatagaatcagaaaagaatgagacgtggaaacttgcaagagcctcgttcattgaagttaaaacatgtacttggccaaaatcacataccctctggagcaacggtgtattagagtctgagatgatcataccaaagatttatggaggtccaataagtcaacataattatcgaccaggatacttcacacaaactgcagggccctggcatctcggaaaacttgaactagatttcgatttatgtgaaggaaccacagtagtcgtcgatgaacactgtggcaatcgtggtcctagtttaagaaccacgactgtaacgggtaagattattcacgaatggtgctgtagatcttgcacacttccaccgctcagatttagaggagaggacgggtgttggtacggaatggaaataaggccggtcaaagaaaaagaagaaaacttagtacgaagcatggtaagtgcggggtctggagaagtagacagtttttccctaggtatcctatgcgcatcaattatgattgaagaagttatgaggtcaagatggagtcgaaagatgttaatgactggaacattagcagtgtttttactattaatcatgggacagctaacttggaacgatcttataagattatgtattatggtaggcgcaaatgcgagtgaccgaatggggatgggaacaacttatctagcattaatggcaacttttaagatgagaccaatgttcgctgtaggattattgttccgaaggttgacatcacgagaagtcctcctactaaccatagggcttagccttgtagcctcagtagagttaccaaattcattggaagagttaggagatggactagcaatgggaataatgatgcttaaactgttaacagaatttcagccacatcagttatggacaacactattaagtcttacttttattaagactactttgagcttagattacgcttggaaaacaactgcgatggctttatcaatagtttcattatttccgctttgtttatccaccacttctcagaagacgacgtggttaccggtgttactaggctccctagggtgtaaacctttaacgatgtttctgatcacagaaaataagatatggggcagaaaatcctggcctttaaatgaaggtatcatggctattggaatagtatcaatcttgttaagctcacttctcaaaaacgacgtgccattagctgggccactcattgctgggggaatgctaatagcatgctacgtaattagtggcagcagtgctgatctgtccttagaaaaagcggccgaggtgagctgggaacaagaagctgaacactctggtacctcccataatatcctagtcgaggttcaagacgatggtactatgaaaataaaggacgaggagagagacgacacactaactatattgttaaaggctacattactcgcagtaagcggagtttatccaatgtcgattcccgcaacacttttcgtatggtatttttggcagaaaaagaaacaaagatcaggagttttatgggatacaccctcgccgcccgaagtagagagagcagtactagatgatggaatataccgtattcttcaacgagggttgctgggacgaagtcaagttggagtaggcgtcttccaagacggagtctttcacacaatgtggcatgtaactcgaggtgcagtcctaatgtaccagggaaaaagattggaaccatcgtgggccagcgtgaagaaagatctgatcagctatggcggaggctggagatttcaaggaagttggaatacgggagaagaagtacaagttattgctgtagaacccgggaaaaacccgaaaaacgtacagacgacgccaggcacctttaagactcctgagggtgaagttggtgcaatagcacttgactttaaaccgggaaccagcggatcgcctattgttaatcgggaaggtaaaatagtagggttatacggaaacggagtggtcactacaagtggcacatatgtttctgcgatcgctcaggccaaagcatcgcaagaggggcccttaccagaaatagaagacgaagtctttaaaaagcgaaatttaactatcatggatctacatcctgggtcaggtaaaactagacgatacctacccgcgattgttagagaagcaatcaaaaggaaattaagaacattaattctggctccaacacgagtagtagcatcagaaatggctgaagccctgaagggaatgcccataagataccagacaacggccgttaaaagtgaacatacgggtagagaaattgtcgatttaatgtgtcacgcgacgtttacaatgcgtctattaagtccagttagggtaccgaattacaacatgataataatggacgaagcacattttactgaccctgcaagcatagccgcaaggggatacatctcaacacgggtcggtatgggtgaagcagcggctatctttatgacagctaccccaccaggttcagtggaagcgtttccgcagagcaatgctgtcattcaggacgaagaaagggacatacccgagcgtagttggaactccggatacgattggataacagattttccaggtaaaacagtttggttcgtgccaagtattaaaagcgggaacgatatagcaaattgcttacgtaaaaatggaaagcgggttattcaactctcgcggaagacattcgacacagaatatcaaaagactaaaaataacgactgggattatgtggttactactgacatctcagaaatgggcgcaaattttagagcggaccgagtcatcgacccaaggagatgtctcaagccagtgatattgaaagatggaccagaacgggtgatcctcgccggaccgatgcctgtaacagtagcatcggccgcacaacggcgaggcaggataggcagaaatcagaataaagaaggggatcaatatgtatatatgggacaacccctaaataatgacgaagatcacgcacactggacggaggctaaaatgttactggataacataaacacacctgagggtattatacctgcactatttgagccagaaagagagaaaagcgcggctatagatggagagtatcgtttgaggggagaggcaagaaagacctttgttgaactcatgagacgtggagaccttcctgtatggctttcttacaaagtcgctagcgaaggttttcagtattccgacaggcgatggtgttttgacggagaacgcaacaaccaggtattggaggaaaatatggacgtggaaatttggactaaggagggggaacgaaagaaattgagaccacggtggttagatgcgagaacctattcagacccactcgccttacgcgagtttaaagaatttgcagcaggtagaagatcagtttctggcgatctaatcttggaaatcggcaaattgccacagcacctcactctcagagcacaaaacgcacttgataacctcgtaatgctacataatagtgaacaaggcggtaaagcatacagacatgctatggaagaacttcctgacacgatcgaaactcttatgctattagccctaattgcagtattaacagggggtgtcacactcttctttttatcaggaaaaggactcggcaaaacaagtataggcctattatgtgttacagctagtagtgcattattgtggatggcatcggttgaaccccactggattgccgcatctattatactcgagttctttctaatggtactcttaatcccggaacctgaccgtcaaagaacaccccaagacaatcaactagcatacgtcgtaataggacttttattcatgatccttaccgtagccgctaacgaaatgggtcttttggaaacgaccaaaaaggatctgggtatcggtcatgtagctgccgaaaatcatcaacatgcaactatgctagatgtcgatcttagacccgcgtccgcttggactctgtacgctgttgcaacaactgtgataacacctatgatgaggcacactatagaaaatacaacagcaaacataagtttaacagcaatcgctaatcaggcggctatattgatgggattagataaaggatggcccataagtaaaatggatataggtgttccattactggctctcggatgttatagtcaggtaaatccattaacattaaccgcggctgttctaatgttggtggcccattacgctatcattggtcctgggttacaggcgaaagcaacccgagaagcacagaaaaggacagctgcaggtataatgaagaatcctaccgtagacggaatagtcgccatagatctcgacccggtagtatacgatgcaaagtttgagaaacaactcggtcaaatcatgcttctaatactatgtacaagtcaaatactacttatgaggacgacgtgggcattgtgtgaatccatcacgctagccaccggaccactaacaaccctatgggaaggatccccgggaaaattctggaatacgacgattgcagtgtcaatggcaaatatctttcgagggagttacctcgcaggggctgggctcgcattctcgctaatgaagtcacttggtgggggaagacgagggacaggagcacaaggagaaacgttaggagagaagtggaagaggcaattgaaccaattgtccaagtcagagttcaatacgtataaacgaagcggaatcatggaagtagaccgaagcgaagcaaaagaagggctaaaaagaggggaaacgacaaaacatgctgtgagtcggggcactgctaaactaagatggttcgtagagagaaaccttgtaaagccagaagggaaagtaatagacctcggatgtggaagaggaggatggagctattactgcgctgggctcaagaaagttacggaagtaaaagggtataccaaaggcggtcccggacatgaggaacccatccccatggctacctatggatggaacctagtaaaattacattccggtaaagacgtattctttatgccaccagagaaatgcgatacactactatgtgatataggagaatcatcacctaatccaacaattgaagagggaagaacactccgcgtcctaaagatggtagagccatggctgcgtggaaatcaattctgcatcaaaattctcaatccgtacatgcctagcgtagtcgaaacattagaacagatgcaaagaaaacatgggggtatgttggtccgaaatcctttatcaagaaattcgactcacgaaatgtactgggtcagctgcggcacaggaaacatagtctcggctgtgaacatgaccagcagaatgttattaaatcgatttacaatggctcatagaaaacccacatttgagagggatgtagaccttggtgcaggaacgcgacatgtagccgtcgaaccagaagtggcgaacttggatattataggtcaaagaatagagaacatcaagaatgaacacaaatcgacttggcactatgatgaggataatccctataaaacatgggcctaccatggatcatatgaggttaaaccaagtggttccgcaagtagcatggtcaatggggttgtgagactattaaccaagccctgggatgtaatacctatggtaactcaaatagcaatgacagacactacgccttttgggcagcaacgagtgtttaaagaaaaagtagatactagaacgccacgagcaaagcgtgggactacacagatcatggaggtcacagcaaagtggttatggggttttcttagcaggaataagaaaccaagaatttgcacgagagaagaatttacacgcaaagtacgatctaacgcagctataggggcagtttttgtagatgagaatcaatggaacagcgcaaaagaggcagtagaagacgagaggttttgggatctagtacacagagaaagagaacttcataaacaaggcaagtgcgccacctgtgtatataacatgatgggtaaaagagagaagaaattaggcgagttcggcaaagctaaaggaagcagagcaatatggtacatgtggctaggcgcccgatttctcgaatttgaagctctgggctttatgaatgaggaccattggtttagtcgtgaaaattctctctctggcgtagagggagaaggcttacataaactaggatatatactgcgtgacatttccaaaattccaggtggaaacatgtatgctgacgatactgcaggctgggacacaaggattactgaagatgacctacaaaatgaagctaaaattacagatataatggaaccagaacacgctctgttagctacatcgatttttaagctaacataccagaataaagtagtcagagtacagagaccggccaaaaacggaacagtaatggacgttatctcacgcagggatcaaaggggaagcggacaagttggcacatacggattaaatacttttacaaatatggaggtacaactaattcggcagatggaaagtgaaggtatctttttgccgagtgaattagaaactccaaatctggctgagagggtactagactggctggaaaaacatggcgctgaacgactaaaaaggatggcaatatcaggtgatgattgcgtggttaaacctatcgatgatagatttgcaacagctctcacagctttaaatgacatgggcaaagttagaaaggatatcccccagtgggagccatctaagggatggaacgactggcaacaagtaccgttttgctcacatcacttccatcaattaataatgaaagatgggcgtgagatcgtagtaccttgtcgaaatcaggatgaacttgtagggcgtgcaagagtgtctcaaggtgctggctggtcattacgggagacagcctgtcttgggaagagttacgcacaaatgtggcaactgatgtattttcacaggcgcgatctacgactagccgccaatgcgatatgtagtgctgtgccagttgactgggtacccacatcaaggacgacatggagcatacacgcacaccaccaatggatgactaccgaagacatgttgtcagtttggaatagggtttggatagaggaaaacccatggatggaagataaaactcatgtgtcatcttgggaagaagtaccttacctgggcaaaagagaagatcaatggtgtggctcgttaattggattaactgctcgagccacatgggctacaaatatacaagtcgctattaaccaggtacgaaggctaattggcaatgaaaactatcttgactatatgacatcaatgaaaagatttaagaacgagtcggatcccgagggggcattatggtaa

SEQ ID NO: 21273 - RNA, 9879 nt, synthetic construct
  misc_feature 1..9879: note = derived and/or modified CDS sequence (opt6) from DENV-1__KJ189320__SS-prME
  source 1..9879: mol_type = other RNA
tctgtgactatgctacttatgttattacctaccgcactagctttccatctaactactcgaggaggggaaccccatatgattgtctcaaaacaagaaagaggaaaatcactattattcaaaactagcgcaggagtaaatatgtgcacactgatagcaatggatctgggagaattgtgtgaggacacaatgacgtacaaatgtcctcaaattacggaggcggagccggacgatgtcgattgttggtgtaatgcaacagatacttgggttacgtatggaacatgctctcaaactggtgaacaccgacgagataaacggtcagtggcactagcaccccatgttggattagggttagaaacaagaactgagacatggatgtcttcagaaggagcttggaaacaaatacaacgagtagaaacttgggctctaagacatccgggcttcactgtcatagctttattcctggcacacgctataggtactagcataacacaaaaaggaataatcttcattcttttaatgttagttactccctctatggctatgagatgtgttgggattggaaatcgtgattttgttgaaggattatctggagcgacctgggtggacgtggttttggaacatggatcctgcgtaactacgatggccaaaaataaaccaaccttagatattgaacttctaaaaacggaagttacgaatccagcgatacttagaaaattatgtattgaagctaaaatcagtaacactaccactgactcacgatgtcctacacaaggtgaggcaactttagtcgaagaacaagatgctaattttgtgtgtcgccgaacttttgtagatagaggttggggaaatggctgtggattattcggcaaaggtagcttgttaacatgtgcaaaatttaaatgcgtaacaaaactagaaggcaaaatagtccaatatgagaatttaaaatactctgtaatcgtaaccgtacatactggagaccaacaccaagtaggcaatgaaacaacggaacacggcacgattgctacaatcactccacaagccccgacaagtgaaatacaactaacggattacggagcactgacattagactgctcgccacggaccggactagacttcaatgagatggtcctcctcacaatgaaagagaaaagctggctagtccataaacaatggtttctggacttaccactaccatggacttctggcgctagcacgtcccaggaaacatggaacaggcaggatttattggttacatttaaaactgctcatgcgaagaaacaagaagttgttgtactgggatcacaggaaggtgccatgcacaccgctctaacaggcgccacagagatccagacatccgggacgacaacgatatttgctggacacctgaaatgtcgactaaaaatggacaaactaactttaaaaggcacttcttatgtcatgtgtactggtagctttaagttagaaaaagaggttgcggaaacacaacacggaactgtattagtacaggtaaaatacgaggggacagatgccccatgtaaaataccattctctactcaggacgaaaaaggtgtaacccaaaatggtcgacttataaccgctaatccaatcgttacagataaggagaaaccagtgaacatagagacagaacctccattcggagaaagctacatcgtagtaggtgctggcgaaaaagctcttaagttatcttggtttaagaaagggtcgagtatcggaaaaatgtttgaagcaacagccaggggcgctagaaggatggcaattcttggagacacagcatgggactttggctcaattggtggagtatttacgagcgttggcaagctcgtacaccaggtatttgggacagcttatggcgtgcttttctcaggcgtgtcctggacgatgaagataggaattggaattttattgacttggctcgggttaaacagcaggagtacatccctatcaatgacgtgcattgccgtgggtatggtaacactctatctcggtgtaatggtgcaagcagattcgggatgcgtgataaactggaaaggtagggaattaaagtgtggatcaggtatttttgtcacaaatgaagtgcacacctggacagagcaatataaattccaagctgattctcccaaacgccttagcgccgcaataggaaaagcatgggaagaaggcgtgtgcgggattcggtctgcgaccagactagaaaatattatgtggaaacagatatcaaatgagctcaatcatatactcttagagaatgacatgaagttcaccgtggtagtcggcgatgctaatgggatattggcacaggggaaaaagatgataagacctcaacctatggaacacaagtattcatggaagtcatggggaaaagctaaaatcattggagccgacatacaaaatacaacatttattatagacggcccagacacaccagaatgcccagacaatcaacgtgcctggaacatatgggaagtggaagactatggattcggcatattcactacaaatatttggctcaaattgcgagactcgtatactcaaatgtgtgatcacaggctaatgagtgcagcaattaaagactccaaagcagtccacgctgacatgggatattggatagaatcggaaaagaacgagacttggaaattagctagagcctccttcatagaggtaaaaacatgcacttggcccaaaagccatacattatggtctaatggagttttagaaagcgaaatgatcattcccaagatctacggcgggccaatcagccaacataattatcgaccagggtacttcacacaaacagctggaccatggcatttaggaaaactagagttagattttgatttatgcgaaggaaccactgttgtagtagacgagcattgtggaaacaggggaccgtcactccgtacaacaactgtaacggggaaaataatacacgagtggtgttgtagatcatgtactctaccacccttgaggtttagaggagaagacggctgctggtacggtatggaaatcagaccagtcaaagaaaaagaggagaatttagtaagaagcatggtatcagcaggatcaggagaggtagactctttttctttagggatcctatgtgcatctatcatgatagaagaagttatgcgctcaagatggagtagaaaaatgttgatgacaggcaccctggcagtattcttactcttgatcatgggacaattaacatggaatgatctaatacggctttgtataatggttggagccaatgcgtctgacagaatgggcatgggtaccacctatctagcgctaatggcgacgttcaagatgcgtccaatgtttgcagtaggacttctattcagacgactcacatcaagagaagtacttctgctcaccataggattatccttggttgcttctgtagaattaccgaatagtttagaagaactgggcgacggattagcaatgggaattatgatgttgaaattgctgacagagttccagccacatcaactatggaccactctgctttcgttaacttttataaaaactacactatcattagactatgcatggaaaaccacggctatggcgctttcgattgtatcactttttccattatgcttaagtacaacctctcagaaaactacctggttaccagtattactaggaagttttggatgcaaacctctcacaatgttcctaattaccgaaaataagatatgggggcgaaagtcatggcccttaaatgagggaattatggcgataggaatagtatcgatcttgctgagctctctcctaaagaatgacgtcccattagcgggaccgttgatagcgggaggaatgctaattgcatgttacgttattagtggttctagtgctgatttatcgctggaaaaagccgcagaagtaagctgggaacaagaagcagaacatagtggaaccagtcataatatacttgttgaagtccaagacgatggcactatgaagataaaggacgaggaacgtgatgacactctgactattttattaaaagccaccttattggccgtgagcggtgtatatccgatgtccatacctgcaacacttttcgtctggtatttctggcagaagaagaaacaaaggtcaggagtcttatgggatactccaagtccaccagaggtagaaagagccgtactggatgatggaatctatagaatattgcaaagaggactattaggtcgatctcaggttggtgtaggtgtgttccaagatggcgtcttccacacaatgtggcatgtaacgcgcggagctgttttaatgtaccaaggaaaaaggctagagccaagttgggcatccgtaaagaaagacctaatatcctatggaggtggatggaggttccaaggctcttggaatacaggcgaagaggtacaagtaatcgctgtggagccgggcaaaaatcctaaaaacgttcaaacaactcccggaactttcaaaactcccgagggagaagttggagctatcgcactcgatttcaaaccaggaacatcgggatcaccgattgtaaatcgagaagggaaaatagtggggttatacggtaacggtgtagtgacaaccagtggaacatacgtttcggctatagcacaggccaaagcaagtcaagaaggtccgctgccagaaatagaagacgaggtgtttaagaaacgaaatctaacgatcatggacttacacccaggaagtgggaaaacacgaaggtatttaccagctatcgtacgcgaagccattaaacgcaaattaagaactctaattctagctccgactcgagtggtggcaagcgagatggctgaagctctgaaaggaatgccaattcggtatcaaacgacagcagtaaaatctgagcatactggaagagagattgtagatttaatgtgtcatgcaacattcacaatgcgcctgctgagtccagtccgggtcccaaattacaatatgatcataatggatgaggcacatttcacagatccagcaagtatagctgccaggggatacataagcactagggtgggtatgggtgaggctgcggcaattttcatgacagctacgccccctggttccgtagaggcttttccacaatctaatgcggtcattcaagatgaagaacgtgatattccagaacgttcatggaactcaggatatgattggatcactgattttcctggtaaaacagtatggttcgtgccatccataaaatctggaaatgacatagcaaattgccttcgcaaaaatggtaaaagagtcatccaactatcacgtaaaacatttgatacggaataccagaaaacgaaaaataatgattgggattatgtagtaacgacagacatatcagaaatgggggcgaattttagagcggatagagtcatagaccctcgacgttgcctaaaaccagtaatattaaaggatggccctgaaagagtgatacttgcagggcctatgcccgtcaccgtagcatcagccgcacagagaagaggaagaattggcagaaaccaaaataaggaaggagatcagtacgtctacatgggacaaccattaaacaatgatgaagatcacgctcattggactgaagctaaaatgttattagataatataaacacaccggaaggtataatcccagcactgttcgaaccagaaagggaaaagagtgcagccattgatggagaatatagactaagaggtgaagctagaaagacatttgtagagttaatgcgaagaggtgacctccccgtttggctatcgtacaaagtagcgtctgaaggatttcaatatagtgacagaagatggtgctttgacggagaaagaaataatcaagttctagaggaaaatatggacgtcgaaatttggacaaaagagggtgagaggaagaaattaaggccaaggtggcttgacgcaaggacatacagtgatcctcttgcgctgagagagttcaaagaatttgcagcagggcgcagatcagtctcaggcgacctaatattagaaattggtaaactcccgcagcacctgaccttacgcgcacaaaacgcactcgataacttggtaatgttacacaactcagaacaaggtggtaaggcttacagacatgcaatggaagaactgcccgataccattgaaacgttaatgttgcttgcccttattgcagtattaaccgggggagtcacattattctttcttagtggaaaaggattgggtaaaacctcaatagggttactgtgtgtgactgctagctcggctttactatggatggcctctgtagagcctcactggattgcagcgagtatcatactggagttctttctgatggtacttctgattccagaacctgataggcaaagaactccccaagataatcaattagcgtacgttgtcataggccttttatttatgatccttacagttgctgctaatgagatggggctccttgaaacgaccaagaaagaccttggtatcggtcatgtagcagcagaaaaccaccagcatgcaaccatgttggatgtcgacctaagacctgcctccgcatggacattatatgcagtggccactacagttataaccccaatgatgagacatacgatagagaacacaacagcaaatatcagcttaaccgcaattgcaaatcaggcggccatattaatgggtttagataagggctggccaatctcaaaaatggacattggagtgcccttattggcattaggttgctacagtcaagtcaaccctctcaccctgacagcagcagtactaatgctagtagcccactatgcaattatcggacccgggcttcaagcgaaagcgacgcgtgaagcacagaaaagaactgctgcaggtattatgaaaaatccaacagttgatgggatagtagcgatagacttagatccggttgtatatgacgccaaatttgaaaaacaattaggacagatcatgttattaatattatgtacatcccaaatacttcttatgcgtaccacttgggcattatgcgaatcaataaccctagctacaggaccattaacaacattatgggaaggatcacctgggaagttttggaacacaacgattgcggtctctatggcaaacatttttcgtggtagctatttggcaggagctggcctagcattcagtctcatgaaatcactagggggaggacgccggggaacaggggcacaaggtgagacacttggggaaaaatggaaacgtcagctaaaccaattgtctaagtcagaatttaacacatataaacggtccggaattacagaagtggatagatcagaagcaaaagaaggtctgaaacgaggagaaacaactaaacatgcagtgtcgcgaggaacagccaaattacgatggtttgtcgagagaaatctagtaaaaccagaagggaaagtaatagatctggggtgtggacgaggaggctggtcatattattgcgccggacttaagaaagtgacagaagttaaaggctatacaaaaggaggcccaggacacgaagaaccgatacctatggcaacgtatggttggaacctcgtaaagttacattcaggtaaggacgtcttcttcatgccacctgagaaatgtgatacattactatgtgatataggggaatcatctcctaacccaactatcgaagaagggcgtacacttcgagtactaaaaatggtcgaaccatggctgagaggaaatcaattctgcataaaaattttaaatccatatatgccttcagtagtagaaacattagaacaaatgcagcgcaaacatggaggaatgcttgtgcgcaatccattaagtagaaatagtacccatgaaatgtattgggtttcatgtgggacagggaatattgtatctgctgtaaatatgacaagtaggatgctactaaatcgctttacaatggcacacagaaaacctacattcgaaagagatgtagatttaggagcagggactagacatgtagctgtagaaccggaggttgccaacctagatatcataggccaacgtatagaaaatatcaagaatgaacataaatctacttggcactatgatgaagataatccgtacaaaacctgggcttatcacggatcatacgaagttaaaccaagtggatcggctagtagcatggtaaatggagtagtacgtcttttgactaaaccatgggatgtaattccaatggttacacaaatcgcgatgacagatactactccgtttgggcagcaaagggttttcaaggaaaaagtggatactagaacaccaagagctaaacgaggaacaacccaaataatggaagtaaccgccaaatggctgtgggggtttctctctagaaataaaaagccaagaatttgtactcgcgaggagttcacaaggaaggtaaggtctaatgcagcaatcggtgcggtattcgttgatgaaaaccaatggaactccgccaaggaagccgtcgaggacgaaagattttgggatcttgtgcaccgtgaacgagaactccataaacagggcaaatgtgcaacatgtgtttataacatgatggggaaacgtgagaagaaacttggagagttcggcaaggctaaaggctccagagccatctggtatatgtggctaggcgcgcgtttcctcgagtttgaggcattaggattcatgaatgaagatcactggttctcgcgagaaaattcattaagtggagtagaaggtgaaggtcttcataaactaggctacatactcagagatatcagtaaaataccagggggaaatatgtatgcagatgacacagcaggctgggacacacggataacagaggatgaccttcaaaatgaggcaaaaatcacagatatcatggaacctgagcatgccctattggcgacttcaatatttaagctcacataccagaataaagtcgtgagagtacaacggcccgccaagaatggaacagtcatggatgtaatttcgagaagggatcagaggggtagtggacaagttggaacgtatggtttaaatacattcacaaatatggaagtacaattaatcagacagatggaatctgagggaatatttttgccctcggagctcgagacgccaaacctagctgagagggtattagattggttagagaaacacggagccgagcgtcttaaaagaatggctatatccggagacgattgtgtagtaaaaccaattgatgatagatttgcaactgcgttgaccgccttgaatgatatgggtaaagtgcgcaaggatattccccaatgggaaccttcgaaggggtggaacgactggcaacaggtcccattttgctcacaccactttcaccagctgattatgaaggacggacgagagatcgttgttccctgcaggaaccaagatgaattagtgggtcgagccagagtgagccaaggggcaggttggagtctaagagaaacagcgtgtttaggtaaatcgtatgcccaaatgtggcagctaatgtattttcataggagagatctacggctggcagcaaatgcaatttgttcagctgttccagttgattgggtaccaactagccgaactacgtggagcatacacgcccaccatcagtggatgacaacagaagacatgttatcggtttggaatagggtatggatagaggaaaatccgtggatggaagataaaacgcacgtatctagttgggaagaagtaccctatctcgggaaaagagaagatcaatggtgtggttctttaattggattaaccgcaagagcgacatgggcgacaaatatccaagtagccataaatcaagtcagaaggctgattgggaatgaaaattatttggactacatgacaagtatgaaaagattcaaaaacgaatcagaccccgaaggtgcgctctggtaa

SEQ ID NO: 21274 - RNA, 9879 nt, synthetic construct
  misc_feature 1..9879: note = derived and/or modified CDS sequence (opt6) from DENV-1__KJ189323__SS-prME
  source 1..9879: mol_type = other RNA
tcagttaccatgttgcttatgctgctgccaacagcactagcctttcatctcacaacaagaggtggagaaccacatatgatcgtatccaaacaagaaagaggaaaaagtctactgttcaaaacgtcagctggggtaaacatgtgtacgctcatagctatggatcttggagaactatgcgaagataccatgacatataaatgtccacaaataacagaagcggaaccagacgatgtcgattgttggtgtaatgcaacggatacatgggtaacatatggcacatgttcacaaacgggagaacacagaagggataaaagatcggttgctttagcgccacacgtaggactgggactagaaactcgaacagaaacctggatgagtagcgaaggggcgtggaaacaaattcaacgcgttgaaacatgggcattacggcacccagggtttacagtaatagcgctattcctcgcacatgccatcggcacgtcaatcacacaaaaaggaatcatcttcatactcttaatgctagtcacaccaagtatggccatgcgttgtgtcggtatcggaaacagagactttgtggaaggattatccggggcaacgtgggtagatgtcgtactagaacacggcagttgcgttacaacaatggccaaaaataaaccaactcttgatatagaacttttaaaaaccgaagtgacaaaccccgctatcttaagaaaactatgtattgaagcaaaaataagcaacacgacgactgattcaagatgcccgactcaaggagaagcaactttagttgaggagcaagatgcaaactttgtttgtaggagaacctttgtcgataggggatggggaaacggttgcggcctttttgggaaaggcagcttattaacttgtgctaaattcaaatgtgttacgaaactggaagggaaaattgtacaatacgaaaatcttaaatattcagttatcgttacagtgcacacaggtgaccaacatcaggtcggaaacgagactacagaacacggtacgatagcaactataacaccacaggcacctaccagtgaaatccaattaactgactatggtgcacttactctagactgttctccgcgaacgggcctagatttcaatgagatggtcttattgacgatgaaagagaaatcgtggcttgttcacaaacaatggtttttggacttacccctaccctggacatctggagcttctacatcacaggagacatggaaccggcaagacttacttgtgacctttaaaaccgcacacgcaaagaagcaggaggtcgtcgtactgggctcccaagaaggggcaatgcatacagcactgacaggagcaacagagattcagacatcaggcaccacgacaatattcgcaggtcatttaaaatgcagacttaaaatggataaattgacgttgaagggaacgtcctacgtaatgtgtacaggcccgtttaaactagaaaaagaagtcgctgaaactcaacatggtacagttctagtccaggtaaagtatgaggggacagatgccccgtgtaaaataccattctcgacacaagatgagaagggcgttacacaaaatgggcgtcttatcacggcaaacccaatagtaactgacaaggagaaacctgtaaacatagaaacagaacctccttttggcgaaagttatatagtggttggcgcgggcgaaaaggctctcaaactatcctggtttaagaaaggctccagcataggcaaaatgtttgaagcaacagctcgcggagcgcgacgtatggctattttaggagatacagcatgggattttggatcgattggcggcgtgtttacctctgtaggaaagttagttcaccaagtttttggaacagcgtacggtgtattattttcaggcgtgagctggactatgaaaataggaattggaattttactaacatggcttggactaaattctagatctacatcgctttccatgacgtgtatcgcagtaggcatggtgaccttgtatctaggggtcatggttcaagcagatagtggttgcgtcatcaattggaaaggtagagagctaaaatgtgggtcaggaatcttcgtaacaaatgaagtacacacatggacagaacaatataagtttcaagctgattcacccaaaagactcagcgcggcaatcggaaaagcctgggaggaaggtgtttgtggcatacgttcggcaaccagattagaaaacatcatgtggaagcaaataagcaacgagttaaaccacatactcttagaaaatgatatgaagtttacagtggtggtaggtgacgcaaacgggatattagcgcaaggcaagaaaatgatcagaccccaaccaatggaacacaaatacagttggaaatcgtggggcaaagccaagattataggtgcagatatccagaacacaacgttcataatagatggcccggatacgccggagtgtcctgataatcaacgagcctggaacatatgggaggtagaagactatggttttggtatttttacgaccaacatttggctcaaactaagggattcgtatacacagatgtgcgatcaccgcttaatgagtgccgcaatcaaggacagtaaggcggtacacgctgatatgggctattggattgagtctgagaaaaacgagacatggaaattagcccgtgcttctttcatagaagtaaaaacctgcacttggcctaagtcgcacacgctctggtccaatggggtattagaatctgaaatgataattcctaaaatatatggaggccctatatcccaacataattacaggccaggatacttcactcaaacagctggaccctggcatcttggtaaactagaattggactttgatctatgtgagggaactactgtagtggttgacgaacattgcggtaatcgaggtcctagtctaagaacaactacagtgactggcaaaataatacatgaatggtgttgtaggtcatgtactctacccccattgagatttagaggggaagacgggtgttggtatggaatggaaataagacccgtaaaagaaaaagaagagaatctagtcagatctatggtcagtgctggttctggagaagtggactccttcagtctcggaatcttgtgtgtttcaataatgatagaagaagtaatgcgaagtagatggagccgcaaaatgttaatgacaggcacgctagcggtatttctactgcttgtcatgggtcaattaacatggaacgatttgattagactgtgtataatggtcggtgcgaatgcgagtgaccgtatgggtatggggaccacttatttagccctcatggcgacattcaaaatgcgtcccatgtttgccgtaggcttactatttagacgtcttacgtcaagagaagttttactcttaaccatcggactctcattagtggcctcggtcgaactcccaaacagcctagaagaactaggagatggactcgcaatgggaattatgatgttaaaactacttaccgaatttcaaccacaccaattatggacgactttactctcattgacatttattaagactactttgtcattggactacgcctggaaaactaccgcaatggcattatctattgttagccttttcccattatgtctatctaccacttcccagaaaaccacttggctccctgttttattggggtcgttcggttgcaaaccactgacaatgttcctgataaccgaaaataaaatctggggaagaaaatcttggcccttaaacgagggcattatggcgattggaatagtaagtattcttttgtcatcattgctaaagaatgacgtaccattagctggtccattaatagccgggggaatgttgatagcttgttacgtcatatcaggcagttcagcagatttgagtctagagaaagcagcagaagtctcgtgggaacaagaagcagaacactcaggaacaagtcacaacatcctagtagaagttcaagacgacggaacgatgaaaatcaaagacgaagaaagagacgatacacttacaatcttattaaaagccaccttactagcagtttcgggagtctatccaatgtccatcccagcaaccttatttgtatggtatttctggcagaaaaagaaacagaggtctggggttttatgggatacaccatctccaccagaggttgagagggcagtgctcgatgatggaatttatagaatcttacaaagaggactcttgggccgcagtcaagtaggtgtgggagtcttccaaggaggtgtattccatacaatgtggcacgtcacacggggcgctgtccttatgtaccaagggaaaaggttagaaccgtcatgggcgtcagtgaagaaagatttaatatcttacggcggaggatggcgttttcaaggaagctggaataccggtgaagaagttcaagttattgcagtggaaccagggaaaaatcccaaaaatgtccaaaccacaccgggaacttttaaaactccagagggcgaagtaggggcaatagctttagacttcaaacctggtaccagtggttcacctattgtgaatcgagaagggaaaattgtagggttatacggtaatggcgtagtgacaacttcaggcacttacgtttctgcaattgcgcaagctaaggcttcacaagaaggaccgttgcccgaaatagaggatgaagtattcaagaaacgaaatctaaccatcatggatctgcatcctggttccggaaaaacaagacgatatttacctgcaatcgtgagagaggctataaagagaaaacttcgcactctaattctggcacccacgagagtcgttgccagtgagatggctgaagccttaaagggtatgccgataagatatcagaccacagcagtaaagagcgaacataccggcagggagatagttgatctcatgtgtcacgctacatttactatgagactactttccccagtacgggtaccgaactataatatgataataatggacgaagctcactttacagatcctgcttctatagctgcaagaggctatatcagtacgagggttggaatgggtgaggccgcagccatatttatgacagctacgccacctggatcagtagaggctttcccccaatcaaatgcagtcatacaagatgaggaaagagacatccccgaacgaagctggaatagtggctacgattggataacggactttcctgggaaaacagtttggttcgtacctagtataaaatctgggaatgatatagccaattgtctaaggaagaatgggaaaagagtaatacaattatcaagaaaaacctttgatactgagtatcagaaaactaagaataacgattgggactatgttgtcacaacagatatatcggagatgggtgcgaactttagagcagatagagtaatagaccccaggcggtgtttgaaacctgtaatactaaaggatggccctgaacgggtgatattagccggcccaatgcccgtaacagttgcctcagctgcccaacgcaggggtaggattgggcgtaatcagaacaaggaaggagaccaatacgtatacatgggacaaccactcaacaacgacgaggatcacgcacactggacagaagccaagatgttactagacaacataaatacaccggaaggaataattccagctttgtttgaaccagaaagggaaaaatcagctgcgattgatggagaatatagattacgtggagaggcacgaaagacttttgttgagctaatgaggagaggagacctaccagtctggttatcctataaagtcgctagtgaggggttccaatatagtgacagacgatggtgttttgatggagagcgaaataatcaagtactagaagaaaacatggacgtagagatttggaccaaggaaggggaacgaaagaaactaaggccacgttggcttgatgccaggacatacagcgacccacttgcactgagagagtttaaagagttcgcagctggacgacggtcagttagcggagacttaatattggaaatcggaaaattaccacaacaccttaccctacgcgcccaaaacgcacttgataacctagttatgctacacaactctgaacaagggggtaaagcctatcgtcatgcaatggaagagttacccgatacaattgaaacgctaatgcttctcgcccttattgcagtactgacgggaggagtaacgttattctttttatctggcaagggcctaggaaagacaagcatcggattattgtgcgttactgctagcagtgcactattatggatggccagtgtcgaaccacattggatagcagcaagtataatattagagttctttttaatggtcctacttatccctgaaccagatcgacaaagaaccccgcaagacaaccaactcgcttacgttgtaataggactactatttatgattcttaccgtcgcagccaatgaaatgggcctcttagagactacaaagaaggatcttggaataggacatgtagctgcagaaaatcaccaacatgccaccatgttagacgtcgatttgcgccccgcatctgcatggacgttatacgcagtcgcaacaaccgtcattacccccatgatgagacatacaatcgaaaacacaacggctaatatttccttaaccgcaatagcaaaccaagcagcaatattaatgggattagataagggatggccaatatctaaaatggatattggtgtgcctctactagctttaggttgttattcacaagtcaaccctctgacactaactgcggcagtactaatgcttgtagcacactacgctattataggaccagggcttcaagcaaaagcaacacgagaggcacagaaaagaacagcggcaggcatcatgaaaaatccaaccgttgatggaatagtagcgatagatttagatcctgttgtatacgatgctaagttcgagaaacagctaggacaaattatgctactaatattgtgcacttcacaaatacttctaatgcgaacaacttgggcgttatgtgaatccataaccttagctacaggaccgctaactaccctttgggaaggatctcccggaaaattttggaatacaacaattgccgtttccatggccaacattttccgcgggtcttacctagctggtgcaggattagcattttcactgatgaaatctctgggaggaggaagaagaggaactggtgcccagggagaaacgcttggagaaaaatggaaacgtcagttgaatcaattgtcaaaaagcgagttcaatacgtataaaaggtctggtattatggaagtagatagatcagaagctaaagaaggattaaaaaggggagaaacgactaaacacgcagtctcacgaggaacagctaaattaagatggtttgttgagagaaatttagtgaaacctgagggcaaagttattgatctagggtgcgggagaggaggctggagttattattgtgcagggctaaagaaagttacagaagtaaaaggttatacaaagggtggacctggtcatgaagaacctattccgatggcaacatatggatggaatctggttaaactgcattccggtaaagatgtctttttcatgccaccagaaaaatgcgatactttattatgtgacattggggagtctagtcccaacccgaccatagaagaaggaaggactttgagagtactgaaaatggtagaaccttggttacgtggaaaccaattttgcatcaagattttaaacccgtacatgccatccgtagttgagacgctggaacaaatgcaacgcaaacatggaggcatgcttgtccgaaatccactgtctagaaatagtacccatgagatgtactgggtatcttgcggaactggaaatatcgtatcggccgttaacatgacaagccgaatgctactaaatagattcacaatggcacaccgaaagccaacctacgaaagagatgtcgacttaggagctggcacaagacacgttgctgtagaaccagaagtagctaatttagatataatagggcaaagaattgaaaatataaagaatgagcacaagtctacttggcattacgatgaagacaatccttacaaaacttgggcgtaccatggttcatacgaagttcgcccgtcgggctctgctagttctatggtgaatggggttgtcagactgttaaccaaaccatgggacgtaatacctatggttacacaaatagcaatgactgatacaactccattcgggcaacagcgtgtattcaaagaaaaggtggacacgcggacaccaagggcaaagcgtggaactacacaaatcatggaggttacagcaaaatggctttggggcttcctatcgaggaataagaaacctcgcatctgtacacgagaagagttcactagaaaggtacgttcaaatgcagcaataggagcagtgtttgtagacgaaaatcaatggaactccgcaaaggaggcggtagaagatgagcgattctgggatttagtccatcgagaaagagaattacataaacaaggaaagtgtgcaacttgtgtatataatatgatgggaaaaagagagaaaaagttaggcgaatttggaaaggccaaaggttccagagcaatctggtatatgtggcttggtgcaagatttctcgagttcgaggcattgggatttatgaatgaggaccattggtttagcagagaaaactctttatcgggcgtagaaggtgaaggtttacataaactaggatacatattgagagacatttcaaaaatcccaggtggaaatatgtatgcagatgatacagccggatgggacacgagaataactgaagacgatttacaaaacgaagcaaagataacagagattatggaacctgagcatgcgttacttgcgacctcgatatttaaattaacttatcaaaataaagtagttcgtgtacagaggccagcaaagaatggtacagttatggatgtaatttcgcgtagagatcaaagaggttctggtcaagtaggtacgtacggactaaacacattcactaacatggaagttcaactaatacgacaaatggagtcagaaggtatttttcttccgtcagagctggagactcccaatctcgcggaaagggtactagattggttagaaaaacatggcgcggaacgacttaagcgcatggcaatctcgggtgatgattgtgtcgttaaaccgatcgatgatagattcgctacagcacttacggcactgaacgatatgggtaaggtaagaaaagatataccccaatgggaaccctcaaaaggttggaatgattggcaacaagtgccattctgtagccatcattttcatcaacttatcatgaaagacggacgtgaaattgtagttccttgccgaaatcaggacgaactggttggccgcgcacgagtaagtcaaggcgccgggtggagtttaagagaaactgcttgtttaggcaagagctatgcacaaatgtggcagttgatgtattttcatcgaagggacctcaggcttgctgcaaatgcaatttgctcagcagtcccagtggattgggtgcctacatcgcgaacgacttggagtatacatgcacaccatcagtggatgacaaccgaagacatgttatccgtatggaatagagtgtggattgaagaaaatccatggatggaagacaaaacacatgtaagtagttgggaagaggtaccttatttgggcaaacgagaagaccaatggtgcggctcccttatagggttaacagcacgagcaacatgggcaacaaacatacaagtggctattaaccaagttagaagattgataggaaatgaaaattatcttgattatatgacaagcatgaagcgttttaaaaatgaaagcgacccggagggagccctatggtga

SEQ ID NO: 21275 - RNA, 9879 nt, synthetic construct
  misc_feature 1..9879: note = derived and/or modified CDS sequence (opt6) from DENV-1__KJ189324__SS-prME
  source 1..9879: mol_type = other RNA
tcagtaactatgttactcatgcttttacccactgcactcgcttttcatttaaccactagaggcggagaaccacatatgatagttagtaaacaagaaagaggtaaaagtttactatttaaaacatcagctggtgtaaatatgtgtacgttaattgcaatggatctaggcgaactatgcgaagatactatgacttataaatgtccccaaataactgaagcggaaccggatgacgttgactgctggtgtaatgcgacggatacatgggttacgtacggtacctgctcacaaacaggggaacatcgtagagacaaacgctcggtggcgttggctccgcacgtgggattgggtttagaaacgagaaccgaaacttggatgtcatctgaaggtgcttggaaacaaattcaaagagtagaaacatgggctctacgacatccgggtttcaccgttatagcgctctttttagctcatgcgataggaacgagcataactcagaaaggaataatatttatattgctcatgttagttactccatcgatggcgatgcgctgtgtaggaatcgggaatcgagacttcgtagaaggactgtcaggagcaacctgggtagatgtagtcctcgaacatggatcatgcgtaacgacaatggcgaaaaataaacctacactagacatagaactattgaaaacagaggtaactaacccagctatactccggaaattgtgtattgaggcgaaaattagcaacacaactactgattcaagatgtccaactcagggtgaagctacgctggtagaagaacaagacgcaaatttcgtttgccgacgaacttttgtcgatcgtggatggggtaatgggtgtggcctatttggtaaaggttcactattaacatgtgctaaatttaaatgtgttactaaattggaaggaaaaatagtacagtatgaaaatctaaagtactcagttatagtaacagtacataccggggaccaacatcaggttggaaatgaaacaactgaacatggaaccattgcgacaattacgcctcaagcacccaccagcgaaattcagctgactgattatggagcattaacactagactgcagtccaagaactgggttagatttcaatgaaatggttctattaacgatgaaagaaaagtcctggttagttcataaacagtggtttttagatttaccactaccatggacaagcggagcttccacgtcgcaagaaacctggaacagacaggatctattagtaacctttaaaacagcacacgccaagaaacaagaagttgtagtactcggatcacaggaaggggccatgcatactgcattaaccggcgcaacagaaatacaaacaagtggaactacaactatatttgcgggacacttaaaatgcagattgaaaatggacaaactcacgttaaaaggaacctcctatgtaatgtgtacagggagtttcaaacttgagaaagaagtagcagaaacacagcacggtacagtgctagttcaagtaaagtacgaaggaaccgatgcgccatgtaagatacccttcagtactcaagatgaaaaaggagtaacccagaacggccgtctcatcacagcaaaccctattgttacagataaggaaaaaccggttaatattgaaactgagccgccgttcggcgagtcatatatagttgtcggtgcgggcgaaaaagcactgaagttatcctggtttaagaagggatcctcgataggaaagatgttcgaagcaacagcgaggggagcacgaagaatggccattttaggcgacacagcttgggatttcggatctataggtggcgtgtttacatcagtaggtaagttagtacaccaagtctttggtacagcttatggtgtattattcagtggtgtctcctggacaatgaaaataggtatagggattctgttaacttggctcggacttaattcgcgatctacgagtttatcaatgacatgcatagcagtcggcatggtgactttgtatctgggagttatggttcaagcagactcaggctgcgtaataaattggaaaggacgggaattaaaatgtggttctggcattttcgtcaccaatgaagtccatacttggacagaacagtataagtttcaagccgacagtccaaaacgactatccgcagcaatagggaaggcgtgggaagaaggtgtgtgtggcatacgctcggccacacgcttagagaacataatgtggaaacagatctcgaatgaactgaaccatattctattggaaaatgatatgaagttcaccgttgtagtaggggatgcaaatggaatcttagctcaaggcaagaaaatgatcaggccccagccaatggaacataagtatagttggaagagttggggtaaggcaaaaataatcggagcagatatccaaaacactacatttataatagatgggcctgacacaccagaatgcccagataaccagagggcttggaatatttgggaagttgaagactacggttttgggatatttacaacgaatatatggctgaagttgcgtgattcatatacccaaatgtgtgaccatcggcttatgtcagcagctattaaagattcgaaggctgtacacgcagatatgggatattggattgaaagtgaaaagaacgaaacttggaaacttgcgagggctagctttattgaggttaaaacttgtacatggccgcgttcccatactttatggtcaaatggtgtgctcgagtcggagatgataatacctaaaatttacggagggcccatatcacaacataactaccgccctggttacttcacgcaaacggcaggcccttggcacttaggtaaattagaacttgactttgatttatgcgagggtacgacagtcgtcgtagacgagcactgtggtaatcgtggccccagcctaaggacaaccacagtaacaggaaaaatcatacacgaatggtgctgcagatcatgtaccttgcctccgttgagatttcgcggagaagatggctgctggtatggtatggaaattcgaccggttaaggagaaagaagaaaatctagtaaggagtatggtaagtgcggggtccggtgaggtagattcgtttagtcttgggattctttgtgccagcataatgatcgaagaagtaatgagatcaagatggagcagaaaaatgctcatgacaggtactctagcagtattcctcttactcgttatggggcaattaacgtggaatgatttaataagattatgtattatggtaggtgccaacgcatctgacagaatgggaatgggaactacttatctggcattgatggcaacgtttaagatgaggcctatgtttgccgtgggcctattgtttcgaagattaacaagccgagaggtcctacttttaacaatcggattaagtttagttgcttctgtagaattaccaaactccttagaagaactaggggatggacttgctatgggcataatgatgctaaaactattgactgaatttcaacctcaccagttatggacaacactattatctctaaccttcataaaaacaacactgtcactcgactatgcatggaaaaccacagccatggcgctatcaatcgttagcctcttccccctatgcttaagtactacttcgcagaagacaacatggttaccagtgctattgggtagttttggatgtaagccactcacaatgtttctaatcacagaaaataaaatatgggggcgtaaaagttggcctttaaacgaaggtattatggctataggtatagtatcaatcttactctcgtcactgttaaagaatgatgttcctttagcgggaccactaatagcgggtggtatgcttattgcatgttacgtaatctcaggatcttcagcagatcttagcctagaaaaagcagcagaagtttcatgggaacaggaagcagagcattcggggacaagtcataatatattagtcgaagtccaagacgatggaaccatgaaaattaaagatgaagagagagacgacacattgacgatcctgctaaaagctacactactagcagtaagcggggtttatccaatgtcgatcccagcgactctgtttgtatggtacttttggcagaaaaagaaacaaagaagcggagtcctgtgggacactccatcaccgccagaggtggaacgagctgtcttagacgacggaatctacagaatccttcagaggggactccttggccgttcgcaagttggtgtaggggtattccaagatggtgtattccatacaatgtggcatgtcactagaggtgcggtgttaatgtatcaagggaaaagattggagccttcctgggctagtgtcaagaaagatttaataagttacggagggggttggagatttcaaggaagctggaatacgggtgaagaagttcaagtcatagcggttgaacctggaaagaaccccaaaaacgtacaaactacaccagggacctttaaaaccccagaaggtgaagttggagcaatagcacttgacttcaagccgggaacaagcggaagccctatagtaaatagggaaggtaaaatagttggattatacggtaatggtgtggttacaacttcaggtacttatgtaagtgccattgcacaggcgaaagcgtcacaagaaggtcccttgccagaaattgaagatgaagtattcaagaaacgaaatttaacaataatggatctccatccaggtagtggtaagacaagacgatacttgcctgcgattgtcagagaggcgatcaaaagaaagctgcggacattaatattagcccctactcgcgttgtagccagtgaaatggcagaggccctgaaaggaatgcctatacgataccaaacaacggcggtaaagagtgaacacacaggacgagaaatagtggatcttatgtgccatgcgacttttacaatgcgactactaagtcccgtcagggtgccaaactataacatgattataatggatgaggctcactttaccgatccggcttcaatcgctgcacgtgggtacataagcacacgggtaggcatgggagaagctgcagcaatttttatgaccgctacaccacccggcagcgtcgaagcgtttccacaaagtaacgcagtgatccaagatgaggagagagacatcccagaacgtagctggaactccggttatgactggataacagacttcccaggaaagaccgtatggtttgttccatcgataaaatccggaaacgatatagcaaattgcctgaggaaaaatggaaaacgcgtgatacaattaagtcgtaaaacatttgacactgaatatcagaaaaccaaaaacaacgactgggactacgtcgttacaacagacatatcagagatgggcgcgaatttcagagctgacagagtcatagaccccaggcgttgcttaaaaccggtaatcctcaaagatggcccagaaagagtaatattagcaggaccgatgccagttacggtggcttcagctgcacaacgcagaggaagaatcgggcgtaatcaaaataaagaaggagaccagtatgtttacatgggtcagccgttaaataacgatgaggaccacgcacattggacagaagcaaaaatgctattggacaacataaacacaccagaaggaatcattccagctctttttgaaccggaacgtgaaaagtcagcagcgatagatggcgaatacaggttacgaggtgaagctaggaaaacattcgttgaactaatgaggcggggcgatctacctgtatggttaagttataaagtggcctccgagggttttcaatactctgaccgaagatggtgtttcgacggggagcgtaataatcaggtactagaagagaacatggatgtagaaatatggactaaagagggagagcgcaagaaattaaggccaagatggttagatgctagaacgtattcggacccattagcgctgcgagagttcaaagagttcgccgcaggtagaaggagtgtaagtggagatttaatcttggaaataggaaaacttccacaacatttaacgttgagagcacaaaatgctttagacaaccttgtaatgctccacaactcagagcaaggaggtaaagcgtatagacacgcgatggaagaactaccggatacaatcgagaccctaatgttacttgctcttattgcagtcctaacaggtggagtgacgttattctttttaagcggaaaagggttgggtaagaccagtattgggctgttgtgtgttactgcttcatcagcgctgctctggatggccagtgttgaaccacattggatagctgcatcaatcatcctcgagttctttctaatggtgcttttaattccagaaccggaccgacaaagaactccacaggacaaccaactagcatacgtggttatcggtctgttatttatgatcttaacagtagcagctaatgaaatgggattgctcgaaactactaaaaaggaccttggtataggacatgttgcagcggaaaaccatcaacatgcaacaatgcttgatgtagatttacggccagcaagcgcatggacgttatacgcagttgctacgactgtgataactcctatgatgcgtcacacgatcgagaatacaacagcaaacatttccttaaccgctatcgctaaccaggcagcaatattaatgggtctagataaaggatggccaatcagtaaaatggacatcggagtaccacttctggcgttaggatgctatagccaagtaaatcctttgaccctaacagccgcagtactaatgttagtcgctcattatgcaattattggaccgggattgcaagcaaaggcaacgagggaggcccagaaacggacggcagcgggcataatgaagaatcccactgtcgacggcattgtagcaatagacttagatccggtagtatacgacgccaaatttgaaaaacaactcggacaaataatgttgttgatattatgcacgagccagattcttctgatgcgtacgacctgggcactatgtgaaagcataacattagctacaggtccgttaacaactctatgggaaggctcacctgggaaattttggaacacgacaatcgctgtctcaatggctaatatctttaggggctcatatttagccggtgcaggactagcattctcgctaatgaaatcacttggagggggccgccgggggacgggggcacaaggtgagacattgggagagaaatggaagagacaactaaatcagctctcaaaaagcgaatttaatacatacaaacgttctgggattatggaggtagatagaagtgaggcaaaagagggtttaaaacgaggtgaaacaacaaaacacgcagtatcgagaggaaccgcaaagttacgttggttcgttgaacgaaatctagtgaaacccgaagggaaagtgatagatctcggctgcggacgtgggggatggtcttattattgcgcagggctaaagaaagtgacagaagtgaaaggatatacgaaaggaggaccggggcacgaagaaccgatacccatggccacatacggatggaacctagtgaaacttcattctgggaaagacgtcttcttcatgccacccgagaaatgtgataccctactctgtgatatcggcgaaagcagtccaaaccctactattgaagaaggtaggacccttagggttttaaaaatggtagaaccatggcttcgtggaaaccagttttgtataaaaatactcaacccttatatgccatccgtagtcgagactttagagcaaatgcagcgcaagcatggaggaatgttagtaaggaatccattgagtcgcaattcaacacatgaaatgtattgggtaagttgtgggaccggcaacattgtgtcagcagtgaatatgacgtcacggatgttattgaatcgatttaccatggcgcacagaaagcccacttatgaaagggatgttgatttgggggcgggtacaagacatgtagcagttgaaccagaagtagccaatttggatatcataggacaacgtattgaaaatatcaaaaatgaacacaaaagtacatggcattatgatgaggataacccatacaagacatgggcatatcatggatcatacgaagtaaaaccaagtggatctgcctcgagcatggtcaatggtgtggtaagattattgacaaaaccgtgggacgtgatacctatggttacacagattgcaatgacggatactactccttttggccaacaaagggtttttaaggaaaaagtggacacaagaactccccgcgcgaagcgaggaactactcaaataatggaagttaccgcaaaatggttgtggggattcttgtcacgtaacaaaaagccaaggatctgcaccagagaagagttcactagaaaagtacgtagtaacgcagcaattggcgcggtcttcgtagatgaaaatcaatggaactccgcaaaagaggctgtagaagacgagcgtttttgggacttggtccatcgtgagcgggagcttcataaacaaggaaaatgtgcaacctgtgtctataacatgatgggcaaaagagaaaagaaactaggcgaatttggaaaagcaaagggaagccgagctatttggtatatgtggctaggcgccaggtttttagaatttgaagcattgggcttcatgaatgaggatcactggttctcaagagaaaatagcctttcgggtgtggaaggggaaggactacataaattggggtacatcctcagagatatcagcaaaataccaggaggaaacatgtatgccgatgacacagctgggtgggacacgagaattaccgaggacgacttacaaaacgaagcaaagattacggaaattatggagccagagcatgcgctgttagcaacaagtatcttcaaactaacataccaaaataaggttgtcagagttcaacgccccgccaaaaatggtacagtaatggatgtaatatctagacgagaccagagaggttctggacaggtgggaacatatggtctaaatacatttacaaacatggaagtgcaacttataagacaaatggaaagcgaggaaatatttttgccaagtgaactggaaactccaaatctagctgaaagagtattagactggctggagaaacatggggcggaacgcttgaagagaatggcaataagtggtgatgactgtgtagtcaagcctatcgacgatcgcttcgcaacggccttaactgccctaaacgacatgggtaaagtgcgaaaagatatcccacaatgggaacccagcaaaggatggaatgattggcaacaagtacccttctgctctcatcatttccatcaactcatcatgaaagatggaagggaaattgtagtcccgtgtagaaatcaagatgagctagtagggagagcgagagtgagtcaaggagctgggtggtccctgcgggaaactgcatgtctaggaaaaagttacgcacaaatgtggcaattgatgtatttccacagacgagatctacgattggcagcaaatgccatatgttccgcagtaccagttgattgggtgcccacatcaagaacaacttggtcaatacatgcccaccatcaatggatgacaacggaagatatgttaagcgtgtggaatcgagtttggatcgaggaaaacccatggatggaagacaagacgcacgtctcgtcgtgggaagaagttccatatcttggaaaacgtgaagatcaatggtgcggatcacttattggtttaactgctcgggctacttgggcaacaaatatacaggttgctatcaatcaagttcgtcgattaataggaaacgaaaactatctagattacatgacttccatgaagagatttaagaacgaatccgatccagaaggagccctatggtaa

SEQ ID NO: 21276 - RNA, 9879 nt, synthetic construct
  misc_feature 1..9879: note = derived and/or modified CDS sequence (opt6) from DENV-1__KJ189325__SS-prME
  source 1..9879: mol_type = other RNA
tcggttaccatgttacttatgctattgcccactgctctcgcgttccatctgaccaccagagggggagaaccccatatgatcgtctccaaacaagaacgaggcaaatcacttttatttaaaacaagtgccggtgtaaacatgtgtacacttatagcaatggacctcggagaattatgcgaagacacaatgacctataaatgcccacaaatcacagaagcagaaccagatgatgttgactgttggtgcaacgcaaccgatacctgggtaacttatggcacatgttctcaaacaggtgaacaccgacgagataaaaggtccgtggcattagcacctcatgtgggtttgggactcgaaactcgcactgaaacttggatgagctcagaaggagcatggaaacaaatacaacgggtagaaacatgggcacttagacaccctggattcacagtaattgcactgttcttagcgcatgcaataggtacctcaatcactcaaaaaggaaccatttttatattgttaatgttagtcactccaagcatggccatgcgctgtgtcggtatcggaaaccgagattttgtcgaaggcttaagtggcgcaacctgggtagacgttgttttggaacacggttcttgcgttacaacgatggccaaaaataaaccaaccctagatatcgaactgctgaaaacagaagtaaccaacccagcaatattaagaaaattatgtatcgaagcaaaaatctcaaatacaaccactgattcgaggtgcccaacccaaggagaagcaacacttgtagaagaacaagatgcaaactttgtttgccgcagaacgttcgtagatcgtggttggggtaacggctgcggtctgtttggaaaaggaagcctcttaacatgtgcgaagtttaagtgcgtcacaaagttagaaggtaaaatagtacaatacgaaaatttaaaatactccgttattgtgaccgttcatacgggtgaccaacaccaagtgggtaatgaaactacagagcacggaaccatagctactatcacacctcaggcaccaacttcagaaatacaactgactgattatggcgcgttgacacttgattgtagccctcggacaggtctagactttaatgaaatggtattacttacaatgaaagaaaaatcttggctagtacataaacaatggtttttagatctccctttaccatggaccagcggcgcaagtacaagtcaagaaacttggaacagacaggatttattagtaacattcaaaactgcacatgccaagaaacaagaagtggttgtgcttggaagtcaagaaggtgcaatgcatactgcacttaccggtgcaacggaaatccaaacatcaggtacaaccacgattttcgccggacacctaaagtgtaggctgaaaatggataaactcacattaaagggtacttcgtacgtcatgtgtacagggagctttaaattagaaaaagaagtagcagaaacacaacacggaacagtactcgttcaagtcaaatatgagggaacggacgcaccctgtaaaattccttttagtactcaagatgagaaaggagttacccaaaatggaagacttataacagccaaccctatagtaaccgataaagaaaagccagtaaacatcgaaacagaaccaccgttcggcgaaagctacatcgttgttggggcaggagagaaggctttaaaactttcgtggtttaagaaaggttctagtatagggaaaatgtttgaagcaactgcccgtggcgctcgcaggatggccatattgggagatacggcgtgggattttgggtccatagggggtgtattcacatctgtcggcaaattagttcaccaagtattcgggacggcatacggtgtactgttttcaggagtgtcatggactatgaaaattggcataggaatattactaacttggctaggactcaactccagatcaacaagcctaagcatgacttgcattgctgtaggaatggtaacactgtacctaggagtaatggttcaggcagatagcgggtgcgtaataaactggaaaggcagagagctaaagtgcggctcaggaatatttgtaactaacgaagttcatacctggactgagcagtacaagtttcaagcggattcacccaaacggctatcggcagcgattgggaaagcctgggaagaaggtgtatgtggaattagaagcgccacaaggctagaaaatataatgtggaagcaaataagtaatgagttaaatcacatattactcgaaaacgatatgaagttcacagttgtagtcggggacgcgaacgggatattagcacaaggtaagaaaatgataaggcctcaacctatggaacataagtattcctggaagtcatgggggaaggcaaaaataattggagcagacattcaaaacactaccttcattatcgatggtcctgacacaccagaatgtcccgataatcaacgggcttggaacatttgggaagtagaagactatggatttggaattttcacgactaacatatggttgaaattgagggactcgtacactcaaatgtgtgaccatagactcatgagcgcagccattaaagattcaaaggctgttcatgcagatatgggctactggatcgaaagtgagaaaaatgaaacatggaaacttgcgagggcgagtttcattgaggttaagacctgtacctggcctaagtcccataccttatggtctaatggagtacttgaatcagaaatgatcataccgaaaatttatggaggaccaatatctcaacataactaccgacctggctactttactcaaacagcagggccttggcatcttggtaagctagaacttgattttgacttatgtgaaggcacaacagtagtcgtagacgaacattgtggcaatagaggtccatcactgcgtacgacaacagtaacaggcaaaattatccacgagtggtgttgtagatcatgcacactaccaccccttaggtttagaggggaggatggttgttggtatgggatggaaatacgtcctgttaaagaaaaggaagagaatctagtcagatcaatggtttccgccggttctggagaagttgactcgttctccctaggcattctctgcgcgtcaatcatgatagaagaagtaatgcgatcaagatggtcaaggaagatgcttatgactggaactcttgctgtatttttattattagtcatgggacaattaacttggaacgacttaatacgactctgtattatggttggtgccaatgcatctgaccggatgggtatgggcacaacctacttagcgttgatggcaaccttcaagatgcggccaatgtttgcagtaggtttactcttcagaagactaacatcgcgcgaagttttactattgaccatcggtttatccttagtggccagcgtggaacttcctaattcgttggaagaattaggtgatggtctagcaatgggaatcatgatgctaaagctacttactgagttccaaccacatcaactatggatcacgttgctcagcttaacatttataaaaactactttgtcattagactacgcttggaaaacaacggcgatggcattgtcgattgtttcactcttcccattatgtttatcaactaccagtcagaaaactacctggctaccagtgctcttaggaagttttggatgcaagccacttacaatgtttttgataacagagaacaaaatatggggacgaaagagctggcccctaaacgaaggtataatggcaatagggattgttagtattttactatcaagtctactaaagaatgacgtccctctagctggacccttaatagcagggggaatgttgatagcctgttacgtaatctcagggtcctcagccgacttgtcattggaaaaggctgcagaagtaagctgggaacaagaagcagaacactcagggacttcccataatattttagtcgaagtacaagatgatggtactatgaaaatcaaagatgaggaaagagatgatacacttacaatcctccttaaagctactctattagcagtgagcggcgtttatcccatgagtatacctgcaacgctattcgtctggtatttttggcaaaagaagaaacaaagatctggggtgttatgggatacacctagcccacccgaggtcgaacgcgcagtattggatgatggaatatacagaatcctacagcgaggcctccttggaaggagtcaagtaggcgttggagtattccaggacggtgtctttcacacaatgtggcatgtaacaagaggagcagttttgatgtaccagggcaaaagacttgaaccaagttgggctagtgtaaagaaagacttgatttcgtacggaggtggctggagatttcaaggctcttggaataccggagaagaagtccaagtaatagcagtagaaccaggtaaaaaccccaaaaacgtgcaaacgatgccaggaactttcaaaactccagaaggtgaagtaggggcaattgccctggattttaaaccaggcacctctggatctccgattgtcaatagagaaggaaaaatagtaggactttacggaaacggagtagtaaccacctctggtacttatgtaagtgcaatcgctcaggcgaaagcctcgcaagaaggtccgttacctgagatagaagacgaagtgtttaagaaacggaatttaacaataatggatttacatccaggatctggtaaaactcgtaggtacctaccggcgatggtccgggaagcaattaaaagaaaactaagaacactcatcttagctcctacacgagtagtggcttcagaaatggcagaggctttgaaaggcatgccaattagatatcagactacggctgtcaagtcagagcacaccggtagagaaatagtagacttaatgtgccacgcaacatttacaatgcgactcttatcacctgtacgtgttccgaattataacatgattataatggatgaagcacacttcaccgacccggcatccatcgcagcaagaggttatatttccaccagagttggcatgggggaagccgccgcaattttcatgaccgctacgcctcccggaagtgtagaagcctttccccaatctaacgctgtaatccaagatgaagagagggacattccagaacgaagctggaactccggatatgattggatcacggacttccccgggaagacagtatggtttgtgccatctattaaatcggggaatgatatagcaaactgcctaaggaaaaacgggaaaagagttatacagttaagcagaaagacttttgatacagagtatcagaaaactaaaaataatgattgggactatgtagtaacaaccgacattagtgaaatgggagctaattttcgagcagatagagttattgatcctcggaggtgtttaaaacctgtcatcttaaaagatggaccggaacgagtaatattggcaggccccatgccagtaactgtagcctcagctgcacaaagaagaggtaggattggtcgtaatcaaaataaagagggagatcaatacgtatacatgggtcaaccactaaataatgacgaggaccatgcacactggacagaggctaaaatgttactcgataacatcaatacaccagaaggtattattcctgccctgtttgagcctgaaagggagaagtcagcggccatagacggcgaatatcgtctcagaggggaagcaagaaagacttttgttgaactaatgcgcagaggagacttacctgtttggctatcatacaaagttgcttcagaaggcttccaatattctgataggagatggtgcttcgatggagaaaggaataatcaagtattggaggaaaatatggacgtcgaaatatggaccaaagagggagagcgaaagaaactcaggcccaggtggttagatgctaggacttattctgatccgttggcgttgcgcgaatttaaagagttcgcggcaggtaggagatctgttagcggagatctgattttagaaataggtaaactaccccagcatctcacgctaagggcacaaaacgcattagataatttggtgatgcttcataacagcgaacaaggaggaaaggcttacagacatgcaatggaagaacttccggatacaattgaaaccttaatgcttctagcactgatagccgttttgacaggaggggtcaccctattctttctttccggaaaaggtctaggtaaaacaagtatcggccttctatgcgtaactgcttcatcggcattgttgtggatggctagtgtcgaacctcattggatagccgcatccataattttagagttctttctaatggtgttactaattcctgaacctgaccgacaaagaactcctcaagataatcagcttgcatatgttgtaatcggtctgcttttcatgattttaacagttgcagcgaatgaaatgggtttgttagaaacgacaaagaaagatttaggaatagggcatgttgcggcagaaaaccaccaacatgctacgatgctagatgtagacctaagaccagcaagtgcgtggaccttgtacgcagtggctacaactgtaattacacccatgatgagacatacaatagaaaatacgacagctaacatcagtttaacagctatagcaaatcaagccgcaatacttatggggctggacaagggatggccaatttcgaaaatggacataggtgtacctctcctagcattgggttgctactcacaagttaatcccttaacgctcacggctgctgtgctaatgttagtcgcacattacgcaattatcggtccaggcttacaagcaaaagcgactcgggaggcccagaaaagaacagcggccggaataatgaaaaaccctactgttgatggtatagtagctattgacctagatcccgttgtatatgacgcgaaatttgaaaagcaactaggtcagataatgttactcatattatgtacaagtcaaatattgttaatgaggacaacttgggctttatgtgaaagtattacgctcgcaacaggaccgttaacaacactttgggaaggatcacccggtaagttttggaataccactattgctgtaagtatggcaaacatctttcgaggaagctatctggcaggagctggtttggcttttagtcttatgaaaagcctaggtggaggacgccgcgggactggagcgcagggagaaacactaggagaaaagtggaaacgtcaattaaaccaactaagtaaatcggaatttaatacgtataaaaggtctggaatcatggaagtagacagatctgaagcaaaggagggattaaaaagaggggaaactacaaagcacgctgtctctagaggcaccgctaagttaagatggttcgtagaaagaaacttagttaagcctgaagggaaggttatagacttgggatgtggacgaggagggtggagttattactgcgcggggctaaagaaagtcaccgaggttaaaggatacacaaagggaggcccgggacatgaggaacctatacctatggctacatatggttggaatttagtcaaactacattcaggtaaagatgttttcttcatgccgccagagaaatgtgatacgttactatgcgacatcggagagagtagcccaaatccaacaatagaagagggcagaaccctaagagtactaaaaatggtggaaccatggttaaggggaaatcaattctgcataaagatcctaaacccatacatgccatctgttgtagaaacgctcgaacaaatgcaaagaaaacacggaggtatgcttgtgagaaatccattaagccgaaattccacccacgaaatgtattgggtatcttgtggtaccgggaacattgttagtgcagtcaatatgacatcaagaatgctcctcaatcgttttacgatggcccatagaaaacctacctacgaacgagatgtcgatctaggtgcaggaacccgccatgtagcagttgaaccagaagtggcaaatcttgacattatcgggcaacggatagaaaacatcaagaacgaacacaaaagtacgtggcattatgatgaagataacccgtacaagacttgggcataccacggatcttatgaagtgaaaccgtcaggatccgcctcatccatggttaatggagtcgtcagattgctcacgaaaccgtgggacgtaatacctatggtcacgcaaatagcgatgaccgatactacaccatttggacagcaacgtgtattcaaagaaaaggtggacacccgtactcctcgtgcaaagcgaggaacgacgcaaatcatggaggtcaccgcaaaatggctatggggattcctctcacgtaacaagaaacctagaatttgtacgagagaggaatttacacgaaaagttagatctaacgccgcgataggcgctgtattcgtcgatgaaaatcaatggaatagtgcaaaggaagcagtggaagatgaaagattctgggatttggttcacagagaaagagaattgcataagcaagggaagtgcgcgacatgtgtgtacaatatgatgggaaaaagagaaaagaagttaggggagttcggtaaggcaaagggatccagggccatatggtacatgtggttaggtgcgagatttctggagttcgaggcgttaggctttatgaacgaagatcattggttctcaagggagaactccctttcaggtgtcgaaggagaggggttacacaagttaggttatatattgcgagacatatcaaaaatccctggaggtaatatgtacgcagacgatactgcaggttgggacactagaatcaccgaagatgacctgcagaacgaagccaaaataacggaaattatggagcctgaacacgctttgcttgcgacttccatttttaaattaacctatcagaataaagtggtgcgcgtacaaaggcccgccaaaaacgggacggtcatggatgttatcagtcgtagagaccaacgtgggtcaggacaagtagggacctatggattaaatacctttacaaacatggaagtacagttaatacgacaaatggaatcagaggggatatttttacctagcgaattagagacaccaaatcttgccgaacgagtactggattggctggaaaagcatggcgcagagagattaaaaagaatggctatcagcggcgatgattgtgtcgttaaacctatagacgatagatttgccacggcactaactgcgcttaatgatatggggaaagtaagaaaggatatacctcagtgggaaccttctaaaggttggaatgactggcaacaagtacctttctgttcccaccattttcatcaattaattatgaaggacggtagggagatagtcgttccatgccggaatcaagatgagttagtaggacgagcgcgagtttcccaaggagcaggatggtcattaagagagacagcgtgtttaggaaaatcctacgcacagatgtggcagcttatgtacttccatagacgtgacttaagacttgcggcaaacgccatttgtagtgcggtcccggttgactgggttcctacgagtagaactacatggtcaatccatgctcatcaccagtggatgaccacagaagatatgctttcggtatggaaccgagtgtggatcgaggagaatccttggatggaagacaagacccatgtctctagttgggaagaagtgccttatctagggaaaagagaagatcaatggtgcggatcattaatcggtctaacggcgagagcaacatgggcaaccaacatacaagtcgccatcaaccaagttcgcagactcattggtaacgaaaattatttagattacatgaccagcatgaaaagatttaagaacgaaagtgatccagagggcgctctatggtag

SEQ ID NO: 21277 - RNA, 9879 nt, synthetic construct
  misc_feature 1..9879: note = derived and/or modified CDS sequence (opt6) from DENV-1__KJ189326__SS-prME
  source 1..9879: mol_type = other RNA
tcagttaccatgcttttaatgctattaccaacagcattagcttttcatttaacaacgagaggcggagaaccgcacatgattgtttccaaacaagaaagaggaaagagcttattatttaaaacaagtgctggagtaaacatgtgtacattgatagcaatggacttaggagaattatgcgaagacaccatgacgtacaaatgtccgcaaataacagaagcggaaccggatgatgtagattgttggtgtaatgcaacagacacatgggttacctacgggacctgcagtcaaacaggtgaacataggagggataagcgaagtgtagcactagcgccgcatgttggtctaggactcgagacgcgaactgaaacctggatgtcatcggaaggagcgtggaaacagatacagcgtgtagaaacttgggcgctacgtcatcctggattcacagtaattgcgctatttctagcacatgcgatcggaacaagcataactcagaaagggaccattttcatcctgctaatgttagtcactccctccatggcaatgagatgtgtaggaataggaaacagagactttgtagaaggattatccggggcaacatgggttgatgtagtattggaacatgggtcgtgtgttactacgatggctaaaaataaaccaacattagatattgaactgttaaaaacagaagtaacaaaccctgcaatactaaggaaattgtgcatagaagccaaaataagcaataccacaactgactcaagatgcccaacacaaggagaagcaactttggtcgaagaacaagatgcaaactttgtgtgcagaagaacatttgtcgaccgcggctggggaaatggttgtggtttattcggtaaaggatcactcctgacttgtgccaaatttaaatgcgtgacaaaacttgaaggaaaaattgtccagtacgaaaaccttaaatactctgttatagttactgtccatactggcgatcaacatcaagtagggaatgaaactaccgaacatggaacaatagccactataacgccacaagcacctacatctgaaattcaattgaccgactatggagctctaaccttggactgtagtccaagaacgggattagatttcaatgaaatggtcctattgacaatgaaagaaaaatcttggctagtacataaacaatggtttcttgatctcccgttaccgtggacctcaggggcttcaacatcccaagaaacctggaatcgacaggacttattagttacattcaagacggcgcatgccaagaaacaggaagtagtagtcctgggatctcaagaaggagcgatgcataccgccttaactggagctactgaaattcaaacatcaggaacaacgacaatttttgccggacatcttaaatgtcgtctaaaaatggataaactcaccctcaaaggaacaagctatgtaatgtgcacgggatctttcaagttggaaaaggaggtcgcagaaactcaacatggcacggtgttagttcaagtgaagtacgagggtacggacgcaccatgtaagataccctttagtactcaagatgaaaaaggcgttacgcaaaatggtcgccttatcacagctaacccaatcgttactgacaaagaaaaacccgtgaacatagaaactgaaccccctttcggggagtcgtacatagtagtcggagcaggagaaaaagcactcaaacttagttggttcaagaaaggatcttcaataggaaagatgttcgaagctacagcacgaggagcgagacgaatggcaatattaggtgatactgcatgggatttcggaagtatcgggggagtttttacaagtgtaggaaagctagttcatcaagtgtttgggactgcatatggtgtactttttagcggggtaagctggacgatgaaaataggcattgggatcctactaacatggctagggcttaactccagaagcacatccttaagcatgacatgtatagcagtcggaatggtgactttgtacctcggcgtaatggtgcaagcagacagtggttgcgttataaactggaagggtcgagaactaaagtgcggtagtggcatatttgtaaccaatgaagttcatacatggacagaacaatacaaattccaagcagacagccctaagaggctcagcgcagcaattgggaaggcctgggaagaaggagtatgtggaataaggtcggcaacccgtttagaaaatattatgtggaaacaaatatctaatgaattaaatcatattcttttagaaaatgatatgaagtttaccgtagttgtaggggatgctaatggaatactcgctcagggcaagaaaatgattagaccccaacctatggaacataaatattcctggaaatcatggggtaaagcaaaaataattggcgcggatatacaaaataccacctttataatagatggcccagacaccccagaatgtccagataatcaacgtgcgtggaacatctgggaagtagaggattacggttttggtatattcactactaatatctggctaaaattacgtgactcttatacacaaatgtgtgatcaccgattaatgagcgcagctatcaaggattctaaagcagtacatgctgacatggggtattggatcgagtcagaaaagaatgagacttggaaacttgcgagggctagcttcattgaagtcaaaacatgcacctggccgaaatcacatactttatggtcaaacggagtcctagaatcagaaatgatcataccaaaaatatacggtggtccgataagtcagcacaattatagaccaggatattttactcaaacggctggaccttggcacttaggtaaattagagcttgattttgacctatgtgaagggactacagtggtagtagacgaacattgtggtaatagaggtccatcgttgagaacgacaacagttaccggcaaaattatacatgaatggtgctgtcgttcgtgtactctaccaccattgcgatttcggggagaagatggttgttggtacgggatggaaataagacccgtcaaagaaaaagaggaaaaccttgtacggtcaatggtgagcgcggggtccggcgaagttgactcgttcagtctagggatactgtgcgctagtatcatgattgaagaagtgatgagatcgagatggtcccgaaaaatgttaatgacaggaactttagccgtgtttctattgctggtaatgggacagctcacatggaacgaccttattagactttgtataatggttggtgcgaacgcatcggatcgaatgggaatgggaacgacttatttggcattaatggcaacattcaaaatgcgcccaatgttcgcggtaggtttattattcaggagacttacaagtagagaagtacttcttttaacaatcggtttaagccttgtcgcttcggttgaactacccaatagtttagaagaactgggtgatggattagcgatgggtattatgatgctcaaactactgacagagttccaaccgcaccaattgtggacaacactgttatctctaacctttataaaaactacgttgtctctagattacgcatggaaaacaaccgccatggccctcagcattgtatctctattcccgttatgcttatctacaacctcacagaaaactacatggttaccagtactactaggatcatttgggtgtaaaccattaactatgttcctaataaccgagaataaaatttgggggcggaaatcctggccgttaaatgaaggcataatggctatcggaatcgtaagtattttattgtcttccttgttgaaaaatgatgtacccctagctgggcccctaatagctgggggaatgctcatagcatgttatgttataagcggttcatcagctgacctaagtctcgagaaggcagctgaggtaagctgggagcaagaagccgagcacagtgggacgtcccacaatatcctagtagaagtacaagacgatggcaccatgaaaattaaagacgaagaaagagacgacaccctcacaatactattaaaagctacactactggcagtcagtggggtttatccaatgtcaatacctgctaccttattcgtctggtatttctggcagaagaagaaacaaaggagcggtgttttgtgggatactccctcaccccctgaggtagaacgtgcagtgttagacgatggtatctacagaatattgcaaaggggactattgggaagatcccaagttggcgtcggtgtgttccaagatggagtatttcatactatgtggcatgtcactagaggagcagtactaatgtatcaaggaaaacgcctcgaaccgtcttgggcctctgtgaagaaagatctaattagttatggaggtggttggagatttcaaggtctatggaatacaggagaagaagtccaagttatagcagtcgagccaggcaaaaatcccaaaaatgtacagacaaccccaggaacatttaagacaccagagggcgaagtgggagcgatcgctttagactttaaaccaggcaccagtggaagcccaattgtaaacagggaggggaaaatcgttggcctatatggaaacggagttgtcacgaccagtggtacatatgtttcagctatagcgcaggctaaagcgtcacaggaaggacccttaccagaaatagaagatgaagtattcaagaaaagaaatctaactatcatggaccttcatccgggctcaggcaagacgcggcgatatctacctgctatggtaagagaagcaattaagaggaaattacgaacgctaatcttagcacctactagagtagtagcctcagaaatggccgaggcactcaagggaatgcctatacgatatcaaacgacagctgtcaaatcggaacatacggggagggaaatcgttgatttaatgtgccatgcaactttcactatgagattgttgagtcctgtaagggttcctaattacaacatgataataatggatgaagcccattttacagatcctgcatcaatcgccgcaagaggttatatatctacgagggttggtatgggtgaagccgcagcaatctttatgacagcaacccctcctggaagtgtagaggcttttccacaatcaaacgcggtaatacaggatgaagaacgcgatatacccgaaagatcatggaatagcgggtatgattggataacagattttcccgggaaaacagtgtggttcgtgcctagcattaagtcgggaaacgatatagcgaattgtctgaggaaaaatgggaagagggtcatccaactatctaggaaaactttcgataccgaataccagaaaactaagaacaatgattgggactacgtagtaactacggatataagtgaaatgggagccaattttagagcggatagagttatcgaccctcggcgttgtttaaaaccagttattctaaaagatgggccagaacgagtcattttagccggaccgatgcccgttacagtcgcttctgcggcacaaaggcggggtagaataggcaggaatcaaaacaaagagggcgatcaatatgtctacatgggccaaccattaaacaacgatgaagatcacgctcactggacagaagcaaaaatgcttctagacaacataaacactccagaagggataataccagctcttttcgaacctgaacgtgaaaaatctgcagctatagacggcgaatacagacttaggggagaagcaagaaaaaccttcgtcgaattaatgagaagaggtgatctgcccgtttggctaagctacaaagtcgcctctgaagggttccaatatagcgacagaagatggtgtttcgatggtgagagaaacaatcaagtcctcgaagaaaacatggatgttgaaatttggactaaagaaggcgaacggaagaaattacgtccaagatggctagacgctcgaacatattcagacccgctcgcgttacgtgaatttaaagaatttgcagcaggtagaaggtcagtatcgggtgatttaattcttgagataggcaagctgccacaacatttgacattgagagcccagaacgcactggacaacttagtaatgttgcacaatagcgaacaaggcggtaaggcttacaggcatgcaatggaagaactaccagatacaattgaaaccctaatgctcctcgccttaattgcagtactaacaggtggcgttacgttattctttttgtcaggaaagggattaggtaagacatcaattggattattgtgcgttactgctagcagtgcgttattatggatggcgagcgtggagccccattggatagctgcaagcataatactagaatttttcttaatggtactcctaatacccgaaccagacagacagagaactccacaagataatcagctggcttacgtagttattggcctattatttatgatcctaacagtggcagccaatgaaatgggacttctcgaaacaactaagaaagacttgggaattggtcacgtggctgctgagaatcaccaacatgctacgatgctggacgtggatctgagacctgcatcggcatggacgttgtatgcagtagcaactacagtcataactccaatgatgcgtcacactatcgaaaatactacggctaacataagcctaacggcaattgcgaaccaggctgcaattctcatgggactcgacaaaggatggccaatctcgaaaatggacattggggttccactacttgcactgggttgttactcacaagtaaatccactgactttgacagctgcggttttgatgttggtagctcattacgcaataataggcccaggtttacaagcaaaagcaacacgagaagcacaaaaacgcacagcagctggtattatgaagaaccccactgtagacggtatagttgctatagatttagatcctgttgtgtacgatgcaaaattcgaaaaacaactgggacaaataatgttattaatactatgcacaagtcaaatattactaatgcgaactacgtgggctctgtgtgagagtattacgctggctacaggcccgcttacaaccttatgggaagggtccccgggaaaattctggaacacgacgatagccgtctctatggctaacatcttccgtggcagttatcttgcaggagcaggtttagcattttctctgatgaaatcgctcggagggggtcgccgaggaactggtgcgcagggtgagacactaggcgagaagtggaagaggcaactgaatcaactcagtaaatctgaatttaatacatacaagagaagtggaattatggaggtagatagatcagaagcaaaagaaggattgaagaggggagagactaccaaacatgcagtttcgcggggaacagccaaacttaggtggtttgttgagcgcaatcttgtaaaacctgaagggaaggtaatagatctcggctgtggcagaggtggttggagttactattgtgcgggtctcaagaaagttactgaggttaaagggtacaccaaaggcggaccaggacacgaagaacccataccaatggctacatatggttggaatctagtgaaactacattcgggaaaagatgtcttctttatgccccctgaaaaatgtgatacacttctttgcgatataggcgaatcaagtcctaatcctacaatagaagaaggacggactcttagggtactaaagatggtggaaccatggttacgaggaaatcaattttgtatcaaaatacttaatccatacatgccttcggttgttgagacgttagaacagatgcaaaggaagcacgggggcatgctagttaggaatccactaagcagaaatagtacacatgaaatgtactgggtaagctgtggtacgggtaatatcgtgagtgccgtcaacatgactagcagaatgctactaaatagatttactatggctcaccgcaagccaacttacgaacgagacgtagatttaggtgccggcactcgacatgtggctgtagaaccagaggttgcaaacctagatatcataggccaacgcatcgaaaatatcaaaaatgagcacaaaagcacttggcattacgacgaggataacccttacaagacgtgggcatatcacggctcgtatgaagtaaaaccatccgggtcagctagtagtatggttaacggggtcgtgagattgttgactaagccatgggacgtcataccaatggtaactcaaattgctatgacagatactacaccttttggtcaacagagggtattcaaagaaaaggtggatacacgcactcctcgggcaaaaagaggaacaacgcaaataatggaagtaacagcgaaatggttatggggtttcttatctagaaacaagaaacctaggatctgcacaagggaagagtttactcgaaaagtgcgctcaaacgctgccataggagcagtatttgttgacgaaaaccaatggaatagcgcgaaagaagcagttgaagacgagagattttgggatctagtacatagggaacgggagcttcacaaacaaggaaaatgcgcaacttgcgtgtataatatgatggggaaaagagagaagaaattaggtgagttcgggaaagcaaaaggcagtagagctatatggtacatgtggctcggagcaagatttctagagttcgaggctttaggcttcatgaacgaagatcattggttttctagagagaatagcttatcgggcgtcgaaggtgagggactccacaaattaggatacatactccgtgacatctcaaaaatccctgggggcaatatgtatgccgacgacacagcaggttgggatacacgcataacagaagacgacttacaaaacgaagcaaaaattactgaaataatggaacctgaacatgcattactagccacttcaattttcaaattaacatatcaaaataaagtagttagggtacaacgacctgccaaaaatggtaccgtgatggacgtaatttctagaagggatcaaagaggaagtggacaagtaggcacgtatggcctgaacaccttcacaaatatggaagtacaattaatacgacaaatggaatcagaagggatctttttaccaagcgagttggaaactccgaatttagctgaaagagtattggattggttagagaaacatggtgccgaaagattaaagaggatggcaatttcaggtgatgactgtgtcgtaaaaccaatcgatgatcgtttcgccactgcattgactgctctaaacgacatgggaaaggttcgaaaggacattccgcaatgggaaccatcaaagggatggaacgactggcaacaagtaccgttttgctcacatcatttccaccaacttatcatgaaagatgggcgcgagattgtagttccttgtcgaaatcaggacgaactcgttggtcgagcaagagtatcacaaggagctggctggagccttcgtgaaactgcttgccttggaaaaagttacgctcagatgtggcagttaatgtattttcatagacgcgatcttcgactcgcggctaatgccatctgctctgcggtacccgtggattgggtaccaacaagtcgtaccacttggagcattcatgcccaccatcaatggatgactactgaggacatgctgagcgtatggaacagagtttggatcgaagaaaacccatggatggaagataaaactcatgtttcatcgtgggaagaagtaccatatctggggaaacgtgaagaccaatggtgcgggagtctaattggactaacagcacgggcgacctgggcgactaatattcaagttgcaatcaatcaagttcggcgactaataggcaatgaaaactacctagattatatgacatccatgaaaagattcaaaaatgagtctgaccccgagggagcattgtggtaa

SEQ ID NO: 21278 - RNA, 9879 nt, synthetic construct
  misc_feature 1..9879: note = derived and/or modified CDS sequence (opt6) from DENV-1__KJ189327__SS-prME
  source 1..9879: mol_type = other RNA
tctgttactatgcttcttatgttattgcctactgctcttgcgtttcatcttacaacgcgtggaggtgaaccccatatgattgtctctaaacaggaacgtggtaaaagtttactctttaaaacgtcagccggagtgaacatgtgcacattgatagcaatggatttaggagaactctgcgaagacacaatgacatacaaatgtccccaaataacagaagccgaacctgatgacgtcgattgctggtgcaatgctacagatacatgggtgacgtatgggacatgcagccaaactggggaacatcggcgtgaaaaacgttctgtagcgttagctcctcatgttggtttaggtcttgaaacgagaacagaaacgtggatgtcctcagaaggagcgtggaaacaaatacaaagagtcgaaacttgggcattacgacaccctggattcactgtcatagccctgttcctagcgcacgccataggaacatccattacacaaaaaggaattattttcatactacttatgctcgtaactccaagcatggcgatgagatgcgtagggataggcaaccgagattttgtggaaggtctttcaggcgcaacctgggtagatgtagtgctagagcatgggagctgcgtcacaactatggcgaaaaacaaaccgacacttgacatagaactactcaaaactgaggtgaccaatccagcaatactacgaaaattgtgcatagaagctaaaatatcgaataccacaactgactccaggtgtccgacgcaaggggaagctacattagtagaagaacaagacgcgaatttcgtatgtagacgaacgttcgtggacagagggtggggcaatgggtgtggactattcggaaagggcagcttattaacatgcgcgaaatttaaatgcgtaactaaacttgaagggaaaatcgtacaatatgagaatttaaaatatagtgttatagtaacagtgcatactggagatcagcatcaagtcggaaacgaaactaccgaacatggcaccattgcaaccataacaccacaagcaccaacttcagaaatacagctaactgattacggggctctaacccttgactgctcaccacgaacaggacttgattttaacgagatggtactcttgacaatgaaggaaaaatcttggttagtccacaagcaatggttcctggacttacccttaccttggacaagtggcgcttcgacatcacaagaaacatggaacagacaagatttactcgtaacttttaaaacggcacacgccaagaaacaagaagtagttgtgctggggtcccaggagggtgcgatgcatactgctctaactggggcaacggaaatccagacgagtgggacaactacgatcttcgctggacacctgaagtgtcgtttaaaaatggataaacttacactcaaagggacatcctatgtaatgtgtactggttcattcaaattagaaaaagaagttgcagaaacgcaacacggcacagtgcttgtacaggtcaaatatgaaggcacagatgcgccttgtaaaattccattcagcacacaagatgaaaagggagtcacccaaaacggacgtcttatcactgctaaccccattgtaacggataaggaaaaaccagtgaacatagagaccgaacctccgtttggagagagttacatagttgtaggagctggcgaaaaggcgttaaaacttagttggtttaaaaagggcagttctatagggaaaatgtttgaagccacagccaggggcgcccgaaggatggctattttaggtgacacagcttgggattttgggagcataggaggtgtctttacaagcgtcggcaaacttgttcaccaagtctttggtacggcatacggggtgctatttagtggtgttagctggacaatgaaaattggtatagggatcctcttaacatggttgggattaaactcaagatcaacatcgctatcaatgacatgcattgcggtcgggatggtaacactatacttaggtgtcatggttcaagcagattcaggctgcgtaataaattggaagggcagagagttaaagtgtggaagtggaatatttgttacaaatgaagtacatacatggacagaacaatataaatttcaagctgattcgcccaagagattatccgccgctattggtaaagcgtgggaagaaggtgtgtgcggtatacgaagtgcaacacgtctcgaaaatatcatgtggaaacaaatatctaatgaactaaatcacatattgctagaaaatgacatgaaatttaccgttgtagtaggagatgccaatggcattctcgcacaaggaaagaaaatgatcagaccccaacctatggaacataagtacagctggaaaagttggggtaaagcaaaaataattggcgcggacacccaaaacacaacttttataatagatggaccagataccccagaatgtcctgataaccaacgggcatggaatatttgggaagtggaagactacggttttggaattttcaccacgaatatatggttgaaattaagagacagctacacacagatgtgtgatcatagattaatgagcgcggcaataaaagactcaaaagctgtacatgcagatatgggatattggattgaaagcgagaaaaatgaaacatggaaactagctagggcatcatttatagaagttaaaacttgcacttggccaaagagtcacacactctggagtaacggtgtcttagagtcggaaatgatcattccaaagatttatggtggaccaatatcacaacataactataggcctggttattttacacaaaccgcaggaccatggcatctgggcaaactggaattagattttgacctatgtgaaggaacaacggtcgttgttgatgagcattgcggaaacagaggcccgagcttaagaactactactgtaacagggaagataattcatgaatggtgttgtagatcttgcacattaccaccactacgatttcgaggggaagatggttgctggtatgggatggaaatccgcccggttaaagaaaaagaagagaacttagtacgatcaatggtgagcgcagggtcaggagaggtagactcgttctcacttggcattctgtgtgcatccattatgattgaggaagtaatgaggtcacggtggtcacgaaagatgttaatgactggtacattagccgtgtttcttttgttaatcatgggccaactaacgtggaatgatctaattagattatgcattatggttggtgctaatgcatcagatagaatgggtatgggtacgacatatctcgcgctcatggccacattcaaaatgcgccccatgttcgcggtaggcctattgttccgtcggttaacttcgagagaagtattactcctaacaataggactatccttggttgcttcagtcgaactgcccaattccttagaggaacttggagatggtttagcaatgggtattatgatgctaaaactattaaccgaatttcagcctcatcaactatggacgacgctgctaagcctaactttcataaaaacaacgctttcgttggattacgcttggaagactacggcaatggccttaagtatcgtgtctttattccccctatgtctctctacaacgtctcaaaagacaacatggcttccagttttgttgggatcctttggctgtaagccgttaacaatgttcctaataacggaaaataagatttggggaaggaaaagttggccgctaaatgagggaataatggctataggtatagtttcaatactactgtcatccttattgaaaaatgacgtcccgctagctggacccttaatagccggtggtatgctaatagcgtgttacgtaatttcaggtagttctgcagacttatcactcgaaaaggcagcagaagtttcttgggaacaagaagcagaacacagtggtacttcacacaacatacttgtagaagtccaagatgacggtacaatgaaaatcaaggacgaagaacgagacgatacattaaccatcctgctcaaggcgactctattggctgtatcaggtgtatatcctatgtccatcccggcgaccctatttgtatggtacttttggcagaagaagaaacagcgcagtggggtgctgtgggatacaccatctccaccggaagtcgagagagcggttcttgatgacggtatttatagaatcctccagagaggattattaggtagatctcaagttggagtaggggtatttcaagatggagtgtttcatacaatgtggcacgtaaccagaggtgcagtattaatgtatcagggaaaaaggttggaaccttcatgggctagtgtcaagaaagacctcatttcctatggagggggctggagattccaggggtcgtggaatactggggaagaagttcaggttatagcagttgaacctggtaaaaatccaaagaacgtacaaacaactccaggaactttcaaaacacccgagggagaagtcggagccatagcattagacttcaaaccaggaacgtctggatctcctattgtaaacagagagggaaaaatagtcgggttatatggtaacggagttgttactacctctggtacctatgtatccgccatagcacaagcaaaggcaagccaagagggtccactaccagagattgaggatgaagtcttcaagaaaagaaacttaacaataatggacctacatccaggcagcggtaaaacacggcgttacttgccagcaattgtacgcgaagccataaaacgaaaattgcgcacactaatactcgcaccgaccagagttgtagcaagtgaaatggctgaggcgctcaaaggtatgcccatacggtatcagaccacggcggtgaaatctgaacacactggaagagaaattgtagatctaatgtgccatgctacgttcactatgagactgttgagtcccgttagagtacctaactataacatgatcataatggacgaagctcattttaccgatccagctagtatagcagccagaggatacatttccacccgagttggcatgggggaagctgctgctatttttatgacggcaacgccacccggctcagtggaggcctttccgcaatcaaacgcagtaatacaagatgaagaacgagacatcccagaaagaagttggaactcggggtatgactggataactgatttcccgggaaaaacggtttggtttgttccgagtattaaaagcggcaatgatatagcaaactgcttaaggaaaaacggtaaaagagtcatacaactctctagaaaaacttttgatacagagtatcagaaaactaaaaataatgactgggattatgttgtaactactgacatttcagagatgggagcaaatttccgagccgatagagttatcgacccgagacgatgtctaaaacccgtgatactcaaggatggaccagaaagagtaatcctcgccgggcctatgccagtcacagtagcctctgcggcacaaagaagaggcagaatcgggagaaaccaaaataaagaaggggatcaatatgtttacatgggacaacctcttaataacgatgaagatcatgcgcattggacagaagcaaaaatgttgctcgataacataaatactccagaaggtatcataccggctctatttgaaccagaacgggagaagtccgcagccatcgatggagaatatcgccttcgtggggaggcacgcaagacatttgtagaactaatgagaagaggtgatcttcccgtctggctgagctacaaagtggcgtctgaaggatttcaatactctgacagaagatggtgcttcgacggggaacgcaataatcaagtgcttgaagaaaatatggacgttgaaatatggacaaaagagggcgagaggaagaaacttcgaccgcgttggttagatgcacgaacatattcagatcctttggcattacgtgaatttaaagaatttgccgcaggccgaagatctgtttcaggggacttaattcttgaaataggcaagctgccccagcacttaacattgcgtgcgcaaaacgctctagacaatttagtcatgctccataatagtgaacagggtgggaaggcgtatagacatgccatggaagaactaccggatacaatagaaactctcatgttattagccttaattgccgtattaacaggtggtgtgacactattctttttatcaggtaaaggactcggaaagacatctattggactcctgtgcgtaacagcaagctccgctctcctttggatggcaagcgtagaaccacactggatagcagcctcaataatactagagttctttttaatggtacttttgataccggaaccagatagacaacgcacgccacaagacaaccaactcgcatacgtagtcataggtttgctattcatgatcttaaccgtagcggcaaatgaaatgggattgttagaaacgactaaaaaggatttggggataggtcatgtagcggcggaaaatcatcagcacgccaccatgctggacgtagacttgaggcctgcaagtgcctggaccctgtatgcagtggccacaacagtcatcacaccaatgatgaggcatacaatcgaaaatacaacagcgaatataagcctaactgctattgctaaccaggcagccatattaatgggactagacaaaggatggccgatatctaaaatggatataggagtcccattactagctttaggatgttacagtcaagtaaacccattgacccttacagcagctgtgttaatgctggtcgcccattatgctataattgggcccggactgcaagcaaaagcgacaagagaagctcaaaaacgcaccgctgcaggtattatgaaaaatcctacagtagatggtatcgtggccattgatttagacccagtcgtatatgacgctaagtttgagaaacagttaggacaaatcatgctcttaatactatgtacctcacagatcctactaatgcgtacaacatgggcattatgcgagtctataacactagccacaggtccattaaccacattgtgggaaggatctcccggcaaattttggaacacgacaatcgcagtttcaatggcaaatatcttcagagggtcgtacttagcaggagctggcctcgctttttcactaatgaaatccttaggaggtggaaggcgtggaacaggcgcacagggtgaaacgttaggtgaaaaatggaaaagacagcttaaccaattgtcaaaatcggaatttaatacatataaaagaagcggaataatggaggttgacaggagcgaagccaaagaaggattaaagcgtggagaaacgactaaacatgccgtatcacgcggaactgcaaagctcagatggtttgtagagagaaatcttgtcaaaccggagggaaaagttatagacctaggctgtggtcgaggaggttggtcatattactgcgctggactgaaaaaggtcacagaggttaaaggatatactaaaggaggtccaggtcatgaagaacctattcccatggcaacgtatggatggaacttagtaaaacttcattcaggaaaagatgtattctttatgccgcctgagaaatgcgacacactgttatgtgatattggtgaaagttcgccaaatccgacaatcgaagaaggaaggacactcagagtactgaagatggtagaaccatggctaagagggaaccaattctgcatcaaaatccttaatccatatatgccgtcagttgtcgaaaccttagaacaaatgcaacgaaaacacggcggaatgttagttcgaaatccgttatcaagaaattccacacatgagatgtattgggtatcttgtgggacaggcaatattgtatcagcggtaaatatgacatctcgaatgcttttaaaccggtttactatggctcacagaaaaccgacattcgaacgggatgttgacctaggagcaggaacacggcacgtagctgtggaaccagaagttgcaaacttagatataattggacaacgaatcgaaaacatcaaaaacgagcataagtcaacatggcattatgatgaggacaatccgtataaaacttgggcctaccatgggagctacgaggtgaaaccttctggctccgcttcatccatggttaatggagtggtacgtctattaacaaagccatgggacgtgattcctatggtcacacagatagcgatgacagatacaacaccctttgggcaacaacgggtgttcaaagaaaaggtcgatacacgtacgcctcgcgcgaagcgagggacaacacagataatggaagtaacagcgaaatggctttggggctttttaagtagaaacaagaaaccacgcatttgtacgagagaagaatttacaagaaaagttaggtcaaatgccgctatcggcgcagtgttcgttgacgaaaatcagtggaactccgctaaagaggcggtagaagacgagcggttttgggaccttgtacacagagagcgcgaattacacaagcaagggaaatgcgccacctgtgtgtataatatgatgggtaagcgcgagaagaaattaggtgagtttgggaaagctaaaggtagtagagcaatatggtatatgtggttaggcgcacgtttcctagaatttgaagcactcggatttatgaacgaagatcactggttctcaagggagaactcattatccggagtagaaggtgaaggtcttcacaaattgggatacatactaagagacatcagcaagatacctggaggaaacatgtacgctgacgacacggctggatgggatacaaggataacagaggacgatctccaaaacgaagcaaaaataacagacatcatggagcccgaacatgcattacttgcaacaagtattttcaagctaacctaccaaaacaaggtcgtgcgcgtgcaaagacctgccaaaaatggaacagttatggatgttatttcaaggagagatcaaagggggagtggacaggtcggtacatatggtctgaatacctttactaatatggaggtacaacttatcagacagatggagagtgaaggaatatttctaccctcagaacttgagactcccaatttagcagagcgagttctagattggttagaaaagcacggcgctgaaagattgaaaagaatggctatctctggtgacgactgtgttgtgaaacctattgatgatagattcgccacggcgctaacggcattaaacgacatgggaaaagttagaaaagatattccgcaatgggaaccatcgaaaggttggaacgattggcaacaagtgccattttgcagccatcattttcatcagctaataatgaaagatgggcgagaaatcgtagtaccgtgtaggaaccaagacgagctagtagggcgagccagagtatcacaaggagctggatggtctctaagggaaacagcatgcttaggaaaatcatacgcgcagatgtggcaacttatgtattttcatcgaagagacttacgacttgcggcgaacgcaatttgcagcgcagtgccagtagattgggtacctacttcccgcacaacatggtccatacacgctcatcatcaatggatgacaacagaggatatgttgagtgtctggaatcgtgtgtggatcgaagagaacccttggatggaagataaaacacatgtatctagctgggaagaagtaccatacctaggaaaaagagaagaccaatggtgtggcagtttaatcggactaaccgcacgtgcaacctgggcaactaacatacaagttgcaatcaaccaagtaagacgactgatagggaatgaaaactacctggattacatgacgtctatgaagagatttaagaacgaaagcgatccagaaggtgcgctatggtaa

SEQ ID NO: 21279 - RNA, 9879 nt, synthetic construct
  misc_feature 1..9879: note = derived and/or modified CDS sequence (opt6) from DENV-1__KJ189328__SS-prME
  source 1..9879: mol_type = other RNA
agcgtgaccatgttattaatgctattaccaactgccctggcatttcatttaacgacaagaggcggtgaaccccatatgattgtgtcaaaacaagaaagagggaaatcattattgtttaagacaagtgccggggtaaatatgtgtacgctgatagccatggatcttggcgaactatgtgaagacactatgacctacaaatgtcctcaaataacggaagcagaacctgatgatgtcgattgttggtgtaatgcgaccgatacttgggttacatacggaacttgctcacaaacgggcgaacatcggcgcgagaaaagatctgtggccctagcaccccacgtcggtttaggactggaaacacgtacagaaacttggatgagcagtgaaggcgcgtggaagcaaattcaacgagtcgaaacatgggcattgcgacatccagggtttacagtaattgcgctatttttagcacatgcaataggaacttcgataacacagaaaggtataatatttatattactcatgctagtgacgccgtcaatggcgatgcgttgcgtcggtataggtaacagagattttgtcgaaggactaagtggggccacgtgggtggacgtagtcttagaacatggatcctgcgttaccactatggctaaaaataaaccgacactagacatagaactattgaaaacagaagtaacaaaccccgcgattcttcgtaaactttgtatcgaagctaaaataagtaatacaaccaccgacagtagatgtccaacccagggagaagcaacacttgtagaagaacaggatgcgaactttgtttgtcgcaggacatttgtagatagaggatggggcaacgggtgtggacttttcggaaagggcagtttgttgacgtgtgcaaagttcaaatgtgttactaaactcgaagggaaaatagtacaatacgaaaatcttaagtactcagttatagttacagtccatacgggagaccaacaccaggttgggaatgaaacgacagaacacggaactatagcaacgataacaccacaagcgccgaccagcgaaatacagttaacagactatggtgctctaacactcgattgctcgccgcgaactggacttgatttcaacgaaatggtgctcttaaccatgaaggagaaatcctggcttgtacataaacaatggtttctagacttacctcttccgtggacgagcggtgcatcgacaagtcaggaaacttggaatagacaagatttattagttacatttaagacagctcacgcaaagaaacaagaggtagtagtgcttggctcacaagaaggtgctatgcatacagcactaaccggagccactgaaatacaaacatctggcactacaacaatctttgcgggccacctaaaatgccgcctcaagatggacaagctcacattgaaaggaacctcgtatgttatgtgtacaggctccttcaaactagaaaaagaggtcgcggagactcaacatggaacggtcctcgttcaagtaaaatatgagggtacagatgcaccatgtaaaatcccgtttagcacccaagacgagaaaggggtaacccaaaatggacgactaattacagctaaccctattgttactgataaagagaaaccggtaaacatagaaacggagccaccattcggagaatcatacattgttgtaggggcaggagagaaagctctgaaacttagctggtttaagaaaggatcgagtattggaaaaatgttcgaagctacagctagaggagctcgtagaatggcaattcttggtgacacagcatgggacttcgggtcaataggtggagttttcactagcgtaggaaaacttgtccatcaagttttcgggacagcgtacggagttctcttttccggggtctcttggacgatgaaaattggaattggtatcttactaacatggttgggtttaaattcacggtcaactagcctatcaatgacgtgcattgccgtgggaatggtgactctatacctaggagttatggtgcaggcagactcgggctgcgtgattaattggaaaggtcgtgaattaaaatgcggttcgggcatattcgtcaccaatgaagtacatacatggacagaacagtataaattccaagccgactctccaaagaggttaagcgcggctataggcaaagcgtgggaggaaggggtctgtggtattagatccgcgacgagactggaaaatataatgtggaaacaaatatcaaacgaattaaatcatattctactagaaaacgatatgaaattcactgtagtggtaggcgacgcgaatgggattctggctcaaggtaaaaagatgataaggccccaaccaatggaacacaaatactcatggaaaagctgggggaaagcgaaaatcataggggcagacatacaaaataccacttttatcatagacggcccagatacacccgaatgtccagacaaccagagagcatggaacatatgggaggtagaagactatgggtttggaatttttaccactaatatttggctgaaattgagagattcctatacacagatgtgcgatcataggcttatgtctgcggcaatcaaggatagcaaagcggttcatgcagatatggggtattggattgaatcggaaaagaatgaaacatggaagttggctcgcgctagttttatcgaagtaaaaacttgtacatggccgaaatcgcacactttatggtcgaacggtgtacttgaaagtgaaatgataatacccaaaatttatggtggtcccatatcacaacacaattaccgacccggttatttcacacaaactgccggaccatggcatttaggaaaactagaactagatttcgacttatgtgaaggaacgacggttgtggtagacgaacactgtggcaatcggggaccctccttaaggaccacaacagttacgggtaaaattatacatgaatggtgttgtagatcgtgtactttaccacccctacgtttcagaggagaggatggatgctggtacggcatggaaataaggcctgtaaaagaaaaagaagaaaatcttgtaagatcaatggtaagtgcaggctcaggtgaagttgatagtttttcactcggtatattatgcgtgtctataatgatagaagaagtcatgcgatcaagatggtcacggaaaatgttaatgactggaactctagcagtgtttctcctactaataatgggtcaattgacctggaaggacctaatccgcctatgtataatggtaggcgctaatgccagcgatagaatgggcatgggcacaacatatctggccttgatggcaacattcaagatgagaccgatgtttgctgttgggttactattccggagactaacgtccagagaagtactattattaactattggtctgtcgctcgtagcgtcagtagagctccctaatagtctagaagaattgggtgatggattagccatgggaataatgatgttgaaacttttaaccgaatttcaccctcaccaactctggactacactattaagtcttactttcatcaaaacgactttatcattagattatgcgtggaaaacaacggcaatggcgttgtctatagttagtcttttcccattgtgtctttctacaacatcccagaaaacaacatggttaccagtcttgctcggttccttcggttgcaaaccattaacaatgtttttgataaccgaaaacaaaatctggggccgaaagagttggccattgaacgagggaattatggcaatcggcattgtaagtattttattgagttctttgctcaaaaatgacgtaccgctagctggacctttaattgctggtggtatgctaattgcttgttacgtaataagcggatcttcagccgatttatcgctagaaaaagcagcggaggttagttgggaacaagaggcagagcattcaggtacatcacacaacatcctagtagaagtacaagacgatggtacaatgaagatcaaagacgaagaaagagatgataccttaactatactcctcaaagctacactattagctgtttcaggagtctacccaatgagcataccggcaactttgtttgtctggtatttttggcagaagaagaaacaacgttcaggagtgctttgggacacacctagtccacctgaagtggaaagggcagtgttagacgatggtatttacaggatcttgcaaaggggactattaggcaggagtcaggtaggtgtaggcgtttttcaagacggagtctttcataccatgtggcatgttacaaggggagcggtcctaatgtatcagggtaaaaggttagaaccgtcgtgggcgagtgttaaaaaggacttgatctcatacggagggggttggaggtttcagggaagctggaacacaggagaagaggtccaggtgatagctgttgaacctggcaaaaatccgaaaaatgtacaaacaacaccaggaacttttaaaacgcctgaaggagaagtaggtgcgattgcattggactttaaacccggtacctcggggagtcccatcgttaacagagaaggaaaaatcgtaggtttatacggcaacggtgtggtaactacaagcggcacttatgtttccgcaatcgcacaagccaaggcatcacaggaaggtccccttccagaaatcgaggatgaagtgtttaagaaaagaaatttgacaataatggacttacaccctggatctggaaaaacaaggaggtacttaccggcaattgttagagaagcgattaagcgcaagttacgaacactaatattagctcctactcgtgtcgtagcttcagaaatggcggaagcactaaagggaatgccaatccgctaccaaacgacagccgttaaatccgagcataccggaagagaaatagtagacttaatgtgccacgctacatttacaatgagattacttagcccagttcgagttccgaactacaatatgattattatggatgaagcccactttaccgatccagcttccatagctgcacgaggctatatcagtacccgcgtaggaatgggagaagcggccgcaattttcatgacggcaacgccaccaggatcagtagaagccttcccccaatcaaacgcggtaatccaagatgaggaacgagatataccggaacgttcgtggaacagcggttacgattggataacggatttcccaggcaaaacggtgtggtttgtaccaagcattaaatctgggaacgatatagctaactgtttaaggaaaaatggcaaaagggttattcaactatcccgaaaaacattcgacacagaatatcagaaaaccaaaaataatgattgggactacgtagtaacaacagatatatcggaaatgggtgccaactttagagcagatagggtgattgatccaagaagatgcttaaaacccgttattctaaaagatggcccagaaagagtcatattagcagggcccatgccagttacagtagcttccgctgcacaaaggcgaggtcgtatcggtagaaatcaaaacaaagaaggtgatcagtacgtatacatgggccagccccttaataatgatgaagaccatgcccattggacagaagccaaaatgctactagacaacataaatacaccagaaggaattattccagcactgtttgaaccagaaagagagaaatcagctgcgatagacggagaatataggctacggggagaagctcgaaagacattcgtagaactgatgcggcgaggagacctgccagtatggctaagttacaaggtcgcgtctgaaggattccagtattcagaccgtagatggtgcttcgacggagagaggaacaatcaagtattggaggaaaacatggatgttgaaatatggaccaaagagggtgagcgtaaaaagttaagaccaagatggttggacgcccggacatacagtgacccgctcgcattaagagagttcaaagaatttgcggccggccgacgctcagtttcaggcgacttgattttagaaataggaaaattaccacaacatcttacactaagagcacagaatgctcttgacaacttggtcatgctccataatagtgaacaaggaggaaaggcgtatcgacacgcaattgaagaattgcccgacactattgaaaccttaatgcttttagcacttatagccgttttaacaggaggcgtaacattgttcttcttaagcggcaaaggattagggaagacgtctatcgggttactatgtgtaactgcctcatccgccttattatggatggctagcgtggagcctcactggattgcagcatcaattatacttgagttctttttaatggtcctactaattcccgaacctgatcgacaacgaaccccacaggataatcaactagcttacgtggtcatcggcctcttgtttatgatcttaaccgttgccgccaacgaaatgggattacttgaaacgacaaagaaagatcttggtataggacatgtagccgcagaaaatcatcaacacgcaacgatgctagacgtagacttgaggcctgcctctgcatggacgttatacgcagtagcaactactgttatcactcccatgatgcgacatacgatagagaatacaactgcaaatatctctctaacagcaatcgctaatcaggctgcaatactaatgggtttagacaagggctggccaatttcaaaaatggatattggagttccgttactagcactcggttgttattcacaagtaaatccacttacactcacagccgcagttctaatgttagttgctcattatgcaataataggtccaggattacaagcaaaagcgacccgtgaagcccagaagcggacagctgctggaatcatgaaaaatcctactgttgacggaatagtagcaattgacctggatccggtagtatatgatgcaaaatttgagaaacaactaggacaaattatgcttcttatattgtgtaccagtcaaatactcctaatgagaacaacctgggcactttgtgaaagcataactttagcaactgggccattaactacattgtgggaagggtcacccggaaaattctggaatactacaatagccgtcagcatggcgaacatatttaggggtagttacctagctggagctggactagcttttagtcttatgaagagtcttggtggagggcgaagaggtacgggtgcgcaaggggaaaccctaggagaaaaatggaaacgtcaattaaatcaactatctaaaagcgaatttaatacatacaaaagaagtggtatcatggaggtagacagatctgaggcaaaagaaggtctaaagagaggagaaactacgaagcatgcagtgagtaggggaaccgcgaaattgagatggtttgtagaacgaaatctagtaaaaccagaaggtaaggtgatagatttaggatgtggaagaggtggttggagctattactgcgccggcctaaagaaagtaacagaagttaaaggatatacgaaaggaggtcccggccatgaggaacctataccaatggctacttacggttggaatttggtaaaattgcattcaggcaaagacgtgttctttatgccgcccgaaaaatgcgacaccctactgtgtgatatcggcgaaagtagcccaaatccgactatagaagaaggacgaaccctcagggtattgaaaatggtggagccgtggctaagaggaaatcaattttgcataaaaatcctcaatccttacatgccatcggtagttgaaacattagagcaaatgcagagaaaacatggtggaatgttagtaaggaatcctttgtcaagaaatagtacacacgagatgtactgggtatcatgtggtactggtaacatagtgtcagccgtgaatatgacctcacggatgttgttgaatagattcactatggcgcatcgtaaaccgacctatgaacgcgatgtagatttaggcgcaggaacacggcatgttgccgtagagcctgaggtcgcaaatttagatataattggccagcgaatagagaacatcaaaaacgaacataaaagtacttggcattatgacgaagacaacccatacaaaacttgggcatatcacggatcatatgaggtcaagccaagtggcagcgcttcgtccatggttaatggcgttgttagattattgacaaaaccatgggatgtaataccaatggtaactcaaatagcaatgactgacactacaccctttggacagcaacgagtattcaaagaaaaagtcgacacccgaacccctagggccaaaaggggtacaacgcaaatcatggaggtaacagcaaaatggttatggggatttttaagtagaaataaaaagccaagaatctgtactcgggaagaatttactagaaaagtaaggtcgaatgcagcaataggagccgtcttcgttgatgaaaaccaatggaactccgcaaaagaagcagtagaagatgagaggttctgggatttagtgcatagggaaagggaactacataaacaaggtaagtgtgcaacttgtgtatataatatgatgggaaagcgagaaaagaaattaggagaatttggtaaagctaaagggagcagagcgatttggtacatgtggctaggagctaggtttttggagtttgaggcactgggattcatgaacgaagatcactggttttcacgtgaaaactcactaagcggagtagaaggtgagggcttacataaattaggttatatcctgagggacataagtaagatacctggtggaaacatgtacgcagacgataccgcaggttgggatactcgaattactgaggatgacttgcaaaatgaagctaaaataactgatattatggaaccagaacatgcattgctagcaacaagcatttttaaattaacttaccaaaacaaagtcgtaagagtacagcgccccgccaaaaacggcactgtaatggatgttatttcccgacgtgatcaacgaggatcaggccaagttggtacatacggattaaacacattcaccaatatggaagttcaactaattaggcaaatggaaagtgagggtatattcttgccatccgagctagaaactcccaatctcgctgagagagtattagactggttagagaagcatggcgcagaaagattaaaaaggatggcgatttcaggcgacgattgcgtagtaaaaccaatagacgaccgcttcgctaccgcattaacagcgttaaatgatatgggaaaagttcgaaaagatatacctcagtgggaaccttctaaaggctggaacgactggcaacaagtcccattttgtagccatcactttcaccaattaatcatgaaagatggacgtgagattgtcgtaccgtgcagaaaccaggatgagcttgtgggtcgggcccgagtgtcacagggtgcaggatggagtttaaaagagactgcctgcttagggaagtcctatgctcaaatgtggcaactaatgtactttcacagacgagacctaagactagcagccaacgctatatgtagcgccgttccagtggattgggtaccgacgtcacgtacaacatggagcatccatgcccatcatcaatggatgacaaccgaagacatgctatccgtatggaaccgagtgtggatcgaagaaaacccgtggatggaagacaaaactcatgtaagctcttgggaagaagtaccctatctaggaaaacgtgaagatcaatggtgtggctctttaataggactaacggcgcgtgccacatgggccaccaatatacaagtagcaataaaccaagttagaaggctgataggtaatgaaaactatctcgactacatgacctcaatgaagagattcaaaaatgaaagcgatccagagggtgctttatggtaa

SEQ ID NO: 21280 - RNA, 9879 nt, synthetic construct
  misc_feature 1..9879: note = derived and/or modified CDS sequence (opt6) from DENV-1__KJ189329__SS-prME
  source 1..9879: mol_type = other RNA
tccgtcaccatgctacttatgctactaccgactgcattagcatttcatcttaccactcgagggggagaaccccatatgatagtatccaaacaagaaaggggtaaaagcctactttttaaaacaagtgctggcgtgaacatgtgtacgctcatagcaatggacctaggggaattatgcgaagacactatgacgtacaaatgtccgcaaattacagaagcagaaccggatgatgtggattgttggtgtaatgcaacagatgcatgggtcacgtacggtacgtgcagccaaacaggtgaacacagacgtgataaacgtagcgtcgcactagctcctcatgtaggactcggattagaaactagaacagaaacatggatgagttcagaaggcgcatggaaacaaatacagcgagtcgaaacctgggcattgagacacccaggattcaccgtaatcgcatttttcttagctcatgctataggtacttccataacacaaaaaggaataatattcatactactaatgctagtcacgccatcaatggcgatgcggtgcgtaggaatcggaaacagagattttgtagaaggtttatcaggggcaacttgggtagatgtagtcttagaacacggttcatgtgtgaccacaatggccaaaaacaaaccaacattagacatagaacttctaaaaacggaggtgacgaaccccgcaattctaagaaaactatgcatagaggcaaaaataagcaatacaaccacggatagtcggtgcccgacgcaaggcgaggcgactctagttgaggaacaagatgcaaattttgtatgcagacgaacatttgttgatcgtggatgggggaatggctgcggtctttttgggaaaggtagccttctcacgtgtgcaaaatttaaatgtgttacaaaactagaaggaaaaatcgtacaatatgagaacctaaaatatagtgttatcgtaactgttcatacaggagatcaacatcaagtaggaaacgaaacgactgaacacggaacaatcgcgactattaccccacaagcgcccacatcagaaattcaattaacagattatggagcgttaaccttagactgttccccgcgcacaggactagatttcaatgaaatggttcttttaactatgaaagaaaaatcgtggttagttcataaacagtggttcctggatctaccattgccatggaccagcggtgcaagtacatcacaagagacgtggaataggcaagatttattggtgacattcaaaactgcacacgcaaagaaacaggaagtagtcgtgttggggagtcaagaaggtgcgatgcacactgcgttgactggagcaaccgaaattcaaacaagtggcactacaactatttttgctggccacctcaaatgcagattaaaaatggacaagttaacgctaaaaggaacctcgtatgtcatgtgtaccggaagtttcaaattagaaaaagaggtagccgaaacacaacatggaacagtattagtccaagttaaatatgaaggaaccgacgcaccgtgtaaaataccattttctacgcaagatgagaagggggtcacccaaaacggaagattaataacagctaatcctatagttaccgataaagagaaaccggttaatatagaaactgagccaccttttggcgaatcttacatcgttgttggggccggagaaaaagccctaaaattaagttggtttaagaaagggtcatcaataggaaaaatgtttgaagcaactgccagaggggcaagaaggatggcaatattgggtgatacagcttgggatttcggatcaatagggggtgtattcacttcagttggcaaactcgtacatcaagtatttgggactgcttatggcgtactgttctctggtgtctcatggacaatgaaaattggaatcggtatacttctcacgtggttgggacttaatagccggtccacctcattatccatgacctgcatcgcagtagggatggtcacgctttacctaggagtgatggtccaagcagattctggttgcgttatcaactggaagggccgagaacttaaatgcggttccggtatttttgttactaatgaagtacatacatggacagaacaatataaatttcaagctgattctcctaagagactaagcgcagccatcggaaaagcgtgggaggagggagtatgtgggatacggagcgcaacacgactagaaaacattatgtggaaacaaattagcaacgagttaaaccacatactactggaaaacgatatgaaattcactgtggttgtcggggatgcaaacggcatactagctcaaggaaagaaaatgattagaccacaaccgatggaacacaaatactcttggaaatcatggggtaaagctaaaataataggcgccgatattcaaaatactacttttattattgatggacctgacacaccagaatgccccgataaccaaagagcttggaatatatgggaagtggaagattatggattcggaatttttacgaccaacatttggttaaagctaagagattcctacactcaaatgtgtgaccatcgactgatgagtgcagccataaaagactcaaaggcagtgcacgcggacatggggtattggatagagagtgagaaaaatgaaacttggaaattagcacgagctagttttatagaggtaaaaacttgtacatggcccaaaagtcatactttatggtctaatggagtcctagaatcggaaatgatcatacccaagatatacggtggtcccatatcacaacataattatcggagcggttatttcactcaaaccgctgggccatggcatctcgggaagttggagttggatttcgacttatgtgaaggaacaaccgtcgtagtggatgaacattgcggaaaccgcggcccatctctacgtacaactactgtaactggtaaaatcatccacgagtggtgttgccgaagctgtaccttacctcccttgcgcttcaggggcgaagatggttgctggtacggaatggaaattagacctgtcaaagaaaaggaggaaaatttggtacgatcgatggtcagtgcaggatcgggtgaggtagattcatttagcctgggaatactttgtgcgtccataatgatcgaagaagtaatgaggagtcgatggtcaagaaaaatgttaatgacaggtacactagctgtatttttgcttctagttatgggccaactaacatggaatgatttgattcgattatgtataatggtaggtgcaaatgcgtccgatagaatgggaatgggaaccacatatcttgcgctaatggccacttttaaaatgagaccgatgttcgctgtaggtttactctttagaagattaacaagtcgagaggttctccttcttacaattggcctatccttggtagcaagcgttgagctaccaaactctcttgaagaactgggggatggtctcgctatgggaatcatgatgctaaaattattgacagaatttcaacctcatcaactttggacaactctactctctttgacgtttataaaaacaacactaagtctcgattatgcctggaaaactacagcgatggctttaagtatcgttagtctctttcctttatgtctctcaaccacctcacagaaaacaacttggctaccggttctgttaggttcctttggttgtaagccgctaactatgtttctaataacagaaaataaaatttgggggaggaaatcgtggccattaaacgaaggaatcatggcaatcggaatagttagtattctattgagctcattgttgaaaaatgatgtgccattagccgggcctttaattgcaggcgggatgcttatcgcatgttatgtcataagtggtagttcagcagacttgagtttagaaaaggctgcagaggtctcttgggagcaagaagctgagcacagcggaaccagtcacaacattctcgtggaagtccaagacgatggaacaatgaaaataaaagatgaagaaagagatgatactttgacaatcttattaaaagctactttactagccgtatcgggggtttaccccatgagcatccccgcgactctatttgtatggtacttttggcagaagaagaaacaacgtagcggggttttatgggacacgccatcacctcccgaggtcgaacgagcggtattggatgatgggatatacaggatattacaacgcggtctcctaggtcgttctcaagtgggagtaggagtctttcaggacggagtttttcatacaatgtggcacgtgacaagaggcgctgttctcatgtatcagggaaaacgactcgaaccaagctgggcgagtgtcaaaaaggatctaataagctatgggggcggctggcgttttcaaggatcatggaatacgggagaagaggttcaagttatcgctgttgaaccaggcaaaaatcctaaaaatgtccaaacaacaccgggcacattcaaaactccagagggcgaagtcggcgcaattgcactcgattttaagccagggacatcagggtctccaatcgtgaacagggagggaaaaatagttggattatacggaaacggggtggtaaccacgtctggtacgtatgtatcagctatcgcgcaggcaaaggcttcccaggagggtccgcttccagaaatagaggacgaagtcttcaagaaaagaaacttaacgatcatggatttacatcctggctcaggaaaaacgaggcgatatcttccagctattgtgagggaagcgataaaacgtaaactaagaactttgatacttgcacctacaagagtcgttgcaagtgaaatggctgaagcactaaagggcatgccgatacggtaccagacgactgctgtcaagtcagagcatacaggaagggaaattgttgatcttatgtgccatgcaacatttacaatgaggctactttctcccgttagagttccaaactacaacatgattataatggacgaagcacacttcacagacccagcatcgatcgccgcaagaggatatatttccacgcgtgtgggcatgggagaggctgctgctatttttatgacagcaactcccccaggctcggttgaagcattccctcaatctaacgctgttatacaagacgaggaaagagatataccagaaagatcatggaactcagggtacgactggataacagactttccaggtaaaaccgtatggtttgtgccatccataaaaagtggaaacgacatagcaaattgtctacggaaaaacggaaaacgagtcatacaattatctagaaagacattcgatactgaatatcagaaaacgaagaacaacgactgggactatgtagtaacgactgatatatcggaaatgggtgctaatttcagggccgatagagtaatcgacccaaggagatgcttaaagccagtgattcttaaggacggtccagaaagagttatactagcggggcctatgcctgtcacggtagcgagcgctgcacagaggcgagggagaatagggaggaatcagaacaaggaaggtgaccagtacgtatacatggggcaacccctaaataatgatgaagatcatgcacattggacagaagcaaaaatgctgttagataatattaatacaccagaaggaattattccagccctatttgaacctgaaagagagaaaagtgcagcaatagatggcgagtacagactacggggtgaagcaaggaaaacgttcgtggagttgatgcgtagaggagacttaccggtatggctatcctacaaagtagccagcgaaggttttcaatatagcgataggcgatggtgtttcgacggtgaacggaataatcaggtgttagaagaaaacatggatgtagaaatttggacgaaagaaggagagcgcaagaaattgagaccaagatggttagatgcacgaacgtattccgaccccctagcgctaagagaatttaaggagtttgcagccggtcgacgctccgttagcggagacctcatattagagatcggaaaattgccgcaacatttaacaagtagagcacaaaatgcgttagataatttggtaatgctacacaactctgaacaagggggaaaggcttataggcacgctatggaagaacttccagacacaatagaaacattgatgctactcgcacttatagccgtattaaccggaggcgtaacgttattcttcctaagcggaaaagggctaggaaagacgagtattggattattgtgcgtgacggcctcgagtgctttactatggatggcctcagtagaaccacattggattgcggcaagcataatactggagttctttttaatggtgctactaataccggaacctgaccgacaaaggacaccccaagataatcaactggcatatgttgttataggactcttatttatgatcttaacagtggcagcaaatgaaatgggtttacttgaaactacaaagaaagatctaggaattggacatgtagcagcagaaaatcaccaacatgctactatgctcgatgtagatttaagacctgcgtcagcatggacactctatgcagtggcgacgactgttatcaccccaatgatgagacatacaattgaaaataccaccgcgaacatatcacttacagcgatagccaatcaggctgcaatcttgatgggactagataagggttggccaatatcgaaaatggacataggggtaccgctgttagcgctcggatgctacagtcaagtaaatcccttaacactaacagcggccgtattgatgctagtagcgcattatgcaataataggacctggcttgcaggcaaaggctacaagggaagcacaaaagagaacagcagccggaataatgaaaaatcccacagttgatggtattgttgctattgacctggatcccgtcgtttacgatgcaaaatttgaaaagcaactggggcaaataatgctgctaatactatgtaccagccaaatattactcatgcgtaccacgtgggctttatgtgaatcaataacacttgcaacgggaccgttgacaacactatgggaagggagcccaggaaaattctggaatacaactatcgcagtgagcatggctaacatattcagagggagctacttagcaggcgcaggattggctttctctctaatgaaaagcctcggcggaggacgtcgaggaacgggagctcagggagaaactcttggcgaaaagtggaaaagacaattaaaccagttatctaaaagcgagtttaatacttataagagatccggtataatggaagtggataggtccgaggcaaaggaaggtctaaaaagaggtgaaactacaaaacatgctgtaagcagagggacagcgaagttgagatggttcgtagaaaggaatctcgtaaagcctgaaggaaaagtaatagatctgggctgtggcagaggtgggtggagttattattgtgcaggattaaagaaagtgacggaggtaaagggttacacaaaaggaggaccggggcatgaagaaccaataccaatggcaacttacggatggaacctagtcaaattacattcaggaaaagatgtattctttatgccaccggaaaaatgcgatacacttttatgtgacatcggagaatcatcaccaaaccctactatagaagaagggaggacgctacgtgttctaaaaatggtcgaaccttggctacgaggaaaccaattttgtataaaaattctaaacccatacatgccatccgttgtagaaactctagaacaaatgcaacgaaagcatggtgggatgttggtcaggaatcctttgtcacgtaattcgacccatgaaatgtactgggtatcatgtggaacggggaatatagtttctgccgtcaatatgacaagtcggatgctactcaatagatttacgatggctcatcgtaagcctacatatgaacgagatgtggatttaggcgcaggtacccgacacgtagccgtagagcccgaagtagctaatttagatataataggacagagaattgaaaatatcaaaaacgaacacaaaagtacgtggcattacgatgaagataatccataccgtacctgggcttatcatggaagttacgaggtaaaaccatcaggatccgcctcatcaatggttaacggagttgtaaggttactgacgaaaccttgggatgtcatcccaatggtcacacagatagccatgacagatactaccccatttggccaacaaagagtcttcaaagaaaaagtagatactaggacaccgagagccaaaagaggcaccacacaaataatggaagtcacagccaaatggttatgggggttcttgtcaagaaacaagaaacctaggatatgcacccgcgaagaatttacgcgtaaggttagatcgaacgcagcaattggagcagtttttgttgacgaaaatcaatggaactccgctaaagaagcagttgaagatgaaaggttttgggacctagtacacagggaacgagaactccataagcaaggaaaatgtgcgacatgcgtatataacatgatggggaaacgtgagaagaaactcggcgaatttggaaaagcaaagggtagtcgggccatatggtatatgtggcttggggcgagatttctagagttcgaggcgctcggttttatgaatgaagatcactggttcagtagggaaaactcgctttcaggtgtagaaggtgagggcctacacaaactaggatatattctccgagatatctccaagattcctggagggaatatgtatgcagacgatacagcaggttgggacaccagaataactgaggatgacttgcaaaatgaagcaaagattaccgaaataatggaaccagaacacgcattgttagcaacctcaatatttaaactaacttatcagaataaagtagtacgggtccagagacctgccaaaaatggtacggtcatggatgtaatatcaagacgcgatcaaagagggtctggtcaagtaggtacttacggtttaaacactttcactaacatggaggtacaattgattagacaaatggaatcagaagggatttttcttccatctgaacttgaaacaccgaacttagcagaaagggtactagactggttggaaaagcatggagctgaaagattaaaacgcatggcaatatcaggggatgactgcgttgttaaacctattgatgacagattcgctaccgctcttacagccttaaacgatatgggcaaagtccggaaggatatcccacaatgggaaccatcaaagggatggaacgattggcagcaggtcccattctgtagtcatcattttcatcaattaattatgaaagatgggcgagagattgttgtcccgtgtcgtaatcaagatgaattggtcggacgtgcaagagtatcacagggagcaggatggagtttacgagaaacagcctgtttggggaaaagttatgcgcaaatgtggcaactaatgtacttccataggagagatttaaggttagctgcaaacgcaatctgttccgcagtacctgtcgactgggttccaacctcgaggacaacttggagcatacatgctcatcaccaatggatgactacagaagatatgctatctgtgtggaatagggtttggatagaagaaaatccatggatggaagataagacacatgtgagtagctgggaagaggtgccttatcttggaaaaagggaagaccagtggtgtggctcattgattggattaacagcgagagcaacttgggccaccaatatccaagtcgctataaaccaagtgcgacgactaataggtaacgaaaactacttggactatatgacgtccatgaaacgctttaaaaacgaatcggatccagaaggcgctctttggtaa

SEQ ID NO: 21281 - RNA, 9879 nt, synthetic construct
  misc_feature 1..9879: note = derived and/or modified CDS sequence (opt6) from DENV-1__KJ189331__SS-prME
  source 1..9879: mol_type = other RNA
tcagtgacgatgctgctaatgctactacccaccgcactagcgttccatttgacaacaagaggaggagaaccacatatgattgtgtctaaacaagaaagaggaaaaagtctactatttaaaacaagtgcaggagtaaacatgtgcaccttaattgcaatggatttaggtgaattatgtgaagatacaatgacgtacaaatgtccacaaataactgaagcagaaccagatgatgtggactgttggtgcaatgcaaccgatacatgggtcacgtatggaacttgctcacaaacaggagaacacagacgtgataaaagaagcgtcgctcttgctccccatgttggtctgggattagaaactcggacagaaacatggatgtcctccgaaggcgcttggaaacaaatacagcgtgttgaaacatgggctcttagacatccagggtttacagttatagcactctttctcgcgcatgcaatagggacaagtattacgcagaaagggataatatttatactattaatgttggtaactccgtcaatggctatgcgatgtgtaggaattggaaatcgagactttgtggaaggtctcagtggagcaacatgggttgatgtggttctagagcacggatcctgtgtcaccacgatggccaaaaataaaccaacattagacatagaattactaaaaacggaggtaacgaatccagctattttaaggaaactttgcatagaagccaagatttctaatacaaccacggattcacgatgtcccacacaaggagaggctacattagttgaagaacaagatgcaaactttgtatgtcgtagaacatttgtcgataggggttggggtaatggttgcgggctttttggtaaaggatctttactcacatgtgctaaattcaagtgtgtaacgaaactagaaggaaaaatagtccaatacgaaaatctaaaatacagcgtaattgtaacagtacacacaggggaccaacatcaggtaggaaacgaaacaaccgaacatgggacaatagccacaataacaccccaagcacctacaagcgagatccaattgacagattacggagccctaaccttagactgttcaccaagaacaggactggattttaatgaaatggtgctactaactatgaaagagaaatcttggctagtacataaacaatggttcttagatctaccactaccatggactagcggagctagcacatcccaagaaacctggaacagacaagacctactggttacatttaaaacagcccatgcgaaaaagcaagaagtagttgtattagggtctcaggaaggagccatgcataccgccttaaccggtgccacagaaatacagacctcaggaacaacaacaatattcgccggacacttaaaatgccgcctaaagatggataaactaacattaaaaggtaccagttatgtaatgtgtacaggcagcttcaaacttgaaaaggaagtggcggagacccagcacggaactgtcttagttcaagtcaaatacgaaggaacggacgcaccgtgcaagatacccttttctacgcaagatgaaaaaggagttacacaaaatggtagactgatcaccgctaacccaattgttacagataaagaaaaacccgtgaatatagagacggagccacctttcggagagtcatatatcgtggtgggagcaggagagaaagctctaaaattaagctggttcaaaaagggttctagcattggtaaaatgtttgaagccaccgcccgaggtgcgcgtaggatggcaattctcggggatacagcctgggatttcggatcaataggtggggttttcaccagcgttggaaaacttgtacaccaagtttttggtacggcttatggcgtattgttttctggcgtttcgtggacaatgaaaatcgggatcggtattctactgacatggctaggattgaactcccgctcaacgtccctatctatgacatgcatagcggttggcatggtcacgctctatttgggtgtaatggttcaagcggacagtggttgcgttattaattggaaagggagggagcttaaatgtggaagtgggatctttgtgacaaacgaagtccatacgtggacagaacaatacaaattccaagctgacagccctaagcgcttatccgcggccatcggtaaagcatgggaagaaggcgtatgtggcattcggagtgctacacggcttgaaaatataatgtggaagcaaatatccaatgaattgaaccatatcctactagaaaacgacatgaagttcactgtagtcgtgggggatgccaacggcatattagcacagggcaagaaaatgattaggccacagcctatggaacacaaatacagttggaagagttggggaaaagctaaaatcataggagccgatatacagaatacgacatttatcattgacggtccagatacgcctgaatgtccagataatcaaagagcgtggaacatatgggaagtagaagattatggattcggtatatttacaacaaatatctggcttaaattacgggactcatatactcagatgtgcgatcacagactgatgtctgcagccataaaggattcaaaagcagtacacgctgacatgggctattggatcgaatcagagaaaaatgaaacatggaaactagctagagcaagtttcatagaagtcaaaacatgtacttggccaaaaagtcatacgctatggtcaaacggagtgttagaatcggaaatgataataccaaaaatttatggaggccctatcagtcaacataactacagaccaggctattttacacaaactgccggtccgtggcacctagggaaactagagttagattttgatctctgcgaaggaacaacggttgttgtggatgagcattgcggtaatagaggtcccagcctcagaacaacgacagtgaccggaaaaattatacatgagtggtgctgccgatcatgtacacttccgccgctccgttttcgcggggaggacggatgttggtatggtatggagatacgtcccgttaaagagaaggaggaaaatctggtcagatctatggtgtctgccggatcgggtgaagtcgactcattttctcttggcattctctgtgcatccatcatgatcgaggaagttatgcgttcgagatggtctagaaaaatgttaatgataggcactttggctgtatttttactgttgatcatgggacaacttacatggaatgatctaatacggttatgtataatggtaggtgctaacgcatcagacagaatgggaatgggaactacttatctcgcgctaatggcgacgtttaaaatgcggcccatgttcgcagtaggattactttttcgaaggttaaccagtcgggaagtcctattgttaacgataggtttatcactggtagcctcggtagagctccctaacagcttagaagaattaggagatggcctagcgatgggaattatgatgctaaaacttcttactgaatttcaaccgcaccaattatggactactttactatcactgactttcataaaaactacattgtcattagactatgcttggaaaaccacagccatggcactgagcattgtcagtttgtttccattatgtctatcaaccacatcacagaagacgacatggttacctgtccttctaggtagttttggatgtaaacctcttactatgtttcttattacagaaaataaaatatgggggcgaaaatcgtggcccttaaacgaaggtataatggcaattggaatagtatcaattctattgtcgtcactccttaaaaatgacgttcccctagctggaccattgatagccggtggtatgttaatagcatgctacgttattagtggttcaagtgcagacctaagcctagagaaaactgcagaagtaagctgggaacaggaggcggaacattctggtacatcacataatatcctagtcgaagtccaagatgacggaactatgaaaattaaagatgaagaacgtgacgatacactaaccatcctgttaaaggcaactctactcgcagtctcaggcgtatatccaatgtccataccagccactctatttgtgtggtatttttggcaaaagaagaaacaacgatctggagttctttgggataccccctcacctcctgaggtagaacgcgcggtattagatgatgggatttataggattctacagcgcgggcttctcggacggagtcaggtaggagtgggtgtgttccaagatggggtatttcacaccatgtggcatgtaacaagaggcgctgtattgatgtatcaaggcaaacgattggaaccatcttgggcttccgtgaaaaaggaccttataagttacggtggcggatggcgatttcaggggtcatggaatacaggtgaagaagtacaggtgatagcggtagagcccggcaaaaaccctaaaaacgtccaaacgacaccgggtacgtttaaaacaccagaaggagaagtaggagctatagcactagactttaaaccaggaacttcaggcagcccaatagtaaatcgggaaggcaaaatagtgggcctatatggtaatggtgtagtgactacttccggtacgtatgtctcagccatagcccaagcaaaggctagtcaggaaggcccattaccagaaattgaagacgaagtcttcaagaaacgtaatttgacaatcatggacctacacccagggagtggtaagacaagacgatacctacccgcgatagtacgcgaagctataaagcgtaaattgaggactctaatactggctccaacaagggtagtcgccagcgaaatggcagaagccctaaaaggaatgcccatacgataccaaaccacagcggtcaaatctgaacatacgggacgggagatcgttgacctgatgtgtcatgcaacgtttacaatgaggctactgagcccagtacgggtccccaactataatatgattataatggatgaagctcactttacagatcccgcctccatagccgcgcgaggatacatatctacacgagtcgggatgggtgaagcggccgccattttcatgacagcaacaccgcccggatcggttgaagcattccctcaatcaaatgcggtcatccaagacgaggagagagacattccagaaagatcttggaactcaggctacgactggataaccgattttccaggaaagacagtgtggtttgtaccaagcataaaatcaggtaacgacatagctaactgtctacggaaaaacgggaaacgagttatccaattaagcaggaaaactttcgatacagagtatcagaaaactaaaaataatgattgggactatgtagtcaccacggatatttctgaaatgggagctaattttcgagccgatagagtaatagacccacggagatgtctaaaacctgtaatactaaaggatgggccagaacgagttatactagcagggcctatgccagttacagtagcatctgctgcgcaaagacgcgggcgtattggtcgtaaccaaaataaagaaggcgatcaatacgtatacatgggacaaccactaaataacgatgaagatcatgctcattggacagaggcgaaaatgttgctagacaacattaatacgccagagggaattatacctgctttatttgagccagagagagaaaaatctgcagccatagatggagaataccgtttgagaggggaagcaagaaaaacatttgtcgaactaatgcgaaggggtgacttgcctgtctggctatcctacaaagtagcgtcagaggggtttcaatattctgatagacgatggtgctttgatggagaaagaaataatcaagtgctggaagaaaacatggatgtagaaatttggactaaagaaggggaaaggaagaaattgcgacctcggtggctggatgccagaacatattcggaccctctcgcgctacgagaatttaaggaatttgccgccggaagacgttccgttagtggagatttaattttagagatcggaaaacttccacaacatcttacccttagagcacagaacgctctggataacctggctatgctacataattcggaacaaggaggaaaagcatataggcatgctatggaggaactgcccgataccatcgaaactttgatgctacttgcactgatagcagtcttaactgggggagttactttatttttcctatcaggtaaaggacttggcaagacatcaattggtctcttgtgtgtcacagcatcatcagcgctgttatggatggctagtgttgaacctcattggatagcagcaagcataatcctagaatttttccttatggtcttattaatacctgaaccagacaggcaaagaacaccacaagacaaccagcttgcgtacgtcgttattggtttgctattcatgatcctaacggttgcagcaaatgagatgggactcttagaaaccaccaagaaagacctgggaatcggacacgttgctgcagaaaatcaccagcacgctaccatgctagacgtagatttaaggccggcttcagcctggacattatatgcagttgcgacaactgtaataacaccaatgatgcgacataccatagagaatacaacagcaaacatttcattgaccgcaatcgctaatcaggcagccatattaatgggactagacaaaggttggcctatctctaagatggacataggtgttccgcttttagctcttggatgctattcacaagtcaatcctttaacactcactgccgctgttttgatgctcgttgcgcactacgctataataggcccgggtcttcaagcaaaagccacccgagaggcacaaaaacgaacggccgctggaataatgaaaaaccccacagtcgacgggatagttgctatagatctagatccggtcgtgtatgacgcaaagtttgaaaagcaactcggccaaatcatgttacttatactctgcacatcccagatattactaatgagaactacatgggctttatgtgaaagcataactctcgctactggaccactaaccacactatgggagggctcgccgggaaagttctggaacacgactatcgcggtgagtatggcaaatatttttcgaggaagctatttagcgggcgcaggactcgcgttcagtctaatgaaaagtttaggaggaggccgtagaggtacaggggcccaaggagaaactctaggtgaaaaatggaaacgccagctgaaccaactgtccaagagtgagttcaatacttataaacggtcaggtattatggaagttgatagatcagaagcaaaagaaggtctaaaacgaggtgaaacgacaaagcacgccgtaagccgtgggacagcaaaactcagatggttcgttgagcggaatcttgtaaaaccagaaggtaaagtgattgatctaggttgcggacgaggaggatggagttactattgtgccggattgaagaaagtcacagaagtaaagggctatacaaaaggtgggccaggacatgaagaacctatacctatggcaacgtatggatggaacctagtaaaactacacagcggcaaagacgtcttcttcatgccaccagaaaaatgtgacacattattatgtgacatcggcgaatcttctccaaatccgactatcgaggaaggccgaacactacgagtccttaaaatggtggaaccttggttacgtggaaaccagttctgcattaagattctaaatccctatatgccatccgtagtagagacacttgaacaaatgcagaggaaacacggaggaatgctagtcagaaatccgttgagccgtaattctactcatgaaatgtattgggtcagttgcgggacaggaaatatagtgtctgccgttaatatgacatcgcggatgttactaaatcgatttacaatggctcacagaaaacccaccttcgagagagacgttgatttaggtgctggcacaaggcatgtcgcggttgaacctgaagtcgcaaacctagatataattggccaaaggattgaaaatatcaaaaatgaacacaaaagtacttggcattatgatgaggacaatccttacaaaacatgggcgtaccatgggtcatatgaagtaaagccttcaggttcagccagtagtatggtcaatggagtcgtaaggcttcttacaaaaccatgggatgttatacctatggtaacgcaaattgctatgacagacacgacgccatttggacaacagcgcgttttcaaagaaaaggtagatacacggacaccaagagcgaaacggggtacaacccaaattatggaagtcactgcgaaatggctatggggattcctaagcagaaataagaaaccaagaatatgtacacgagaagagtttacgcgtaaagtcaggtctaacgcagctataggagctgttttcgtagacgaaaatcaatggaactcagcaaaagaagctgttgaggatgagcgattttgggatttagtccatagggaaagggaattacataaacaaggaaagtgtgctacatgcgtatataatatgatgggcaagcgtgaaaagaagttaggcgagttcggaaaagctaagggaagtagagccatctggtatatgtggttgggtgctagatttcttgagttcgaagcactcggtttcatgaatgaagatcattggttctcccgtgaaaacagcctgtccggtgtggagggagaaggccttcacaaattaggttatatattaagagacatatcaaaaatacctggtggtaatatgtacgccgatgacactgctggctgggatacacgaataactgaggatgaccttcaaaacgaagcaaaaatcaccgatattatggagcccgaacacgcattactagccacaagtatcttcaagttaacctatcaaaataaggtagttagggtgcagagacctgctaaaaatggcacagtaatggatgttatcagtcgccgagaccaaagaggtagcggtcaagtggggacttatggcctaaatacctttacgaatatggaagtgcaattgatcagacaaatggaatcagaaggtatattcttaccaagtgaattagaaacacccaatttagcagaaagagtattagattggctggagaaacatggagccgaaagattaaaaagaatggccatatcaggtgatgattgcgtggtaaaaccgatagacgaccgatttgctacggcccttacagcattaaatgacatgggcaaagtccgaaaagatataccacaatgggaaccatcaaaaggctggaacgactggcaacaggtacctttttgtagtcaccattttcatcagcttattatgaaagacggcagggaaattgttgtgccgtgtagaaaccaggacgagctggtggggagagcaagagtttctcaaggtgcagggtggagcttacgtgaaactgcgtgcctaggtaagtcatacgcgcagatgtggcaactaatgtattttcaccggcgagacttaagactagctgcaaatgcgatttgttccgcggtacctgtagattgggtacctacgtcacgaacaacttggtccatacacgcgcatcatcaatggatgactacggaagatatgctatctgtctggaacagagtctggattgaggaaaatccatggatggaagataaaactcatgtctcttcgtgggaggaagtaccatacctagggaaaagagaagatcaatggtgtggatctctcatcggtctcacagcacgagccacatgggctacaaacatacaagtagcaataaatcaagtgcgaaggttgattggaaatgagaactatctggattatatgacctctatgaaaagatttaagaacgagtcggatccagaaggagccttgtggtaa

SEQ ID NO: 21282 - RNA, 9879 nt, synthetic construct
  misc_feature 1..9879: note = derived and/or modified CDS sequence (opt6) from DENV-1__KJ189332__SS-prME
  source 1..9879: mol_type = other RNA
tcagtcactatgttattgatgttattacccacagcgctagcattccacttaaccacaagaggaggagaaccccatatgatagtttccaaacaagaacgtggaaaatccctattgttcaaaacctccgcaggggtcaacatgtgtacacttatagcgatggatcttggtgaattgtgcgaagacacaatgacatacaaatgtccacaaattacagaagcagaacccgatgacgtcgactgttggtgtaatgcaacggacacctgggtaacatacggaacatgttcacaaaccggtgaacatcgaagagataaacgatcagtagctctggcaccgcatgtgggtctggggttggaaactcgaacagaaacatggatgtcctctgaaggggcgtggaaacaaatacaaagggtagaaacatgggctctaagacatccaggtttcaccgtaatagctctatttttggctcacgcgattggaacaagcataactcaaaaaggaacgatttttatcctgttgatgcttgttaccccatcaatggcaatgagatgcgtggggattggaaatagggatttcgttgaaggattatcaggcgcgacgtgggttgacgtagttttagaacacggatcttgtgttacgacgatggcgaaaaataaaccaacactagatattgaactgttaaaaactgaagttacaaacccagctatcttaagaaaactatgtatcgaagctaaaatatcaaacaccaccacagatagtcgatgccccacccaaggagaagcaactttagtcgaagaacaagatgctaatttcgtatgccgtaggacatttgtagaccgaggttgggggaatggttgtggactctttggtaaagggagcttactaacatgtgcaaaatttaaatgtgtgactaaactagaaggaaaaatagttcaatacgaaaacctaaaatattcggtaatagtcactgttcacaccggtgaccaacaccaagtaggaaatgaaaccactgaacacggaacaatagccactattacccctcaagctccaactagcgaaatccaattgacggattatggcgctttgactttagattgctctcccaggactgggctcgatttcaatgaaatggtgctcttgactatgaaagagaaaagttggctagtccataaacaatggtttttggatttaccattaccctggacaagcggagcgagtacttcacaagaaacttggaacagacaagatctcttagtaacattcaaaactgcacatgccaagaaacaagaagtggtcgtacttggatcacaagaaggcgcaatgcatacagcattaacgggagcaacagaaatacaaactagcggaacgaccacaatatttgctggacacttgaaatgcagattgaaaatggataaactaaccctaaaagggacgagttacgttatgtgcaccggaagttttaaacttgagaaagaagtcgccgaaactcaacacgggaccgtattagtccaagtaaaatatgaaggtaccgatgcaccatgtaaaatcccattcagcacacaggatgaaaaaggcgttacgcaaaatggacgcctaataacagcaaacccaattgtaacggataaagaaaaaccagtgaatatagagacggagccacctttcggcgaatcctacattgtagtaggggctggagaaaaagcgttaaaacttagctggtttaaaaagggaagcagcatcggtaaaatgttcgaagctacagcaagaggtgcgcgaagaatggccatactaggagacacagcctgggatttcggttccattggcggagttttcacttcagttggaaagctagttcatcaagttttcggtacggcctacggagtactattcagcggtgtaagctggaccatgaagataggtataggcattctgctaacatggttaggactaaattcgcggtcaacaagtttatcgatgacgtgtatagctgtgggaatggttacattgtacctaggtgtaatggttcaagcggactctggatgtgtaataaattggaaaggaagggaattaaaatgcggatctggaatatttgtaacgaacgaagttcacacttggaccgaacaatacaaatttcaagccgattcgccaaaacggttaagtgcagccatcggaaaggcttgggaggagggagtgtgcggcatacggagtgccacaaggctagaaaatataatgtggaaacaaatatcgaatgagctgaatcatatacttcttgaaaacgacatgaagttcacagttgtagtaggagatgccaatggtatcttagcccaaggcaagaaaatgataagaccccaacctatggaacacaaatatagttggaaatcctggggtaaagcaaaaataataggtgctgatattcaaaacacaacgttcatcatcgatggacccgatacacctgagtgcccagataaccagcgagcatggaatatatgggaggtagaagattacggattcggaatatttacaacaaatatatggctaaaattacgagactcttacacgcaaatgtgcgatcatcgactcatgagtgcagctataaaagatagcaaggcggtacatgcagacatgggctattggatagaaagcgagaaaaacgaaacatggaaattagccagagcttcctttatagaagtgaaaacgtgtacctggcctaagtctcacacgttatggagtaacggtgtattggagagtgaaatgataatacctaaaatctacggaggacccatttcacaacacaactatcggccggggtattttacgcaaaccgcaggaccgtggcacctaggcaaattggaacttgatttcgatttatgtgaaggaacaaccgtggtggttgacgaacactgcggtaatagaggaccatccttacgaacgacgacggtgacgggcaagattatacacgaatggtgttgtcggagctgtacgttaccaccactaagattcagaggagaagacggatgctggtacggaatggaaatacgacccgtgaaagaaaaagaagaaaacttagtacgaagcatggtatcagcgggatctggagaagtagacagtttttctttaggcatactttgcgcaagcattatgatcgaggaagtaatgagatcaagatggtctcgtaaaatgttaatgacaggaacgttagcagtctttctccttttaattatgggtcaattaacatggaatgacttgattagattgtgcataatggttggagctaacgcttcagatagaatggggatgggtactacatacttagcacttatggctacatttaaaatgcggcctatgtttgccgtcggcttattatttaggaggctgacgtcacgagaggtattgttgctcaccataggactatcattagtagcctcggttgaactaccgaatagcttggaggaactaggtgatggccttgcaatgggtatcatgatgttgaagttactcactgaatttcaaccgcaccaattatggactaccttactttcactaacctttataaaaacaacgttgtcactggattacgcgtggaaaaccacagcaatggcgctatcaatagtcagcttatttccactgtgcctgtctacaacgtcacagaaaactacgtggttaccagtactgctaggcagcttcgggtgtaaaccactaacaatgtttctgatcaccgaaaacaagatatggggtcgaaaaagttggccattaaatgaaggtattatggcaatcggtattgtatcaatccttttgtcctcattattgaagaacgatgtaccgcttgcgggcccactcatagctgggggcatgttaatagcctgttatgtaatttcgggttccagtgcagatttatcactcgagaagactgcagaagttagttgggagcaagaagcggaacacagtggaacttcacataacatcttagtggaagtacaagatgatggaactatgaaaataaaagacgaagagagagacgatactcttacaatactactgaaagctacccttttagcagtttctggagtttaccctatgtcaatcccagctactctattcgtatggtatttctggcagaagaagaaacaaagatcaggagtgttatgggataccccgagtccacccgaggtcgagagagcagtattagatgatggaatttacagaatactacagagaggtcttttaggtagaagccaggtaggtgttggtgtatttcaggatggtgttttccataccatgtggcatgtgacgaggggcgcagtcctaatgtatcagggtaaaagattggagccctcatgggctagtgttaagaaggacttgatatcttatggagggggctggcgatttcagggctcatggaacactggagaagaagtacaggttatagctgtagaaccaggtaagaacccgaaaaacgttcaaaccactcccggaacgtttaaaactccggaaggagaagtaggagcgatcgctctggattttaaacccggaacgagtggttcgccaatagtaaacagggaaggcaaaatcgttggactttacggtaatggtgttgtaaccacatccggtacatatgtgagcgcaatagctcaggcaaaagcatcgcaagaaggaccattgcctgagatagaagatgaggtttttaaaaagcgaaatcttacaataatggacctgcaccctgggtcaggaaagaccagacggtatttacccgcaatagttcgagaagcgattaaaagaaaactccgtacactcatattagcaccgacacgtgtagtggcatcagaaatggctgaagctctgaaaggcatgccgatacgataccaaactacagccgtaaaatcggagcatacgggaagggaaatagttgacttgatgtgccatgctacttttacaatgcgcctcttgagccctgtacgggtaccgaactataatatgattattatggatgaggcacactttaccgatcctgcatcaatagcagcacgaggttacatttcaacgagagtgggcatgggcgaggcggcagccatctttatgaccgccacaccacctggctcagttgaagcatttccacaatcaaacgctgtaatacaggatgaggaaagagatataccggagcgatcttggaacagcgggtatgactggataacggatttcccaggaaagacagtatggttcgttcccagcataaaatcagggaatgatatagcaaattgcttgaggaaaaatggaaaaagggttatacaacttagccgtaaaacatttgacacggaataccaaaagacaaagaataatgactgggattacgtagttactacagatatttcagagatgggtgcgaacttcagagcggaccgtgttattgacccaagaagatgtctaaagccggtaatacttaaggatggaccagaaagagtcatactggcaggtcctatgccggtaaccgtcgcatcagcggcacaaagaagagggcggatcggtcgcaatcaaaacaaagaaggggaccaatatgtgtacatgggtcaaccgttaaataatgatgaagatcatgcccactggacagaagccaaaatgcttcttgacaatattaacacccccgaagggataataccagcactatttgagccggaacgagagaaaagcgcggcgatagatggtgaatacaggctacgtggagaagcgagaaaaacgttcgtagaactgatgagaagaggcgatttacctgtttggttgtcttacaaggttgccagtgaaggttttcaatattctgacaggcgctggtgttttgatggcgaacgcaacaaccaagttttggaagaaaatatggatgttgaaatttggacaaaggagggcgaaaggaagaaacttaggcctcgttggttagacgcaagaacatactctgaccccttagcattaagggaatttaaggaatttgctgcaggtagacggagcgtttctggtgaccttatactggaaattgggaaacttccacagcatttgaccctaagagcacagaacgctttagataatctggccatgcttcacaactctgaacaaggagggaaggcttaccgacatgcgatggaagaactaccggacaccattgaaacactaatgctattagcactaatcgctgtcttaacaggaggagtaacattgtttttcctctcaggcaaaggccttggcaagacatccataggcctactatgtgtaaccgcatcaagtgcattgctttggatggcatctgttgagccgcactggatagcagcgtcaataatcctagagttctttctaatggttctactaataccagagccggataggcagcgcacaccacaggataatcagttggcatatgtagttattggtttattattcatgatactgactgtggctgcaaacgagatgggcttattagaaacaactaagaaagacctgggtataggtcacgtcgctgctgaaaatcatcagcacgcaacaatgcttgatgtggacttacgaccagcatctgcctggaccctgtacgccgtagctactacagtgatcacgccaatgatgcgacacacgatagaaaatactaccgcgaacataagcctaacagccattgcgaatcaagctgccatactcatggggctcgataaaggatggcctatctctaaaatggatataggtgtaccattactggcacttgggtgctactcacaagtgaatcctcttactttaactgccgcagttctgatgttggtggcgcattatgcaataattggaccgggactgcaagcaaaggcaacaagagaagctcagaaaagaacagcggcaggtattatgaaaaatcccacggttgatggaatagttgcaatcgacttagaccccgtcgtttacgacgccaaatttgagaaacaactaggacaaattatgttactcattctttgtacaagccagattctattaatgcgtacgacgtgggcattgtgcgaatccataacattagcaacaggtccattaaccactttatgggaaggttcacccggaaaattctggaatacaacaatagcagttagcatggctaacattttcaggggtagctatctcgctggagcagggctggccttttcgctcatgaaaagtttaggaggagggagaagaggtacgggagctcaaggagaaaccctaggagaaaaatggaaaagacaacttaatcaactctcaaaaagcgagttcaatacatacaagcggtctggaataatggaagttgaccgttcggaggcgaaagaaggtctgaaaagaggagaaactacgaagcatgcagtaagcagaggaacagccaaactacgctggtttgtcgaaagaaatttagttaaacccgaaggtaaggtaattgacttgggatgcggaaggggcggctggtcatattactgtgctggactgaagaaagtaacagaagtaaagggatatactaaaggaggtcccggacatgaagaacctatccccatggcaacgtacggttggaatttagtgaaattacactccggaaaggatgtcttcttcatgccacccgaaaagtgtgatacactcctatgtgatattggggagtccagtccaaaccctacgatcgaagaaggtcgaaccctccgagtactaaaaatggtggagccatggttaagaggaaatcaattttgtattaaaattcttaatccatatatgccatcagtagttgaaacgctagagcaaatgcaaagaaaacacggaggtatgcttgttaggaatccactttcaagaaatagtacacacgaaatgtactgggtaagctgtgggaccggtaacattgtatccgcagtaaacatgacatcaaggatgctcttaaacaggttcaccatggctcataggaagccaaccttcgagagagacgtagatctgggggccggcacccgacatgtagcagttgagccagaggtagcgaacttagacattattggacaaaggatagaaaatatcaaaaatgagcataaatccacatggcactacgacgaggataatccatacaaaacttgggcatatcacgggtcgtatgaagttaagccaagtggttccgcaagttcaatggttaacggtgtcgtaagattattaaccaaaccatgggatgtgataccgatggtcacacagattgctatgaccgatacaacgccctttggacaacaaagagttttcaaagaaaaggtcgacacacgaacgccacgcgcaaagagaggtacaacacagataatggaagttacagccaagtggttgtggggctttctaagtcgaaataagaaaccacgcatatgcacccgtgaagagttcacacgaaaggtccgaagtaacgcagctataggcgctgtatttgtagatgaaaaccaatggaacagcgcaaaggaagctgtagaggacgaaaggttctgggacttggtccacagagaaagagagttacataagcaaggtaaatgcgccacatgcgtttataatatgatggggaagcgggagaagaaactaggtgagttcggaaaggcaaaaggaagccgcgcaatctggtacatgtggttaggagcaagattccttgaatttgaggctttaggatttatgaacgaagatcattggttcagccgcgagaactcacttagtggcgtcgaaggtgaaggcctgcacaagctgggctatatattacgagatatcagtaagataccgggcggaaatatgtacgccgatgacacggccggatgggatacaagaatcacagaagatgacttacaaaatgaagccaaaataacggatataatggaacccgaacatgctttgttagcaacatcgattttcaagctaacatatcaaaacaaagtagtccgagttcaaagaccagccaaaaacgggactgttatggatgtaataagtagacgagatcagcgtggctcaggacaggtcggaacgtatggattaaacacctttacaaacatggaggttcaattaataaggcaaatggaaagcgaaggaatatttttaccttccgaattagaaactcccaatttagcggagagggtattggactggctggagaaacatggcgccgaaaggctgaaacgtatggcaatttccggagacgattgcgtagtcaagcccattgatgatagatttgcaactgcattaaccgcactaaatgatatgggaaaagttcgaaaggatattccacagtgggaaccatcgaaaggatggaatgattggcaacaagttccgttctgtagtcatcattttcatcaattaattatgaaagacggccgcgaaatagtcgtaccctgtagaaatcaagacgagcttgtaggcagagctcgagtatcccaaggagcgggatggtctttacgagaaacagcatgtttgggaaaatcgtatgctcagatgtggcagctgatgtattttcacagacgcgatcttagactagcagcaaacgcgatatgtagtgcagtaccggtcgattgggtacctacatctcgaaccacttggtctattcatgctcaccatcaatggatgactactgaagacatgttatcagtatggaaccgtgtgtggattgaagagaatccctggatggaagacaagactcatgttagttcatgggaagaagtaccatatcttgggaaacgagaagatcaatggtgtggctctttaataggactaactgcacgggctacctgggcgactaatatccaggtcgctataaaccaagtgcgccgtctaattgggaacgaaaactacctagactacatgacaagcatgaaaaggtttaaaaacgaaagcgatcccgaaggcgctttatggtaa

SEQ ID NO: 21283 - RNA, 9879 nt, synthetic construct
  misc_feature 1..9879: note = derived and/or modified CDS sequence (opt6) from DENV-1__KJ189334__SS-prME
  source 1..9879: mol_type = other RNA
tcggtcaccatgctattgatgctattaccaacagcgttagcattccatttaaccacacggggtggagaaccgcatatgatagttagcaaacaagaacgcggtaaaagcctactctttaaagtaagcgcgggtgtcaacatgtgcaccttaatagctatggatttgggtgaattatgtgaagataccatgacatataaatgtcctcaaattacagaggcagagcccgacgatgtagattgctggtgcaatgcaactgatacctgggtcacatatgggacgtgtagccaaactggagaacacaggagggataaacgatcagtggcattagcaccacatgtcggtctaggtctggaaacccgtacagagacatggatgtcttccgagggggcgtggaaacaaatccaaagagtagaaacatgggcacttcgacatccaggatttacagtgatcgcattctttcttgcccatgcgataggtactagcataacacaaaagggtatcatttttattctacttatgctagtgacaccaagcatggcaatgcggtgtgttgggattggaaatagggatttcgtcgaaggattatcaggagcaacttgggtagatgtagtcctagaacatggatcgtgtgttacaacgatggccaaaaataaacccacattagatatagagctattaaaaactgaagtgaccaaccctgctattttacgaaaattatgcatcgaagcaaagatttccaacacaacaactgattcccgttgtcctacacaaggggaagcaacattggttgaagaacaagatgctaattttgtatgcagaagaacattcgtcgacagaggctggggaaacggatgtggcctatttggaaaaggtagcctgctaacttgtgcgaaatttaagtgtgtaacaaaactagaaggtaagatcgttcaatacgagaatttaaagtattcggtcatagttacggttcatacaggtgatcaacaccaagtcggaaatgaaacaacagaacatgggaccatagctacaataacaccccaagcacctacttcagagatacagctaacggattatggtgctctcacactcgattgtagtccacgtacggggctggacttcaacgaaatggtattgttaacgatgaaagagaagagttggctagtgcataaacaatggttcctcgacctaccactaccgtggactagcggcgcatctacctctcaggaaacctggaatcgacaagatttattagtcacattcaagacagcccacgcgaagaaacaagaagtggtcgtgctaggatcacaagaaggagcaatgcatacagctctgacaggggcaaccgaaattcagacaagtggcacaacaaccatatttgccggacatctcaaatgtagactcaaaatggataaactcacattaaagggaacttcatatgttatgtgcaccggtagttttaaacttgaaaaggaagttgccgaaacgcaacatggtaccgttttagtccaggtaaaatatgaaggaaccgatgcaccttgcaaaatcccattctcaactcaagacgaaaaaggggttacgcaaaatggtcgtctaataaccgctaaccccatcgttacagataaggagaagccagtgaatatcgagacagaacccccgtttggtgaatcatatatagtcgtaggagcgggagaaaaggcactaaaactctcttggttcaaaaagggaagctcgatcggtaaaatgtttgaagcgactgcacgaggagccagaagaatggcaatcttgggagatacagcatgggacttcggaagtatcggaggtgtgttcacgtccgttgggaaacttgtgcaccaagtatttgggaccgcctatggagtcctttttagtggagttagttggacaatgaaaataggaattggcattctactcacgtggctcggcttaaactcccgtagtaccagcctgagcatgacctgcattgctgtaggaatggtgacattatacttaggtgttatggtacaagctgatagcggttgtgtaatcaattggaaaggaagggaattaaaatgtggttctggcatatttgttaccaacgaagttcatacatggactgaacaatacaaatttcaagcagattctccaaaacgtctctcggcggcaataggaaaggcttgggaagagggtgtatgtggaataagaagcgcaacgagacttgaaaatataatgtggaaacaaatatcgaacgaattaaaccatatactgttagaaaacgacatgaaatttactgtagtagtaggcgatgctaacgggattctggcccagggaaagaagatgattagaccccagccgatggaacacaagtactcatggaaaagctggggtaaagctaagataataggagcagatatacaaaacacaactttcataatcgacgggccagatacgccagaatgtccggataaccagagggcatggaatatatgggaagttgaggattatggctttgggatttttacaacaaatatatggctaaaattacgagactcgtatacgcagatgtgtgaccatcgattaatgtccgcagctattaaagattcgaaggcggtacatgcagatatgggttattggatcgaaagtgagaaaaacgaaacgtggaagttagcacgagcctcctttatcgaagttaaaacatgcacatggcctaaaagccacaccttatggagtaacggcgtattagagtcagaaatgataataccaaagatatatggaggtccaatcagtcaacataattacaggccaggttactttactcaaaccgctggaccttggcacttaggtaagctagaattagacttcgatttgtgtgaaggcacgacagtggtagtagatgaacattgtggaaatagaggaccaagtctaagaacgaccacagtaacgggaaaaataatccatgagtggtgttgcagaagttgtactctcccacctctaagattccgcggcgaggacggatgttggtacggtatggaaatccgacctgttaaagagaaagaggagaatttagttcgatctatggtatcagctggatccggagaagtagatagcttctcattaggaatactatgtgtaagtataatgattgaggaggtaatgaggtcgcgatggtcccgcaaaatgttgatgaccggcacactagctgtttttcttcttctagtaatggggcagcttacttggaacgatttaatacgactctgtataatggtcggggctaacgctagtgacagaatgggaatgggtactacatacctggcactcatggcaacgttcaagatgagaccaatgtttgcagttggcttactttttagacgtctaacatcacgagaggtcctattactgacgattggcctatcactcgtagcatcggtagaattaccaaatagtttagaagaattaggagatggtctcgctatgggtataatgatgctaaaattattaacagaatttcaaccacatcaattatggactactcttctatccctgacatttattaagacgactttgagtctagattatgcttggaaaaccacagcaatggcgctctcgatagtgtccttatttcctctgtgtctttcgacgacttctcagaaaaccacttggttgcctgtactactaggttcgtttggctgcaaaccactgacgatgttcctcataacagaaaataaaatatggggaagaaaaagttggccactcaacgaaggaatcatggctatcggtatagtaagcattttactttcgagtttgctaaagaatgatgtacccttagccggaccattaatagctggtgggatgttgatagcttgttacgttataagtggttcgtcggctgacttatcattggagaaagcagcagaggtatcttgggaacaagaagcagaacatagcggcaccagtcataatatcctagttgaagtacaggacgacggtacgatgaaaataaaagacgaagaaagagatgacacattaactatactgttaaaagcaacattattggcagtatcaggagtttacccaatgagcatacccgcgacattatttgtttggtacttctggcagaaaaagaaacaacgtagcggagtactttgggatacaccctcaccaccagaggtcgaacgcgctgttttagacgatggcatatatagaatattgcaacggggactattaggacgaagccaggtgggcgtcggtgtatttcaagacggagtctttcacacgatgtggcacgttacgaggggagcagtactcatgtaccaaggtaaaagattagaacctagttgggcaagtgttaagaaagacttaatttcatatggagggggttggagatttcaaggctcatggaatacaggggaagaagttcaagttatagcggtggaacccggcaaaaatccaaagaatgtacaaacgacaccgggcaccttcaaaactccagaaggagaagtaggggcgatagccttagactttaagccgggtactagcggtagccccattgtcaatcgtgagggcaaaattgtgggactatatggaaatggagtcgtgactacatccggaacttatgtatcagcgatagcgcaagctaaggcaagccaggaaggaccgttaccagaaatagaagatgaagttttcaagaaacgaaatcttaccataatggacttgcatccaggtagcggtaagacaagacggtacctacccgctattgtccgagaagctataaaaagaaagctacgaaccctaattcttgcacccacgagagttgttgctagtgaaatggcagaggctttaaaagggatgcctattagatatcagactaccgctgtaaaatccgagcataccggtcgtgagatagttgatctcatgtgtcacgcaacattcactatgagactcctgagcccggtcagagtaccaaactataatatgataatcatggatgaagcacattttacagatccggcaagcatagctgcccgtgggtacatctctacaagagttgggatgggagaggctgcggctatcttcatgacagcgacgccgccaggaagtgtggaggcatttccacagtcaaacgccgtgattcaagacgaagagagagatatacctgaaaggtcatggaactccggatatgattggattacagacttcccaggcaaaacagtatggtttgtaccttccattaagtctggtaacgatattgcgaattgtttgcggaaaaacggaaaaagagtaatacagctaagccgaaaaaccttcgacacagagtaccagaaaacgaagaacaatgattgggattacgtggttacaacggacattagtgagatgggtgcaaactttagagcagatagagtcatcgatcctagaagatgtctcaagccggtgatactgaaggatggaccagaaagagttattttagcaggtccaatgccagtcaccgtagcatctgctgctcaaagaaggggaaggataggtcgtaaccaaaataaagagggggatcaatacgtgtacatgggtcaaccgttaaataatgatgaggatcatgcccactggactgaggccaaaatgctcttggataatataaacaccccagaaggtattatccctgcgttattcgaaccagaaagagaaaagaatgcagcgatagatggtgaataccgcctcagaggagaagctaggaaaacatttgtcgaattaatgaggcgtggtgacttacctgtctggttaagttataaagtagcatcggaaggatttcaatactcagatcgaagatggtgcttcgacggagaaagaaataatcaagtgttggaagagaatatggacgttgaaatatggactaaagaaggagaacggaagaaattaagaccaaggtggttagatgctcggacatatagcgatcctctggcattacgagagtttaaagaatttgcagcaggtagacgctcggtttctggagatcttatacttgaaataggtaaattgccgcagcacttgacactgagagcacaaaatgcactagacaacctagtgatgctacataatagtgaacaaggtggtaaagcatacagacacgccatggaagaattacctgacacgatcgagactctaatgctcttagcgttaatagcagtattaacaggtggagttacattattctttttgtcagggaaaggacttggaaagacctcaattggactactctgtgtcaccgcctcctcggcgttattgtggatggcaagcgttgaaccgcactggatagcggcgtcaataatactagaatttttcttgatggtactactcatccccgaaccggaccgacaaagaactcctcaagacaaccaacttgcatatgtcgttattggtctgctttttatgatactaacagttgcagcaaacgaaatgggcttattagaaaccaccaagaaagacctcggtatcgggcatgtggccgcagagaatcatcaacacgccactatgttagatgttgatttacgaccagcctcggcatggaccttatacgcagtagctacaacagttatcacaccgatgatgcgtcacacgattgaaaatacgacggcgaacataagtttaacggcaatagcaaatcaagcagcgattttaatgggactagataaaggatggccaatttctaaaatggacataggagtcccgcttctagccttaggatgttatagtcaggtaaaccctctgacgttaactgcagcagtactaatgttagtcgcgcattatgcgatcataggcccaggcttacaagcgaaagcaacccgtgaagctcagaaaagaacggcagcgggaatcatgaaaaaccccacggttgatggtattgtagccatagatcttgatccagtcgtatacgacgcaaaatttgaaaaacaactgggacaaattatgcttctgatactatgtacgtcccaaatattacttatgaggaccacctgggctctctgtgagagcataacactagcaacaggccctttaacaacgttatgggagggaagcccaggaaaattctggaatacgacgatagctgtttcaatggcaaacatattcagaggcagttatctagctggtgctgggttggcattctccttaatgaaaagtctcggaggaggaagacgtggaacaggagctcaaggagagaccttgggagaaaaatggaaacgccaactgaaccaactttcgaagtctgaatttaatacgtataaacgatctggaataatggaagtcgatagaagtgaagccaaagaggggttgaaaaggggagagactacaaaacatgcagtaagtcgtggaactgcgaaacttagatggttcgttgaaagaaaccttgtaaaaccagagggtaaagtaatagatcttggttgcggaagaggtggttggagttattattgcgccggcttgaagaaagttaccgaagttaaggggtacacgaaaggaggaccgggtcatgaagaacctatcccaatggctacatatggttggaatttggtcaaactccatagcgggaaagacgtatttttcatacctcctgaaaaatgtgacacattattatgcgacattggagaatcatctcccaatcccacaatagaagaaggcaggacactaagagtacttaaaatggttgagccatggttgcgtggaaatcaattttgtattaaaatattaaatccatacatgccctcagttgtagaagcccttgaacaaatgcaaagaaaacacggagggatgttggtgcgaaatcctctatcgagaaattcaacccacgaaatgtattgggtaagctgcggtacagggaacatagtcagtgcagtaaacatgacttcacgaatgctactgaacagattcaccatggcgcatcgtaaacccacttacgaaagagacgtagacttaggagcaggtaccagacatgttgctgtcgaaccagaggttgctaatttagatataatcggacagcggatagaaaacatcaaaaatgaacacaaaagtacctggcactatgatgaagacaacccatacaagacctgggcataccatggtagttacgaggtaaaaccttcgggatcggcctcgagtatggtaaacggcgttgttagactattaacaaaaccatgggacgttattcccatggtaactcaaatcgcaatgactgacacgactccatttgggcaacaaagagtcttcaaggaaaaggtagatacgcggactccacgggcaaaacgcggaaccacgcaaatcatggaggtaacagcgaagtggttatggggtttcttaagtcgcaacaagaaacctcggatatgcacgcgagaagaatttacaagaaaagtacgatctaacgcggcaattggcgccgtttttgttgacgagaaccaatggaacagcgcaaaagaagctgtagaagatgaaaggttctgggatctagtccacagagaaagggaactacataaacagggcaagtgtgccacatgcgtctacaatatgatgggcaaacgagaaaagaagctaggggaatttggcaaggcaaaagggagtagagcaatctggtatatgtggttaggcgcacgatttttagagttcgaagcgctaggcttcatgaacgaagatcattggttcagccgcgaaaattccctgtcaggggtggaaggtgagggacttcataaattaggttatatattacgcgacatttcaaaaatacctgggggcaatatgtatgccgatgacactgctgggtgggatacgagaataacagaggatgacttacagaacgaagcgaagattactgaaattatggaacccgaacatgcacttctagctacatctatctttaaacttacatatcaaaataaagttgtgcgggtacaaaggccagctaaaaatgggacagtaatggatgtcattagtaggcgtgatcaaagagggtccgggcaagtaggaacttacggtttaaacacattcacaaacatggaagtacagttaataagacaaatggaatccgaagggatcttcttaccatcggaactagaaacacctaatctggcagaaagagtcttagattggttagaaaaacatggagccgaaagacttaaaagaatggctatatccggagacgattgtgtggtaaagcctattgatgatagatttgcaacggcattgactgcgctcaacgatatgggtaaggtaaggaaggacataccgcaatgggagcccagcaaaggatggaatgattggcaacaagtccctttctgttcgcaccactttcatcaactgataatgaaagacggaagagagattgtagttccatgccgtaatcaagacgagctcgttggacgagcccgggttagtcaaggtgcaggatggtctttaagagaaacagcatgtctaggtaaatcttatgcgcaaatgtggcagctgatgtattttcaccgtagggatctacgtctagcagcaaacgcgatatgctcagccgtacccgtcgactgggtacccacatctcgcacgacgtggtccattcatgctcaccatcagtggatgacaaccgaagatatgttaagcgtttggaacagagtatggattgaagagaacccctggatggaggataaaacccacgtaagttcttgggaggaagttccatatttagggaaaagggaagaccaatggtgtggcagcttgataggattgactgcccgagccacatgggcgacgaacatacaggttgcgattaatcaggtgagaaggcttataggaaatgaaaactatttggattatatgacttcaatgaagcgattcaaaaatgaaagtgaccctgaaggggcgctgtggtag

SEQ ID NO: 21284 - RNA, 9879 nt, synthetic construct
  misc_feature 1..9879: note = derived and/or modified CDS sequence (opt6) from DENV-1__KJ189335__SS-prME
  source 1..9879: mol_type = other RNA
agcgtcactatgttactaatgcttcttccgacggcactagcttttcatcttactacccgaggtggtgaacctcatatgatagtgtccaaacaagaaagggggaaaagtctactattcaaaacttcagcaggcgtcaatatgtgtacactaattgctatggatttaggcgaactctgtgaagatacaatgacttacaaatgtccgcagatcacggaagcggaaccagatgatgtagactgttggtgcaacgctacggacacatgggtgacatatggtacgtgcagtcaaacgggggaacatagaagagataaacgatcagtggcgttagcaccacatgttggcttaggcctagaaactagaacagaaacgtggatgtcgagcgaaggagcgtggaaacagatacaacgtgttgaaacttgggcactaagacacccaggcttcacagttatcgctttcttcttagctcatgcgataggaaccagtataacccaaaaagggataatttttatcttactaatgttagtaacaccatctatggcaatgagatgcgtaggaattgggaacagagatttcgtcgaagggttgtccggtgcaacgtgggtagatgtggtcttagaacacgggtcatgtgtcacaacaatggcgaaaaacaaacccactctagatatagaactgttaaaaaccgaagtaacaaacccagcaatactacgtaaactatgtattgaagcaaaaataagtaacaccacaacagactctagatgtccaacacaaggcgaagcaacacttgttgaagaacaagatgctaattttgtctgtaggaggacattcgtcgatcggggatggggcaacggatgtggactattcggaaaaggttccttgctaacatgcgcaaaattcaaatgtgtaactaaattggaaggcaaaatagtacaatatgaaaacctgaaatattctgtcatcgtaaccgtacatactggtgatcagcatcaagttggcaatgaaacaacagaacatggaacgattgcaacaataacaccacaagcccctacttcagaaatccaacttactgattacggagcactaacattagattgctctccacgtactggtctggattttaacgaaatggtcttacttacaatgaaggaaaagagctggcttgtacacaaacaatggttcttagatctgccacttccatggacaagcggtgcatcaacatcacaagaaacgtggaacagacaggacctgctagttacgtttaaaacagctcatgctaagaaacaagaagtagtcgttctgggcagccaggaaggagctatgcataccgcactaacaggagcgaccgaaatccaaacgtctggcacaacgacgatatttgcaggacatttaaagtgtcgattgaagatggataagttaacgttgaagggaaccagttacgtgatgtgtacaggttcattcaaactcgaaaaagaagtagctgagacgcaacatggaactgtcttggtacaggttaagtatgaaggtaccgacgcaccatgcaaaattccatttagcacccaagatgaaaaaggcgtcactcaaaatggtcgtctcattacggccaatccaattgttacagataaagaaaaacctgtgaatatagaaactgaacctccgttcggagaatcgtatatagtagtaggtgcgggcgagaaggcgttaaaactcagttggtttaagaaagggagttctatcggtaaaatgtttgaagcgaccgcaagaggggcaagaagaatggctatacttggagatacagcatgggattttggatctataggaggggtctttacttcggttggaaagttagtgcatcaagttttcggaacagcctatggcgttctcttcagtggcgtgtcctggacaatgaaaatcggcataggtatactacttacatggcttggactaaactcacgtagtacatcactttctatgacctgtatcgcagtagggatggtaaccctctatctaggagtaatggtacaagctgacagtggatgtgtaataaattggaaaggcagggaattaaagtgtggctccgggatcttcgtaacgaacgaagtacatacatggacagaacaatataaatttcaagccgatagtccaaaacgtttatcagctgctatagggaaagcatgggaagaaggcgtctgtggtatcagatcagcaacaagattagaaaacattatgtggaagcaaataagcaatgaattaaaccacattttacttgaaaatgatatgaaatttactgttgtagtaggggacgcgaatggaatactagcccaaggaaagaaaatgatccgtcctcagcccatggaacacaaatacagttggaaaagctggggcaaggcaaaaatcataggagccgacatacagaacacaacgtttattattgacggacctgacacacccgaatgccctgacaaccagagggcatggaatatatgggaagtagaagattatggatttggcatattcacgactaacatatggttaaagttacgtgatagctatacacaaatgtgcgaccatcgactaatgtccgccgcaattaaggactcaaaagcagtacatgctgatatgggatattggatcgaaagtgagaaaaacgaaacttggaaactagcacgagccagctttatagaagtaaaaacctgcacttggccaaaatcccacactctttggtcaaacggagttctagagagtgaaatgattatacctaaaatttatggaggccccatatcacaacataactacagaccaggttacttcacacaaacagcaggcccgtggcatttaggaaaacttgaacttgattttgatctctgtgaaggcacaacagtagtagtagacgaacattgcggaaataggggtccatctttaagaacaacaacggttactgggaagattattcatgaatggtgctgtagatcatgtactctacctcccttaagatttagaggtgaggacggttgctggtatggcatggaaatccgaccagtaaaagagaaggaggaaaacttggttaggtcaatggtatctgcaggttccggtgaagtggattcgttttcgttaggtatcttatgcgtgagtattatgattgaagaagttatgcgctcacgatggagtagaaaaatgttgatgacgggcacattggctgtctttcttctattagttatgggacaactaacgtggaatgatctaatccgcctatgtataatggtgggagctaatgcaagtgataggatgggtatgggcacaacttacctagcgctaatggccactttcaaaatgcgaccaatgtttgcagtcggattattgttccgaaggcttacctccagagaagtattactacttacaattggtttgtctctagtggctagtgtcgaattacccaattcattagaggaattaggggatgggttagccatgggtatcatgatgttaaaactattaaccgaatttcaacctcaccaattatggacaacccttttaagtctaactttcataaaaaccacactgtctcttgattatgcatggaaaaccacagctatggcgttgtctatagtaagcctcttccccttatgtttaagtacaacttcacaaaagacaacatggttaccagtacttctagggagctttggatgtaaaccattaactatgttcttaataaccgaaaacaaaatctggggaagaaaaagctggccactgaacgagggaataatggcaatcggtattgtgtctatcctgcttagttccctactcaaaaacgatgttcctctagcaggtccattgatagcagggggtatgcttattgcttgctatgtcatttctggatcaagtgccgacctgagcttagaaaaggcggcagaggtgagctgggaacaggaagctgaacacagtggtacgagtcataacatattagtagaagtacaagatgacggaaccatgaaaataaaagatgaagaaagagatgacacactaacaattctattaaaagcaactctcttagctgttagtggagtatacccgatgtctataccagctactctatttgtctggtacttttggcagaagaagaaacagcgtagtggagttctgtgggataccccaagcccaccagaagttgaacgagctgtactagatgatggtatttaccggatcttacagagaggacttctcggtagatcgcaagtcggcgttggggtatttcaagacggagtatttcatactatgtggcacgtaacaagaggagcagtacttatgtatcaagggaaacgattagagccgtcttgggcctcagtgaagaaggaccttatcagctatggaggagggtggagattccaagggagttggaataccggtgaggaagtacaagtgatcgcggtagaaccaggtaagaatcccaaaaatgtacaaactactccaggcacatttaaaaccccggaaggtgaggtaggggcaatcgccttggatttcaaacctggaacgagcggttcgccaatagtcaatcgagagggcaaaatcgtaggtctgtacgggaatggagtcgtaactacaagtggaacttacgtgagtgcgatagcccaagctaaagcatcacaagaaggtccactaccagaaatcgaagatgaagttttcaagaaacggaacttaactatcatggatttacatcctggttctggaaagacaaggcgttacctaccagcaatagttcgagaagcaataaagaggaaactgaggacattaatactagcacctacacgagtagttgcttcagaaatggcagaggcattgaaaggcatgccaattaggtatcagacaacagcggttaaaagtgagcacacaggaagagagattgtagatttaatgtgtcacgctacctttacaatgcgccttcttagtcccgttcgagttcccaattacaacatgatcattatggatgaagcacactttacggaccccgccagcattgctgcgcgaggttacatatctacacgagtgggtatgggcgaagccgcagctattttcatgactgccaccccacccgggagtgtggaagcattcccccaatccaatgcagtcatccaagatgaagaaagagacataccagaaagatcttggaactctggatatgattggatcaccgattttccggggaaaacagtctggttcgtacccagtataaaatcaggaaatgacatcgcaaattgcttacgtaaaaatggcaaacgtgtaatacaactctcacggaaaacctttgatactgaataccagaaaactaaaaataatgattgggactatgtagtgactactgacatatcagaaatgggagctaatttcagagctgatcgcgtcatcgaccctcgccgatgcctgaaaccggtaatattaaaggatggcccggaaagagtcatcttagctgggcctatgcctgtgacagttgcctccgctgcacaaagaagaggtagaatcggacgaaatcagaacaaagagggggatcaatacgtgtacatgggacaaccactaaataatgatgaagatcatgcccattggacagaggctaaaatgctattagacaacattaacacaccagagggaataatacccgcgttgttcgaacctgaaagagagaaaaacgccgcaatagacggggagtatagactgcgaggggaagcccgcaaaacattcgtagaacttatgcgtcgtggagacttgccagtatggctaagctacaaagtagccagcgaggggtttcagtattcagatcgccgttggtgcttcgacggggaacgtaataaccaagttctggaagagaatatggatgtagagatatggactaaagaaggtgaaagaaagaagttacgccctcgctggctcgacgcaaggacatacagtgaccctttagccctaagagaatttaaagagttcgcagcaggtagaagatcagtatctggagatttaattttagaaataggtaagttaccacaacatctaactttacgtgcgcaaaacgcactggataacctagtaatgctacataactcggaacagggaggtaaggcttatcgtcatgctatggaggaactacccgatacaatagaaaccttaatgttacttgcactaattgccgtcctgaccggaggagtaactttgttctttctgagcggaaaggggttaggaaaaacatccatcggattactatgcgttacagcttctagcgcactactttggatggcatcagtagagccacattggattgccgcatcaattatacttgagttctttctaatggtgctccttattccagaaccagacagacagcgcacaccccaagacaatcagctagcatatgtagtaatcggcctattatttatgattttaaccgtagctgctaatgagatggggctcttagaaaccacgaagaaggatttaggaatagggcacgtagctgcagaaaaccatcaacacgctactatgctcgacgttgacttgagaccggcatctgcatggactctatacgcagtagcaacaaccgtcataaccccaatgatgagacataccatagaaaacacaaccgcaaacatcagcctgacagcgattgctaaccaggcagctattctgatgggattagataaaggatggcctatttctaagatggacataggtgtcccattgctcgctttaggttgttactcccaagtaaatccgctaacactgactgctgcagtactaatgctggtcgcccattacgccataataggtcctggtcttcaagctaaagctactagggaagcacagaaaagaacggcagcaggaattatgaaaaatccaactgttgatggtatagtagctattgatctagatccagtagtatatgacgctaaattcgaaaagcaattaggtcaaataatgcttttaattctttgtacgtcccaaattctattaatgagaactacttgggccttatgcgaaagtattactttggcgaccggtccactgacaaccctttgggaaggtagccccgggaaattctggaatacaactattgccgtttcgatggcgaatatctttcggggcagttatttggccggtgcaggtctcgcttttagtttaatgaaaagtctaggtggaggccgtcgaggaactggtgctcagggtgaaaccctaggtgaaaaatggaaaaggcagttaaaccaactatctaaatctgaatttaatacatataaacgcagcgggataatggaagttgatagaagcgaagcaaaagaaggattgaagcggggcgaaacaacaaagcacgcggtatctaggggaacagctaaattaaggtggtttgtagaaagaaacctagttaaacctgaaggcaaagttatagatctaggctgcggtcgaggaggatggtcgtactactgtgccgggctaaagaaggtaactgaggtgaaaggctatacgaaaggcggtcctgggcacgaagaacccatacccatggccacatatggatggaatctagttaagttacacagtggtaaagatgtattctttatacccccagaaaaatgcgatacactattgtgcgacataggagaatcttccccaaacccaacaatcgaagagggtagaacccttagagtactaaaaatggttgagccatggttaaggggaaatcaattctgcataaaaatcttgaatccttatatgccaagtgtagtggaagccttggaacaaatgcagcggaagcatggtgggatgctagtacgaaatccacttagccgaaactccacccatgaaatgtattgggtctcgtgtggaactggtaacattgtctcggccgtcaatatgacaagtagaatgctgcttaacagatttacaatggcacataggaaacccacatatgaaagagacgtcgacctcggggcaggtacccgtcacgtagcagttgaaccagaagtggcgaatttagatataattggtcagaggatagaaaacataaagaatgaacacaaaagtacttggcactatgatgaagataatccctacaaaacatgggcttaccacgggagctacgaggtaaaaccaagcggaagcgcaagttcgatggttaatggtgtggtccgattactaacaaaaccctgggacgtgataccgatggtaactcaaatagcaatgacagacactactccgttcggtcagcagcgtgtgtttaaagaaaaggtggataccagaacaccgcgcgcgaaaagaggtaccactcaaataatggaagtcacggctaaatggctgtggggcttcttatcacgaaataagaaaccaagaatatgcacacgtgaagagttcactcgtaaagttagatcgaacgccgcaatcggtgctgtatttgtcgacgaaaaccagtggaactcagcaaaggaagctgtagaagatgaaagattctgggatttagtacatagagaaagagaattacataaacaaggaaaatgtgctacatgcgtatataatatgatggggaaaagagagaagaaactcggtgagttcggtaaagcaaaaggaagtagggcaatatggtatatgtggcttggagcaagatttctcgagttcgaagcacttggatttatgaatgaagaccattggttctctcgagagaatagcctttcaggagtggaaggtgaaggacttcataaactaggatatatattacgtgatataagcaaaattccaggcggcaatatgtatgcagatgatacagccggttgggacactagaataacagaagatgacctacaaaatgaggctaaaattacagagatcatggagcctgaacatgcgctgctagccacatccatcttcaagctcacctaccaaaacaaagtcgttcgggtccaacgtcccgcaaagaatggaactgtaatggatgtgattagccgcagagaccaacgaggatcaggccaagtcggcacatatggattaaatacttttactaacatggaggttcaacttatacggcagatggaaagtgaagggatattcctcccatcggagcttgagactccaaatctagcagaacgagtattggactggctagaaaaacatggagccgaacgactcaaacgcatggcaatatcgggggacgattgcgtagtgaaacccatagacgaccggtttgcaactgctctaacagcgctaaacgatatgggtaaggtcagaaaagatattccacaatgggaaccgtccaagggatggaacgactggcagcaggtcccattttgttcgcatcacttccatcaactaattatgaaagatggcagggaaattgtagtaccctgcagaaatcaagacgagttggtaggacgagcacgggtatcacaaggcgcgggttggtcattacgggaaacagcatgtctagggaagagttatgcccaaatgtggcaattaatgtactttcatcggcgtgatctaaggctcgccgcaaatgcgatatgttcagcagtgccagtagattgggttcctacttcccgaaccacttggtcaatacatgctcatcatcagtggatgactaccgaggatatgctatcagtttggaatcgcgtctggattgaagaaaatccatggatggaagataaaacacatgtaagctcctgggaagaggtgccttatctagggaaaagggaggatcaatggtgcggatctttaataggcctcacagcgcgcgccacttgggcaacgaatatacaggtagcaataaatcaggtacgcaggctaatagggaatgaaaattatttagattacatgacatcaatgaaacgttttaaaaatgaaagtgatcctgaaggtgctttgtggtaa

SEQ ID NO: 21285 - RNA, 9879 nt, synthetic construct
  misc_feature 1..9879: note = derived and/or modified CDS sequence (opt6) from DENV-1__KJ189336__SS-prME
  source 1..9879: mol_type = other RNA
agcgttactatgttattaatgttacttccaactgcacttgcatttcatttaacaactcgtggaggagaaccacacatgatagtgagcaaacaagaaagaggtaaaagtttacttttcaaaacgagtgcgggagttaatatgtgtacattgatcgcaatggatctaggtgaactatgtgaagatacaatgacttataaatgcccgcaaattacggaggcggaaccagacgatgttgattgttggtgcaatgcaacagacacgtgggtaacatacggtacgtgctctcaaacgggtgaacacagaagagataaaaggtcagtggcattggcaccgcacgtaggattgggattagaaacaagaacagaaacgtggatgagtagtgagggggcttggaaacaaattcaacgcgtcgaaacatgggcccttaggcatcctggatttactgtaatcgcactatttctggcgcatgcgataggaacatctataacccaaaaaggaatcatatttatacttctcatgctcgtgacccctagtatggcaatgagatgcgtaggaattggtaacagagactttgtggagggactctccggagctacatgggtagacgtagtgctagaacacggctcatgcgtaactacaatggcgaaaaataaaccaacactagacattgaattactaaaaactgaggtaacgaatccagccatattaagaaaactatgtatcgaagccaaaatatcaaataccactaccgattctcgatgccctacgcaaggtgaagcaacactcgttgaagaacaagatgctaacttcgtttgcagaagaacattcgtcgacagaggatggggaaacggatgcggcctttttggcaaaggcagtctattaacctgcgcaaaattcaaatgcgtaaccaaactagaggggaaaattgtacaatatgaaaacctaaaatacagtgttatcgtaactgtccatacaggagaccaacatcaagtcggtaatgaaacaacagaacacggcactattgctacgataacgccacaagctcctacaagtgaaatacaactaacagattacggtgctctcactttggattgttctcctcgaactggtctagattttaatgaaatggtacttcttacaatgaaagaaaaatcctggctcgtacataaacaatggtttttagacttacctctaccttggacaagcggagccagcacgagtcaagaaacatggaatcgacaagacttattagtcacgtttaaaactgcacatgccaagaaacaagaggtcgttgtactaggatcacaagaaggtgcaatgcacactgccttaacgggcgctacagaaatacaaacaagtgggacaactactatatttgcaggtcatttaaaatgccgcttaaaaatggataaattgactcttaaaggaacttcttacgtgatgtgcacaggaagtttcaaattagagaaagaggttgccgaaacacaacatggaacagtattagtgcaagtaaaatacgaaggaactgatgctccgtgtaaaatacctttctcgacacaagatgaaaaaggcgtaacacaaaatggaagattaattacagcaaacccaatagtaactgataaagaaaaaccggtaaatatagaaaccgaacctccgtttggagaatcttatatagtcgtaggtgcaggcgaaaaagctcttaaattatcgtggtttaagaaaggttcatcaattggaaaaatgtttgaagccacagctcgaggtgcaagacgaatggcaatccttggggacactgcatgggatttcggatcaatagggggtgttttcacctctgtaggaaaattggtacaccaggtattcggtaccgcatacggcgtcttattctcaggtgtttcgtggactatgaagatagggattggcatacttctgacatggctcggtctaaacagtaggtccaccagcctttcaatgacatgtatagcagtaggcatagtaaccttatatttaggagtaatggtacaggccgatagcgggtgcgtgataaattggaaaggcagggaattaaaatgtggtagtggcattttcgttactaatgaagttcacacgtggaccgaacaatataaatttcaggcggatagtccaaaacgccttagtgcagcgataggtaaagcatgggaggaaggggtatgtgggatcaggagtgccaccaggttggaaaatataatgtggaaacaaatatcgaatgagttaaaccatatacttctggaaaatgatatgaagtttacagtagtagtgggtgatgccaacgggatattagcgcagggtaagaaaatgatacgtccacagccaatggagcacaaatactcatggaaaagctgggggaaagcaaagattatcggtgcggatatacagaacaccacattcataattgatggtcccgatactccggaatgccccgataatcaaagagcttggaatatttgggaagttgaggactatggctttgggattttcacgacgaatatatggctaaaactcagggattcttatacccaaatgtgcgaccaccgacttatgagtgctgcgattaaagattcaaaagcagttcacgcagacatggggtactggatcgaatccgagaaaaacgaaacttggaaactagctagagcgtcgtttatcgaagttaagacttgtacatggccaaaatctcatacattatggagtaacggagtacttgaatcggaaatgattattccgaaaatatatgggggaccaatttcccaacacaactacagacccggatatttcacccaaactgcaggaccatggcacttaggaaaacttgaattggactttgatctatgcgaaggtactactgttgttgtagatgaacattgtggaaatagggggcctagcttgagaactacgacagttacaggtaagataattcatgaatggtgttgtagatcctgcacattgccgccattaagatttagaggagaagatggatgttggtacggaatggaaatacgcccggtaaaagaaaaggaagaaaacctagtacggtctatggtctcggcagggtcgggtgaagtcgacagtttctccctaggtatactttgcgtcagtataatgatagaggaagtcatgaggtcgagatggagtcgaaagatgctcatgacaggaactttggcagtttttctactgttggtcatgggccaactaacctggaatgatctgatacgactttgcataatggtcggcgctaacgccagtgatcgcatgggaatggggacaacttatcttgctttgatggccacttttaaaatgaggcctatgtttgctgtaggtttactctttagaagactgacttccagagaagtactattattaacgataggtttatcattggtagcaagtgtcgaattgcccaattcattagaagaactcggcgatggactggcgatgggaataatgatgctcaaactattaacggagtttcaaccacatcaactgtggactacgcttttatcacttacctttataaagacaactttaagtctagactatgcctggaaaaccaccgctatggcacttagtattgtttccttattcccgctatgcttgtcaacaacatcacagaaaacaacttggcttccagtcttgcttggatctttcggctgtaaaccattaacaatgttcttaataactgaaaataaaatatgggggagaaaatcctggccgttgaatgaaggcattatggcgatcggaatcgtgagtatattactttcttctctattaaagaatgatgtccctttagcgggaccattaatagcgggtggtatgttaatagcttgctatgtaatttctggaagctctgctgatctgtcattagaaaaagctgccgaagtatcttgggaacaggaagctgaacactcggggacaagtcacaacatattagtagaggtgcaggatgacggcacaatgaaaattaaggacgaagaacgtgatgatacgctgacgatattactgaaagcaacactcctggcagtgagcggcgtgtacccaatgtctattcctgcaacactcttcgtttggtatttctggcagaagaagaaacaacgctcaggagtgctttgggatacgccgtcacctccggaggttgaaagggcagtactggatgacggtatttacaggatattgcagagaggtctcttaggacgaagtcaggtaggagtcggtgtttttcaagatggcgtgttccacacgatgtggcatgtgacaagaggagcggtattaatgtatcagggaaaaagacttgagccatcatgggcaagcgtaaagaaagacttaataagttatggagggggctggcgatttcaaggaagctggaacacaggtgaagaagtgcaagtaattgcagtggagccaggcaaaaatcccaaaaatgtccagacaaccccagggacattcaaaacaccagaaggcgaagtgggtgcaatagctttggactttaaaccaggcacgtcaggttcaccaatcgtaaatcgtgagggaaaaattgtggggttatacggaaacggagttgtaacaactagcggtacttatgtgagcgcgattgcgcaagccaaagctagtcaggaaggaccattgccagaaatagaggatgaagtttttaagaaaaggaatttgactataatggacctacatccgggaagtggtaaaacaagacgctacttgccagcaatagtgcgcgaagccataaagagaaaacttcgaacattaatactagcgccaactagagtggtggcgtcggaaatggctgaagccctcaaaggcatgcctataagataccaaaccacggcagtcaaatccgaacacacgggtagagagattgtagatctaatgtgtcacgcgacattcacgatgcgccttctttcccctgtaagagttccaaattacaacatgataattatggatgaagcacattttaccgatcctgcatccatagcagcacgaggctatatttctactcgagttggaatgggcgaagcagctgcaatatttatgactgctacccctcctggaagtgtagaagccttcccacaaagtaacgccgttatccaagatgaggaaagggatataccggaaagatcatggaactcaggttatgattggataacagatttccctgggaaaacagtctggtttgtcccttccatcaagtcaggtaatgatatcgctaattgtttacgtaagaacggtaaaagagtaatacaactctcacgcaaaacgttcgatacagaataccagaaaaccaaaaataatgattgggactacgtagttacaacggatatatcagaaatgggcgctaattttcgagcagatagagttattgatccccgacgctgtcttaaacccgtaattctgaaagatggcccggaacgtgtaatattagccggaccaatgcctgttaccgttgcctctgcggcccaacgacgcgggaggattggtcgcaatcagaataaagagggagatcagtatgtgtacatgggacaacctctaaataacgatgaagatcatgcacactggacggaagcgaagatgctccttgacaatataaacacgcctgagggaataattccggccctcttcgaaccagagagggagaagtccgcagctatagacggagaatatcgattgagaggtgaggccagaaaaacattcgttgagctgatgcgaagaggtgatttacctgtatggctttcttataaagtagcaagcgaaggctttcaatatagtgatcgtagatggtgctttgacggagagcgtaataaccaagtcctagaagaaaatatggatgtagaaatatggacaaaagaaggtgaaagaaagaaactgaggccgcgatggttagatgctcgcacctattcagatccactcgcactcagagaatttaaagaatttgctgcgggacgtagaagtgtttctggtgatctaattcttgaaattggaaaactaccgcagcacttgacattaagggctcaaaacgctctcgacaatttggttatgttgcataatagtgaacaaggaggtaaagcatacagacatgcaatggaagaattaccggacacaattgaaacccttatgcttttagcgttaatcgcggtactcacagggggtgtaacattgttctttttatcaggcaaaggactaggcaaaacaagcataggattattgtgtgtaacagcaagttctgctctcttatggatggcatctgtagaaccacactggatagctgcaagcattatattagagttctttctaatggttttactgataccagaaccagatagacaacgaactccacaagataatcaactagcatacgttgtaatagggctgctgttcatgattctaacggtggcagcaaatgaaatgggcttgttggaaacaacgaagaaagacctgggaattggacatgttgccgcggaaaatcaccagcatgccacaatgctagatgttgacttacgcccggcgagcgcgtggactttatacgctgtagcaacaacggtaataactccaatgatgaggcacactatagaaaacactacagcaaatattagcctaactgctatcgccaatcaagccgccattctaatgggtctcgacaaagggtggcctatctccaaaatggatataggtgttcctttattggctctcggctgttacagtcaagtgaatcccttaactcttactgcagccgttcttatgttagttgcgcattatgcaataattggaccaggtcttcaagcaaaagcgactagagaagcgcagaaacgaacagcggctggaattatgaaaaatccaacagtggatggaattgtggcaatcgatctggatcccgtggtgtatgatgccaaatttgaaaaacaattgggacaaatcatgttactgattctctgtaccagtcaaatattattaatgagaactacatgggctttatgtgaatcaataacgctggcaaccggaccattaacaacattatgggaaggttcacccgggaaattctggaataccacaatagctgtaagcatggcgaatatattccgcggctcttacctagctggagctggattagcgttctcactaatgaagagtcttggaggcggtcgccgaggtactggtgcccaaggtgaaacacttggtgaaaaatggaagcgacaactaaatcaattgagtaaaagcgaatttaatacatataagcgatccggaattatggaagtggaccgcagcgaagcaaaggaaggtctaaaacgcggagaaactacaaagcacgcagtatccagaggaacagctaaactcagatggtttgttgaaagaaacctagtgaaaccagaaggaaaagtaatagatctcggatgcggacggggcggatggtcatactattgcgctggactcaagaaagtaacagaggtaaaaggatacaccaaaggaggacctgggcacgaggaacctatacctatggcaacatatgggtggaacttagtaaaactacacagcggaaaagatgtgtttttcatgccacccgaaaaatgtgatacattgttgtgtgatataggggaatcgagccccaatcccacgattgaagagggaagaacattaagagttctaaagatggtagaaccctggttgaggggaaatcagttttgtataaagatcttaaatccgtatatgccatccgtagtggaggctttggaacaaatgcagaggaaacacggtggcatgctcgtaagaaaccctttatcacgcaattcaacacatgaaatgtattgggtttcatgtgggacaggcaacattgtatctgcagtaaatatgacatcacggatgctattaaataggtttactatggcgcatcggaagcccacttatgaaagagacgttgatttaggtgcaggaactagacacgtagcagtggagcctgaagtcgcaaacctggatataataggacaaagaatagaaaacattaaaaatgaacacaagtcaacatggcactatgatgaagataacccctacaaaacttgggcgtaccatggatcatacgaggttaaaccaagcggcagtgcctctagcatggtaaatggcgtagtaaggctactgactaaaccgtgggacgttatcccaatggttacccaaatagcaatgacggacacaacacctttcggacaacaaagggttttcaaggagaaagtggatactagaacaccccgtgcaaagaggggaactacacagattatggaggttacggcgaagtggctatggggtttcctatcaagaaataaaaagcctcgcatctgtaccagagaggagtttaccaggaaagtcagaagtaatgcagcaataggagcagttttcgttgacgaaaaccagtggaatagcgcaaaggaagcagtagaagacgaacgcttttgggaccttgtacacagagagcgagaattgcacaaacaaggaaaatgtgccacatgtgtatacaacatgatgggaaaaagagagaagaaattaggtgagttcggcaaggcaaaaggtagtagagctatatggtacatgtggttaggcgcccgatttttagaatttgaagcattaggattcatgaatgaagatcactggttcagcagggaaaattccctgtctggagttgagggagagggattacacaaactaggatacatcctcagagatatctcaaaaatacccggaggcaatatgtacgcagatgatacagcaggatgggacaccaggatcacagaggatgatttgcaaaatgaggccaaaatcacagagataatggagccagaacatgctttattggcgacaagtatatttaaacttacatatcaaaacaaagtcgtacgagtccagcgacccgccaaaaatggaaccgtaatggatgttattagccgtagagaccaaagaggtagtggtcaagtaggaacatacggccttaacacattcactaatatggaggtgcaattaatccgtcaaatggagtctgaaggaattttcctaccatcggaactcgaaactcccaatctggctgagagggtactagactggttagaaaagcatggagcagaacgactaaaaagaatggcaatttcaggggacgattgcgttgtcaagcctattgatgaccgttttgcgacggcactaacggctctaaatgatatggggaaagtaagaaaagatatacctcaatgggaaccaagtaaaggttggaacgattggcaacaagtacctttctgttcacatcacttccatcagcttataatgaaagacggacgtgaaatagtagtcccctgtagaaatcaagacgaattagtgggtagggctagggttagtcaaggcgctggatggtcgttacgggaaacagcctgtttagggaaatcctatgctcaaatgtggcaattgatgtactttcacagaagagatttacgactcgcagctaatgctatatgctcggcggtcccagtggattgggtacctaccagtagaacaacatggagcattcacgcacaccatcaatggatgacaacagaggatatgctttcagtctggaatcgcgtctggattgaagaaaatccatggatggaagataaaactcatgtatcatcctgggaggaagttccatatttagggaagagggaagatcagtggtgcggttcacttattggactaaccgctagagccacgtgggctacaaacatccaggtagccatcaaccaagtcaggagattgattggaaatgaaaattacctagattatatgacgtcgatgaaaagattcaagaatgaatctgacccagagggtgccctttggtaa

SEQ ID NO: 21286 - RNA, 9879 nt, synthetic construct
  misc_feature 1..9879: note = derived and/or modified CDS sequence (opt6) from DENV-1__KJ189337__SS-prME
  source 1..9879: mol_type = other RNA
tctgtgactatgttattaatgttactaccgacagcactcgcatttcacctaacaacacggggtggagaaccacatatgatagttagcaaacaagaaagagggaaatccttactatttaaaacatcagcaggagtcaatatgtgtacgctcatagcaatggatttgggggaattgtgtgaagacactatgacatataaatgtccgcaaataacagaagcagaaccagatgatgtcgactgctggtgtaacgctacagatacttgggtcacatacggaacatgttcacaaactggggaacatagaagagacaaacgaagcgttgctttggccccacatgtgggtcttgggttagaaacgaggacagaaacgtggatgtccagtgaaggtgcctggaaacaaatacaacgagttgaaacttgggccttgagacacccaggatttacagtaatagcgttatttttagcgcatgctataggaacatcaataacgcaaaaagggattatattcattcttctaatgttggtcacaccatcaatggcaatgcgatgcgtggggataggaaatagagatttcgttgagggtttatctggcgcaacatgggtggatgttgttcttgaacatgggagctgtgtgactactatggctaaaaataaaccaacattagatatagaactcctgaaaaccgaagtaaccaaccctgccatattaagaaaactgtgcatagaagccaaaatctcaaatacaacgaccgattctcgatgtccaacacaaggtgaagcgaccctagttgaagaacaagacgccaatttcgtatgcagaagaacttttgttgatagaggctggggaaacggatgtggactatttggtaaaggttcattacttacttgcgcgaaatttaaatgtgtcacaaagctcgaaggaaaaatagtacaatatgaaaatctaaaatacagcgtaatagttacagttcacacaggagatcaacaccaagtgggtaatgagaccacagaacatggaacaatagccacgatcacacctcaggctcccacttcggaaattcagctcaccgattacggtgcattaaccctcgattgcagcccacggactggacttgattttaatgaaatggtcttactaacaatgaaagaaaagagttggcttgtccataagcaatggttcttagatctgcctttaccttggacctcaggggctagtacatcgcaagagatatggaacagacaagatttacttgtaactttcaaaacagcccacgcaaagaaacaagaagtggtagtgctcggaagccaggaaggtgcaatgcacactgcattaacgggagcgactgagatacaaacgtcaggaacaacaacaatatttgccggccatttaaagtgcagactcaaaatggataagctaactctaaagggtacgtcatatgttatgtgtacaggttcattcaaattagaaaaagaagttgccgaaactcaacatgggacggttctggtacaagtgaagtatgaaggaactgatgcaccttgcaaaataccctttagcacgcaagacgaaaagggtgtcacccagaatggcagactgatcacagctaacccgattgttactgacaaagaaaagccagtaaacattgaaaccgaaccgccatttggcgagagctatatagtagtcggggcgggagaaaaagctctgaagttgtcatggtttaagaaaggttcttctattggaaaaatgttcgaagctaccgctcgtggcgctagaagaatggctattttgggcgatacagcatgggactttggctcaatcggaggtgtgttcacctctgttggaaagttggtccaccaagtattcgggacagcatatggggttttatttagcggagtaagctggaccatgaaaataggcataggcatattgttgacttggttagggcttaatagtaggtcgacatctttatccatgacctgcatagctgtaggtatggttactttatatctgggagttatggttcaggcggattccggatgcgttatcaactggaaaggcagagaattaaaatgcggaagtggaatatttgttacaaatgaagtacacacgtggacagaacaatataaatttcaagctgattcgccaaagaggctatcagcagcaatcggaaaggcttgggaagaaggggtttgtggtatccggtcagctacgcggctagaaaacataatgtggaaacagataagtaatgaattaaatcacattctattagaaaatgatatgaaatttactgttgtcgtaggagacgctaacggaatcttagcgcaggggaagaaaatgataagaccgcaaccgatggaacataaatacagctggaaaagttggggcaaagctaaaattatcggggcagatatacaaaacactacttttatcatagacgggccggatacaccggaatgtcctgataaccaacgtgcatggaacatatgggaagtcgaagattatggatttggcatttttacgactaatatatggctaaaattacgagactcatatacacagatgtgcgaccatagattaatgtcagcagctatcaaagattcaaaagctgttcacgccgacatgggctattggatcgaatccgaaaagaatgaaacatggaagttagcgcgagcttcgtttatcgaagtaaaaacgtgtacgtggcccaagagccatacactttggtcgaacggagttttagagtcagaaatgattattccaaaaatatacggaggaccaatatcccaacataattacagacccgggtatttcacgcaaacagcaggtccttggcacctgggaaaacttgaattagatttcgacctgtgcgaaggtactacagttgtcgttgacgaacattgcggaaatagaggaccatcacttcgtacgacgaccgtgacgggtaagataatacacgagtggtgctgtaggtcatgtactctgccaccactaagatttcgtggtgaagacggatgttggtatggtatggaaataaggcctgtaaaagaaaaggaagagaatctagtccgttcgatggtatctgcggggtccggtgaagttgactcatttagtttaggaatactttgtgcatcaataatgatagaagaggtcatgagaagcagatggagtagaaagatgttaatgactgggacgttagcggtattcctgttactaataatgggacaattaacatggaatgatcttattcgcctttgtataatggtcggggcaaatgcctccgaccgcatgggaatgggcacaacatatttagctctaatggcaacgttcaagatgcgccctatgttcgcggttggattattatttagacgattaaccagccgtgaagtcctcttactaacaataggcctatcactcgtggcaagtgtcgaattaccaaattctctagaagaactaggagacggattagcgatgggtatcatgatgttaaagctgcttacagaatttcaacctcatcaattatggacaacactattgtcattaacatttataaaaacgacattatctttagattatgcctggaaaacaaccgctatggcactatcaatcgtaagcctattcccactatgcttatcgacgacgtcccaaaagacaacgtggttaccagttttactaggaagttttggatgcaaaccgctcacaatgtttctaatcacagaaaacaaaatatggggtcgaaaaagttggccactaaacgaaggtataatggcaataggaattgtaagtattctcttgtcaagcctgcttaaaaatgatgtacccttggcaggtccattaatagccgggggaatgttaatcgcatgttacgttataagtggaagttctgcagatctgtcgctagagaaagccgctgaggtgagctgggaacaagaggccgagcatagtggcacaagccataacatcctagttgaggtacaagatgatggaacgatgaagataaaagatgaagaacgcgatgacacattaacaatcttgctaaaagcaacacttctcgccgtttctggcgtttatccgatgagtatcccggccacactatttgtttggtacttctggcagaaaagaaaacaaagatcaggagtactgtgggatacaccgtctcccccggaagtggaaagggcagtactagatgatgggatctatcgaatattacaacggggcctactcggtcgttcgcaagtaggggtcggggtatttcaagatggtgtcttccatacaatgtggcacgtaacgcgaggtgcggtgttaatgtaccaaggaaaaagactcgaaccaagttgggcaagtgttaagaaagacctgatctcgtatgggggagggtggagatttcaaggtagctggaacacaggtgaggaagtccaagtaatagcagtcgaaccaggaaagaatccgaaaaatgtgcaaactactccgggaacgttcaaaactcctgaaggagaagtcggtgctatagcactagactttaaaccagggacaagcggtagcccaatagtgaatagagaaggaaaaatagtgggtctttatgggaacggagtggtaacaacttcagggacttacgtgagcgctatagcacaggcgaaagcatcgcaagagggtccccttccggaaatagaagatgaggtatttaagaaaaggaacttaacgataatggatctccaccccggatccgggaaaacaagaagatacttaccggccatagtgagagaagctattaaacgcaaactgagaacgctgatactggctcccacaagagtcgttgcaagcgagatggcagaggctttgaaaggtatgccaattagataccaaaccaccgctgttaaaagtgagcatacaggtcgggagatagtagacctgatgtgtcacgcaacgttcacaatgcggcttttaagtccggtacgtgtaccaaactacaatatgataattatggatgaagctcatttcacagatccagcatcaattgccgcaaggggatatattagcacgcgggtgggaatgggcgaagccgcagccatctttatgacagccacgcctcctggatctgtagaagcgttcccacagtccaatgcggtcatacaagatgaagaacgcgatattccagaacgtagctggaactcaggttatgattggataaccgatttccctggaaaaacagtttggtttgttcctagtatcaaatcgggaaacgacatcgctaactgtctaaggaaaaatggaaagcgtgtaatacagctatccagaaaaacattcgacactgaatatcagaaaactaaaaataatgactgggattacgtcgtcactacggacataagtgaaatgggagcaaacttccgagcggacagagtaatagacccgcgtaggtgcttgaaaccagtaatattaaaagacggaccggaacgcgtcatactcgcgggacctatgccagtaacagtcgcttcagcggcccagcgtcgaggtagaataggcaggaatcaaaacaaggaaggggatcagtatgtgtatatgggacaacccttaaataatgacgaagatcacgctcattggactgaagcaaagatgctactagataacatcaatacccctgaggggataattcctgcacttttcgaaccagagcgcgaaaagagtgccgccatagacggtgaatatagactccggggagaagcaagaaaaacatttgttgaattgatgcgacgtggagatttaccagtctggttaagttacaaggtggcatccgaaggttttcaatactcagacagacgatggtgttttgatggcgaaagaaataaccaagtattagaggagaacatggacgtcgaaatctggacaaaagaaggcgaacgaaagaaactgcggcctaggtggctagacgccaggacatattcagatccactagcacttagagaatttaaagaatttgctgcaggccgtcgtagtgtctccggggacttgatcttagaaattggtaaactaccacaacatctcacgctaagagcacagaatgcattagataacttggttatgttgcataacagtgagcaagggggtaaggcttacagacatgccatggaggaattgcccgatacgatagagacacttatgctcttggcgttgattgcggtcttgaccggaggagtcacattgtttttcctatctggcaagggtcttggaaaaacaagtataggattactctgtgtaacggccagtagcgcattattgtggatggctagtgtagagcctcattggattgcagcaagtataatacttgagttctttctaatggtacttttaatacctgaacccgacagacagcgaacccctcaagacaaccaattagcctatgtagtaattgggctattattcatgatacttacagtagctgcgaacgaaatgggactattagaaacgaccaagaaagacttaggcataggtcatgtcgcagctgaaaatcaccaacatgctacaatgctcgatgtggacctgagacctgcgagcgcttggaccttatacgctgtagcaacgactgtgataacaccaatgatgagacacactatcgaaaacacaacggcgaatatcagcctaaccgctatagcaaaccaagcagcaatactgatgggattggacaaaggatggccaatctcgaaaatggacattggtgtaccccttcttgcccttggctgctattcacaagtaaatcctcttaccttaacggccgcagtgttaatgttggttgcccattacgccatcataggaccaggcttacaagctaaggcaacaagagaagctcagaaaaggaccgctgcggggatcatgaaaaatcctacagttgatgggatagtcgctatagatttggacccagttgtatacgacgcaaaatttgagaaacagcttggacaaattatgttgttgattctatgcacgagtcaaatacttttaatgcgaacgacatgggcattatgcgagtctataacactggccacgggtccactaactacactctgggaaggcagtccaggaaagttctggaatacaacaatagcggtgagtatggcaaatatatttcgcgggtcatatcttgccggtgcgggcctagcattcagtttgatgaaaagccttggtggtggtagaagaggtactggtgcccagggtgaaacactaggcgaaaagtggaaacggcaattaaatcaactcagcaaatctgagtttaatacatacaaaagatctggtataatggaagtggatcgttccgaggctaaggaagggttgaaaagaggtgaaacaactaaacacgcggtgagcagaggaactgcgaaattaagatggttcgttgaaagaaatctggtcaaacctgaaggtaaagtaatagatctcggctgcggaaggggtggatggtcatactactgtgcaggattaaagaaagtgacagaggtaaaaggatatacaaaaggtggtccgggacatgaagaacccattccaatggctacatatggatggaatctggtcaaattacactctggtaaagacgtattctttatgccacccgagaaatgtgatactttgttatgcgacattggagagagttccccgaatcctacaatagaagaggggagaactctcagggtactaaaaatggttgaaccatggctaaggggaaatcaattctgtataaagatcttaaacccatacatgccttcagtagtagaaacattagaacaaatgcaacgcaaacatggaggcatgctagtccgaaatccactttcccgtaactctacgcatgagatgtactgggtatcatgcggaactggtaacattgtttctgctgtaaatatgacaagtcgaatgttactgaaccggtttacgatggctcacagaaaacccacttttgaaagagacgtggacctgggcgccggaactaggcacgttgctgtagaacctgaagtagctaatttagacatcataggacaaagaattgaaaacgtaaagaatgagcacaaatcaacgtggcattacgatgaggacaatccctataaaacatgggcctaccacgggagctatgaggtaaaaccgtccggtagcgcaagctccatggtaaatggtgtagtaagacttcttacgaagccctgggatgttatacctatggtaactcaaatagctatgaccgatacaacaccgtttggacaacaaagggtatttaaagaaaaagttgatacaagaaccccaagagcgaaaagaggtaccactcaaataatggaagtcaccgcaaaatggctttggggttttctatctcgcaataagaaaccaaggatttgcacgagagaagaatttacgagaaaagtgcgcagtaatgctgcgataggagctgtctttgtagatgagaatcaatggaatagcgcgaaagaggccgtcgaagacgagaggttttgggatctagttcaccgtgaaagagagctacacaaacagggaaagtgtgcgacatgcgtctataacatgatgggaaagcgtgagaagaaattaggtgagttcgggaaagcaaaaggatcacgcgcgatttggtacatgtggttaggcgcgcgatttttagagttcgaagcgttgggattcatgaacgaggatcattggttttcccgcgaaaactctttgtcaggggttgaaggtgaaggactacacaaattggggtatattttaagagatatctctaaaatacccggtggtaacatgtacgccgacgatactgcaggctgggacacgaggataacagaagatgaccttcaaaatgaagcgaaaataacagacataatggaacctgaacatgcgttattggcgacctccattttcaaattaacttatcaaaataaagtcgtgcgtgtccaacggccagcgaaaaacggcacagtaatggacgtaatatcaagaagagatcaacgaggttcggggcaggtaggtacatatggtctaaatacatttacaaatatggaagtgcaactcatacggcagatggaatctgaaggcatatttctacctagtgaactagaaacacctaaccttgcggagagggtactggattggctagagaagcacggagcagaacgcttaaaaaggatggctataagcggcgacgactgtgtggttaaacctatagatgatagattcgcgactgccctaaccgctttaaacgatatgggaaaagtgcgaaaagatatcccacaatgggaacctagtaagggttggaatgattggcagcaagtcccgttttgttcacatcattttcatcaattaataatgaaagatggccgtgaaatagtagtaccttgccggaatcaagatgaattagtaggcagagcacgtgtttcccaaggtgccggatggtcacttagggaaacagcatgcttaggtaagtcctacgctcaaatgtggcaactaatgtacttccatagaagggatctacgcctagcagccaatgccatttgttcggcggtaccagtggactgggttccaacctcacgtacaacttggtcgatacacgcccatcatcaatggatgacaacagaagatatgttatcagtttggaatagagtctggattgaggaaaatccctggatggaagacaagacacatgtcagctcatgggaagaggtaccttacttaggaaagcgagaagatcaatggtgtggtagtttaatcggcctgacagcccgagcaacttgggcgaccaacattcaagtcgcaataaatcaagttcgaagattaataggcaatgaaaattatttagattatatgactagcatgaaacgctttaagaatgaatctgatccagaaggagctttatggtaa

SEQ ID NO: 21287 - RNA, 9879 nt, synthetic construct
  misc_feature 1..9879: note = derived and/or modified CDS sequence (opt6) from DENV-1__KJ189340__SS-prME
  source 1..9879: mol_type = other RNA
tcggtgacgatgttactaatgttactgcccaccgcgctggcgtttcacctaactactagagggggagaacctcatatgattgtgtccaaacaagaacgtggaaaaagtttattgttcaaaactagcgctggcgttaatatgtgtaccctaattgcaatggatttaggagaattatgcgaagacaccatgacgtacaaatgtccacaaataaccgaagcagaacctgatgatgttgactgctggtgtaacgccactgatacgtgggtgacttatggaacctgctcgcaaactggtgaacaccgacgagataaaaggagcgtggcactcgcaccacatgtaggattggggttagaaactcgaactgaaacttggatgagctcggaaggagcctggaaacaaattcaacgcgttgaaacctgggcactgcggcatccagggttcactgtaatagcattatttttagcacacgcaatcggaacatccataacgcaaaaaggcatcatatttatactgctaatgcttgttacaccttctatggctatgagatgtgtcggaataggaaacagggatttcgtagaaggactaagtggtgcaacatgggttgatgtcgtattggaacatgggtcctgtgtaactacaatggctaaaaacaaaccaactttagacattgaacttctcaaaacggaagttactaatccagcgattctacgtaaactatgtatagaagcaaaaatttcaaacactacgaccgattccaggtgtccaactcaaggggaagcaacattagttgaagaacaagatgcgaactttgtctgccggagaacatttgttgacagaggatggggtaacggatgcggactcttcggcaaagggtctctgctaacctgcgccaaattcaaatgcgttactaaattagagggtaaaatagtccaatacgagaacttaaaatacagcgttatagtgactgtacatacgggggatcaacaccaagttggaaatgaaacgacagagcacggtacaatcgcgaccataacaccacaagcacctacttctgaaatacaacttacagattacggagctttgactctagattgttccccgagaactggacttgacttcaacgaaatggtattactaaccatgaaagagaaaagttggcttgtgcacaaacaatggttcctagacttgcctttgccatggacaagtggagcatcaacctcccaagagacatggaatcggcaagatctgttagtaacattcaagactgcgcacgctaagaaacaagaagtagttgttcttggttcgcaagaaggcgctatgcatactgctttgaccggagcaacagaaattcaaacatcagggacgacaactatcttcgctggacatctaaaatgtagactaaaaatggataaacttacgttaaaaggtacgtcttacgtaatgtgcacgggatcatttaaacttgaaaaagaagtagcggagacgcaacacggaacggtgctagtccaagtgaaatacgaaggtaccgacgcaccatgtaaaatcccattcagtactcaagacgaaaaaggtgttacacaaaacggaagactgatcactgcaaaccctatcgtcactgataaggagaaaccagtaaatatcgagacagaacctcctttcggggaatcatacatagtagttggagccggcgagaaagcattaaaactatcgtggttcaagaaaggctcatccataggaaaaatgtttgaagctacggccagaggagcgagaaggatggctattcttggcgatactgcatgggattttgggtcgataggtggagtgtttacttccgtaggcaagttagtacatcaagtattcggcactgcttacggagttttattcagtggtgtaagctggacaatgaaaattggcattggtatactactaacttggttgggtctaaattctagaagcacgtcgctctctatgacttgcattgcagtgggtatggtgactctatacttaggggttatggtccaagctgattcaggctgcgtcataaattggaaaggtcgtgaattgaaatgtggtagtggtatttttgtaactaatgaagttcatacatggactgaacaatacaagtttcaggcagatagccccaaacgcttatcagccgcgatcggcaaagcgtgggaagaaggagtatgcggaatacgtagcgcaacaagactagaaaatattatgtggaagcagataagcaatgagttaaatcacattttacttgaaaatgatatgaaattcaccgttgtagtcggagatgcaaacggtatactggctcaaggtaagaagatgatacgtccgcagcctatggaacacaaatattcttggaagtcttgggggaaagcaaaaataataggagcggatattcaaaatacaacattcataatagatggtccagacacacccgaatgtccagataaccaacgagcatggaatatatgggaagtagaagactatgggtttggaatattcacaactaacatatggctaaaacttcgagactcgtatacacaaatgtgcgatcaccgattaatgtcggcggccatcaaggattctaaggcagttcatgcagatatgggttattggatagaatccgagaaaaacgaaacatggaaattagccagagcctccttcatcgaagtcaaaacttgtacttggcccaaatcacacaccctatggtctaatggagtgttggaatccgaaatgatcatacccaaaatctatggagggccgatttcccagcacaactatcgacctggctattttacccaaaccgctggtccatggcacttaggaaagttagaattggatttcgatttgtgtgaaggaactacagttgtcgtcgatgaacactgtgggaaccgaggtccatctctgagaactactacagttaccggaaaaataatacacgaatggtgctgtcgtagctgtactttgccacccttgcgatttcgaggcgaagatggttgctggtacggtatggaaatacgtcctgtaaaggaaaaagaagaaaacttagtaagaagtatggtatctgcaggtagtggcgaggttgactccttttctctagggatcctctgcgtttcaattatgattgaagaagtaatgagatcgcgatggtcacgaaagatgttaatgacaggaacattagcagtatttctattgctggtgatgggacaacttacgtggaatgacttaatacgactgtgtataatggtcggggcaaatgcgtcagatcgcatgggaatgggcacaacgtaccttgcattgatggcgacgttcaaaatgcgtcctatgttcgccgttggactgctattcagaagactaacatcaagagaagtactcctactcacgattggtctgagcctagtcgcttcagtcgaacttccaaattcactagaagaattaggtgatggattagctatgggaatcatgatgctgaaattattaactgaatttcaaccgcatcaactttggactacattactctcgctaacattcataaaaaccacgctctcattagactatgcatggaaaacgacagcaatggcgctaagtatagtatcattatttccattatgtttgagcactaccagtcagaaaactacatggctaccagtattactagggagcttcggctgcaaacctctcacaatgttcttaataacagaaaacaaaatatggggaagaaagagctggccattaaatgaaggaataatggcgatcggaattgtgtcaatactgctttcgtcattactcaaaaatgacgtcccactcgcgggtccactaattgccggtggtatgttaatcgcatgttacgtaataagcggctcatcagcggatcttagcttagaaaaagcagcggaagtgtcgtgggaacaggaagcggaacatagtgggacaagtcacaacatactggtagaggtccaagacgatggtactatgaagattaaggacgaggaacgcgacgacaccctgaccatattattaaaagctaccctcttagcagtatcaggggtgtatccaatgtccatccctgctacactatttgtatggtatttttggcagaagaagaaacaaagatctggagtcttatgggatactccttccccgcctgaagtagagcgtgctgtcctagacgatggcatctatagaatattacaacgaggtctcctcggtcgcagtcaggtgggtgttggagtatttcaggacggagtatttcatacaatgtggcatgttaccagaggagcagtgttgatgtaccagggcaaaagacttgaaccatcatgggcttcagtcaagaaagatctaatatcttacggcggaggttggcggttccaaggttcatggaatacgggtgaagaagtgcaagtaatagcggtagaaccaggcaaaaatcccaagaacgttcaaacgacaccaggtaccttcaaaacacctgaaggcgaagtgggcgcgattgcacttgattttaaacctggaacatctggatcccctatcgttaaccgagaagggaaaatagttggattgtatggcaatggtgtcgtaacgactggcggaacttatgtaagtgcaatcgctcaagctaaagcgtctcaggagggtccccttccagagatagaggatgaagtctttaagaaaagaaaccttactattatggatcttcatccagggagtggaaaaacaaggaggtatttgccagccatagtacgcgaagcaattaagcgcaaactaaggactttgattctggctccaaccagggttgtcgcaagcgagatggcagaggccttaaaaggcatgcccatcagatatcaaactacagcagtcaaatcagaacacacaggacgtgaaatagttgatcttatgtgtcatgctacatttacgatgagactcctctcgcccgtccgtgttccaaattacaacatgatcataatggacgaggctcactttactgacccggcatctatagcagccagaggctacatatcgacacgagtaggcatgggcgaagctgcagctatatttatgacagcaacacctccaggatctgtagaggcctttccccagagtaatgcagtaattcaggatgaggaacgggatattccggaacggtcatggaatagcggctacgattggataactgactttcctggaaaaactgtttggtttgtacctagcataaaatctggaaacgacatagcaaattgcttacgtaaaaacgggaaacgagttattcaactttcaagaaaaacattcgacacagaatatcaaaagacgaaaaataacgactgggattacgtagtaaccacggacatcagcgaaatgggagctaatttcagagcggaccgcgtaattgacccaagaagatgcttaaaaccagtaatactaaaagatggcccagagcgtgtaatcctggcagggcccatgcctgtcacagtagcatctgctgcacaacgacgaggaagaattggcaggaaccagaataaggaaggagatcaatatgtctatatggggcagcctttaaacaacgatgaagatcacgcccattggacagaggcaaagatgctattagataacattaacacgccagagggtataattcccgcactcttcgagccagaaagggagaaaagcgctgctattgacggagaatatcgcctaagaggagaggcaaggaaaacgttcgtcgaattaatgagacgaggggacttaccagtgtggctaagttacaaagttgcaagcgaggggttccaatactcagaccgtagatggtgttttgatggcgaaagaaataaccaagtattagaagaaaacatggacgtagaaatatggacaaaagaaggagagcgtaagaagctaaggcctcgatggctcgatgcgagaacatattcagacccactggcattgagggagttcaaagaatttgctgccggtaggcgatctgtttcaggcgatttaatattagaaattggaaaactgccacaacatctcacattaagagctcaaaatgctctagacaatctggtcatgttacataactcagagcaaggaggaaaagcatatcgacacgccatggaagaactaccagacactatagaaacgctgatgttactcgcattgatcgcagtactaaccggcggtgtgacattgttctttctaagcggtaaaggtctgggaaaaacaagtattggattactttgcgtaacagcttcctcagctctgctttggatggcttcagtcgaacctcactggatagcagcgtcaatcattctggagttcttccttatggtactacttattcctgagccagacaggcaacgaacaccacaagacaatcagttagcttacgttgtaataggattgctatttatgatcttaacagtagcagcaaacgagatgggtttgctcgagactaccaagaaagacttaggtataggacatgtagctgccgaaaatcatcagcacgctacaatgctagacgtagatttacgccccgcttcagcttggaccctttacgcggtagcgacaacagtcattacaccaatgatgagacacaccatagagaacacaacagccaatattagtctcactgcaatcgcaaatcaagcagcaattctgatgggtttggataaaggttggcccatctccaagatggacataggagttcctttgcttgctctaggctgttactcccaagtgaatcccttgacattaacggcagctgtattgatgctagtggcccattacgcgataataggaccaggtttgcaggcaaaagcaactcgagaggcccagaaaagaaccgcagcaggcataatgaaaaacccaacagtggatggaatcgtagctatagacttagatccggtcgtttacgatgccaagtttgaaaagcagcttggccagataatgctactcatactttgtacatctcaaatacttcttatgcgaacgacgtgggcactatgtgagagtattacacttgccaccggaccactgaccacattatgggaaggatcacctgggaaattttggaatacaacaatagccgtctctatggcaaacatcttcagaggcagttacctcgccggcgcgggcctagctttctcattaatgaaatcactaggaggtggtagacgaggaacaggcgcacaaggtgaaaccttaggagaaaaatggaaacgacaactaaatcaattgtcgaaaagcgagttcaacacgtataagagaagtggaattatggaagtcgatagatcagaagcgaaggagggactaaaacgtggagagacgacaaaacacgctgttagcaggggaacagcgaaactaagatggttcgtcgaaagaaacctcgtcaagccagagggaaaggtaattgacttgggttgcgggcgagggggatggtcgtactattgcgctggattaaagaaagtcacggaagtgaaagggtataccaagggagggccaggtcatgaagaaccgatacccatggcaacctacgggtggaatttggtaaaactccattctggtaaagatgtattctttatgccgcctgaaaaatgcgacacgctgttatgcgacataggagaatctagccctaatccaaccatagaagaaggtcgcactcttagagtgttaaagatggtagaaccgtggttacgaggcaatcaattctgtataaaaatactgaatccgtacatgccatcagttgtagaagcattagaacaaatgcaacggaaacatggaggcatgctagtcagaaacccattaagcagaaactcaacacacgaaatgtattgggtttcttgcggtactggtaatatcgtaagcgctgtgaatatgacttcacgtatgttactaaataggtttactatggcacacaggaagccaacttatgagcgagatgtggaccttggtgcaggaactagacatgttgcagtcgaaccagaagtagcaaacttagatataatcggacagcgaattgaaaatataaagaatgagcataaatcaacatggcactacgatgaagataacccatacaaaacatgggcataccatggatcgtatgaagttaaacctagcggctccgcatcaagcatggtaaacggggtagttaggctacttacgaaaccttgggatgtgattccaatggtgacgcaaatagcaatgactgatactaccccatttggacaacaacgcgtattcaaggagaaagtcgatacaagaactccaaaagctaaacgaggcaccacgcaaataatggaagttacagcgaagtggctatggggttttctatccagaaataagaaacccaggatatgtacaagagaggagttcacaagaaaagttcggtctaatgcggcaatcggtgcagtctttgtcgatgaaaatcagtggaactcagcgaaagaagcggtcgaagatgaaagattttgggatcttgtacacagagaaagagagctccacaaacaaggaaaatgtgccacatgtgtctacaatatgatggggaagagggagaagaaacttggtgaatttgggaaagcaaaggggagtagagcaatttggtatatgtggctaggtgccagattcttggagtttgaagcactcggttttatgaatgaagatcactggtttagtagagagaacagtctaagtggagtcgaaggagaaggacttcacaaattgggatatatactaagagatatctcaaagataccaggaggaaatatgtacgcggacgatactgctggttgggataccaggattactgaggatgacctacaaaatgaagcaaaaattactgaaattatggaaccagaacacgcactactcgcaacttctatcttcaaactcacctatcaaaataaggtagtacgagtacaaagacctgccaagaacggtacggtcatggatgttatttcaagaagagatcaacgaggttctggtcaagtgggcacatacggactgaatacctttactaacatggaagtacaattgataagacaaatggaaagcgaaggaatatttctaccatcggagcttgaaactccaaacttagcagagcgtgtactagattggttggaaaagcatggtgcggaacgtctaaaaagaatggcaataagtggcgatgactgcgtcgtaaaaccaatagacgatcgtttcgcgactgctctaacagcgctaaacgacatgggcaaagtacgaaaagatattccacaatgggaaccatctaaaggatggaacgactggcaacaagtcccattttgtagtcatcattttcaccaattgataatgaaggatggaagggaaatagtcgtgccatgtagaaatcaagatgaactggttggccgtgcacgagtttctcaaggggccggctggtccctgagagaaacggcgtgtttgggaaagtcgtatgctcaaatgtggcagctcatgtactttcaccgccgagacttgagactagcggcgaatgcaatttgttcagctgtccccgtcgattgggtaccaacaagtcgaaccacatggtcaatacacgcccaccatcaatggatgacaactgaagacatgctcagcgtatggaatagagtctggatagaagaaaacccgtggatggaagataaaactcacgtgtccagttgggaagaggtgccataccttgggaaacgagaagatcaatggtgcggtagccttataggacttactgcaagagcaacttgggctacgaatatacaagtagcaataaatcaggtacgtcgattaataggaaatgaaaattaccttgattacatgacgtctatgaaacgctttaaaaatgaaagtgatcctgaaggcgcgctatggtga

SEQ ID NO: 21288 - RNA, 9879 nt, synthetic construct
  misc_feature 1..9879: note = derived and/or modified CDS sequence (opt6) from DENV-1__KJ189341__SS-prME
  source 1..9879: mol_type = other RNA
tcggtgacaatgttactgatgttattaccgactgcattagcctttcacttaacgacacgagggggtgaaccccacatgatagtatctaaacaagaaaggggtaaatctcttttatttaaaacctctgcaggggttaatatgtgtactctaattgcgatggatctgggggaactttgtgaagatactatgacttataaatgtcctcaaatcactgaagcagaaccagatgatgttgattgttggtgtaatgctacagacacatgggtcacgtacgggacatgctcgcaaacagggggtcataggagagagaaaaggtcagttgcgttggctccacacgtgggtcttggacttgaaacaaggacggaaacttggatgtcatcagaaggagcatggaaacaaatacagcgagtagaaacctgggctctaaggcaccctggttttacagttattgctttatttctagctcatgcaatcggaacatcaatcactcaaaaaggcataatctttattctattaatgttagttacgccctcaatggccatgcgatgtgtcggaataggtaatagagatttcgttgaaggtttgtcaggagcaacatgggtggacgtagtattggaacatggatcgtgtgttacgacaatggctaaaaataaaccaactctcgatattgaactattaaaaaccgaagtaacaaaccctgcagttctaagaaaattatgtatagaagcaaaaatatcaaacactacaacagacagtcgctgcccaacccaaggagaggctaccctagtggaggaacaagacgcgaacttcgtctgtcgcaggactttcgtggatagggggtgggggaatggatgtgggttattcggaaaaggttcgctgctaacatgtgcgaaatttaagtgtgttacaaaacttgaaggtaagatcgtacaatatgaaaatcttaagtattctgtaattgtaactgttcatacaggggatcaacaccaagtcggtaatgagaccactgaacacggaacaatcgcaaccataactccacaagctcctacaagtgaaattcagctaacggattatggtgcattgactttagactgctcaccaagaaccggactcgactttaatgaaatggtattactgacaatgaaagagaaatcttggctcgttcataaacaatggtttctagatctacctttaccgtggacttctggcgcgtctacatctcaagaaacatggaatcgacaagatctattagtaacctttaaaacggcccatgccaagaaacaagaagtggtggtacttggcagtcaagaaggggctatgcacaccgcattaaccggagctaccgaaattcaaacatcagggacgactacaatttttgctggtcatctgaaatgtcgtctaaaaatggataaattaaccctaaaaggtacctcatatgtcatgtgcaccggccctttcaaattagagaaagaagtagctgaaacccagcatggtaccgtactcgtacaagtaaaatacgagggtacagatgctccctgtaagataccattttcaacacaagatgaaaaaggagttacgcaaaacggcaggctaataactgcaaaccctatagttaccgataaggagaagccagtgaatattgaaaccgagccaccatttggggagagctacatagtagtgggggcaggagagaaagcattaaaattaagctggtttaagaaaggcagttcgataggtaaaatgtttgaagcaacagctcgaggcgctagacggatggctatactaggagacacagcatgggattttggcagcataggaggcgtctttacttctgtaggaaaacttgtgcatcaagtattcggtacagcctacggagttttattcagcggggttagttggacaatgaaaatagggatcgggattttgttaacctggttaggcctgaatagtagatcaactagcttatcaatgacctgtatcgtagtcggcatcgtaactctttacttaggtgtaatggtccaggccgatagtggatgcgtaataaattggaagggtagagagctaaaatgcggatcaggaatattcgtgacgaacgaagtacacacatggactgagcaatataaatttcaagcggattcaccgaaaagactgagtgcagctataggcaaagcatgggaggaaggagtatgtggtattcgaagtgccacacgtcttgaaaatatcatgtggaagcaaatcagtaatgagctcaaccacatacttttagaaaacgatatgaaatttactgtggtagttggtgacgcaaacggaatattagcccaggggaagaagatgattaggcctcaacccatggaacacaaatattcttggaaaagctggggtaaagcgaagatcataggagccgacacacaaaacacaacatttataattgacggaccggacacgcccgaatgtcctgataatcagagagcatggaatatttgggaagttgaggactacggtttcggcatctttacgacgaatatttggctaaagttaagagactcatatacacaaatgtgtgaccatcgcttaatgtcagccgcgatcaaagactcaaaagcagttcatgcagatatggggtattggattgaaagtgagaaaaatgaaacctggaaactagcgcgagcatcatttattgaggtaaaaacttgtacatggcccaaatcccacacactatggtctaatggggtacttgaatcagagatgataatcccaaaaatatatggagggcccattagtcaacacaattatagacccggatatttcacccagacagcaggtccttggcacctaggaaaattagaattagacttcgacttatgtgagggaacaactgttgttgtagatgaacattgcggtaacaggggacctagtttacgaacgacaacggtaactggtaagataatacatgaatggtgctgcaggtcctgtacattaccaccactgagatttagaggggaggatgggtgttggtacggaatggaaatacgtcctgtcaaagaaaaagaggaaaatttggtaaggtcaatggtctcggccgggagtggagaagttgatagcttttcactaggaatattatgtgcatcgataatgattgaagaagttatgagatcaaggtggagccgaaaaatgctaatgactggaacacttgcggtatttctactactaatcatgggacaattgacttggaaagatctgattcggttatgcattatggttggggccaacgcaagtgataggatgggtatggggacaacttacctagcactcatggctacattcaaaatgcgtcccatgttcgctgtcggattactcttccggcgactaaccagcagagaagtattgcttttgacaattggcctgtcacttgtggcctcggtggaattaccaaatagcctggaggagctaggggatggtctagctatgggtatcatgatgctcaaattgcttacggagtttcaaccacaccaattatggactacgctacttagcttaacgttcataaaaactactctgagcctcgattacgcctggaaaacaacggcgatggcactgtctatagttagtctctttccattatgcctgtcgactacttcacagaaaacaacgtggttaccagtattactaggcagttttggttgcaaaccttcaacaatgttcttaattacagagaataaaatttgggggcgaaagtcatggccactaaacgaaggcataatggcgataggtatagtctcaatacttctatcctccttgcttaaaaacgacgtgcctctcgcaggaccgttgattgccggcggtatgttgattgcgtgttatgttatatcaggatccagtgcagatctgtcactagaaaaagcggcagaagtaagttgggaacaagaggctgaacattctggcacatcgcataacattcttgttgaagtacaagatgacggaacgatgaagatcaaagatgaggagagggatgatactttaactatacttctaaaagcaaccctactagcggtttctggtgtgtatccgatgtccataccagccacactgtttgtttggtatttttggcagaagaagaaacaacgttcaggggtattatgggatactccaagtccaccagaagtagaaagagcagttctcgacgatggcatctatcgtatcttgcaaagagggttattaggtcgcagccaagtaggagtgggagtatttcaagacggtgttttccacacaatgtggcatgttacacgtggagccgtattaatgtatcagggaaaaagactagaacctagttgggcctcagtcaagaaagatctgatctcctatgggggtggctggaggtttcagggaagttggaacacaggagaggaagtgcaagtaatagcagttgaaccaggcaaaaatcctaaaaacgtacagaccacaccaggaacattcaaaacgccggaaggggaggttggagctatagcattagattttaaaccaggcacatcaggaagtccaatagtaaatcgcgaagggaaaatagtcggactatacgggaatggtgttgttacaacaagcggtacatacgtgtcagcaatagcacaagctaaagcaagccaagaagggcctttgcccgagatagaagacgaggttttcaagaaacgtaatctgacaattatggaccttcacccgggttcaggaaagaccagaagatatttaccggcgattgtacgtgaagcgataaaaagaaaattgcgaactttgatattagcaccaacacgtgtagtagcatcagaaatggcagaagcacttaaaggcatgcctataagataccaaactaccgctgtaaaaagcgaacatacagggcgggaaatagtggacctaatgtgtcatgctacctttacaatgcggctcttgtcgccagttcgagtccccaattataatatgataataatggatgaagcacactttaccgacccagcttcgatagcggcccgtggatatatcagtactagagttggcatgggagaagccgcagctatcttcatgacagctaccccaccaggatcagtagaggcattcccacagagtaacgcagtcattcaggacgaagaaagagatattccagaaagatcctggaactctggatacgactggatcacagattttccggggaaaacagtatggtttgtaccgtccattaaatccggtaatgatatagcaaattgtttgaggaagaatggaaagagggtcatccaattgagtagaaaaactttcgacaccgaataccagaaaaccaaaaataatgattgggattacgtagtaacaacggatatatctgaaatgggtgcaaactttagagccgacagagtgattgaccctagacggtgtctcaaacctgtaatactgaaggacggtccagaaagagtaattttagctgggccgatgccggtaacagtagctagcgctgcacagcggagaggtaggattggccggaaccagaataaagaaggggaccaatacgtatatatggggcaaccacttaacaatgatgaagaccatgctcattggaccgaagcgaagatgttattagacaatataaatacaccagaagggattataccagccctcttcgaaccagaacgagaaaagagcgcagcaatagatggggagtatcggttgagaggtgaagctcgtaagacattcgttgagcttatgagaagaggcgatttaccggtatggctatcgtacaaagttgccagcgaaggtatacaatactcggacagacgctggtgctttgatggagaaaggaataatcaagtgttagaagaaaatatggatgtcgaaatttggaccaaggaaggagaaagaaagaaacttagaccaaggtggcttgacgctcgaacatactcagatccgctggcactccgagaatttaaagagttcgcggccggccgaagatcggtatcaggtgacctaatactggaaatcggaaaactgccccaacatctaacattaagggcccaaaatgccttagataatctggtcatgttacacaattcagaacagggtgggaaggcatacagacacgctatggaagaactaccagacacaatcgaaacactaatgttattagctctaatagccgtgttaacgggtggagtaacattgtttttccttagtggaaaaggactcggaaaaacaagtattggtctattatgtgtgacagcaagttcagctctgctatggatggcatcagtggaattacattggattgcagcatcgattatattggaatttttcctaatggtactgctaattcccgaaccggatagacaacgaactccgcaggacaatcaattagcatatgtggtaataggactactcttcatgatattaaccgttgccgcaaatgagatgggactactggaaacaaccaaaaaggaccttggtatcggacatgtagccgcggaaaatcaccaacacgccacaatgttagatgtagatttaagaccagcaagtgcgtggacactctatgcagtagcaacaactgttattactcctatgatgagacatacaatcgagaatactaccgcaaacataagtctaacggctatcgcgaaccaagcagctatacttatgggattggataaaggttggccaatatcaaaaatggacataggggtccccctcctagccttaggctgctacagtcaggtaaatccactaacattaaccgcagcagtcctcatgttggttgcgcattatgcaataataggccctggcttgcaagccaaagcaacaagagaagcacagaaacgaactgctgctggaatcatgaaaaacccgactgtggatggaatagtcgctattgacctagatccggtggtttacgacgcaaaattcgaaaaacagctcggacaaattatgctgttaatactctgtacttcccaaattttacttatgagaacaacgtgggctttatgtgaaagtataaccctagccacagggccccttacaacgctatgggaaggaagtcctggaaagttctggaacacaacaatcgcggtcagcatggccaacatatttagaggttcgtatctagcaggagcagggttagcattttctttgatgaaatctctaggaggaggtaggaggggtactggcgctcaaggcgagactcttggggaaaagtggaagaggcaactgaatcaattgtcaaaatcagagtttaacatatacaagcgatcgggcataatggaagtagaccgatcggaagcaaaagaaggattgaagagaggagaaactacgaaacatgctgtatctagaggaactgctaaattaagatggttcgtcgaaagaaatttagtaaagccagaggggaaagtcatagatttaggatgcggtagaggcggctggagctattactgtgcagggctgaagaaagttactgaggtaaaaggatatacaaaaggcggaccaggtcatgaggaaccaattccgatggcaacatatggatggaatctggttaaattacattcaggaaaggatgtatttttcatgcctccagaaaaatgcgatacactcctgtgtgacataggtgaatcaagccctaatccaacaattgaagagggtcgaacacttagggtgttaaaaatggttgaaccatggcttagaggaaaccaattctgcattaagattttgaacccttatatgccaagtgtcgtagaaaccttggagcaaatgcaacgcaaacacggaggcatgcttgtacgtaatccactgagcagaaattcaacacacgaaatgtactgggtaagctgtggtacaggaaatatcgtaagtgcagtcaacatgacatcacgaatgttgttaaatagattcacaatggcacataggaaacccacttacgaacgggatgtagatctaggagcaggcactagacacgtagcagtggaacccgaggtcgcaaatctagacataataggtcaaaggatcgaaaacattaaaaatgagcataagtcaacatggcattatgacgaggataatccatataaaacttgggcatatcatgggagctatgaagtgaagccaagtgggagtgcctcttcgatggtaaacggggtcgtacgactcctaactaaaccatgggatgtgatacctatggtaacacaaatcgctatgacagacacaactccctttggacagcaacgagtttttaaggaaaaagtagacacacggacgcctagagcaaagagaggaactactcaaatcatggaggtaacggctaaatggctgtggggatttttatcgcgtaataagaaacctcgaatctgtactcgagaggagttcacgagaaaggtcaggtcgaatgcagccatcggagctgtttttgtcgacgaaaatcaatggaactctgctaaagaggctgtcgaagatgagcgattctgggatctggtacacagagaacgcgagctacacaaacaaggaaaatgtgctacatgtgtttataacatgatgggaaaaagagagaagaaacttggggagtttgggaaggcgaagggttcgagagccatatggtacatgtggttaggagcaaggtttctggagtttgaggctttaggatttatgaacgaagaccattggttttcaagagaaaattccttaagcggggtagaaggagagggtttgcataaactaggatacattctacgtgatatttccaaaataccgggcggaaatatgtacgcagatgacacggcaggatgggatactcgaattactgaggacgatttacaaaatgaagctaaaattactgacatcatggaaccagaacatgcactcttagctacatcaatctttaagttaacataccaaaacaaagtagtacgcgttcagcgaccggctaaaaacggaactgtgatggacgtcatttccaggagggatcaacgaggaagtggacaagttggaacatatggtttaaatacatttacgaatatggaagtacaactaatacgccagatggaatcggaaggcatattcttaccctcggaactagaaacaccaaacttggcagaacgcgttcttgactggctcgaaaaacacggtgcggaacggctaaaaagaatggcaatcagtggcgatgattgcgtagttaaacccatagatgatagatttgccactgcattaactgctttgaatgatatgggtaaagtacgaaaagatatccctcaatgggaaccaagcaagggctggaacgattggcaacaggtaccattctgttcacaccactttcaccagttaatcatgaaagatggacgggagatagttgttccatgcagaaatcaagatgaattggtaggtagagcacgggtgagtcagggtgctggatggagcttacgagagacagcctgcttgggaaagagctatgcgcagatgtggcaattgatgtatttccatagaagggatttaagattagctgcgaatgctatctgtagtgccgtccctgtagattgggttcctaccagccgcacgacttggtctatccatgcacaccatcaatggatgactacagaggatatgctttcagtttggaaccgggtgtggatagaagaaaatccttggatggaagataagactcatgtatcatcctgggaagaagtcccctacttaggcaagcgagaggatcagtggtgcgggtcattaattggcctcacagccagagcaacatgggcaaccaatattcaagtggctataaatcaagtgagaagattaattggtaatgagaactatttagactatatgactagcatgaaaaggtttaagaatgaatctgatcccgagggagccctctggtaa

SEQ ID NO: 21289 - RNA, 9879 nt, synthetic construct
  misc_feature 1..9879: note = derived and/or modified CDS sequence (opt6) from DENV-1__KJ189343__SS-prME
  source 1..9879: mol_type = other RNA
tcggtaactatgctattaatgctattacccacagcattagcttttcatttgactacaagagggggtgaaccacatatgattgtatctaaacaagaaagaggaaaatcgctattattcaaaacatcggcaggagtgaacatgtgtacactcatagcaatggacctaggtgaactatgtgaagacacaatgacatacaaatgtccacaaattacagaagcagaacccgacgatgtagattgctggtgcaacgcaacggatacatgggtaacctacggaacatgcagtcaaacaggggaacatagaagggataagcgctcagtcgcactggcaccacatgtaggtctaggtttagaaacgaggactgaaacgtggatgagtagtgaaggcgcatggaagcaaatacaacgtgtagaaacgtgggcgcttcgccacccaggctttacggtaaccgcactattcctagcacatgccatcggaacaagtataacacaaaagggaatcatatttatactattaatgctagtaacgccaagcatggctatgaggtgcgttggaataggaaacagagactttgttgaagggctatccggagctacctgggtggatgttgtgctagaacatggttcttgcgtaaccacgatggccaaaaataaacccacattggatattgagctcctaaaaaccgaagtaacaaaccctgcgatactacgaaaactatgcatcgaagcaaaaataagtaacactactactgacagccgatgcccaactcaaggtgaagctactctagtagaagaacaagacgcaaatttcgtatgtagaagaaccttcgtagatcgaggttggggtaatggttgtggactttttggcaaaggtagccttctgacttgtgcaaaatttaaatgtgtaacaaaactagaaggaaaaattgtgcaatacgaaaatctgaaatattcagtaatagtaacggttcacacgggagatcaacaccaagtagggaatgagactacagagcatggaacaatagcaactatcacaccacaggctccaacatctgaaatccaattgacggactatggtgcacttacactagactgttctccccgtactgggttagactttaacgaaatggtactattaacgatgaaagagaagtcatggctagtgcataaacagtggttccttgatttacccctaccatggacgtcaggggcatcgacgtcgcaagaaacatggaaccgacaagatctattggttacgttcaaaacggctcacgccaagaaacaagaagttgttgtgttggggagccaagaaggagcgatgcacactgcacttacaggggctactgaaatacaaacatctggtacaactaccatctttgcaggtcacctcaaatgccgattaaaaatggataaacttacactcaaaggtaccagctatgtcatgtgcacaggttcgtttaaactcgagaaagaagttgcagaaactcaacatggaaccgtactcgtacaagttaagtatgaagggacagatgctccttgtaaaatacctttcagcacccaagacgagaaaggggtaactcaaaacggtaggttgatcactgctaaccccattgttacagacaaggagaaaccagtgaatattgaaacggaacctccgtttggtgaatcttacatagttgtcggcgcaggagaaaaagcattgaagttatcatggttcaagaaaggatcatcaatcgggaagatgtttgaagccaccgcacgaggagcccgcagaatggcaattttgggggacacagcatgggattttggaagcataggtggagtgtttactagcgtaggaaaactcgtgcatcaagtatttggcacagcatatggtgtactattctcaggggtaagttggactatgaaaattggaatcggaattttattaacctggttaggactaaattctcgatctacttccttatccatgacatgtattgccgtaggtatggtgaccctctacctgggagtaatggtccaagcagattctggttgcgtagtgaactggaaagggagggaactcaaatgcggttccgggatatttgtaacaaacgaagtacacacttggacagaacaatataaatttcaggcagattcaccaaaaagactcagtgcggccataggtaaagcatgggaagaaggtgtttgcggcattcgaagcgcgacacggttggaaaacatcatgtggaaacaaattagcaacgaacttaaccatatactattggagaacgacatgaaattcacagtagtagtaggagacgctaatgggatactcgcacaaggaaagaaaatgataagaccacaacctatggaacataaatactcgtggaaaagttggggtaaagctaagataatcggtgcggatatacagaatactacattcataatagacggtcctgatactcctgaatgtcctgacaatcagcgtgcatggaatatctgggaagtcgaagattacggctttggcatattcacgacaaacatttggttaaaactaagagacagctacacacagatgtgtgatcacaggctcatgagcgccgctattaaggacagcaaggcagtccacgcagatatgggatattggattgaaagcgagaagaatgagacttggaagctcgctcgagctagcttcatagaggtcaaaacctgcacttggcctaagtctcacacactatggtcgaacggagttctggaatctgaaatgattatcccgaagatttatgggggtcctatatctcaacataattaccgaccgggttatttcactcaaactgccggaccctggcatcttgggaaacttgaattggattttgatctctgcgagggtacgactgttgtagtcgatgaacattgtggtaacaggggaccctcactacgaactacgactgttactgggaaaataatccacgaatggtgttgcaggtcttgcacattacctccactaagatttcgaggagaagacggctgctggtacggtatggaaattcgtccagtaaaagaaaaagaagaaaacttagtaagaagtatggtttcggcaggttcaggtgaagtcgatagcttctccttaggtattttgtgtgcttctattatgatcgaagaagtaatgaggtcacgttggtctcggaaaatgctaatgatcggcactcttgcggttttccttctcctcattatgggacaacttacatggaatgacttaatccgtttatgcataatggttggtgctaacgcttctgaccgcatgggcatgggaacgacgtacttagcactgatggccacctttaaaatgagacctatgttcgccgtaggtttattatttcgacgtttgacatctcgagaggtactattattaacaattggcttaagtctagtagcatcggtcgaactcccaaattcactcgaggagcttggagatggattagccatgggtattatgatgctaaaacttctgaccgagttccaaccacaccaactttggacaacccttctttctttgacgtttattaagactaccctctcgttagactacgcatggaagacaacagctatggcactaagcatagtatctctttttccattgtgtttgtccaccacatcccaaaagacaacatggttgccagttttgttgggcagcttcggatgtaagccactgactatgtttcttattacagaaaacaaaatctggggtcgtaagagctggccgctaaatgaaggtattatggctataggtatcgtgagcatcctattatcttcattactgaaaaacgatgttccattagccggaccactaattgccggaggaatgttgattgcatgctatgttataagtggatcctcagccgatttaagtcttgaaaagactgcagaagtatcatgggaacaagaggcggagcactcagggacgtcccacaatattctagttgaagtacaagacgacggaactatgaagataaaagacgaagaaagagatgatacccttacaatattgttgaaagccacactccttgcggtgtccggagtatatccaatgtctatccccgctacgttatttgtttggtatttttggcagaagaagaaacaacggagtggggtattatgggacacaccatcccctcccgaagtagagcgagcagttttagatgatggaatctatcgaatactccaaagaggactacttggtcggtcgcaagtcggtgtaggtgtttttcaagatggagtttttcacacaatgtggcacgtaaccagaggggcagtactaatgtatcagggcaaaagactcgagccatcctgggcatccgtcaagaaagacctgatctcatacggaggcggatggcgttttcaaggctcttggaataccggtgaagaagtccaagtaatagctgtcgaacccggtaaaaatcccaaaaatgtacagactactccaggaacatttaaaacacctgaaggagaggttggagctattgccttagatttcaaacctggcacaagtgggagtcctatagtaaatcgagaaggaaaaattgtaggtttatatgggaacggcgtagtaaccacttcgggtacatatgtgagtgctattgcacaagctaaagcgagtcaagagggaccacttcccgagattgaagatgaggtatttaagaaaaggaatttaacgataatggacttacatccaggaagtgggaagactcggcgataccttccggctattgtcagagaagcaataaaacgaaaattacggacattaattctggcaccaacgcgcgtcgttgcttcggagatggcagaagcattgaaaggaatgccaatcaggtatcaaacaactgctgtgaagtcagagcatacgggtcgcgagatcgtagatctaatgtgccatgctacattcactatgagactgctcagccctgtcagggttcccaattataatatgatcattatggacgaagctcactttacggaccctgcaagcattgcagcacgaggatacataagtacccgagttggtatgggggaagctgcagcaatattcatgactgccacccctccaggatcagttgaagcatttccccaatctaatgcagtgatacaagatgaagaacgggacatacccgagcgatcttggaactctggttatgactggatcacagactttccgggaaaaacggtgtggtttgtgccgagcataaaaagtggaaatgacattgctaactgcctacgtaaaaatggtaaacgagtaatacaattatcgcgcaaaaccttcgatactgaatatcagaaaaccaaaaataatgattgggactacgtggttactaccgacatctcagaaatgggcgcaaactttcgtgcggaccgcgtaatagaccctaggagatgtctcaaacccgttatactcaaagacggaccggaacgggtaatattagcaggccccatgccggtcacagtggcatcggctgctcagcgcaggggaaggatcggtagaaatcaaaataaagaaggtgatcaatatgtatatatgggccaacctttaaacaacgacgaagaccacgcacattggactgaagcaaaaatgttactggacaatatcaatactccagaaggcataattcccgctttatttgaacctgagagagagaagtcagcagccattgatggagaatatagacttagaggagaggcgcgtaagaccttcgtggaactaatgagaagaggcgatttacctgtatggctgtcttataaagtagctagtgagggctttcaatactcagatcgtagatggtgttttgatggtgaacgaaacaatcaagttttggaggaaaacatggacgttgaaatttggaccaaagagggggaaaggaagaaactcagacccagatggctcgatgctaggacatattcagatccactagccttaagggaatttaaagagtttgctgctggaaggcggagtgtatccggagatttgatcctagagattggcaaattaccccaacatcttacgttacgagctcaaaatgctctcgataatctcgcgatgttacacaacagtgaacaagggggaaaagcataccgtcatgcgatggaagaattacccgatacgattgagactctaatgctactagcactaatagccgtactaactggtggagtgacactattcttcttgtcaggcaagggactaggaaaaacatcaataggactgctttgcgtaactgcgagctcggctttactttggatggcttcggtggagcctcattggatcgcagcaagcattatactagaatttttcttgatggttttactaataccagaaccagatcgccaacggacacctcaagataatcaactagcctatgtagtaataggattactattcatgatattaactgttgccgctaacgaaatgggtttgttagagactacaaagaaggatctaggaataggtcatgtagctgcggaaaatcaccaacatgctacgatgttagatgtggacctaagaccagctagtgcatggacactatacgccgttgcaacgacagtaattacacccatgatgcgacatacgatagaaaataccaccgcaaacatatctctaacagctatcgcaaaccaggcggccattcttatgggtttagataaagggtggccaataagtaaaatggacattggtgttccactactagcgttaggatgctattctcaagtcaatccactaactctaacagccgcagtactcatgttagtagcacattatgcaataattggaccaggacttcaagcaaaagcaacaagagaggctcagaaaaggacagcagcgggtataatgaaaaaccctacagttgatggcatagttgctattgacctagacccagtagtctacgatgcaaaattcgaaaaacaattgggacaaataatgttactcattctctgcacatctcagattctccttatgagaacaacatgggcgctatgcgaatcaattactctggctactggcccactcacaactctttgggaaggatctcccggaaaattctggaacacaaccattgcagtatctatggcgaatatattcaggggtagttacctggctggagcaggattggctttttcacttatgaaatctttaggtggcggacgtaggggaacaggagctcaaggagaaacgttaggtgaaaaatggaagcgacaattaaaccaactaagtaagtcagagttcaatacatacaaaagaagcggaatcatggaagtggatagatcagaagcaaaagaaggacttaagcggggagaaacaacaaagcacgcagtctcccgtggtacagctaaacttcgctggtttgtggagcggaatctagtaaaacctgagggaaaagttattgacctcgggtgtggacgtggtggctggagctactactgcgcaggtttaaagaaagtcaccgaagttaaaggatacactaaaggtggccctggacatgaagaacctattcctatggcaacttatggctggaatctagtaaaacttcatagtggaaaagatgtcttcttcatgccacccgaaaaatgcgatacattattgtgtgacatcggtgaatcaagcccaaacccgaccatcgaagagggaaggaccttacgtgttttaaaaatggtagaaccatggctaagaggtaatcaattttgcataaaaattttaaatccttacatgccctcagtcgtggaaacattagaacagatgcaaaggaaacacggaggaatgttagtaagaaacccattgagcaggaatagtacccatgaaatgtattgggtttcatgtggaactgggaatatagtttcagcggtaaatatgacatctagaatgctacttaaccggttcaccatggctcatcgtaaaccaactttcgaaagagacgtagatttaggtgcaggtactcgacacgttgccgtagaaccggaagtagctaacttggacataataggtcagagaatagaaaatattaaaaatgaacataagagcacatggcattacgacgaagataacccatataaaacgtgggcatatcacggtagctacgaggtaaaaccttcaggatctgcttcctcaatggttaatggtgttgtaagacttctgacaaaaccgtgggatgtcattccgatggttacgcaaattgcaatgacagacacgacaccttttggacaacaacgcgtcttcaaagaaaaagtagacactcgaacaccgcgagcgaaacggggtaccacacagataatggaagtaaccgcaaaatggctatggggttttctttcaagaaataagaaaccacgcatatgtacaagggaagaatttacaagaaaagttaggagtaatgccgctatcggtgcagtattcgtcgacgaaaatcagtggaacagtgcaaaagaagctgtggaagacgaaagattttgggatctagtacatagggaaagagaacttcacaaacaaggaaagtgtgctacatgcgtgtataacatgatgggaaaacgggagaagaaattaggggaatttgggaaagcaaaaggatcgagagcgatctggtatatgtggttaggagcccgattcctagagtttgaagcactaggatttatgaatgaagatcactggttttcaagagaaaattcattatcaggtgtagaaggcgaaggtctacataaacttggttatatactaagagatatatctaaaataccgggcggaaatatgtatgccgatgacacagccggatgggatactcgcataactgaagatgatctacaaaacgaagcgaaaataacagacatcatggagcctgaacacgccttgctagctacttcaatttttaaactcacttaccagaataaagtcgtccgagttcagcgcccagccaaaaatggaaccgtaatggacgttatctcccgtagagatcagagaggttcaggacaagttggcacttacggactaaacacgtttactaacatggaagtgcagctaatacgtcaaatggagtctgaaggcatctttttgccttcagaattggaaacacctaacttagctgaaagagtgctcgattggcttgagaaacatggcgcagaacgccttaaacgcatggcgatatccggagatgattgcgtagtgaaacctattgatgataggtttgccacagctctcactgctctaaacgatatggggaaagtccgcaaagatatacctcaatgggaaccaagtaaaggctggaacgattggcaacaagttccattttgcagccatcattttcatcaactaatcatgaaagatgggcgagaaatagtagtaccatgtagaaatcaagatgagctagttggacgagcacgagtatcacagggggcagggtggtccctgcgagaaacagcgtgtctaggtaagtcgtacgctcaaatgtggcaattgatgtactttcatagaagggatctgcgattagcggccaatgcgatatgcagtgcagttcctgtagactgggtaccaacttctcgcacaacctggagcatacacgcacaccatcaatggatgacgaccgaggatatgctaagcgtctggaatagggtttggatagaagagaacccatggatggaagacaaaactcatgtatcatcttgggaagaagttccctatctgggaaaacgagaagatcaatggtgtggctcactaataggtcttacggcgagagcgacttgggccaccaatatccaagtggcgataaatcaagttagaagattgattggaaatgaaaactacctggactatatgacatcaatgaaaagatttaaaaatgaaagcgatccagaaggggccctttggtaa

SEQ ID NO: 21290 - RNA, 9879 nt, synthetic construct
  misc_feature 1..9879: note = derived and/or modified CDS sequence (opt6) from DENV-1__KJ189344__SS-prME
  source 1..9879: mol_type = other RNA
tcagtaacaatgttgttaatgctattaccgactgcgctagcttttcatctaacaacacgaggaggagaaccccatatgatagtatcgaaacaagaacgaggcaaaagcctgctatttaaaaccagtgccggtgttaacatgtgtaccttaattgctatggacctaggtgaactatgcgaagatacaatgacatacaaatgcccccaaattacagaagctgaacctgatgacgtggattgttggtgtaatgcaacagatacatgggtaacgtacgggacgtgctcccaaaccggcgaacatagacgggacaagagaagcgtcgctttagcacctcacgtgggtctaggactagaaacacgaacagagacttggatgtcatcggagggagcatggaagcaaatacaaagggtagaaacatgggctctacgccatccaggatttactgtaactgcactcttcttagcgcatgcaatcggaacaagtattactcaaaaaggtatcatatttattttgctcatgttagtaacgcctagcatggcgatgcggtgcgtagggatcggaaacagagacttcgtcgaaggtttgtcgggtgcaacttgggttgacgttgtacttgaacatggaagctgtgttactacaatggccaaaaataaaccgacgttagatattgaattattaaaaacagaagttacaaatccagcaatattgcgaaaattatgcatagaagcaaaaattagtaataccacgactgacagtcgttgccctacacagggcgaggcaaccctagttgaagaacaagatgcaaactttgtttgcagaagaacatttgttgatagaggatggggaaatgggtgcggattattcggtaaaggctctctcctcacatgcgctaaattcaaatgcgtcacaaaattagagggcaaaatagttcaatatgaaaatctaaagtatagcgtaatcgttactgtacacacaggagaccagcaccaagtaggtaatgaaactactgaacatggaacgatagctactatcactcctcaggcacccacttcggagattcaattaacagactacggagcacttactctcgattgtagcccaagaacaggattagactttaatgagatggtattactcacaatgaaagagaaaagttggttagtacacaagcaatggtttttagacttgccccttccctggacatcgggcgcttcaactagccaagaaacttggaataggcaggatttactggtaacattcaaaacagcccatgccaaaaagcaagaagtggtagttttaggtagccaagaaggtgcaatgcacacagcactgacaggagcaacagaaatccagactagcggaactacaactatatttgctggccacctaaaatgccgattgaaaatggataagttgacattgaagggtactagctatgtaatgtgcacaggaagtttcaaattagaaaaagaagtcgcagaaacacaacatggaactgtcctagtacaggtaaagtatgaagggactgatgctccctgtaaaatcccgttctctacacaagatgagaagggtgttacacaaaacggccgcttaatcactgcaaacccaatcgtaacagacaaagaaaagccagtcaacattgaaacggaaccaccctttggtgaatcctatattgttgtaggagctggagaaaaagctctaaaactgtcgtggttcaagaaaggcagctctattggtaaaatgtttgaagcgaccgcaaggggcgcccgccggatggcaatactaggtgataccgcatgggatttcggcagcatagggggtgtatttacaagcgttgggaaattagtgcatcaagtattcgggacagcgtatggagttttattttcaggagtttcttggacaatgaaaataggcatagggattctgctcacatggctgggtttaaactcaagaagtaccagtctatcaatgacatgtatagccgtagggatggtaacgttatacctcggagtaatggtacaggcagattccgggtgtgtagtgaactggaaaggaagagagttaaagtgtgggtcgggcatctttgtgacaaacgaagtacacacatggaccgaacaatacaaattccaagcagacagcccaaaacgcctaagtgccgcaataggcaaagcgtgggaggaaggagtatgcgggatacgaagtgcaactagactagaaaatattatgtggaaacaaataagcaacgaactgaaccatatactactcgagaatgatatgaaattcaccgtcgtagtaggggatgcaaatggcattttagctcaaggtaaaaagatgatcagaccgcaacccatggaacataagtattcgtggaaatcatggggaaaagcaaaaatcataggagcagacatccaaaatacaacttttattatcgacggacctgacacacctgaatgcccagataatcagcgtgcttggaacatatgggaagtcgaggactatggtttcggtatattcacaactaatatatggctaaagctccgggattcatacacccaaatgtgcgatcaccgcttaatgtccgcagctataaaggattccaaagctgtacatgccgatatgggatattggatagaatccgagaaaaatgagacatggaaattagctagggcatcatttatagaggtaaagacatgtacatggccgaaatctcacacactttggtcaaatggggtattagaaagtgaaatgatcattcccaaaatatacggcggtcctattagtcagcacaattaccgtcccggatattttactcaaacagcgggtccatggcatttagggaaattagaacttgattttgacttatgtgaaggaacaactgtagtggtagatgaacactgtggaaatagagggccctctcttcgcacaacaactgtaaccggaaaaataatacatgaatggtgctgccggagttgcactttgccacccttaagatttaggggagaggatggttgttggtatggcatggagataagaccagttaaagagaaagaagaaaatctggtgcgatccatggtatcagcgggaagcggggaggtagattcattttcactcgggatactttgtgtttccataatgatcgaagaagtcatgaggtccagatggtcaaggaagatgttaatgacaggaacattagctgtctttttattattagtcatgggccaattgacctggaatgatcttatacgactgtgtatcatggtaggggccaatgccagtgataggatgggaatgggtacaacatacctagccttaatggcaacgtttaaaatgcgtccaatgtttgccgtgggcttattgttccgaagactaacctcaagagaagtgttattactcacaattggactaagtctagtcgcaagtgtagaacttcccaatagcttagaagaactaggagacggactagcaatgggtataatgatgctaaaattattgacagaatttcagccgcaccaattatggactacattactatctctcactttcattaaaacaaccctctctcttgactacgcttggaaaacaacagctatggctttaagtatagtatccttattccctctatgtttatctactacctcccaaaagacaacttggctgcccgtccttctaggatcattcgggtgtaaaccgctaacaatgtttctcatcaccgaaaacaaaatatggggaagaaaaagttggcccttaaatgaaggtatcatggcaatagggatcgtctcaatcctcttatcaagcctcctcaaaaatgatgttcccttagcgggaccgcttatagctggaggtatgctcattgcctgttacgtaatatcagggtcatctgccgacctatcactagaaaaagcagctgaggtgtcgtgggaacaagaagcagagcacagtggtacaagtcacaatatcctagtagaggtacaagacgatggtaccatgaagattaaagacgaagaaagagacgatacgctaaccatattattaaaagctacactactggcagtatcaggagtttatccgatgtcaataccagcaacactcttcgtatggtacttttggcagaaaaagaaacaaaggagtggcgtactatgggatacacctagtccacccgaagtggagagggcggtattagatgatggtatatatagaatattacagcgtggattactaggaagaagtcaggtgggtgtaggcgtatttcaggacggggtatttcatactatgtggcacgtaacgagaggtgcagtattaatgtatcagggtaaaagattagagccatcttgggcttctgtcaagaaagatctaatttcctatggtggtggatggcgctttcagggttcatggaacactggtgaggaagttcaagtcattgccgtagaacccggtaaaaatccgaaaaatgtgcaaacaacacctggaacattcaagactcctgaaggcgaggtaggggcaatagcgctggactttaagccaggaacatcaggatcgcctatagtaaaccgtgagggcaagatagtggggctctacggaaatggagtagtcacaacctccggcacgtatgtgagtgcaatagcacaggcaaaagcatcccaggagggcccattaccggaaattgaagacgaagtttttaagaaacgcaacctaactattatggatttacatcccggcagcggtaagaccagaaggtacttgcccgcaattgtcagagaggcaattaagcgaaaactcagaactctcatcctcgccccaacaagggttgtagcgagtgaaatggcagaagcacttaagggtatgccaataagataccaaaccacggccgtaaaaagtgaacacactggaagagagatagtagaccttatgtgccacgcgacgtttacgatgagactattaagtccggtacgagtgccaaattacaatatgattataatggatgaggcacattttaccgatccagcgagtatcgccgccaggggatatatatcaacacgcgttggaatgggagaagcagcggcaatattcatgactgcgacaccacctggaagcgtcgaagcatttccacagagtaatgccgtaattcaagacgaagagagggatataccggaacgttcttggaactcgggttatgattggataacagatttccctggaaaaaccgtgtggttcgttcccagtataaaatcaggcaacgatatagcaaactgtcttcgcaaaaatggaaaaagagtcattcaattatcaagaaagactttcgatactgaatatcagaaaacgaaaaataacgattgggattatgtagtcactactgacatatcagaaatgggcgcaaattttcgcgcagacagagtgatagaccctcgtagatgtctcaaaccagttattctgaaagatggtccggagagagtcattctcgcagggcctatgccagttacagttgcgtcggccgcacaacgaagaggacgaattggacggaatcaaaataaggaaggggatcaatatgtttacatgggacagcctcttaataacgatgaagatcatgctcattggacagaagctaagatgctactagacaatattaacacccctgaagggatcatcccagctctttttgaaccagagcgggagaagtcagcagctatagatggagaatatagactcaggggtgaagcaagaaaaacattcgtagaactaatgagaagaggagatctgcctgtttggttgtcgtataaagtagcgagcgaaggttttcagtactctgacaggcgctggtgttttgacggagaacgaaacaatcaagtattggaagaaaacatggatgtagaaatatggaccaaagagggagaaaggaagaaactgaggcctcgctggcttgatgcaaggacatactccgatccacttgctctacgcgagtttaaggaatttgcggccggtagaagaagcgtaagcggagatttaatattagaaataggtaaacttccacaacacttgacacttagagcacaaaacgccctagacaatcttgtaatgttacataattcagagcaaggaggaaaagcatatcgacatgccatggaggaactaccggataccattgaaaccttaatgttgcttgctctaattgctgttctgacaggtggcgtaaccttattctttttgtctggtaaggggcttgggaagacctcaattggtcttttatgtgtgacagcaagtagtgctctactatggatggcgtcggtggaaccccattggatagcagctagcattatactagagtttttcttaatggtactactaataccagaaccagatcgccaaagaaccccacaagataatcaactagcctacgtagttattggtctgctttttatgatcctcacagtggcagcaaacgagatgggattacttgagacaacaaagaaagatttaggtataggtcatgtagccgcagaaaatcatcaacatgcgacgatgctcgatgtagatcttcgaccagctagtgcctggactttgtatgccgtagccactacggtaattactccaatgatgcggcacactatagaaaataccacagcaaatataagtttaactgctatagctaaccaagcggctattttaatgggtctagataaaggctggcctatatctaagatggacattggagttccactcctagcattaggctgttactcgcaagtgaatcccctaactttaacggccgccgtattgatgctcgtagcacactatgcgatcatcggcccaggattgcaagctaaagcaacgagagaagcgcaaaaacgcacggctgccggaataatgaaaaatcctacagtagacggcatagtagccattgacctagacccagtagtttatgatgcaaaattcgaaaagcaattaggacaaattatgctacttatcctgtgtacctctcaaatattgttaatgagaacaacatgggcactctgcgaatcaatcacgctagccacaggcccattaacaacgttatgggaaggatcacctggtaagttctggaacacgactatcgccgtatcaatggcaaatatattccggggatcttacttagcaggagcaggtttagcattctccctcatgaaaagtctcggtggaggtagaagaggtactggcgcacaaggtgagacattaggtgaaaaatggaaacgacaactaaaccagttaagtaagtcagagttcaatacatataaaagatcagggataatggaagttgataggagtgaagcaaaagaaggcctgaaacgaggggagacaactaagcatgccgttagtaggggaaccgctaaactgagatggtttgtagagcggaatctggtaaaaccagaaggtaaagtaatcgatttagggtgtggtagaggcggttggtcatactactgtgcaggtctcaagaaagtcacagaggtcaaagggtatactaaagggggtccaggccatgaagaacctatacctatggcaacttatggttggaacctagtcaaactccatagcggaaaggacgtattcttcatgccacctgaaaaatgtgatacattactttgtgacataggagaaagttctccaaacccgaccatagaggaaggacgaacattacgagtattgaaaatggtcgagccatggctaagaggaaaccagttttgtattaaaatcttaaacccatatatgccaagtgtagtagaagcattagaacaaatgcaaagaaaacatggaggaatgctagtacgaaatcctttatctcgtaatagcacccacgagatgtattgggtgagctgtggcacaggaaatattgtaagcgccgtaaatatgacctcacgtatgctactaaatagattcactatggctcatagaaaaccgacgtacgaacgggacgttgatctcggtgcaggtacaagacatgtcgctgtggaaccagaagttgcaaatttagatataattggacaacgaatagaaaacataaagaatgaacataaatctacatggcactacgacgaagataatccctacaaaacatgggcttaccatggatcatacgaggtgaaacctagtggcagcgcctcaagtatggtgaatggggtagtgagactgttaactaaaccttgggatgtaatcccaatggtgacacagatagcaatgactgacacgacgccatttggtcaacaaagagtattcaaggagaaagtagatacacgaacacccagagcaaaaagaggtacaacgcagataatggaagtcaccgcaaagtggttatggggttttctcagcagaaataagaagcctaggatctgcaccagagaagaatttactaggaaggtaagatcgaacgccgccattggagctgtatttgtagatgagaatcaatggaactcagcgaaagaagcagtcgaggacgaacgtttttgggacttagtgcatcgagaacgagagcttcataaacaaggtaagtgtgcaacatgcgtctataatatgatggggaaaagagagaagaaacttggagagttcggcaaggctaagggaagccgtgcaatttggtatatgtggcttggcgcacgatttctcgagttcgaggctttaggcttcatgaatgaagaccattggttttcacgagaaaattcactcagtggagtcgaaggtgaaggactgcacaaactaggatatatcttaagggacatatctaaaataccaggcggaaatatgtacgctgacgatacggctggttgggataccagaataacggaggatgatctccagaatgaagctaaaataacggagataatggaacccgaacatgcacttctcgccacaagtatatttaagttaacatatcaaaataaagtagtgcgcgtccaacgaccagccaaaaatggcactgtgatggacgtgatatcccgccgggaccagaggggtagtggccaggtgggtacctatggtttgaataccttcaccaacatggaagttcaacttatcagacaaatggaaagcgaggggatattcctaccgtctgaattagaaacgccaaacttggcagagagagtattagactggttagagaagcacggcgcggaacgactgaaacgtatggctatttcaggtgacgactgtgtagttaaaccaattgatgaccgcttcgcgacagccttgacagcgttaaatgatatgggaaaagtaagaaaagatattccacaatgggaaccatctaaggggtggaacgactggcaacaagttcctttttgttcgcaccattttcatcaattaatcatgaaagatggaagagaaatcgtcgtaccgtgtagaaatcaagatgaactcgtgggacgagcgcgtgtttcgcaaggagccggttggtcactacgggagacagcatgtcttggcaaatcctatgctcaaatgtggcaactcatgtattttcacagaagggatttaagactagcagcaaacgcaatatgttccgcagttccagttgattgggtaccaacttctcgaacaacctggagtatacatgcacatcatcaatggatgacaacggaggacatgttatccgtgtggaatagagtttggatagaagagaatccgtggatggaggataaaacacacgtgtcaagctgggaggaggtcccatatttagggaaaagagaggatcaatggtgcggaagcctaatcggcctgactgcgcgtgctacatgggccacgaacatccaagtagcgataaatcaagtgcgcagacttatcggaaacgaaaactatttagactacatgacgagcatgaagcgttttaagaacgaaagcgatcctgagggagccttatggtaa

SEQ ID NO: 21291 - RNA, 9879 nt, synthetic construct
  misc_feature 1..9879: note = derived and/or modified CDS sequence (opt6) from DENV-1__KJ189346__SS-prME
  source 1..9879: mol_type = other RNA
agtgtaactatgcttttaatgctcttacccacagctctcgcattccatctgactactcgaggaggagaaccccacatgatcgtatccaaacaagaaagaggaaaatccctattattcaaaacttcggctggagttaatatgtgtacacttatcgccatggatctaggagaactatgtgaagataccatgacatacaaatgcccgcaaattacagaagccgaaccggacgacgtagattgctggtgcaatgcaacagacacatgggtgacatacggtacatgttctcagacaggtgaacacaggagggataaacgatcagtagctctggcaccccatgtaggactgggcctagaaacaagaactgaaacatggatgagttctgaaggggcctggaaacaaattcaaagagttgaaacttgggctttacgacacccgggtttcacagtaatagcgctattcttggcacatgcaataggtacatcgataactcaaaaaggcatcatattcatactacttatgcttgtgacaccctcaatggcgatgagatgtgtgggtatcgggaacagagattttgtagaaggactttctggggcaacatgggtcgacgttgtcttagaacatggaagctgtgtcaccacaatggctaaaaataaaccaacattggacatagaattactcaaaaccgaagttactaatcccgcaattctacgaaaattatgcatagaagcgaaaattagcaatactacaacggactctcgttgtccaacgcaaggtgaggcgaccttagttgaagaacaagacgccaatttcgtctgtaggagaacattcgtggacagaggatggggaaacggttgtggcctttttggcaaaggaagtttgttgacttgtgccaaatttaaatgtgtaacaaaactagaaggaaaaatcgttcaatatgaaaatctcaaatattcagttatcgttacagtgcatacaggagaccagcatcaggtaggcaacgaaactacagaacatggaaccatagcgacaatcacgccacaagctccaacatcggaaatacaattaaccgattatggcgctctcactttggactgttcgccaagaactggattagacttcaacgagatggttcttttaactatgaaagaaaaatcatggcttgtgcataaacaatggtttttggatttacctttgccttggacaagcggggcctcgacaagtcaggagacttggaaccgacaagacctattagtaacatttaaaactgcgcacgccaagaaacaagaagtggtggtattaggctcacaggaaggcgcaatgcatactgctttaacgggagctactgagatccaaatgagcggaactaccacaatattcgcgggccatttaaaatgccgccttaaaatggataaattaacactcaaaggtacaagttatgtcatgtgcacagggagttttaaactagaaaaagaggttgcagaaacacaacatggaacggtacttgtccaagtaaaatatgagggcacagatgcaccttgtaaaattccattttcaactcaagacgaaaagggggttacacagaacggaagattaataacggcgaaccccatcgtaacagataaggaaaaacctgtgaatatagaaacagaaccccctttcggagaaagctacatagtagtgggcgccggagaaaaagctcttaaactctcatggtttaagaaaggctcaagtataggaaaaatgtttgaagcaacagctaggggtgcccgtcgtatggccatccttggcgataccgcatgggactttggcagtataggaggagtttttacgagcgttggcaaactggtccatcaagtatttggaacggcgtatggtgttttgttttctggagtgagttggacaatgaaaatagggataggtatactattaacgtggttaggtttaaactctcgcagtactagcttgagcatgacttgtattgcagtaggaatggtcacactatacctcggagttatggtgcaggctgattcaggatgtgtaattaactggaaaggtcgcgaattaaaatgcggatcaggcatatttgtaactaacgaagtgcacacatggactgagcagtataaatttcaggccgattcacccaaaaggcttagtgcagcaataggaaaggcttgggaagaaggcgtatgtggtattcgtagcgctaccagattagagaacataatgtggaaacaaatttcgaacgaactcaaccatattctactggaaaacgatatgaaattcactgtagtggtaggagatgccaatggcatattggcacaaggtaagaagatgatacgtccgcaacctatggaacataagtactcgtggaagtcttgggggaaggcaaagataataggggcggatatacaaaacactaccttcataatagatggaccagacactccagagtgccctgacaatcaacgagcctggaacatttgggaagttgaggattatggtttcggcatattcactactaacatttggctaaaactcagagattcatacacgcaaatgtgtgaccacagattaatgtctgccgcaattaaagactcgaaagctgttcacgcggatatgggatattggatagaaagcgagaaaaacgaaacgtggaagctggcgcgcgcttcatttattgaagtgaaaacgtgtacatggcctaagagccacacattatggagtaacggtgtaatggagagcgagatgattattccgaagatttatggagggccaatatcacaacacaattacaggccggggtactttacacagactgcaggtccttggcacttaggcaagttagagctggactttgatttatgcgaaggcactacagtagtagtggacgaacactgtggaaatagaggtcctagtttaagaactaccaccgtaactggaaaaataatacacgaatggtgctgccgtagttgtaccttaccaccattgcgattcaggggagaagatgggtgttggtatggtatggaaatccgaccagtaaaagaaaaggaagaaaatctagtaaggtctatggtaagtgcgggttccggagaagtagacagtttctctttaggtattttatgtgcatccatcatgattgaggaagttatgcgctcgagatggtcgcgaaaaatgctaatgaccggaacacttgcggtattcctcctattagtcatgggacaactaacgtggaacgacctcataagattgtgtatcatggtgggagcaaatgcaagtgatcgaatgggaatgggaacaacttatcttgcactaatggcaactttcaaaatgagaccgatgtttgccgtaggcctcctctttcgaagattaacaagtcgtgaagtcctactgttgactataggcttaagtctggtggcatctgtagaactaccaaactcgctggaagaacttggtgatggtctggctatgggcataatgatgttgaaactgctcacggagtttcagccacaccaattgtggacgacattattatcactcacctttattaagactactttgagccttgactatgcttggaaaaccaccgcgatggcattgagtatagtatcactctttccactttgcctatctacaacgagtcagaaaacaacatggctaccggttctactagggtcttttggctgcaagccattgactatgtttctaattacggaaaataaaatctggggacgcaaatcatggcctctcaacgaaggtataatggctatcggcattgtctccatcctattaagctctctacttaaaaatgacgtacctctagcaggtccactaatagctggagggatgttaattgcatgttatgtgatttctggaagctctgcggatctgtcccttgaaaaggctgctgaagtctcatgggaacaagaagcagaacactccggtacatcacataatattctggtcgaggtacaagatgatggaactatgaaaataaaagacgaggaaagagatgacacattaacaatcttacttaaagccacgctattagccgtcagcggagtttacccaatgagtatcccagcaacactatttttatggtatttctggcagaagaagaaacaaaggtctggcgtactttgggatactccttcaccaccagaagtagaaagggcagtgttggacgatggtatttacaggattcttcagcggggacttctgggtcgatcacaagtaggtgtaggagtttttcaggacggagtgttccacactatgtggcacgtgacaaggggagcagtattaatgtatcaaggaaagcgtttagagccctcatgggcttcagttaaaaaggacttaatatcatatggtggcggatggcgatttcaaggcagttggaatacgggagaagaagtccaagtaatagccgtcgagcctggcaaaaatccgaaaaacgtgcaaacaaccccagggacattcaaaactcccgaaggtgaagtaggagcaatcgcacttgattttaagcctggaacatcaggaagcccgattgtaaacagggagggcaaaattgtcggactatacggaaatggagtcgttacaacatcgggcacgtatgttagcgctattgcccaagcaaaggcaagtcaagaagggccgctgccagaaatcgaggacgaagtattcaagaaacgtaatttaacaataatggatttacacccaggatcgggaaagactaggaggtacctaccagctatagtacgtgaagccattaaacgtaaacttaggactttgattctagccccaactagagtagtagctagtgaaatggcagaggcgttgaaagggatgccaattagataccagacgacagctgttaaaagcgagcataccgggagagaaatagtagatctgatgtgtcatgcaacttttacaatgaggctactatcgcctgttagagtaccgaactacaacatgataattatggatgaagcgcattttacagacccggcatcgattgcagctagaggatacatatctactagagtaggaatgggagaggcggcggcgatatttatgacagctacaccacccggaagtgtagaagccttcccacaatcaaacgcagttattcaggacgaagaaagggacataccagaacgtagttggaactctggatacgattggatcacagattttccgggaaagacggtttggttcgtccccagcatcaagagtgggaatgatatagcgaactgtttacgtaaaaatggcaaaagagtaattcaattaagtaggaaaacttttgacactgaatatcagaaaacgaagaataatgactgggactacgtagtgacaacagatatttcagaaatgggagcaaatttcagagcagatcgagtaatcgacccccgaagatgtctgaaacccgtcatactaaaagatgggccggaaagagtcatcctggcagggcctatgccagtaacagtagcttcagcagcccaacgccgtggaagaatcggtcgtaatcaaaataaagaaggtgaccagtatgtatacatgggacaacccttaaataacgacgaagatcacgcacactggactgaagcaaaaatgttattggacaatattaacactccagaaggaattattccggcattatttgaaccggaacgtgaaaaatctgctgcaatcgacggagaatatcgcttaaggggagaggcccgtaaaacatttgtagaacttatgagacgaggagatcttccagtatggctgtcatataaggttgcttcagaaggctttcagtattcggatcgccgatggtgtttcgatggtgaaagaaacaatcaagttcttgaggaaaatatggatgtagagatctggaccaaggagggagaaaggaagaaactacgacctagatggttggacgcgcgcacttatagcgatcctctggctttaagggagttcaaggaatttgccgcaggaagacgcagcgtgtccggagatttgatacttgaaataggtaaactgccacaacatttgacaagtagagctcaaaatgcgctagataatttagtaatgttacacaattcagaacaagggggaaaagcctatagacatgccatggaagaactgcctgatacgatagagacacttatgttattggctttaatagcggtgctcacaggtggagtaacgttgtttttcttatccggaaaaggccttggtaaaacatcaataggactgctatgcgttacagcttcatcagcacttctatggatggccagtgtggagccacactggatagcggcatccattatacttgaatttttcttgatggtccttttaataccggaaccggacaggcaacgtacaccacaagacaatcaacttgcctacgtcgtaataggattactgtttatgatacttacggtagccgctaatgaaatgggactacttgaaacaactaagaaagatcttggcatcgggcacgtagcagcagagaaccaccaacatgccacaatgctcgatgtagatttgcgtccagcatcggcttggaccctatatgccgtagctacaacagttattactcctatgatgcgacatactattgaaaatactacagcgaatatttcactaacggctattgctaatcaagcggctatattaatgggactagataaaggatggccaatttcgaagatggacataggcgtaccacttctcgcgttaggttgctattctcaagtgaacccactcacattaacagctgctgtcttaatgttagtagcccactacgcgataataggacccggactacaagccaaagcaacaagggaagcacaaaaacgaacagcagcaggaataatgaaaaatccgaccgtggacggcattgttgctatagatttagatccagtagtgtatgacgcaaagtttgaaaagcagctgggacaaattatgcttctaatattatgcacaagtcaaattctgcttatgagaactacctgggctctctgtgaatcgatcacactagcaacaggacctctaacgactctgtgggaaggttcgcctggtaagttttggaataccacgattgcagtgagcatggcgaacatcttccgaggttcctatttagctggtgcgggcctggctttttcccttatgaagagtttaggaggaggcagaagaggaaccggcgctcaaggagaaactttaggggaaaaatggaaaagacagttaaatcaattatccaaaagtgagtttaacacatataaacgttctggaataatggaagtagaccggagcgaagcaaaagaaggtttaaaaagaggggaaacaacaaaacacgcagtatcaagaggcaccgctaagctcaggtggttcgtggagaggaacctagtaaaacctgagggcaaagtcatcgacttaggatgtgggcgaggagggtggtcatattattgtgcgggactcaagaaagttacggaagtaaaagggtatactaaaggtggcccggggcacgaggagccgatacccatggcaacgtatggatggaatctcgcaaaattacattctggaaaagatgtgttcttcatgccaccagagaagtgtgatactctcctctgtgacattggagagtcaagtccaaacccaactatagaagaaggtagaactttacgagtattaaaaatggtagagccatggctaagaggaaatcaattttgtataaaaattctaaatccatatatgccaagtgtagtggaaacgttagaacaaatgcaacgaaaacacgggggtatgctagtacgaaaccctctgtctaggaacagtacacacgaaatgtattgggtttcttgtggaacaggaaatatagtgagtgccgtaaatatgacgagtaggatgctcctgaatagatttactacagcacatcgtaaacctacatacgaaagggacgtggatttgggagctggcacaaggcacgttgctgtggagccagaagtggcaaatctagacatcatcggacaacgtatagagaacatcaaaaacgaacataaaagtacttggcattatgatgaggacaatccctataaaacatgggcttatcacggtagttacgaagtaaagccatctggaagtgcatcgagtatggttaacggagttgttagattactcaccaagccatgggacgttattcctatggttacccaaattgctatgactgacactactccattcggacaacagagggtttttaaagagaaagtcgatacgcgaacccccagagccaagcgaggaactacacagattatggaggtaaccgctaaatggctatggggcttcctatcgcgcaacaagaaaccaagaatttgcacacgcgaagagttcacacgtaaggtcagaagtaatgcagcaataggcgcagtatttgttgatgaaaaccaatggaatagcgccaaagaagcggtcgaggatgaaagattctgggacctagtacatagagaacgggagctacacaaacagggtaaatgcgcaacttgcgtttataatatgatgggaaaaagagagaagaaattaggagaatttggaaaagcaaaaggaagtagagcaatatggtacatgtggctcggagcgcgctttttagagttcgaagcgttagggtttatgaatgaagatcattggtttagccgagaaaatagccttagtggtgtagaaggagaaggattacacaaattaggatacatattaagagatatatcaaaaatacccggagggaatatgtatgcggatgacacagctggatgggacactcgtattaccgaggatgacctgcaaaatgaagccaaaattacagaaataatggaacctgaacacgccctcctggctacttccatatttaagttgacataccaaaacaaagtagttcgagtacaacgaccggcgaaaaatggcactgtaatggacgtcatttcacgtagagaccaaagggggtcgggacaagtaggaacgtacggtttaaacacgttcacgaatatggaagtacaattaataagacaaatggagtctgaagggattttcttaccatcagaactggaaacgcctaatttagccgaaagagtattggactggttagagaaacatggtgcggaacgtcttaaacgtatggcaatctcaggagatgactgtgttgtaaaacctattgacgataggtttgctactgcgttgactgcactaaacgatatgggaaaagtacgaaaggatatactacaatgggagccgagcaaaggatggaacgattggcaacaggtacccttctgttcacatcattttcatcaattaataatgaaagatggtagagaaatcgtagtgccctgcaggaatcaagatgaattagttgggagggctagagtatctcaaggtgccggttggtcactaagggaaaccgcttgcctgggtaaatcttatgcccaaatgtggcaacttatgtatttccaccgaagagatctaaggctagcagcaaacgcaatatgttctgcggttccagtcgactgggttccgacatcacgaacaacatggtcaatacacgcacatcatcaatggatgacaaccgaagatatgttgtcggtctggaatagagtatggatagaagaaaatccctggatggaagataagactcatgtctctagttgggaagaagttccttatctgggaaaacgtgaggatcaatggtgtggtagcctaatcggacttacagctagagctacgtgggcaaccaatatacaggtggcaatcaatcaggtaaggcgacttattggaaacgaaaactatttagattatatgacgtcgatgaagagattcaaaaatgaaagtgaccctgaaggggcgctttggtaa

SEQ ID NO: 21292 - RNA, 9879 nt, synthetic construct
  misc_feature 1..9879: note = derived and/or modified CDS sequence (opt6) from DENV-1__KJ189347__SS-prME
  source 1..9879: mol_type = other RNA
tccgtgactatgctactaatgctattgcccacagcacttgcttttcatctcactactcgcggtggagaacctcacatgatagtttcaaagcaagaaaggggtaagtcactgctatttaagacgtctgctggtgtaaacatgtgcactctaattgcgatggacctaggagaactatgcgaagatactatgacatataaatgtccacaaattacagaagcagaaccagatgacgtcgattgctggtgtaatgcaacagacacatgggtaacctatggtacatgctctcaaacaggtgaacatcgtagagacaaaagatctgtggcactcgcaccgcacgtagggctggggcttgaaactcgtacggaaacgtggatgtcttctgaaggtgcgtggaaacaaatacaaagggtcgaaacttgggcgttaagacatccaggttttaccgtaatcgcgttgtttttagcccatgccataggaacaagcattacgcaaaaaggaataatttttatactccttatgctcgtcacaccttcaatggccatgcggtgtgtaggaataggaaatagagattttgtagaaggattgtcaggggctacttgggtggacgtcgtactggaacatggttcgtgtgtgactacaatggccaaaaataaaccaacattagacatcgaactgctgaagaccgaagtaactaatcctgctatattacgcaaactttgcattgaagccaaaattagtaacaccacaacagatagtaggtgccccacccaaggcgaagccaccttagtagaagaacaggatgcgaattttgtgtgccgaaggacattcgttgatagaggctgggggaatggatgtggcctattcggcaaggggtcccttttaacttgcgcaaaattcaaatgtgtaaccaaattagaaggtaagattgttcaatacgaaaacctgaaatatagtgttatagtcacggtccacacaggtgatcagcaccaagtaggtaatgaaacgacagaacacggtacgattgcaaccataaccccacaggctccaacttcagaaatacagctgactgattacggagcccttacactggactgcagtcccagaaccgggctagatttcaatgaaatggtgctactaactatgaaagagaaaagctggttagtgcacaaacaatggtttttagatcttcctctgccctggacaagtggagcctcaacctcgcaggaaacatggaaccggcaagatctgttagtaacattcaaaacagcgcacgccaagaaacaagaagtagtagtattagggagccaagaaggggctatgcatacagcattaacaggagcgaccgaaatacaaacctcaggtacaaccacgatatttgcaggtcatctaaaatgcagattaaaaatggataagctcactttgaaaggaacgtcgtacgtgatgtgtacaggcccattcaaattagaaaaagaagtagccgaaacgcaacatggaacagtgttagtgcaagtaaaatacgaaggaacagacgctccttgcaaaattccttttctcacacaagatgaaaaaggtgttacacaaaatgggagactaataaccgcaaatccaatcgtaacagacaaagaaaaacctgttaacatagaaacagaaccacctttcggggaatcctatatcgtagttggtgctggtgaaaaggcattaaaattaagctggtttaaaaagggatcatctataggcaaaatgttcgaagcaacggctagaggcgcacggcgaatggcaattctaggcgatacggcatgggatttcggctcaataggcggtgtctttacaagtgttggaaagctagtacatcaggtatttggaaccgcatacggtgtgctattttccggcgtttcatggactatgaaaataggtatagggatattgctaacatggttaggattaaactcaagatcgacaagtctctctatgacctgtattgcagttggtatggtaacactatatctcggagtcatggtacaggcagattcaggatgtgtaattaattggaaaggtagggaattaaaatgtggctcaggaatcttcgtaaccaatgaagtgcatacgtggacagaacaatataaatttcaagcagactcacctaaacgactaagtgcagcgataggtaaagcatgggaagaaggtgtatgcggtatccgaagcgcaacgagactagagaacattatgtggaaacagatatcaaacgaactaaaccatatactcctagagaacgatatgaagtttactgttgttgttggagacgctaacggaatactagcacaaggcaagaaaatgatacgtccacaaccaatggaacataaatatagttggaaatcatggggaaaagctaaaataataggggcagatatacaaaataccacgtttatcatagatggaccagacacacccgaatgtccggataaccaaagagcatggaacatctgggaagtagaagattatggattcgggatttttaccacaaatatttggttgaagttgagggacagttatacgcaaatgtgtgatcatagactaatgagtgcggccataaaagactcaaaagccgtacacgcagatatgggctattggattgaaagcgagaaaaatgaaacatggaagttagcacgggcgagctttattgaggtcaaaacttgcacatggcctaagtcccatacattatggtccaatggagtgctagaatcggaaatgataattcctaaaatatacggaggccccatatcgcaacacaattacagacctggctatttcactcaaacagcaggaccctggcacctcggaaaattagagctagatttcgatctatgcgagggtacaacggtagtcgtagatgaacactgtggaaatagaggtcctagcctaagaacgactaccgttacaggaaaaataattcatgaatggtgttgcaggtcatgtactttacctccccttcggtttaggggcgaagatggctgctggtacggcatggaaataagaccagtgaaagaaaaagaagagaatttggtaagatcaatggtgagcgctggaagtggggaagtggattcattctccctaggcatattgtgcgtgagtataatgatcgaggaagtgatgaggtcgcgctggagtagaaaaatgttaatgaccggtacgctagccgtgttcttactgcttgtgatgggacaactcacttggaatgacttaattcgactatgtattatggttggagcgaatgcaagcgaccgaatggggatggggacaacttatttggccctaatggcaactttcaaaatgcgccctatgtttgcagttggcctattgtttagacgcttaacctcgagagaagttctgttgctgacaattgggttaagcctaatggcgtcagttgagctgccgaactctctagaagaacttggagatgggttggcgatggggattatgatgctaaaacttttgacagagttccaaccacatcaattatggacaacgctactatcactcaccttcataaaaaccacgctttcactagactatgcatggaaaaccaccgcaatggctctctccatagtgtcactatttccactttgtctgtccacgacaagtcagaaaactacttggctaccagtcttactgggttcatttggatgtaagccattgacaatgtttttaattactgaaaacaaaatctggggaaggaaatcatggccgttgaatgaagggatcatggcaatcggaattgtatcaatattgttatcgtcgttactaaagaacgacgtaccattggcaggaccattaatcgcgggcggaatgttgatagcatgctacgtgataagtggaagttcagctgatctaagtcttgaaaaagcagcagaagtgagctgggaacaagaggctgaacatagcggcacttcccataatatacttgttgaagttcaggacgatggaaccatgaaaataaaagacgaagaacgggacgatacattaactattctccttaaagcaactttattagcggtatcaggtgtctatccaatgagtattccagcaactttattcgtatggtatttctggcagaagaagaaacagagatccggggtactttgggatacaccaagccctcccgaagttgagcgggcagtattagacgatggaatatacagaatcttacagagaggtttgctaggccgaagtcaggtaggtgtaggggtttttcaggatggtgtgttccacacaatgtggcacgttacacgaggagcagtactaatgtatcagggaaaaagattggaaccatcatgggcttcagttaagaaggatttgatttcgtatgggggaggatggcggtttcagggctcatggaacactggtgaagaggtacaagtgattgcagtagaaccaggcaaaaatcctaagaatgttcagaccacaccaggaacctttaaaactcccgaaggggaagttggtgctatcgcactggacttcaagccaggtaccagtggttctcctatagttaacagagaaggtaagatagtaggactatatggaaacggtgtagtgacaacgtcaggaacttacgtatcggcgatagcacaggctaaagcgtcgcaagagggtcctctaccagaaatagaagacgaagtgtttaaaaagagaaaccttacaattatggatctccacccagggtctggaaagacccgtcgatacctaccggctattgtccgtgaagccataaaaagaaaactcaggacactcattttagctcctactcgagttgtcgctagcgaaatggcagaagcactcaaaggtatgcctatacgatatcagacaacggctgttaaatctgaacatacaggcagagagatagtagacctaatgtgccatgccacttttacaatgcgcttgctgagcccagtgagagtaccaaattataacatgataattatggatgaagcacattttactgacccagcctctattgccgctcgagggtacatcagtaccagagtaggtatgggggaggctgcagcaatctttatgacggcgacgccaccaggaagcgtagaggcctttcctcaaagcaatgcagtaattcaagatgaagaacgagatatacccgagagatcctggaactctgggtacgactggataactgatttccctggtaagaccgtctggttcgtaccgtcaatcaaatcaggaaacgacatagcgaattgtctgcgcaaaaacggaaaacgtgtcatccaattgtccaggaagacgttcgacactgaatatcagaaaaccaaaaataatgattgggactacgtcgtgaccactgatatttcagagatgggcgccaatttccgagcagatcgagttattgacccacgtaggtgcttaaaacctgtaatattaaaggacggacctgaaagggtgatactcgccggaccgatgcctgttacagtagcaagcgccgcccaaagaaggggcagaatcgggcgaaatcaaaacaaagaaggggatcaatacgtatatatggggcaaccgttgaataacgatgaggaccatgcacattggactgaagcaaagatgttactcgataatataaatacacctgaggggatcattcctgccctctttgaaccagaaagggagaaaagtgccgccatagacggggaataccgacttagaggagaagcaagaaaaacattcgtagaacttatgcgtaggggagatctacctgtatggctctcttacaaagtcgcatcggaaggattccagtattcggatcgtcgttggtgtttcgatggagagagaaataatcaagttttagaggaaaatatggatgttgaaatttggactaaggaaggagaaagaaagaaacttagaccaagatggttggacgcccgaacctactccgacccactcgcattgcgagagttcaaagagttcgcagcgggaagacggagtgtcagtggggatttaatcctggaaataggtaaattacctcaacatttgacgctacgagcccagaatgctttagataatcttgttatgttacacaactccgagcaagggggaaaggcgtatcgtcatgcaatggaggagttgcctgacaccatcgaaacattaatgctactagcgctgatagctgtattaactggcggggtaactttattctttttatcgggaaagggactagggaaaacatccatcgggttattatgcgtaactgctagctccgcgctactatggatggcatcagtagaaccccattggatagctgctagtattatccttgagttctttctaatggtactattaataccagaaccagaccgtcaaagaacaccgcaagataatcagctagcatatgtggttatcggtttattatttatgatactaaccgtggcagcaaacgaaatgggtttactcgagacaactaagaaagatctaggaattggacacgtagcggccgagaatcatcaacatgcaaccatgttagatgttgacttaagaccagcttccgcctggaccttatacgcagtagcgacaaccgtaatcacgccaatgatgcgtcataccatagaaaatactacggcaaatatctctttgacagccatcgctaaccaagcagctatcctaatgggactcgataaaggatggcccatatcaaaaatggatatcggagtgccacttcttgcactaggatgctattctcaagtaaatcccttgacactcacggcagccgtacttatgcttgtggcgcactatgcaataatagggcctggattacaagcaaaagcgacgagagaggcacagaaaagaacagcagcaggcataatgaaaaacccaacagtagacgggatagtagctatagaccttgatcccgtagtctatgatgccaaattcgaaaaacaactgggacagatcatgttgctaatactatgtacatcacaaatattattaatgagaacaacttgggctctgtgtgaatcaattaccctagctaccgggccgctaacaactctctgggaaggaagtccaggtaagttttggaacactacaatagcagtgtctatggcaaatatatttagaggttcatatctggcgggagccggcctagccttttcattaatgaaaagcctgggtggcggaagaagaggtacaggtgcacaaggagaaacattgggtgagaaatggaaaaggcaactaaatcaactatcaaaatccgagttcaatacctataaacgtagcggaatcatggaggttgatcgatccgaggcaaaagaagggttaaaaagaggtgaaacaacaaaacatgcggtatcaagaggaaccgctaaacttagatggttcgtggagagaaatctagtaaaacctgaaggtaaagttatcgatcttggttgcggaagaggtggctggtcttactactgcgcaggattaaagaaagtaaccgaagtaaaaggatatacaaaaggcggccccggacatgaagaaccaataccaatggcaacctatggttggaatttagtaaaattacattcaggcaaagatgttttctttatgcctcctgagaaatgtgatacactcttgtgtgacataggcgaaagcagtcccaatccaactatcgaagaaggaaggaccttaagggtattaaaaatggttgaaccgtggctacgtggtaaccaattctgcattaaaatcctgaatccatatatgccatcagtggtagaaacgctagagcagatgcaaagaaagcatggagggatgttagttagaaaccctctttctcgaaattcaacacacgagatgtactgggtctcatgtggcaccggaaatatcgtatcggctgtaaatatgacgtcacgtatgctattaaatagatttacaatggcacacagaaaaccaacatatgaaagagacgtcgaccttggtgccggtactcgtcatgtcgcggttgaaccagaagtcgcgaatctagacatcataggacaaaggattgaaaatataaagaatgaacataagagtacttggcattatgatgaagacaatccttataaaacctgggcctatcatggttcttacgaagttcgaccaagtggtagcgcgagcagtatggttaacggcgtagttcgtcttctaaccaaaccttgggacgtgataccgatggtaacgcaaatagctatgacagacaccaccccatttggacaacagagagtcttcaaagaaaaagtcgatactagaacaccacgagcaaaacgtggaacaacacaaatcatggaggtaactgcaaagtggctatggggatttctttcaagaaataagaaaccaagaatttgcacaagagaggagttcacacgcaaagtaagatccaatgcagccataggagcggtgtttgtagacgaaaatcaatggaactctgctaaagaagcagtcgaggatgagcgattttgggacttagttcacagagaacgggaactacacaagcaaggtagatgcgctacctgcgtatataatatgatgggaaaaagagagaagaaattaggcgaatttgggaaagctaagggttcacgtgcaatatggtacatgtggcttggggcaagattcctagagttcgaagctctcggattcatgaacgaggatcactggtttagccgtgaaaacagcttgagcggtgtggaaggtgaaggattacataaacttgggtacatcctgagagatatctcaaaaatccctggaggcaatatgtacgcagacgatacagcaggctgggacactaggattacggaagatgatttgcaaaacgaagcgaaaattacggaaattatggagcctgaacatgcattacttgctacgagcatattcaaactgacctatcaaaacaaagtagttagagtacaaagaccagccaaaaatggaacagtaatggacgttatcagtagaagggaccagagagggtcaggacaggtaggtacatatggacttaatacgtttacgaatatggaagtacaattaataagacagatggagtccgaggggatattcttaccaagtgaactggaaacccccaacttagcagaaagagtgttagattggttagaaaaacatggagctgaacggttaaagagaatggctatatcgggcgatgattgtgtggtaaaacctatcgacgatagattcgctaccgccttaacggcgctaaacgacatgggaaaagtacgtaaagatataccgcagtgggagccgtcaaaaggatggaatgattggcaacaagttcccttttgctcacaccattttcatcaactaatcatgaaggacggaagagaaatagtagtaccatgccgcaaccaagacgagctagtaggccgtgcaagggtttcgcagggcgcagggtggtctttaagggaaacagcgtgtttggggaagtcatacgcacaaatgtggcaattaatgtacttccatagaagggacttgaggttagcagccaacgcaatatgctctgccgttccagttgattgggttcctacttccagaacgacttggtcaattcatgcacatcatcaatggatgacaactgaggatatgctaagcgtttggaaccgtgtctggatagaagaaaatccatggatggaagacaaaacacatgtctcaagctgggaagaagttccatacctaggaaaaagagaagaccaatggtgcggctcattaattggattgaccgcccgagccacatgggcgactaatatacaagtcgccataaatcaagtaaggagattaataggtaatgagaactatttggattacatgacgagtatgaagagattcaaaaacgaaagcgatcctgaaggggcgttatggtag

SEQ ID NO: 21293 - RNA, 9879 nt, synthetic construct
  misc_feature 1..9879: note = derived and/or modified CDS sequence (opt6) from DENV-1__KJ189348__SS-prME
  source 1..9879: mol_type = other RNA
agcgttacaatgcttttaatgttattacccacagcattggcatttcacctcacaacacgaggaggagaacctcatatgatcgtttcgaaacacgaaagagggaaatccttgttatttaaaacatctgctggtgttaatatgtgcacactcattgcgatggatttaggggagttatgtgaggacacaatgacctataaatgccctcgcataacagaagcagaacctgatgacgtagattgttggtgtaatgcaacagacacatgggtgacatacggtacttgcagtcaaacgggggaacacagaagagacaaacgatccgtggcgctggcgccacatgtaggactagggcttgaaaccagaaccgagacgtggatgagttcagaaggcgcatggaagcaaatacaaagagtggaaacttgggcacttcgacaccccggattcactgtaatagcattattcctagctcatgcaatcggaacaagcataacacaaaaaggcattatttttatcttattgatgttagtgactccatcaatggcaatgagatgtgtgggaatcggaaatagagattttgtagaagggttaagtggcgcaacctgggtggacgtagtattagagcatggatcgtgtgtaacaacaatggccaaaaataaacctactctagatatcgaactattaaaaacagaagtcaccaaccctgcagtattacgtaaactctgcatagaagcaaaaattagcaacactactactgatagtagatgtccaacccaaggagaggctactctcgtagaagaacaagacgctaactttgtatgccgacggacatttgtcgaccggggatggggtaatggatgcggcttattcggtaaaggttcactactaacatgtgccaaatttaaatgtgtaactaaactggaaggcaaaattgtccaatacgagaacctaaaatattcagttattgtaaccgtacatacaggagatcaacaccaagtaggcaatgaaactacagagcacggtacaattgctactataacaccacaagcccccacatcagagatccaattaaccgactatggagcattaacacttgactgtagcccaaggactggactagacttcaatgaaatggtcctactaacaatgaaagagaaatcgtggttagtgcacaagcaatggtttttagacttacctttgccatggacatcgggagcttcgacgtcgcaagaaacatggaaccgacaggacttattagtaacgtttaagacagcacatgccaagaaacaggaagtagttgtgctaggatcacaagaaggcgcaatgcacaccgccctaacaggagcgactgaaatccaaaccagtggaacaactaccatatttgcaggtcacctgaaatgcagactcaaaatggataaactcaccttaaaaggtaccagttatgtaatgtgtacgggatctttcaaattagagaaagaggtagcagaaacgcaacatggtaccgtattggtacaggtaaaatatgaaggtacagacgctccatgtaaaattccattttcgactcaagacgaaaaaggagtgactcaaaatggtagactaataacagcaaacccaatcgtaacagataaagaaaaacctgtaaatatagaaacggaaccacccttcggggagagctacatcgtcgtcggagcaggggagaaggccctaaaattgagttggtttaaaaagggaagttctataggaaagatgtttgaagcgactgcacgaggggctaggagaatggctatattaggagacacagcctgggatttcggttcaatcggaggagtatttacatcagtaggcaaattagtccaccaggtttttggaacagcatatggcgttttgttctcaggtgtaagttggacgatgaagattggtattggaattttactcacctggttaggactaaactcaagaagtactagcttttcaatgacctgcatagcagttggaatggtaaccctttacttaggcgttatggtgcaagcggacagtggttgtgtaataaactggaagggtagggaactaaagtgcggatccgggatctttgtaacaaatgaagtacatacgtggacagaacaatacaagtttcaagccgacagtccaaaacgactgtcagcagcaattgggaaggcttgggaggaaggcgtgtgtgggattaggagtgcaactcgcctcgaaaatataatgtggaaacagatctctaacgaacttaatcatattcttcttgaaaacgacatgaaattcacagttgtagtcggagatgctaatggtatcctggctcaaggcaagaaaatgataagaccacagcccatggaacacaaatattcctggaagtcttgggggaaagcaaagattattggcgcagatattcaaaatactacatttataatcgacggacccgatacaccagaatgtccagatgatcaacgagcatggaatatttgggaagttgaagattacggattcggaatatttactacaaatatttggcttaagctgcgagactcatacacgcagatgtgtgatcatcgtttgatgtcagcggccattaaagattccaaagctgtacacgctgatatgggatattggatagaatccgagaaaaatgagacgtggaaactagccagggcgtcgttcatagaggttaaaacgtgtacctggcctaaaagtcatacactatggagcaatggcgtattagaatcggaaatgatcataccaaaaatctacggtggtcctatctcacagcataattatcgtccaggatatttcacacaaacagcgggaccttggcatttagggaaattggaattagatttcgatctctgcgaaggaaccacagtcgtagtagatgaacattgcggaaatagagggccgtcccttcgaaccacaacggttactggaaaaataatccatgaatggtgctgcaggagttgcaccctgccaccattgcgattcagaggcgaagatggatgctggtatggtatggaaattcgtcctgtaaaagaaaaagaagaaaacctcgtacgaagtatggtctcagcaggaagcggtgaagtagattcattttcattaggaatactatgtgtttcaataatgattgaggaagttatgcgttcccgctggagtcgcaaaatgttaatgaccggtacactagcagtatttttgttgttaataatgggacaactaacctggaatgatttgatacgattatgtatcatggttggcgccaatgcctcggatcgtatgggaatggggacaacatatctagctctaatggccacatttaaaatgaggccaatgtttgctgtaggcatcttgtttcgccgtttaacgtctagagaggtcctgttattgacaataggattatcgctggttgcctcggtagaattacctaactcgctcgaggaactaggagatgggttagctatgggcattatgatgctaaaactacttacggagtttcaacctcaccagttgtggaccacattactatcattaacattcataaaaaccacactgtctctagattacgcctggaaaacgactgcaatggcattgtctatagtctcgctgtttcctttatgcctttcaaccacatcacagaaaactacttggctgccggtattactaggttcattcggttgcaaacctttgactatgtttttaatcactgaaaataaaatatggggacgaaagagctggcccataaacgagggaataatggcgattggcatagtatccatattactgagcagtctgcttaaaaatgatgttccactagccggaccactaattgccggtggaatgttaatcgcatgttatgtaatatctggatcttcagcagatttaagtctcgaaaaagctgcggaagtgtcctgggaacaagaggcagaacatagcggtacatcacacaatatccttgttgaagtacaagatgatggaactatgcgtattaaagacgaagagaaagacgacacactgaccatccttctgaaagctacactcctggcagtatcaggggtatatcccatgtccattccggctactctctttgtatggtatttttggcagaaaaagaaacaacgatcgggagttctgtgggacactccaagcccacctgaggtagaaagggcagtacttgatgatggtatatatagaatattgcagcggggacttttggggcgtagtcaggttggcgtaggggtatttcaagatggagtctttcatactatgtggcacgtaactcgaggagccgtattaatgtatcaaggaaaacgtttagaaccgtcatgggcgtcggtcaagaaagacctaatatcgtatggaggcggatggagattccaaggaagttggaacaccggtgaagaagtacaagtcatagcagtagagccaggaaagaaccccaaaaatgttcagacaacaccgggcacattcaagacaccggaaggtgaagtaggggccattgccttagattttaaaccagggaccagcggaagtccaattgtgaatagagaggggaagatcgttggattgtatggtaacggagtcgtcacaaccagcggcacctatgtatcagcaattgcacaggcgaaggcatcccaagaaggacccctaccagaaatcgaagacgaggtcttcaagaaacgcaaccttacaatcatggatctccatccgggaagtggtaaaactagacgttacctaccagcaattgttcgagaagcgataaagcgcaaactgcgcactcttattttagcgccaactagggtagtggcgagcgaaatggcagaagccctaaaaggtatgcctataagatatcagaccactgcggttaaaagtgaacacacaggaagagaaattgtagaccttatgtgccatgcaactttcacgatgcggttgcttagtccagtgagagttccgaattacaatatgatcataatggatgaagctcactttacggacccggcatcaatagcagcacgagggtacatctcaactcgtgttgggatgggagaagcagctgctatattcatgactgcaacaccacctggatcggttgaagcctttccccaatcaaatgctgtcatacaggacgaagaaagggatattccagaacgatcatggaactctggttatgattggataaccgattttccggggaagacagtatggttcgtaccatccattaaatctggcaacgacattgcaaattgtctacgcaaaaacggtaaaagagtcatacagctaagtagaaaaacgtttgatacagagtaccagaaaaccaaaaataacgattgggattatgttgtcacgaccgacatctcagaaatgggagcgaactttcgtgcagatagggttatagatccccgacgatgtctaaaaccagttatattgaaagacggacccgaacgagtcattctagctgggccaatgcccgtaacagtggcttcagctgcacaaaggagaggacgcatcggccgaaatcaaaataaggagggagatcagtatgtatatatgggacaacccttgaataatgatgaggatcatgcacattggacagaagcaaaaatgttattagataatatcaacacgccagaaggaattataccagcgttgtttgagccggaacgagaaaaatccgcagcaatagatggagaatacagattacggggcgaagcgcgtaagacgttcgtagagctcatgcgtcgtggcgatctacccgtatggctatcgtataaagtagcttcagaagggtttcaatactcggatcggaggtggtgctttgacggggaacgaaataatcaagttcttgaagaaaacatggacgtagaaatttggactaaagagggtgaaaggaagaaacttcgtccacgttggctagacgcacggacatacagtgatccgctcgcattgagggaatttaaggagtttgcagccgggcgacgctcagtctcaggggaccttatactggaaattggtaaactccctcaacatctaaccctgagagctcagaatgcattagataacctggtgatgctccataactcagaacaaggcggaaaagcctacagacatgcgatggaagagttgcccgacacaattgaaacgcttatgctacttgcattaatagcagttttaaccggaggtgtgaccctattcttcttgtcaggcaaaggcctagggaaaacctcaataggtctactatgtgtcaccgcaagctcggcccttctgtggatggcaagtgtagaaccacattggattgcagcgtcaataatcctagagttcttcttgatggtactactaatcccggaacccgatagacagcgtactccacaagataaccaactagcatatgtcgtgattggactcctttttatgattttaacggttgcagcaaacgaaatgggattgctagaaacaacaaaacgtgatctaggaattggccacgttgcggcggagaatcatcagcacgcgacaatgttagacgtagaccttcggccagcttcggcctggaccttatatgctgtcgccaccacagtaatcacccccatgatgcgacatactatagagaatacaacggctaacattagtcttactgcaatcgccaatcaggcggcaatcctcatgggtttagataaggggtggccaattagtaagatggatataggtgtgccacttctggcgctaggctgttatagtcaggtaaaccctcttacattaacagcagctgtcctcatgcttgttgctcactacgcaataataggcccaggtctacaggccaaagcaacgagagaagctcaaaagcggactgctgcgggtataatgaaaaatcccacagttgacggcatagtagctatagatttagatccggtggtgtacgacgcaaaatttgaaaaacaactgggacaaataatgctactaatactatgtacaagccagattcttttaatgagaaccacttgggctctttgtgaatcgattacgctcgcaactggacctctaacaactctgtgggaaggctcacctggaaagttttggaacacaaccattgcagtatccatggctaatattttcaggggcagttatttggccggtgcaggattagcattttcactgatgaaatccctaggaggcggaagaagaggaacaggcgctcaaggtgagactctaggagaaaagtggaaaagacaattaaaccagttaagcaaacccgagttcaatacgtacaaaagaagtggcatcatggaagttgacagaagcgaggctaaagaaggtctaaaaagaggagagactacgaaacatgcagtttccaggggcactgccaaattacgctggtttgttgaaagaaaccttgttaagccagaagggaaagtaatagatcttggatgtggacgcggaggatggtcatattattgtgcaggactgaagaaagtaacggaggttaagggttacacgaaaggaggaccaggccacgaagaacctatacctatggcaacttatggatggaatttagttaaactgcattcaggcaaagacgtatttttcatgccgcccgaaaaatgtgatactcttttgtgtgatatcggagaaagtagccccaacccaaccatagaagagggacgaacattgcgtgtactaaagatggttgaaccatggttaagaggtaatcagttttgtatcaaaattctcaatccttacatgccatcagtagtagaaacattagaacagatgcaaagaaagcacggaggtatgctagtaagaaatcctctatcaaggaactcaactcacgaaatgtattgggtctcatgtggtacggggaacatagtctcggcagtaaacatgacatctcgaatgttacttaatcgctttactatggcacaccgcaaaccaacatatgaacgagacgttgatttaggagctggtactcgacacgttgctgtagagccagaagtagcaaatttagatattatcggacaaagaattgaaaatatcaaaaatgagcataagagtacctggcattacgatgaagataacccatataaaacatgggcatatcacggatcctacgaagtaaaaccaagcgggtcagcatcctccatggttaatggagtggttcggcttttgacaaaaccgtgggatgtaatccctatggtgactcaaatagcaatgacggatacgactccgttcggacaacagagagtttttaaggagaaagttgacacaagaacgccaagggcgaaaagaggaacgacacaaattatggaagtcacagccaagtggctatggggtttcttgtcacgtaacaagaaacctagaatatgtacgagagaagaatttacaagaaaagtgagatccaacgcagctattggagctgtattcgtagacgaaaatcaatggaatagcgcgaaagaagctgttgaagacgagaggttttgggacctcgtacatcgagaaagggaactacataaacagggtaaatgtgctacttgtgtttataatatgatgggcaaacgagagaagaaactaggtgaatttggaaaggctaaaggatcaagggcaatctggtacatgtggttgggagcccgattcctggaatttgaagcactcggttttatgaacgaagatcactggttctccagagaaaattcactttcaggagttgagggcgaaggcctgcataagttaggctatatcctacgcgacatatccaaaatacccggaggaaatatgtatgctgacgacaccgcaggatgggatactaggattaccgaagacgacttacaaaatgaagctaaaataactgatattatggaaccagaacatgccctacttgcaacgtctatatttaaacttacgtatcaaaacaaagttgtacgtgtacaacgaccagctaaaaatgggaccgtcatggacgtaataagtcggagggaccagagaggttcaggtcaagtagggacatatggtttgaatacatttacgaatatggaagttcaactaattaggcaaatggaaagcgagggtatttttctaccaagtgagttggaaaccccaaacctagccgaacgagtattgaattggctagagaaacatggagctgaaaggttaaagcgaatggctatctcaggagacgactgtgtggtaaagccaatcgacgacagatttgcgactgcgctaacagctcttaacgatatgggaaaagtgcggaaggacattccgcagtgggaaccaagcaaaggttggaatgactggcaacaggttccgttctgcagtcatcatttccaccaactaataatgaaggatggccgagaaatagtggttccgtgtcgaaaccaggacgaacttgtcggacgggcaagagtaagccaaggagctggttggagcttacgagaaacagcttgtttaggtaaatcctatgcccaaatgtggcaattaatgtactttcacagacgcgatctaaggttagcggccaacgcgatctgtagtgccgtaccagtagattgggtcccaacttcccgaacgacgtggagtatacatgctcaccatcaatggatgactacagaggatatgctgagcgtctggaacagagtctggatagaggaaaatccatggatggaagacaaaactcacgtatcatcatgggaagaggtgccttatctgggaaaacgtgaagatcaatggtgcggctcattaatcggattgacagcacgggcgacctgggctaccaatatacaggttgctataaatcaagtacgacgtctaataggaaatgagaattatctggattatatgacatctatgaagcgatttaaaaatgaatcagaccctgagggcgcgttatggtaa

SEQ ID NO: 21294 - RNA, 9879 nt, synthetic construct
  misc_feature 1..9879: note = derived and/or modified CDS sequence (opt6) from DENV-1__KJ189368__SS-prME
  source 1..9879: mol_type = other RNA
tcagtaactatgctactaatgttattaccaaccgcattagcatttcacttaactaccaggggtggtgaaccacatatgatcgttagtaaacaagagaggggaaaatctctgctttttaaaacctctgcaggcgtgaatatgtgcactctcatagccatggacctgggggaattatgtgaagatactatgacttataaatgccctcaaattacagaagcagagccggacgacgtggactgttggtgtaatgcaacggacacttgggttacatacggaacgtgttcacaaaatggtgaacatcgtagggataaaagaagcgtcgctttggcgcctcatgtaggcttaggtctggaaacacgaacagaaacatggatgtcatctgaaggcgcatggaaacaaattcagagagttgaaacgtgggctttaagacatccaggttttacagtcatcgccctttttctagcacatgccattggcacgtcgattacccaaaaaggaatcatatttatattgttgatgctggtgaccccttcaatggctatgcgatgcgtaggaattggaaatcgagattttgttgaaggtttatctggagcaacctgggttgatgtcgtactagaacacggatcatgtgtaactacgatggctaaaaataaaccaactttggatattgaactgttaaaaactgaggtgacaaatccagcaatactccgtaaattgtgcattgaagccaaaatctccaatacaaccacagattctcgatgcccaacacaaggagaagctacattagttgaagaacaagatgcgaatttcgtatgtaggaggacgttcgtggatagggggtggggtaacggttgcggtctattcggcaaagggagcttattaacctgtgccaaatttaaatgtgttacaaaattagaggggaaaatcgtacaatatgaaaatcttaaatattcagtgatagtcacagtacatactggcgatcaacatcaagtaggcaatgaaacaacggagcacgggacaattgctaccataacgccgcaagcgccaacaagtgaaatacaactgaccgattatggggcactaaccttagattgcagtccaagaactggtcttgacttcaatgaaatggtattacttaccatgaaagagaaatcatggttagtacacaaacaatggtttttagatcttccattaccgtggacaagcggagcgtcaacttcgcaagaaacctggaatagacaagacttacttgttacatttaaaaccgcacacgcaaagaaacaagaagttgttgtactcggatcacaagaaggtgctatgcatactgcgctgacgggcgcgaccgagatacagacatccggaactacaacgatcttcgcaggtcatctaaaatgtcgactgaaaatggacaaactcacattgaaaggcacatcctacgttatgtgtactggaccttttaaactggaaaaagaagtcgcggaaacgcagcatggaacagtgctagtacaagttaaatacgagggcactgatgcaccatgcaaaatcccattcagcacacaagacgaaaaaggagttacacagaatggacgactaataacggctaacccaatagtaaccgacaaagaaaaaccggtgaatattgaaacagaaccacccttcggcgagtcttatatagttgtgggagctggcgaaaaggctttaaaactatcatggtttaaaaagggctcctccataggaaagatgtttgaggccactgcaaggggtgctcggaggatggcgatactcggagacacagcttgggatttcggttctataggcggtgtgtttacgagcgttggcaagttagtacatcaagtgttcggcacggcatatggtgttctgtttagtggtgttagttggactatgaaaattggaataggcatacttcttacctggttaggactgaacagtagatccaccagtctatcaatgacttgcatagctgttggaatggtaacattatacttgggtgtcatggttcaagcagattcaggatgcgtaatcaattggaaaggaagagagctgaaatgcgggagcggtatctttgtaactaatgaagtacacacgtggacagaacaatataaattccaagcagactcaccaaaacgactatctgcagcaataggaaaggcttgggaagagggcgtctgcgggattagaagtgcaactagattagaaaatataatgtggaaacaaatatcaaacgaattgaatcacatattgctagaaaatgacatgaaatttactgtggtcgttggggatgcaaatgggattttggcacaagggaagaaaatgatacgaccacagccaatggagcacaagtattcatggaaatcgtggggcaaagcaaaaatcatcggggctgatatacaaaacaccacatttataatcgacggaccggatacccctgaatgccctgataaccaacgagcttggaacatctgggaagtcgaggattacggtttcggaatctttaccactaatatctggcttaaattacgcgatagttacacacagatgtgtgatcatcgtctaatgtcagctgcaataaaagacagcaaagcggtgcatgcagatatgggttactggatcgaatccgaaaagaatgagacgtggaagttagcaagagcctcattcatagaagttaaaacctgcacctggcccaaaagtcatacgttgtggagcaatggcgtcttagaatctgaaatgattataccaaaaatttatgggggtccaatctcacaacataattataggccaggttacttcacccaaactgcgggaccctggcatttaggaaaactcgaattagactttgacctctgtgaaggaactaccgtggttgtagatgaacactgcgggaataggggtcccagcttacgtaccactacggtaactggaaaaataattcacgaatggtgttgtcgaagttgcacattaccaccactaagatttcgtggagaagacggatgttggtatggaatggaaattagaccagtaaaagaaaaggaagagaatctagttaggagtatggttagcgcgggtagtggagaagtagacagctttagtttaggaattttatgtgtatctatcatgattgaagaagtgatgcggtcgagatggagtcgtaaaatgctaatgactggcacattagcagtatttttattattagtaatgggacagctaacatggaatgacttgatcagactttgcataatggttggagcgaacgccagcgataggatgggaatgggaacaacctatctagcgctaatggcgactttcaaaatgaggcccatgttcgcggtaggattattgtttcgacgtttaacatctagagaagtgctattactgacaattgggttgagcttagtagcaagtgtcgaattgccaaacagtttggaagaactaggagacggtttggccatgggtatcatgatgttaaaactactcaccgagttccaaccccaccagctttggactacgcttttatcactaacttttataaaaactacattatcgcttgattatgcatggaaaacgaccgcaatggctctttcaatcgtcagcttattcccattatgcttgtcgacaacaagtcagaaaacgacctggttgcctgtactgctcgggagcttcggctgtaagcctctaacgatgtttttgatcacggagaacaaaatctggggaagaaaatcatggcctttaaacgaaggtataatggcaataggaatagtctccatacttttatccagtctactaaagaacgatgtaccgctagcggggcccttaatcgcagggggaatgctaatagcttgctacgtaatcagtggttcatcagctgacttatcacttgaaaaagcagcagaagtttcttgggagcaagaagcagaacattccggtacatcacataacattctagttgaggtccaggatgacggaactatgaaaataaaagacgaagagagggatgacacgctgacaatactgttgaaagcaactttactggctgtttcgggcgtatacccaatgtcaataccagccacactgtttgtgtggtatttttggcagaaaaagaaacaaagatcaggagtgttgtgggacactcccagtccgcctgaggttgaaagagccgtgttggatgatggtatatacagaatacttcaaagaggcctattaggtcggagtcaagtcggagtaggagtgtttcaagacggagttttccacactatgtggcatgtaacaagaggggcagtgctgatgtatcagggaaagagattagagccgtcttgggcgagtgttaagaaagatctgatatcttacggtggtggctggagatttcaaggttcctggaatacgggtgaagaagtacaagttatagccgtcgaacctgggaaaaaccccaaaaacgtccaaacgacccctggcacgtttaaaactcctgaaggggaagtaggtgcaattgcacttgatttcaaacctggtacctccgggtcaccgattgtaaatcgtgagggcaaaattgtcggtctctacggaaacggagtcgttaccacgagtggcacatacgtatcggcaattgctcaggcaaaggcaagccaggaaggcccccttcctgagatagaagatgaggtctttaagaaaaggaatctgacaataatggaccttcacccaggctcagggaaaaccagacgttatttaccggctatagtaagagaagcaataaaacgaaaactacgaacgttaatattagcccctacccgcgttgttgcatccgaaatggcagaggctttaaaaggcatgccaatccgttatcagacaacagcagtaaagagcgaacacactgggcgagagatcgttgacttgatgtgccatgctacgttcacaatgagactcttatcaccggtacgagtaccgaattataacatgataatcatggatgaggcacacttcacagaccctgccagtatcgctgctcgaggttacatatcaacacgagtaggaatgggagaagcggccgccatattcatgacagccactcccccagggtcagtagaagcattcccacagtcaaatgcggtaatacaagacgaagaacgagatattcctgaaaggtcatggaactcgggctacgattggattaccgactttcccggtaaaactgtctggttcgtaccgagtataaagagtggcaacgacattgccaattgtctaagaaagaacggtaaaagagtcattcaactaagtagaaaaacctttgatacagaatatcagaagaccaaaaataacgattgggattatgttgtcacaacggacatttcggagatgggggcaaattttcgggcggatcgagtcatcgatcccagaagatgcttaaaaccggttattctaaaggacgggcctgaaagagtcatactagcgggacctatgcctgtcacggtcgctagcgctgcgcagaggcggggcaggataggtcgcaaccaaaacaaggagggagatcagtacgtatatatggggcaaccccttaataatgacgaggatcacgcacattggaccgaagctaagatgttacttgataacataaacactccagaaggcataataccggcattatttgaaccagaaagggaaaaatccgcagcaattgatggtgaatatagattacgaggggaagctagaaaaacttttgtggaactaatgcgacgaggagatctaccggtatggttgtcttataaagttgcgtcggagggattccaatacagcgatagacgttggtgtttcgacggagaacgtaataaccaagtattagaggaaaacatggatgtagagatatggactaaagagggagaacgcaagaagctcagaccaagatggttagatgcaagaacttatagcgacccacttgctcttagagagtttaaagaatttgcagccggacggcgatccatttcaggagatttaatcctcgaaatcggtaaattaccccaacatctcacgctaagggcccaaaatgcattagataacttagtaatgcttcataattcagagcagggtggaaaagcatataggcatgccatggaagaactgccggataccatcgaaacattgatgcttttagctctgatagcggttctcacaggaggtgtcactctattctttttatcaggcaaaggtttgggaaagacatcaataggactactatgtgtaacggcgtctagtgcgctactatggatggccagcgtggaaccgcactggatagcagcgtcgattatacttgagttctttctcatggtgttattaatacctgaaccagacagacaacgaactccacaagataatcaattggcatatgtcgtgattggtctattatttatgatacttacagtagcagcgaatgaaatgggtctgttagaaacaactaaaaaggatctcggaatcggacacgtagcagcagaaaatcatcaacatgcaaccatgttagacgttgacctaaggcccgcatcagcttggacgttatatgcagttgccactactgtgataacgccgatgatgaggcatacaatagaaaacactacggctaacataagtctaactgcaatcgcgaatcaggcagccattttgatggggttagacaaaggatggcccatttccaagatggatatcggagtacccttactggcattaggatgctattctcaggtgaatcctctaacacttaccgcggccgttttaatgctggtagcgcattacgcgataataggaccaggcttacaagctaaggcaacaagggaggcacaaaaacgcacagcagcagggattatgaagaatccgactgtagatggcatagtagcgatagatctcgatcctgttgtttacgatgctaagtttgaaaaacagttaggacaaattatgctattaatattatgcacatcacaaattttgttaatgagaacaacttgggccctatgtgagagcattacgttggcgactggaccgctaacaacactttgggaaggttcgccggggaaattttggaacacaaccatagcggtcagtatggcgaatatcttcagagggtcttatctagctggtgcaggactagctttttctttaatgaaatcattgggcggaggaaggagagggacaggagcacaaggagaaaccctaggagagaagtggaaacgacaattaaaccaattaagcaagagtgaatttaatacttataaacgatcaggtattatggaagtcgacaggagtgaagccaaagagggccttaaacgaggagagacaactaagcacgcagtttctcggggaacagcgaaactaagatggtttgttgaacgaaatttagtcaaaccagaaggtaaagttattgatttaggatgtggaagagggggttggagttattattgcgcgggtctaaagaaagtgactgaagtcaaaggatacacaaagggtggtccaggtcacgaagaaccgataccgatggctacatacggatggaatcttgtaaagctacatagtggcaaagatgttttctttatgcctccagaaaagtgcgatactttattgtgtgatattggggaatcttcacctaacccgacaattgaagaagggagaactttgagagtattaaaaatggtggagccttggctgaggggtaaccaattttgcatcaaaattctaaacccgtacatgccttcggttgtcgaaacactagaacaaatgcaacggaaacatggcggtatgctagttaggaacccattgtcaagaaattctactcacgagatgtattgggtttcatgcggtactggaaatattgtcagcgcagtgaatatgacaagtagaatgttactgaatagatttacaatggcccatcgaaaaccaacatatgaaagagatgtggacctaggagcaggaacacgacatgttgctgtggaaccggaagttgcaaatctagacattatcggtcagcgcatagaaaatattaagaacgaacataaaagtacgtggcactacgacgaagataatccgtacaagacttgggcctatcatggatcctacgaagtaaagcctagtgggtcagcatccagtatggttaacggtgttgtaagattgctaacgaagccttgggacgtcatccctatggtgacgcagatagcaatgacagataccacgccatttggccaacaaagggtttttaaagaaaaagtagatacccgaacacctagggcaaaaagaggaacgacacaaataatggaagtaactgctaaatggttatggggatttttaagtagaaataagaaaccaagaatttgtacacgagaagaatttacacggaaagtcagatcaaacgccgcaataggagctgttttcgtagatgaaaaccagtggaatagcgcaaaagaagctgtagaagacgaacgattttgggaccttgtgcatcgagagagagaactacataaacaaggtaaatgtgcaacatgtgtttacaacatgatggggaaacgcgagaagaaactgggcgaatttgggaaagccaaagggagcagagctatttggtatatgtggttgggagctcgatttctagaatttgaggctttagggtttatgaacgaagatcactggttcagcagagaaaatagcctttcaggcgtcgaaggagaaggcttacacaaactcggatacatattgagggatatatcgaaaatcccagggggaaacatgtacgcagacgatactgcgggttgggatactcgtattaccgaagatgaccttcaaaacgaagctaaaattacagagttcatggagcccgagcacgcactattagccacttctatattcaaattaacataccaaaacaaagttgtaagagttcagagacctgcgaaaaatggtacagttatggatgttatctccagaagagaccagagaggaagtggacaagttggaacatacggattaaatacttttacaaatatggaggtgcaactaatcagacaaatggagtctgagggtatattcttaccgtcagagttagaaactccaaatttggcagaacgtgtattcgattggttggagaaacatggagccgaacgattgaaaagaatggccataagcggcgatgattgtgtagtaaaaccgattgatgaccggttcgcaacagcactaacggcacttaatgacatgggtaaggttagaaaggacatcccacaatgggaaccgagtaaagggtggaatgactggcaacaagtgcccttttgttctcatcacttccatcagctaataatgaaggatggacgagaaatcgttgtgccatgtagaaatcaagatgaattagtcgggagagcccgagtctcacagggagcaggatggagccttcgagagacagcctgcttaggaaaaagttacgcacaaatgtggcaactgatgtattttcatagaagagatctcagattagcggcgaacgcaatctgcagcgctgttccagttgattgggtcccaacgtcgcgaaccacatggtcaatccatgcccaccaccaatggatgacaacagaagacatgctctctgtatggaatcgagtctggatagaggaaaacccctggatggaagacaagacccacgtcagttcatgggaagaagtaccatatctaggaaaacgagaagaccaatggtgtggcagcttaattgggctaacggcaagagctacatgggctacaaacatacaagtagctataaaccaagttagaagattaatagggaatgaaaactatcttgattatatgacatcaatgaagagatttaaaaacgaaagtgacccggaaggagccctctggtag

SEQ ID NO: 21295 - RNA, 9879 nt, synthetic construct
  misc_feature 1..9879: note = derived and/or modified CDS sequence (opt6) from DENV-1__KJ189369__SS-prME
  source 1..9879: mol_type = other RNA
tcagtaactatgctacttatgctactgccgactgcgctagcatttcacttaacaactcgcggtggcgagccccacatgattgtctctaaacaagaacgtgggaaaagcctactgtttaaaacctcagccggtgtaaatatgtgtacccttatagcaatggatctaggcgagctttgtgaagatacaatgacatataaatgccctcaaattacggaagccgaacccgacgacgtagactgttggtgcaatgcaacagacacttgggtaacttacggtacttgttctcaaactggggaacacagaagggataaaagaagcgtagctttagcaccgcacgttggcctcgggttagaaacgagaaccgaaacctggatgtcctccgaaggagcatggaaacaaatacaacgagttgaaacgtgggcacttagacaccccggctttacagtgatagcgcttttcttagcccacgcaataggaactagcataacacaaaaagggatcatatttatcttacttatgctggtaacgccttcaatggctatgagatgtgttggaataggtaaccgtgatttcgtggaaggcttaagcggggccacatgggtagatgtggttctagaacatggaagctgtgtaactactatggccaaaaataaacctacgctcgatatagaactgttaaaaaccgaggtaactaacccagcgatattaagaaaattgtgtatagaagctaaaatcagtaataccacgacggacagtcgatgtcccacacaaggagaggctacattagtagaggaacaagatgcaaattttgtatgtagaagaacgttcgtggatagaggctggggtaatggttgcggcctatttggaaaagggtcgttattaacatgcgcaaaattcaaatgtgtaacaaaattagagggtaaaattgtacaatatgaaaaccttaaatactccgtcatagtaaccgtacatacaggcgatcaacatcaagttggaaacgaaactacagagcatggcaccatcgcaacgataacgccccaagccccaaccagcgagatccagctaacagattacggcgctctaacactagattgctcacctcgtaccggcctcgatttcaatgaaatggttctattgaccatgaaagaaaaatcttggctagtccacaaacaatggtttttagatctacccctaccatggacatcgggagcctcgacttcgcaagaaacatggaacagacaagacttgctggtgacattcaaaacggcccatgctaagaaacaagaagtcgtcgtattagggtcacaggaaggtgcaatgcacactgcattaaccggggccacagaaatacaaacaagtggcacaaccactatttttgcaggccatttgaaatgtagattaaaaatggacaaattaacccttaaaggaacaagctatgtcatgtgcacaggctcttttaagctagagaaggaggtagccgaaacccaacacggtacagtcttagtacaggtaaaatatgaaggcactgacgcaccctgcaaaatcccattttccacacaagatgaaaaaggagtaactcaaaacggaagattaatcaccgctaaccccattgtaactgacaaagagaaaccagtaaacatagaaacagagccaccatttggagaatcatatatagtagttggcgccggtgaaaaagccttgaaattaagttggtttaagaaaggctctagtatagggaaaatgttcgaagcaacagcaagaggcgcacggaggatggccatacttggagatacagcttgggattttggatcgattggcggagtcttcaccagcgtaggaaagctagtacaccaagtatttggaactgcatatggagtgctatttagcggagttagctggacgatgaaaattggtataggaattttgttaacttggttagggttaaattcgcgtagcacatcactgagcatgacttgtatagctgtagggatggtgactctataccttggggttatggttcaagccgactcaggttgcgtaataaactggaagggtagagagttaaaatgtggttccggaatatttgtaacaaatgaagtacacacctggactgaacaatataagttccaagctgatagccccaagcgactatctgctgctatagggaaagcgtgggaagaaggcgtatgcggcattagatcggctacccggctagaaaacataatgtggaagcaaatatcaaatgaattaaaccatatcctactggaaaatgacatgaaattcacagtagttgtaggagatgctaacgggattctagcgcaaggtaaaaagatgattcgtcctcaacccatggaacataaatacagctggaaaagttggggaaaagccaaaataataggggcagacatacaaaatactacatttataatagacggccctgacacaccagagtgcccagacaatcaaagggcctggaacatttgggaggtggaggactatggattcgggatatttacaacgaacatatggctgaaactacgcgacagctatactcaaatgtgtgaccatagactaatgtcggcagcaatcaaagattctaaagcggtacacgcggatatgggatactggatagaatcggagaaaaacgaaacctggaaacttgctcgagcatcttttattgaggtcaaaacctgtacttggcctaagagccacactttatggtctaatggtgtactagaatcggaaatgattatacctaaaatctacggaggacccatatctcaacacaactaccgaccaggatattttacacaaacagcaggtccatggcatctagggaaactggaattggatttcgatctgtgcgaaggtacaaccgttgtggttgatgagcattgtggtaatagagggcctagtctacgaacaacaacagtaacaggaaaaattatacatgaatggtgctgtagaagttgcactctacctcctcttagattcaggggagaagatggctgttggtacggaatggagatcaggcccgtgaaagagaaagaggaaaatctggtaaggagtatggtttcagccggatccggtgaagtcgatagcttttccctgggtattctctgcgtgagtattatgatagaagaagtgatgagatcaaggtggtcacgtaaaatgttaatgaccggtaccttagcagtatttctattgctagtcatggggcaactaacttggaatgacctcatacgattatgtattatggtgggcgctaatgcatcagaccgtatgggtatgggcacaacttatctcgcactaatggcgacatttaaaatgagaccaatgttcgccgtagggctattatttagaagactaacaagtcgggaggttctcttactaactataggactgagtttggttgcatctgtagagctacctaatagtctagaagaattaggcgatggcctggcaatgggcattatgatgttaaagctcttaacagaatttcagccacatcaattatggacaactctgctcagcttaacattcataaaaacgactttatctttagattatgcttggaagacaacagccatggctctctcgatagttagtctattccccctatgcttatcaaccactagccagaagacgacttggctaccagtactccttggaagttttggttgtaaacccttaacaatgtttttaataaccgagaataagatatggggtagaaaatcctggccacttaatgaaggaatcatggcaataggtatagttagtatactcttatcttcccttctgaaaaatgacgtgccactagcgggtccgttaatagcgggaggcatgttaatagcctgctatgttatttcaggatctagtgctgatttatccttagaaaaagcagcagaggtttcatgggaacaagaagccgaacattcgggtacatcccataatatcctagttgaggttcaagatgacggaacaatgaaaattaaagacgaggaacgtgatgacacacttactatattactgaaagctacgctcctggcggttagcggtgtatatccaatgagcataccagcaactctatttgtctggtatttctggcagaaaaagaaacaaagaagtggagttttatgggataccccttctccacccgaagtcgagagagctgtgttggatgacggaatctatcgtatcttacaacggggtcttctagggagatcgcaagtaggggtcggtgtctttcaggacggagtttttcataccatgtggcacgtaactcggggagcagttcttatgtatcagggcaaacgtctcgagccttcatgggctagtgtcaagaaagatctaattagctatggtggagggtggaggtttcaaggaagttggaataccggagaagaagtacaagtgattgctgtagaacctggtaaaaatcctaaaaacgttcaaactacaccaggaacttttaaaacccccgaaggagaagtgggcgcgattgccctcgatttcaagccagggacatcgggctctccaatagtcaatcgtgagggtaaaatcgtgggcttgtacggtaatggagtcgtcacaacttcgggcacgtacgttagtgcgattgctcaagcgaaagcctcccaagaaggtcctttacccgaaattgaagacgaggtttttaagaaacgcaacttgacaatcatggatctccaccctggttctggaaaaactcgacgatacttaccagccatagttcgtgaagcaattaaacgaaagttgagaacattgatacttgcaccaacacgagtagtagcaagcgagatggcagaggctttgaaaggaatgcccattcgatatcaaacaaccgcagtaaaatccgagcatactggtagagaaatagtcgacttaatgtgccatgcaacatttactatgagactactttcaccagttcgagtgcctaactacaatatgataattatggacgaagcacattttacagaccccgcttcgatagctgcaagggggtacatctcgacacgagttgggatgggagaagccgcagctatatttatgacggcaacaccaccaggttcagtcgaggcgtttcctcaatctaatgcggtcatacaagacgaggaacgtgacattccggaaagaagctggaactctggctatgattggatcacagactttcccggtaaaacggtatggtttgttccgtcaataaagtcaggcaatgacatcgcaaattgtctcagaaagaatggcaaacgtgttatacaactttcacggaaaacctttgataccgaatatcagaaaactaagaataacgactgggattatgtagtaacaacagacataagtgagatgggcgcaaactttcgtgcagatcgggttattgatcccagaagatgtttaaagcctgtaatcttaaaggatggtccggagagagtaatcctagccgggccaatgcccgtcactgtagccagtgcagcgcaaagacgcgggagaattggcaggaatcaaaataaagaaggagaccaatatgtttacatgggacagccattgaataacgacgaagaccacgctcactggacggaagctaaaatgctattggataatataaatactccagaagggataatccctgcgttatttgagcccgaaagagaaaagaatgcagcaatagacggagaatacagacttagaggggaagcaagaaagacatttgtagagctaatgaggcgtggcgaccttcctgtatggctatcttacaaagtagcaagtgaaggattccaatatagtgacagaagatggtgcttcgatggtgaaagaaacaaccaggttttggaagaaaatatggacgtagaaatatggactaaagaaggtgaacgtaagaaattacgcccgagatggttggacgctcgcacatatagtgaccctttggcactgagagagtttaaggagtttgcggcaggtcggcgtagcgtaagcggtgacctcatactggaaataggaaaactaccacagcacttaactttacgggctcaaaatgctttagataacttggtgatgttacataatagcgagcaaggaggaaaagcatatagacacgcgatggaagaacttcctgacacaattgagacgctgatgctcttagcattgatagctgtgttaacaggtggtgtgacgttattctttttgagtgggaaaggacttggaaaaacgtccatagggcttctgtgcgtgactgctagctcagcgcttctttggatggcttcagtggaacctcattggattgctgctagtatcattttggaatttttcttaatggtactgctgataccagaacccgatcgacaaaggactccgcaggacaatcaattagcctacgttgtaataggccttttatttatgatactgacagttgcagcaaatgaaatggggttgttggagacaaccaagaaagaccttggtataggacatgtagccgcagaaaatcatcaacacgcaacaatgctcgatgtagacctccgtccagcgagtgcctggacactgtatgcagtggctacgacagtgataactcccatgatgcgccacaccattgaaaatacgactgcaaatatttcactcactgccatagcaaatcaagcagcaatactaatgggacttgacaaaggctggcctatttcaaaaatggacatcggagtacccctacttgctttaggctgctatagccaagtaaaccctcttaccctaactgcagctgtgctgatgctcgtagcacactatgcaatcataggaccaggactccaagccaaagcaacacgtgaagcccagaaaaggacagcagccgggattatgaaaaatccgactgtcgacggcatcgttgcaattgatctagacccagtcgtatatgacgccaaatttgaaaagcaactaggacaaatcatgttgctaatactatgtacaagtcaaatcctccttatgagaacaacatgggcattgtgtgaatcaattacactcgctaccggtcccttaacgacgctatgggaaggaagtccaggaaaattctggaatactactattgctgtaagtatggcaaacatctttagaggatcctatttagcaggagcgggacttgctttttcattaatgaaatctctgggtggcggacgaaggggtacaggggcacagggagaaacgttaggcgaaaaatggaagagacagttgaaccagctctcaaaatccgaatttaacacgtataaacgctcaggcataatggaagttgaccgttcggaagcgaaagagggtttaaagagaggggaaacaactaagcacgcagtatcaagaggtacagctaaattacgttggttcgtcgagagaaatttggtaaaaccagaaggtaaggtaattgaccttggttgtggtagaggtggctggtcctattattgtgcaggtctgaaaaaggtaactgaagttaagggttatactaaaggaggtccaggacacgaagaaccgatcccaatggccacatatgggtggaacttagtaaaactacacagcggaaaagatgtgttctttatgccacctgaaaagtgcgatacgttgttatgtgacataggtgagagttcacccaatcccacaatcgaagaaggaaggacgttgagagttctgaaaatggtagaaccttggcttagaggtaaccaattttgtatcaaaatccttaacccctacatgccctcggtggtcgaaacactagaacagatgcaaagaaaacatggaggtatgttagttagaaatccactatctcgtaacagcacacacgaaatgtattgggtgtcatgcggcacaggaaacatcgtaagtgctgtaaatatgaccagcagaatgttgctaaacaggtttactatggcacacagaaaaccaacgtatgaacgcgatgttgacctaggcgcaggcacgcgacatgttgcggtcgaacctgaggtcgctaatctcgatattatcggacaaagaatagagaatattaagaatgaacataaatcaacatggcattatgatgaggataacccctacaaaacttgggcttatcacggctcatacgaagttaaaccatctggatctgcttccagcatggtaaatggagtggttagattgttgacaaaaccctgggatgtaatacctatggtcacacagatagcgatgacagatactactccattcggacaacaaagggtatttaaagaaaaagttgacacccgaactcctagagcaaaacgtggtacaacacaaataatggaagtcacagcaaaatggctttggggtttcctaagtcggaacaagaaaccgagaatttgcacaagagaagaatttaccaggaaagtacgctcaaatgcagctataggagcggtctttgtagacgaaaatcaatggaactcggcaaaagaagcagtagaagacgaacgattctgggacctagtacatagggaacgggaattacataagcaaggaaaatgtgcaacatgcgtctacaatatgatgggtaaaagagaaaagaaactcggagagttcggcaaggctaaaggcagcagagcaatatggtatatgtggcttggcgcacgattcctggaatttgaagccttagggtttatgaacgaagatcattggttctcacgggaaaattccctctcaggagtcgaaggtgaaggattacacaaactcggttatatattgcgtgacataagcaagattccaggagggaatatgtacgcagacgacaccgcaggatgggataccaggataacagaggacgatctccagaatgaagcaaaaataacggaaataatggaacctgaacacgcattattagcaacaagtatttttaagttgacctatcaaaacaaagtagtgcgtgttcaacggcctgcaaagaacggtaccgtgatggatgtgataagtcgccgagatcagcgcggatctggacaagttggaacatatgggttaaacacattcacaaatatggaagtacagcttataaggcaaatggaaagtgaagggatattccttcctagcgaactagaaacccctaatcttgcagagcgggtgctagattggcttgaaaaacatggagcggaaagattgaaacgaatggctatttctggagatgattgcgtagtgaagcctatagatgatcggtttgctactgccttaactgccctaaacgatatgggtaaggtaagaaaagacatacctcaatgggaaccatcaaaaggatggaatgattggcaacaagttccattttgctcacaccatttccatcaactaataatgaaagatgggcgagaaatagtagtcccatgccggaaccaagacgagctcgtcggtagagccagagtcagccaaggggctggttggagcttacgcgaaactgcatgtttaggaaaatcatatgcacaaatgtggcagctaatgtattttcatagaagagatttaagattagcggcaaatgcaatctgttcggccgttcctgtagattgggtccctactagccgaacaacttggagtatacatgcacaccatcagtggatgactacagaagatatgttatctgtatggaatcgagtttggatagaagagaatccctggatggaagacaagacacacgttagcagttgggaggaagttccatatctcgggaaaagagaggaccaatggtgtggtagcctaataggtctaactgcacgagctacgtgggcaaccaatatccaagtagcaataaatcaagttagacgtctaatagggaatgaaaattatctagattatatgacaagcatgaaaagatttaaaaacgaaagtgatccagaaggtgcactgtggtaa

SEQ ID NO: 21296 - RNA, 9879 nt, synthetic construct
  misc_feature 1..9879: note = derived and/or modified CDS sequence (opt6) from DENV-1__EU482615__SS-prME
  source 1..9879: mol_type = other RNA
agcgtaacgatgttattaatgttactacccactgccttggccttccatctaactacccgagggggagaacctcacatgatagtctcgaaacaagaaagaggtaaatcgctattattcaaaacctcagccggagtaaatatgtgcacgttgattgctatggatctaggtgaactgtgcgaagacaccatgacttataaatgccctcaaataacggaagctgaacctgacgatgttgattgctggtgtaacgcaacagacacatgggtcacatatggtacatgttcccaaactggagaacatcggagggacaaacggagtgttgctttagcaccacacgttggcttagggctagaaacgcggacagaaacttggatgtcatctgaaggggcatggaaacaaatacaaagagtagaaacatgggcactaagacatccaggctttactgtaattgctctcttcctagcgcatgctattggtacgtccataacccaaaaaggtataatattcatcttattaatgttggtaactccaagcatggccatgaggtgcgtaggaatagggaatagagatttcgtagaagggctgtctggcgccacatgggtagatgttgtccttgaacatggctcatgcgtcacaacaatggccaaaaataaaccaaccctggacatagaacttctgaaaacagaagtaaccaatccggcaattcttcgtaaactatgcattgaagccaaaataagtaacacaactactgactctagatgtccaacacaaggcgaagcgacacttgtcgaggaacaagatgctaattttgtgtgtcgaagaaccttcgtagatagggggtggggcaatgggtgtggtcttttcggcaaaggaagtttacttacctgtgctaaattcaaatgcgtcactaaactggaaggtaaaattgtacaatatgaaaatctaaaatactctgtgattgtaacagtacatactggtgaccaacatcaagtagggaatgaaacaacggaacacggaacaatagcaacaataacgccgcaggccccgacgagtgagattcaacttacggactatggggcattaacgctagattgttcgccaagaacaggtctagactttaacgaaatggtattacttaccatgaaggaaaagtcatggcttgtccataaacagtggtttctcgatttaccactaccgtggacatctggtgccagtacatcgcaagaaacatggaatagacaggatttattagtaacatttaaaacagcacatgcgaagaaacaggaagttgtagtcttaggcagccaagaaggtgccatgcatacagctttaacaggggccacagagattcagaccagcggtactacaaccatctttgcaggtcatttgaaatgtcgactgaagatggacaagttaactttaaagggaacaagttatgtaatgtgcaccggatctttcaaactagagaaagaagtagctgaaacccaacacggaaccgttctagtacaagtcaaatatgaaggaacagatgcaccttgtaaaataccgttctcaacacaagatgaaaagggagtcacccagaatggcaggcttataaccgcgaatcctattgtaacagataaagaaaaaccagtaaatattgaaacagaaccgccctttggtgaaagttatattgtggtaggcgctggagaaaaagcacttaaattaagttggtttaaaaagggttcctcaattggaaaaatgtttgaagctactgcacgtggagcgcgccgcatggcaatactcggggatactgcttgggacttcggatcaataggcggagtctttacttctgtaggcaagttagtacatcaagtcttcggaacagcttatggcgtactgttttctggagtaagttggaccatgaaaatagggattggcatattattaacgtggcttggtctaaactcacgaagtacctcactatcaatgacgtgtatagcagtcggaatggtaacattatacctaggagtaatggttcaagctgactcaggttgtgttataaattggaagggtagggaacttaagtgtggatctggtattttcgtgactaacgaagttcacacgtggacggaacaatataagttccaagcagactcgcctaagcgattgtccgctgctataggaaaggcttgggaagagggggtatgtggtataagaagtgcaacaagattagaaaacattatgtggaagcaaatttcaaatgaacttaaccacatattgctcgaaaatgacatgaaatttacagtggtagtcggtgacgcgaacggtatactagctcaaggcaagaaaatgatacggcctcaaccgatggaacataaatacagctggaagtcatggggcaaagccaaaataattggtgctgatatacagaatacaacgttcataatagatggaccagacactcctgaatgcccagataaccaaagggcgtggaacatatgggaagtagaagattatgggttcggtatatttactacaaacatatggctcaaattaagagattcatatacacaaatgtgtgatcatcgcctaatgtcggccgccataaaagatagtaaagctgttcatgccgatatgggatattggattgagagtgagaaaaatgaaacatggaaacttgcccgagcaagttttatagaagtcaagacatgtacatggcccaaaagtcatacattatggtctaatggagtgctagaatcagaaatgattataccgaaaatttatggcggtcctatttcacagcataactacagacctggatatttcactcaaacagcaggaccgtggcacttaggaaaattggaattagattttgatctctgtgaaggtacaacagtggtggtcgacgagcattgcgggaataggggtccgagcttaagaacaacaaccgtaactggcaaaattatacatgaatggtgctgtaggtcatgcacattaccaccacttaggtttagaggggaagacggttgttggtacggtatggagataagacccgtcaaagagaaagaggaaaaccttgtaaggtccatggttagtgcaggtagtggcgaagtagattcattcagcctaggtatactatgtgcatcgataatgatcgaggaggttatgaggagtagatggagtcgtaagatgctaatgaccggtacattggccgtcttcttacttctaataatggggcaattgacttggaacgacctgatccgattgtgtataatggttggggcaaatgcaagcgacagaatgggcatgggaacaacgtatcttgctctcatggccaccttcaaaatgagaccaatgtttgctgtaggacttctttttaggcgtttgacatcaagagaagtgttattattaacaatcgggttatctctagtagcaagtgttgaactaccaaactcgctagaagaattaggtgacggattggctatgggtatcatgatgctcaaactcctaactgaatttcagccacatcagctgtggaccacattactatcactaactttcataaaaactactctctctttagactacgcgtggaaaacaactgccatggctttaagtatcgtaagtctatttccactctgcctgtccactaccagccagaaaaccacttggttaccggtcttattagggtcttttggctgcaaaccactaacaatgtttctaataacagagaataagatttgggggcgtaaaagttggcctctaaacgaaggtataatggcaatagggattgtatcgattctcttatctagcctcttgaaaaacgatgtaccgttggctggtccattaatcgcaggcggcatgttaatagcttgttacgtgataagcggaagttctgccgatttaagtctagaaaaggcagcggaagtatcgtgggaacaagaggcggagcattcagggacttcgcacaatattctcgttgaggtccaagatgatggcactatgaaaatcaaagatgaggaacgcgacgacacacttacaatcttattaaaagcaacattactcgccgtctcaggcgtttaccccatgtctatcccagccacgttatttgtatggtacttctggcagaaaaagaaacagagaagcggggttctatgggacactccgtctcccccagaggttgaacgcgcagttttagacgacgggatctataggatactacaacgtggactactcggtaggtcacaagtgggagtgggagtgttccaagacggggtatttcatactatgtggcatgtcacaagaggagctgtgctcatgtaccaaggaaaaagacttgaaccatcctgggcgtctgtcaagaaagatctgattagttacgggggaggctggcgattccaaggcagttggaacactggtgaagaggtgcaggtcatagcagtagaacctgggaaaaacccgaaaaacgtccaaacaacgcctggaaccttcaagactcctgaaggggaagtaggggcaatagcacttgacttcaagcctggcacttcgggcagtcctattgtaaacagggagggaaaaatagtgggcctatatggaaatggagtagtaacaacgtccggtacttatgtaagtgcaatcgcgcaagctaaagcatctcaagaagggccgttacccgagatagaggatgaagtattcaagaagagaaatttaacaattatggatttgcatccaggttctggaaaaacaagacgttatttaccggcaatcgtaagagaggctataaaaagaaaactaagaaccttaatcttggcacccacaagagtggtagcatccgaaatggccgaagctctgaaaggaatgccaataagatatcaaacaacagcagtgaaatcagaacatacaggtagggaaattgttgacttaatgtgtcatgcaaccttcacaatgcgacttttgtcgccggtgagagtacctaactacaatatgataataatggatgaagctcatttcaccgaccctgcctcgattgcagcaaggggttacataagtacgcgggtaggcatgggtgaagcagcagccatttttatgacggcaacacccccgggttctgttgaagcatttccccaaagtaatgcagtaatacaagatgaggagagggatattcctgagagaagttggaactccggatatgattggattacagacttcccgggaaaaaccgtttggttcgtgccgagtataaaatcaggcaacgacatagccaactgcctgaggaaaaatggcaagcgtgttattcagttaagccgtaagacctttgatacagaatatcagaagacgaaaaataatgattgggattatgttgttacgacagacatatctgaaatgggagcaaatttcagagcagatcgagtcatagacccgagacgctgtctaaaacctgtaatcctcaaagatggacccgagagggtaatactcgcaggaccaatgcctgtcaccgtagcgagtgctgcacaaagacgtggtagaatcggccgaaatcaaaacaaagagggagaccaatacgtatacatgggccagcccctcaataatgacgaggatcacgcgcattggacagaagctaaaatgctacttgacaatatcaatacgccggaaggcattatacctgccttgttcgaacctgaaagagaaaagagtgcagcaatcgacggggagtacaggctacgaggagaggctagaaaaactttcgtagaattaatgagaagaggtgatttgccagtctggctcagttacaaggtggcgagtgaaggatttcaatattctgatagaaggtggtgcttcgatggagaaagaaataatcaggtactcgaggaaaatatggacgtagaaatttggacaaaagaaggcgaaagaaagaaactccgtcctagatggttagacgccagaacatattcagaccctcttgcccttcgagagtttaaggaatttgcggctggacgaaggtccgtcagtggagatttaatacttgaaattggaaagttaccccaacatctaaccctaagagcacaaaatgcattagataatttggttatgctgcataatagcgaacaaggtggaaaagcatatagacatgctatggaggaactcccggatacaatagaaactttaatgttactagcactcatcgccgtcctgactggaggagtaacactcttctttttaagcggaaaaggactcgggaaaacgtctattggcttattatgcgtcactgctagttccgcattattatggatggccagtgtagaaccccattggatcgcagcatcaatcatactcgaatttttcttaatggttcttttaataccggaaccagatcgccaacgcacaccccaagacaaccaactagcatacgtcgtgatcggattattgttcatgattttaactgtagctgcaaatgaaatgggactattagagaccaccaagaaagacttgggtataggacatgtagccgctgaaaatcaccaacatgcgactatgttagatgtagatttgagaccagccagtgcctggaccttatacgctgtagcaaccacagtgataacacccatgatgcgccataccattgagaatactactgcaaatatttctttaacggcaattgcaaatcaagctgctattttgatgggtttggacaagggttggcctatctcaaaaatggacattggtgtcccgctattagctttaggctgttattcacaagtaaatccattaacattgacagcagcggtccttatgttggtggcccattatgcaataattgggccaggactacaagctaaagcgacaagggaggctcaaaaacgaacggcagcaggaatcatgaagaacccaacggtagatggcatagtcgcgatagatcttgatcctgtagtatacgacgccaagtttgaaaaacagttaggacagatcatgctcttgatcctctgtacctcacaaatattgttaatgcgaactacatgggctctctgtgaatcaattacactggcaacgggcccgttgacaactttatgggagggtagccccggaaagttctggaataccaccatagcagtatcgatggcaaatatttttcgaggatcgtatctagcaggagccggtttagcattttcattaatgaaaagtttaggaggaggcagaagaggcactggagcacaaggtgaaacattaggcgaaaaatggaaaagacaattgaaccaattgagtaaatcggagttcaatacctataagagatctggaataatggaagtggaccgaagtgaagcaaaagaaggtttgaaacgtggtgagacaactaaacacgcagtaagtaggggtacagcaaagttgagatggtttgtagaaagaaacttagtcaaaccggaaggaaaagtgattgacttgggctgcggtagaggtggctggagctattactgcgcaggtttaaagaaagtcacggaagtaaaaggatatacaaagggaggacctggacatgaagaaccaatacctatggccacctacgggtggaatttagttaaattacatagtggaaaggacgtattctttatgccacctgaaaaatgtgacacactattatgcgatattggtgaatcatcacctaacccgactatcgaagagggacgcacattaagggtactgaaaatggtagaaccatggctcagaggaaaccaattctgtatcaagatactgaacccatacatgccatcggtggttgaaacattagagcagatgcagcgtaaacacggtggtatgctagtacgaaatccattaagcagaaactcaacacatgagatgtattgggtatcttgtgggactggcaatatcgtatcagccgttaatatgacctcacgaatgttattaaatagattcacaatggctcatcgtaaaccaacctatgaacgagacgtggacttaggagcgggaacccgtcatgtcgcagtcgaaccggaggttgcaaatcttgacataatcggccagcgcattgaaaacatcaaaaatgaacacaaatcaacctggcattatgatgaggataatccatataaaacctgggcttatcacggaagctacgaggttaaaccgagcggatctgcttctagtatggtgaacggagtcgttagattgctaacaaaaccgtgggacgtaatacctatggtaacacaaatagcaatgaccgatacgacacctttcggacagcagcgagtatttaaagaaaaagtagacacgcgaactccacgagccaagcgcggtacgacacaaattatggaagtgacagcaaagtggctctggggattcctgtcaaggaacaagaaaccacgaatctgtactagggaagagttcacgagaaaagttagaagtaatgcggcaattggtgcggtgttcgtagatgagaatcagtggaacagtgctaaagaagccgtagaagacgaaaggttttgggacttagtgcatagagagagagagcttcacaaacagggaaaatgtgcaacgtgtgtttataatatgatggggaaacgggagaagaaactaggtgagtttggaaaggctaaaggatcacgagctatatggtatatgtggttaggagcgagatttctggaatttgaagcgctaggcttcatgaatgaagatcactggtttagtcgagaaaattcattatcaggtgtggaaggagaaggacttcacaaactcggatacattttaagagacatatcaaaaatacctggcgggaacatgtatgcagacgacacagctggatgggacacaaggataacagaagatgatttgcagaatgaagcaaaaattactgacatcatggagcctgagcatgcactgttggccacgtcaatattcaaattaacttatcaaaataaagttgttagagtgcagaggcccgctaagaatggcacagtgatggacgtaattagccgccgagatcaaagaggatctggccaagtaggaacttatggcttgaatactttcaccaacatggaagttcaattaattagacagatggagagcgaaggcatctttctaccctcagaactcgaaacaccaaatcttgctgaacgcgtattggactggttagagaaacacggcgcagagagattaaaaaggatggcaataagtggagatgattgcgttgttaaacccatagacgataggtttgccacagctctcactgcacttaatgacatgggcaaagtaagaaaggatataccgcagtgggaaccatcaaaaggatggaacgattggcaacaagtgccgttctgttctcatcactttcatcaactaataatgaaagacggcagagaaatagttgtcccgtgtcgcaatcaggatgaactggtaggacgtgcaagagtttcgcaaggcgcaggttggtctctcagagaaaccgcttgtctgggaaaatcgtatgcgcagatgtggcaattgatgtatttccataggagagacctgagacttgcagcgaatgcgatctgcagtgcggtaccggtagactgggtgccaacatcgaggacaacttggagtatacatgctcatcatcagtggatgacgacagaagatatgctttctgtatggaatagggtttggatagaagaaaatccatggatggaagacaaaacgcatgtatctagctgggaagaagtaccataccttggaaaaagagaagatcaatggtgtgggtccctaataggtttaacagcaagagcaacatgggctacgaatattcaggtagctataaatcaagttcgaagattaattggaaatgaaaattacctggactatatgacgtctatgaaacgtttcaaaagcgaaagtgatccggaaggagcactatggtag

SEQ ID NO: 21297 - RNA, 9879 nt, synthetic construct
  misc_feature 1..9879: note = derived and/or modified CDS sequence (opt6) from DENV-1__EU482616__SS-prME
  source 1..9879: mol_type = other RNA
tcagtaactatgttactgatgttactcccaactgcactagcatttcacttaactactagaggtggcgaaccccacatgatagtaaacaaacaagaacgaggaaaatcacttctattcaaaacatcagcaggagtaaatatgtgcacattaatagctatggaccttggcgaactttgcgaagacaccatgacgtataaatgtccacaaataactgaagcagaaccagacgacgttgactgctggtgtaacgcaacagatacctgggtgacatatggaacatgtagtcaaacaggcgaacatagaagggataagagatcagtagctttggccccacatgtcgggttggggctagaaactcgaacagaaacatggatgagttccgaaggagcatggaaacaaattcagcgagttgaaacttgggccttgagacatccaggctttaccgttatagccctgttcctagcgcatgcgatagggacgagtataacacagaaaggtataatattcattcttttaatgctagttactcccagtatggctatgcgttgcgtggggataggcaatagagattttgttgaaggacttagtggtgcgacatgggtcgatgtcgtactggaacacggttcatgcgtaaccactatggcaaagaataagccaactttggacattgaattattgaaaacagaagttactaatccagcgattttacgtaagttatgcatagaagctaagattagtaacactacaaccgattccagatgtccaacacaaggtgaggccacgttagtcgaggagcaggatgcgaacttcgtctgccgacggacatttgtcgaccgagggtgggggaatggatgcggactgtttgggaaaggttcacttttaacttgtgcaaaatttaaatgtgttaccaaattagagggtaaaattgttcagtatgaaaacttaaaatactccgttattgtgacagttcatactggcgaccaacaccaagtcgggaatgaaactactgaacacggaaccatcgcgaccataactccacaggctccaacaagtgaaattcaattaacggattatggagccctaacattggactgtagccctaggaccgggttagatttcaacgaaatggttttgttaactatgaaagagaaatcttggttagtacataagcaatggttcctggatttgccactaccatggacatcgggtgcatctaccagccaagagacctggaacaggcaagacctcctagtgactttcaagactgcccatgctaagaaacaagaagtggtggtgttgggcagccaagaaggagcaatgcacacagcattaacaggggccactgagatacagacatccggaaccacaacaattttcgccgggcaccttaagtgcagattaaaaatggataagctaaccttaaaaggcacgagctatgtcatgtgcacggggagcttcaaactagagaaagaggtagcagaaacccaacacggtacagtattagttcaagttaaatatgaaggtacggatgcgccttgcaaaataccattcagtactcaagacgagaaaggagtgactcagaatggtagactgataactgctaatcccatcgtcactgataaggaaaagcctgttaatattgaaacggaaccaccgtttggagaatcctatatagtagttggggcaggagagaaagcgttaaaattatcttggttcaaaaaggggtcaagcataggaaaaatgtttgaagcaacggcgagaggggcacgacgaatggcaattctaggcgacacagcttgggattttggctccataggaggagtgtttacaagtgtagggaagctagttcatcaggtatttgggactgcatacggcgttttattcagcggcgttagttggaccatgaaaataggtataggaatactcctgacttggctaggtctgaactcgcggtcaacatcgctatcaatgacatgcatagctgtaggaatggtgacattgtatttaggagtaatggtccaagcagatagcggatgtgtaatcaattggaaaggtcgagagttgaagtgtgggagcggtatctttgtgacaaatgaagtgcatacctggacagaacaatacaaatttcaagcagactcacccaaaagactgtcagcggctataggaaaagcatgggaagaaggggtatgcgggatccgttcagcaactaggcttgaaaatatcatgtggaaacagatctcaaacgaactaaatcacatcctgctggaaaatgacatgaaattcacagtagtcgttggcgacgctaacggcatattggcgcaaggtaagaaaatgattagaccccagccaatggaacataaatatagctggaaatcatggggaaaagcaaaaataattggagcagatatacaaaacacaacattcattatcgacggccccgatactccagaatgtcccgacgatcaacgtgcttggaacatttgggaagtagaagattatggttttggcatttttacaacaaatatttggcttaaactgcgagactcttatacacagatgtgtgatcatcgtctaatgtcagcagcaatcaaagatagtaaagccgtccacgcagacatgggttactggattgaatctgagaaaaatgagacgtggaagttggctagggcgagcttcatagaagtaaaaacatgcacatggccgaagtcgcacacattatggagcaatggcgtcttagaaagcgaaatgattattccaaagatatatggagggcctatctcccagcataattacaggccaggttatttcacccaaacagcgggcccatggcacctgggaaaattagagctcgatttcgacctatgtgaggggacaacagtagtcgttgatgagcattgcggtaatcggggaccatctcttaggacaacaactgtaactggaaagataattcacgagtggtgttgtagaagctgcaccttaccccctctaagatttagaggagaggatgggtgctggtacggaatggaaataaggccagtaaaggaaaaagaggaaaacttggtacgatcaatggtaagtgcgggatcgggagaggtagacagcttctctctagggatcctttgcgctagtataatgatcgaggaagtgatgaggtctcgctggagtcgaaaaatgctaatgacggggactcttgcagtatttctattgctgatcatgggtcagctgacatggaacgatctaatacgattgtgtataatggtaggagcaaatgcatcagatagaatgggaatgggaacgacctaccttgctttaatggcaacttttaaaatgaggcccatgtttgctgtaggtctcttattccgaagactgacaagtagagaagtattactattaacgataggattaagcctagtagcaagtgtggaattacccaatagcctcgaggaattaggagatggtctagccatggggataatgatgctgaaacttcttacagaatttcagccacaccaactctggacaacattacttagtttaacgtttatcaaaacgacactttctctggattatgcttggaaaacaaccgcgatggctctatcaatagtatccttattcccattatgcttaagcacaacctcacaaaagaccacatggctaccagtattgcttggctcgtttggttgtaaaccattaacgatgttcctgataacggaaaacaaaatatggggccgcaaatcatggcctctaaatgaaggtattatggctattggtatagttagtatactattatcatcgctactaaagaatgacgttccattagcagggccgttaatagcgggtggtatgctgatagcatgttatgtaattagtggatcgtcagcagacctatcattggagaaagctgcagaggtgagctgggagcaggaagctgaacatagcggaacatcacataatatcctagtagaggttcaagacgacggaaccatgaaaattaaagacgaggaaaaagatgataccctgactattttgcttaaagcaacacttctggctgtctccggagtctatccgatgtcaattccagcaacgcttttcgtttggtacttctggcagaagaagaaacaaaggtctggtgttttgtgggacacccctagcccacccgaagttgaacgagcagtacttgatgatggtatttaccgcattctacaaagaggcttactaggaagaagccaggtgggggtaggtgtcttccaagatggagtttttcatacaatgtggcatgtaaccaggggtgcagtactaatgtatcaaggcaaaagacttgaaccctcttgggcttcagtaaagaaagacctaatcagttacggtggcggatggcggttccaagggtcttggaatactggcgaagaagttcaagtcattgcagtagagccaggtaaaaaccccaaaaatgtacaaacaaccccaggaactttcaaaacgccagaaggtgaagtaggcgctattgcattagactttaagcccggcacgagcgggagtcctatcgtgaacagggaagggaaaatcgtaggattgtatggaaatggtgtagtgactacatcagggacatacgtgagtgcgatcgcgcaggccaaggcaagtcaagaaggtcctttaccagagattgaggatgaagtatttaagaaacgaaatttgacaataatggacttacatcctggatctggaaaaacaagacgctatttaccggcgattgttcgtgaagcaataaaacgaaagttacgcacactaatacttgctcctacgagagttgtagcttcagaaatggctgaagcactaaaaggcatgccaattagataccaaactaccgctgttaaatccgaacacacgggaagagaaatagtagatttaatgtgtcacgcaacatttaccatgagattactgagccccgtgcgggtaccaaattacaatatgatcattatggatgaagctcacttcaccgatccagcttcaatagccgcacggggatacattagcacaagagtgggaatgggagaggccgctgccattttcatgacagcgactcctccgggatctgtcgaagcattcccacaatctaatgccgtaatccaagacgaagaacgtgacataccggagaggagctggaactctggatatgactggataacagattttccaggaaagaccgtttggtttgtgccatcaatcaaatcaggaaatgacattgcaaactgcttacgcaagaacgggaagagggttatacaactatctagaaagacgttcgacactgaatatcagaaaactaaaaacaatgactgggattatgttgttacaacagatatatcggaaatgggagccaacttcagagctgatcgagtcattgatcctagacgatgtttaaaaccggttattttaaaagatggtccggaacgcgtcattctggcaggtcctatgcccgtcacagtagcatctgcagcgcaacgcagagggaggataggccgcaatcaaaataaagagggagaccaatacgtatacatgggtcaacctttgaacaatgatgaagatcacgcccattggactgaagcaaaaatgttactagataatataaacactccagaaggaattatcccagccttgtttgaacccgaaagagaaaagagcgcagctattgatggtgaatatagactaaggggagaagcccgaaagacatttgtcgaattgatgcgacgaggcgatctacctgtttggttatcttacaaggtagcatcagaaggattccaatactcagacaggagatggtgttttgacggagagcgaaataatcaagtattggaagaaaatatggatgttgaaatttggacgaaagaaggagaaagaaagaaacttcgcccacgttggttggatgccaggacttattcagaccctctagcacttcgagagttcaaagagtttgcagcagggagacgaagtgtatcgggagacttgatactagaaataggtaaattgccacaacatctaaccttgcgagcacaaaatgcgttagataatttggttatgctgcataacagtgaacaaggaggaaaagcctatagacacgcgatggaggaacttccggacacgatcgagactttaatgttacttgctctaattgctgtcttgacgggaggtgtaacattatttttcttgagcgggaaaggtttgggtaaaacctctattggtttactatgtgttacagcaagttcagccttattgtggatggccagtgtagaaccacactggatagctgcgtcgattatattagaatttttcctcatggttttattgatacctgaaccagatagacagcgaacaccccaagacaaccagctagcttatgttgtcattggattgctctttatgattttaacagttgcagctaacgagatggggcttctagaaacaacgaagaaagacctagggatcggtcatgtagcagctgaaaatcatcaacatgcaacaatgttagatgtagatcttagaccggcttctgcttggacattgtatgcagttgcgacaacggttataacacccatgatgaggcatacgattgaaaatactacggcaaatatatcattaacagcaatagctaatcaagctgccattctcatgggactagataagggatggccgataagtaaaatggatataggggtaccattattagccctaggatgttactctcaagtaaaccccctcacattaacggcagcagtgttaatgttggttgcacactatgcgattataggaccaggcttacaggcgaaagccacacgtgaagctcaaaaacgtacagctgcgggaattatgaaaaatccaaccgtagatggcattgttgcaatcgaccttgatcctgtcgtctatgacgctaaatttgaaaaacaactagggcaaataatgttgttgatattatgcacttcccagattttgttgatgaggacaacttgggcattgtgtgaatcaatcacgctagccactggacctctcactacgttgtgggaaggtagtcccggcaaattttggaatacaacaatcgcggttagtatggcgaatatcttcagggggtcgtacttagctggagctggactagcgttcagcttgatgaaaagtttaggtggaggacggagaggaacgggagctcaaggagagacattgggagaaaagtggaagaggcaactaaatcaactgtccaaatcagaatttaatacatataaacggtccggtattatggaggtagaccgatccgaggcaaaagagggactaaagcgaggcgaaaccacaaaacatgcagtaagtcgaggaacagccaaattgcggtggtttgtagagagaaatctagtaaagcctgaagggaaggtgatagacttaggatgtgggcgaggaggatggagctattactgtgcgggattgaagaaggtaactgaagttaaaggatatacaaaaggaggtccaggacatgaagaaccgattcccatggctacttatggctggaatctagttaaacttcactcaggaaaagacgtattctttatgccacctgaaaagtgtgacacgctactgtgtgatataggtgaatcgtccccaaatccaaccattgaagaaggacgaacattaagagttttgaaaatggttgaaccatggttgagaggaaatcaattttgcataaaaatattaaacccatacatgccttcagttgttgaaaccttagaacaaatgcaaagaaagcacggaggtatgctggtaaggaaccctctctcacgaaatagtactcatgagatgtattgggtatcatgcggcacagggaatatagtatctgcggttaacatgacgtctagaatgcttctaaatagattcacgatggcccacagaaaaccgacttatgaaagggatgtagatcttggagccggaacacggcacgttgcagtggagccagaagtggctaatcttgatataattggccaacgaatcgaaaatatcaaaaatgaacacaaatccacatggcattacgatgaggataatccctataaaacgtgggcttatcatggatcttatgaagtaaagccctcgggttccgcgagtagcatggtaaatggtgtcgtcaggttactcacaaaaccatgggatgtcatccctatggtaacccagattgcaatgacagacacaacaccatttggacaacaaagagtatttaaggaaaaggtcgataccaggactccgcgcgctaaacgcggcacaacacaaatcatggaagtgacagctaagtggttgtggggatttctttcccgaaataagaaacctagaatttgcacacgtgaagagtttacaaggaaagtccgatcaaacgctgcgataggagcagtgtttgtagatgaaaatcagtggaatagtgccaaagaagctgtcgaagatgaaagattttgggatttagttcatcgcgaacgcgaattacataaacaaggtaagtgtgccacatgcgtatacaacatgatggggaaaagagagaagaaactaggagagttcggtaaagctaaaggaagtagggcaatttggtatatgtggttaggtgcaagattcttagaatttgaggcacttggattcatgaatgaagatcattggttctcgagagaaaactcgctatccggagtcgaaggcgaaggtttacataaactaggctatatattacgtgacatatctaaaattccagggggtaatatgtatgcagatgacacagctggatgggatacacgtataacagaggatgatctacaaaatgaagcgaaaataaccgatattatggaacccgaacatgcccttctcgcaacaagtatatttaaacttacctaccaaaataaggtagttcgagtccaacgaccagccaaaaatggtactgtgatggacgtgatatccaggcgcgaccaaagagggagtgggcaagtcggaacatatgggctaaatacgtttacaaacatggaagtacaacttattagacagatggagagcgaaggcatattccttccaagtgagctcgaaacaccaaacttggcaaagcgagtattagattggctagaaaagcatggagcagaacgactgaaaagaatggccatatccggtgatgattgcgtggtaaaaccaattgacgatcgtttcgctactgcgcttacggccttaaatgacatggggaaggttagaaaagatataccacaatgggaacctagcaaaggatggaacgactggcaacaggttccgttctgcagtcaccactttcatcaattaatcatgaaagacggcagagaaatagtagtaccttgccgaaatcaggatgagctggtagggcgagctagggtatcacaaggtgctggctggagtttacgtgaaacagcatgtttaggtaaaagctacgcccaaatgtggcagctcatgtatttccacagacgggacctacgtctcgccgctaatgcgatatgttccgctgtacccgtcgactgggtacctacatcgaggactacatggagtatacacgcacatcatcagtggatgactacagaggatatgctatctgtatggaatagagtatggatagaagaaaacccctggatggaggataagacacacgtcagctcatgggaagaagttccctatttagggaagagagaagaccaatggtgtggttccttaataggattaacagcgagagcgacatgggcaacaaatatacaggttgccataaaccaggtaaggagactaataggtaacgaaaactatttagattacatgacctcaatgaaacggtttaaaaatgaaagtgatcccgaaggagctttatggtag

SEQ ID NO: 21298 - RNA, 9879 nt, synthetic construct
  misc_feature 1..9879: note = derived and/or modified CDS sequence (opt6) from DENV-1__EU482618__SS-prME
  source 1..9879: mol_type = other RNA
agtgttacaatgttattaatgttacttcctacagcgctcgcattccacctaacaactagaggtggtgaaccacacatgatagtcagtaaacaagaaagaggaaagtccctgttattcaagaccagcgcaggagttaacatgtgtacattgatagcaatggacctaggagaactttgtgaagatacaatgacttataagtgtccccaaataacggaagcggaaccagatgatgtggactgctggtgcaacgctactgatacttgggtcacttacggtacctgttctcaaaccggtgaacataggagagacaaacgctctgtcgcattagcgccacatgttggtctaggactcgaaacacgtacagaaacttggatgtccagtgaaggtgcctggaaacaaatacaaagagtcgaaacttgggcgctccgccatccgggtttcacagtaatagcgttattcctagcccatgccatagggacttcaattacgcaaaaaggtataatatttattctactgatgttagttactcccagcatggccatgagatgtgtaggaatagggaacagggactttgtcgaaggtttaagcggtgcaacttgggtcgatgtggtattagaacatggttcctgcgtaacaacaatggccaagaataaaccgactttagatatagaattactcaaaactgaagtaacaaatccagcgatattaagaaagttatgcatagaagctaagatcagcaacactactaccgacagtaggtgtccgacgcaaggtgaggcaacattagtagaggagcaggacgcaaatttcgtttgcagacgaacgtttgtggaccgcggatggggaaatggatgtggactttttggaaaaggatcactactaacctgcgccaaatttaaatgtgtaacaaaattagaaggcaaaatagtgcaatacgagaacttaaagtattcggtcatagtaactgtccatacaggtgatcaacaccaagtaggtaacgaaaccacggaacatggaacaatcgcaaccattaccccacaagcgccaacaagtgaaatacaactaacagattatggagcactaacactggattgttcacccaggacaggattagattttaacgaaatggtgctactaactatgaaagagaaaagctggctagtacataaacaatggttccttgatttacctttaccttggacttcaggtgcatctacatcacaagaaacctggaaccgtcaagatttgcttgtcacgtttaaaacagctcatgccaagaaacaagaagtcgttgtattagggagccaagagggcgccatgcatactgctctaacaggcgcaacagaaattcaaacgtcgggaacaacaactattttcgctgggcacctgaaatgtagactaaaaatggataaattaactctaaaagggacgtcgtacgtcatgtgcacgggtagctttaaactggaaaaggaagtcgccgaaacacaacacggaactgtccttgtacaagtgaaatatgaaggaactgatgctccatgtaaaatcccatttagtacccaagacgaaaaaggggtaacccaaaatggaagacttataaccgcgaaccccatcgtgactgataaagaaaagccagtcaacatagaaacggaacccccgtttggagaatcatacatagtagtcggagcaggagaaaaagcacttaaattgtcatggtttaagaaaggatcatctattggaaagatgtttgaggcaacggccagaggagcacgaaggatggcgatcctaggtgatactgcttgggactttggaagtatcggaggagtcttcacgagcgtgggaaaactcgtacatcaggttttcggtactgcttacggagttctttttagcggagtaagctggaccatgaaaataggaataggcatattattaacttggcttggcttaaactctcgatctacatcactcagtatgacgtgtattgcggtcggtatggttacgttatatctaggtgtaatggttcaggcagatagtggctgcgtaataaattggaaaggacgtgagttaaagtgtgggagtggaatatttgttaccaacgaagttcatacatggacggaacaatacaaattccaagctgactctccaaaaagattaagtgctgctataggcaaagcatgggaggaaggtgtatgtggtataagatcggcaacgagacttgaaaacatcatgtggaagcagattagtaacgaactaaatcacattttattagagaatgacatgaaatttacagttgtagttggagacgccaatggcatattagcccagggtaagaaaatgattcgaccccagccgatggaacacaagtatagctggaaaagctggggcaaagcgaaaataattggagccgatatccaaaacacaaccttcataattgatggtcccgacacacctgaatgcccagataaccaaagggcatggaatatttgggaagtagaagattatggatttgggatttttactacgaacatatggctaaagctccgagatagttacacgcaaatgtgtgaccatcgtctaatgagcgctgcgataaaggactcaaaagccgtacatgccgatatgggatattggatagaaagtgaaaagaatgagacctggaagctagcaagggccagctttatagaagtaaagacatgcacctggccgaaaagtcacacactatggagtaatggcgtcctagagtcagaaatgatcattccgaagatctacggaggtcctataagccagcataattatcgaccgggttattttacccaaactgctggcccttggcatcttggaaaacttgaattagattttgatctatgtgaaggaacgactgtcgttgttgatgaacactgcgggaaccggggtcctagtctacgcacaacaacagtaaccggaaaaataattcatgaatggtgctgccgtagctgcactttaccacctttaaggtttcgaggtgaagatgggtgttggtatggaatggaaataagaccggtgaaagaaaaggaagagaacctggtccgttctatggtttcggcaggaagtggtgaagtagatagcttcagtttgggcatcttgtgtgcttccataatgattgaagaggtcatgaggtcaagatggtcacgaaaaatgctaatgacaggaactctagcagtgttcctcctactcattatgggacagctgacttggaacgaccttatcaggctttgtattatggttggagcgaatgcttcggacagaatgggaatgggtactacttacttagcgctcatggctacattcaagatgagaccaatgtttgcagtaggactattgttccgacgcttgacgtcccgagaagtattactactgacaataggtttaagcctagtagcctcggtagaattgcccaacagcctggaggaactgggagatgggcttgcgatggggatcatgatgttaaagttactgaccgaatttcaacctcatcaattatggactactttgttatccttgacatttatcaaaacaactttgagcctagattacgcatggaaaacaacagctatggctctaagtatagtatcattattcccactctgcttgagcacgacatcccagaaaaccacctggctgccagtactattagggtcatttggctgtaaaccgttgactatgttcttaattaccgaaaacaaaatatggggtcggaaatcatggcccttaaacgaaggaattatggccatcggaattgtttcaattctactgtcctctttacttaagaatgatgtacctttagctggtccattaattgcaggagggatgttaatagcatgctacgtgataagtggatcttccgcagatttatctctggagaaagcagccgaagttagctgggagcaagaagcagaacattccgggacaagtcacaacatcctagtagaagtacaagatgatggaacaatgaaaataaaagatgaagaacgcgacgatacattgactatcttattgaaagcaacattgctcgcggtatccggggtttacccaatgtccatcccggcaactctatttgtatggtatttttggcagaaaaagaaacaacgatccggagtactatgggataccccatcccctcccgaagtcgaacgagccgttctagatgatggtatatatagaatacttcagagagggcttttgggacgatcccaggtaggcgttggggttttccaggacggagtatttcatacaatgtggcatgtcacgagaggtgctgtgctgatgtatcaaggaaaaagactcgaaccaagctgggcgagcgtgaaaaaggatttaatatcatacggcgggggttggaggttccaaggcagttggaacacaggagaagaagtgcaagtaatagccgtagaaccggggaagaacccgaagaatgttcaaactacaccaggtacgtttaaaacacctgaaggggaagttggtgcgatagctttggacttcaaacctggaacatctgggagcccaattgtcaacagagagggtaagattgtagggttgtatggaaacggcgtagtaacaacgagtgggacatacgtgtctgctatagcacaggcaaaggccagccaagaaggtccactaccagaaatagaagacgaggtctttaagaaacgcaatttaactatcatggatctgcacccgggtagcggaaaaacaagaaggtacttacccgccatcgtccgggaagctatcaaacgaaaacttcgtaccttgatattagcgccaacaagggtagtcgcaagcgaaatggcggaagccttaaaaggtatgccaataagatatcaaacaactgccgtcaaaagtgaacatactggacgagaaatagttgatctgatgtgtcacgcaacttttacgatgagattactgtcgcccgtacgtgtccctaattacaacatgatcataatggatgaggctcatttcacagatccggcctcaatcgcagcgagaggctatatctctacaagagtgggcatgggtgaagccgcagcgatatttatgacagccacaccacccggatcggttgaagcctttccgcaatccaacgccgttatacaagatgaagagagagatataccagaaagatcatggaatagtggatatgactggataaccgacttcccaggtaaaactgtatggttcgtaccaagtattaaaagcggaaacgacatagcaaattgtctaaggaaaaacggaaaaagagtcattcaacttagcagaaagacctttgatactgaataccagaaaaccaaaaataatgactgggattacgtggtaaccacggatatatcagagatgggtgctaattttagagcagatcgtgtcattgatcctcgtaggtgccttaaaccggtgatcttaaaggacggacctgagcgagttatattagcggggccgatgcctgttactgttgcgtcggcggctcaacgcaggggaaggataggaagaaaccagaataaagaaggcgaccaatacgtttacatggggcaaccgctgaataatgatgaagatcatgctcactggactgaagcaaaaatgttactagacaacataaatactcctgaggggattattccggccttgtttgaaccagaacgggagaaatcagctgccattgacggagaatatcgtctacggggtgaagctcgaaaaacatttgtggaactcatgcggcgaggtgatctgcccgtgtggttatcatataaagtagcttctgaaggatttcagtactctgatagaagatggtgttttgacggagagcggaacaatcaggtattagaggaaaacatggatgttgaaatttggactaaagaaggggaaagaaagaaattacgccctaggtggttagacgcgcgaacgtatagcgacccgttggcattaagggagttcaaagagtttgcagctggtagaaggtccgtatccggcgacttgattctagaaataggaaaacttccccaacacctaactttaagagctcagaatgcccttgacaatcttgttatgttacataacagtgaacaaggaggaaaggcttataggcacgcgatggaagaactaccagatacaatcgaaactcttatgttattggccctgattgcagttttgacgggaggagtgactctcttctttctcagtggcaaaggactagggaagacaagcataggccttctatgtgttacagctagtagcgctctgctctggatggcatcagtagagcctcattggattgccgcaagtattatcctagagttcttcctcatggtcctattaatcccagaaccggacagacaaagaacacctcaagataaccaactggcatatgtcgtcataggtttattgtttatgatcctaacagtagcagcaaacgaaatgggactattagaaactactaagaaagatttgggaatcggtcacgtcgctgcagaaaatcaccaacatgcaactatgctggatgttgatttgaggcctgcgagcgcatggacattatacgccgtggcaacaacagtaataactccgatgatgaggcacacaattgagaatacaacagcaaacatatcattaacagcaatagcgaatcaagctgcaatacttatgggacttgacaaaggatggccaatcagtaaaatggatataggtgtgccacttctggcccttggttgttattcgcaggtaaatcccctgacactaacagcggcagtattaatgctcgttgcacactatgcaataatagggcccggtttgcaggcaaaagctacaagagaagctcaaaaacgaacggctgctggcattatgaaaaatccaacagtagacgggatagtagcaattgatttggatccagtggtctatgatgcaaaatttgaaaaacaattgggacaaataatgcttttgatcctatgtactagccaaatactcttgatgcggacgacatgggcactgtgcgaatcaataactctagccacgggcccgcttactacattatgggaaggttcccctggcaaattttggaatactaccatagcggtttccatggctaatatatttaggggctcgtatttggcaggggctggattagcatttagtttaatgaaaagtttaggaggaggtcgaagaggcacaggtgctcaaggtgaaacgctaggtgaaaaatggaaaaggcagcttaaccaacttagtaaatcggaatttaacacctacaaaagatctggtattatggaagttgatagaagcgaagcgaaagagggacttaaaagaggagaaacaactaaacacgcagtcagccgaggaaccgcgaaattacgttggttcgtggaacgaaatcttgtcaaacccgagggaaaggtgattgacctcggttgcggccgaggaggatggtcatattattgcgcaggattgaagaaagtaacagaagtcaagggatatacaaagggaggcccaggtcatgaggaaccaataccaatggcaacttatggatggaacctagttaagctgcattcaggcaaggatgttttcttcatgccaccggagaaatgtgacacattgctctgcgacataggggaaagctcacctaacccaacaatagaagaaggaagaaccctaagagttttaaaaatggtagagccctggttacgcgggaaccaattttgcataaaaatactaaatccatatatgccttcagttgtagaaactttagaacagatgcaacgaaaacatggcgggatgcttgttcggaaccctttgagcagaaactccacacatgaaatgtactgggtctcatgcggcaccggaaatatagtaagcgcagtcaacatgaccagcaggatgctgctaaataggttcactatggcgcatagaaaacccacttacgaaagggatgttgatctaggagcaggtacaagacatgtcgcggttgaaccggaagtagcaaacctggacattataggacaacggatagaaaatattaagaatgaacacaagagcacatggcattatgacgaagataacccatataaaacgtgggcatatcacgggtcctacgaagtcaaaccaagcggctctgcctcaagtatggtaaacggtgtagttcgactcttaacgaaaccatgggacgtaataccaatggtaacacaaatagccatgacagatacaacaccttttggccagcaacgagtgtttaaagagaaggtagacacacgtacacctagagctaagcgagggacaacacaaatcatggaagtcacagcaaagtggctgtggggatttttgtcaaggaacaagaaaccacgaatatgtacaagagaagaatttacacgcaaagtcagaagtaacgctgcaatcggagctgtgttcgtcgatgagaatcaatggaacagcgcaaaagaagcagtagaggatgaaagattttgggatctagtacaccgtgaacgtgagttacacaaacagggaaagtgtgccacttgcgtatataacatgatgggtaagcgtgagaagaaactaggagagttcggtaaggcaaaaggatcacgcgcgatctggtatatgtggctaggtgcaagatttctggagttcgaagcattgggttttatgaacgaggatcattggttcagcagggaaaattcactctcaggtgtagaaggtgaaggtttacataaactgggctatattcttcgagacatatcaaaaattcctggaggcaacatgtacgctgacgatacagccggatgggatacaagaatcacagaagatgacttgcagaacgaagctaagataaccgacataatggaacctgaacacgctctcctcgcaacctcaatattcaagttaacctatcagaataaagttgttcgagtacaaaggcctgcaaagaatggaacagtgatggacgttatatcaagacgagatcaaagaggttcaggacaagttggaacatatggcttgaatacattcaccaacatggaagtacagttaataaggcaaatggaatcggaagggatatttttgccaagcgaattagaaactccaaacttagcagaacgtgttttggactggcttgagaagcatggagctgagcggttaaagaggatggccataagtggagatgattgtgtggtcaaaccgatagacgatcgttttgcaaccgctctgacagcgttgaacgacatggggaaagtacgcaaagatatacctcaatgggagcccagtaagggatggaatgattggcaacaggtaccattctgctcacatcactttcaccagctcataatgaaagacggacgcgagatcgtagttccatgccggaatcaagatgaactggtaggcagagcacgtgtgtctcaaggagcgggatggtcattacgcgaaactgcctgtcttgggaaatcatacgcacaaatgtggcaattaatgtacttccatcggcgggatctacgcttggccgccaatgcaatatgttcagctgtcccggtagactgggtccctacatcaagaacaacttggagtatacatgcacatcatcaatggatgacgactgaggatatgttgtccgtgtggaatagagtatggatagaggaaaacccgtggatggaagataaaacacatgtatcaagttgggaagaagtgccatatttaggaaaacgcgaagatcaatggtgtggcagcttaataggactaacagcaagggctacatgggcaactaatattcaagtggcaataaatcaagttcgacggttaatagggaatgagaactatttagattatatgacttcaatgaaacgctttaagaacgaatcagacccagaaggcgctctatggtaa

SEQ ID NO: 21299 - RNA, 9879 nt, synthetic construct
  misc_feature 1..9879: note = derived and/or modified CDS sequence (opt6) from DENV-1__EU482619__SS-prME
  source 1..9879: mol_type = other RNA
tccgtaactatgctactcatgcttcttccaaccgcactcgcgtttcatttaactaccagagggggtgaaccacacatgatcgtatccaaacaagaacgagggaaaagtttattattcaaaacttccgctggagtgaatatgtgtactctgatcgctatggatctcggagagctatgcgaggacacaatgacatacaaatgtccgcaaataactgaagcagaaccagatgacgtcgattgttggtgcaatgccaccgacacatgggttacatacggcacatgttcacaaacaggcgaacatcgacgagataaacgaagcgttgcattagcacctcacgtaggactaggtttagaaacgcgaactgaaacttggatgtcctccgaaggggcgtggaaacaaatacaaagggtagaaacctgggcattaaggcatcctggtttcacagtaatagcactgttcctcgcacacgcgattggtacatccataactcaaaaaggtatcatctttattttattgatgcttgttacaccttcaatggctatgcgttgcgtaggtatcggaaatcgcgacttcgtcgagggactgtcaggcgctacctgggtagatgtggttttggaacatggatcttgtgtaacaacaatggccaaaaataaaccaacactagacatagaactgctaaaaactgaagtcacaaatcctgcaatactacgaaaattatgtatagaggccaagataagtaatacaacaactgattcaaggtgcccgacccaaggcgaagcgactctagtagaagaacaagacgctaacttcgtatgtagacgtacttttgttgaccgcggctggggtaacgggtgtggattgtttggtaaaggtagtctgttaacgtgcgctaaatttaagtgcgttacaaaactagaaggaaaaatagttcaatatgaaaatcttaaatacagtgtcatagtcactgtgcatactggtgatcaacaccaggtaggcaacgaaacgactgaacatggaactatagccaccattacaccacaagctccaaccagtgagatacagctaacagactacggagcattaactctcgattgcagtccgaggacaggattggactttaatgagatggtacttttaactatgaaagagaaaagttggctagtacataagcaatggttcctagatctaccattaccttggacaagcggtgcgtcaaccagccaagaaacttggaatcggcaagatctccttgtaacctttaaaacagcacatgctaagaaacaagaagtcgttgtattagggtctcaagaaggcgcgatgcacacagcacttacaggagccacggaaatccaaacttcgggaactacaacaattttcgctggtcatttgaaatgtcgcctaaagatggataagctaactctaaagggaactagctacgtaatgtgcacaggatcttttaaattggagaaagaagtagcggaaacacaacacggtacagttctagtacaggtaaaatacgaaggaacagacgcaccatgcaaaatcccattcagcacacaagatgaaaaaggtgtgacacagaacggcagactcatcacggcaaacccaattgtaacagacaaagaaaaacccgtcaacatcgaaacagaacctcctttcggagagagttacattgtggtgggcgccggagagaaagccttaaaactatcctggtttaagaaaggaagtagcataggtaaaatgtttgaagcgacagcacgaggtgccagaagaatggccattttaggtgataccgcctgggacttcggctcaattggtggcgtattcacttcagttggtaaattagttcatcaagttttcggaactgcgtatggagtcctattttcaggagtgtcatggacaatgaagatcggaataggtatattactaacgtggctgggcttaaacagccgtagtacatctttgagtatgacatgtatcgctgttggaatggtcactctatatttaggtgtcatggtacaagcagattccggttgtgttataaattggaaaggtagagaattgaaatgcggaagtggaatttttgtcaccaacgaggtgcatacatggacagaacagtacaagtttcaagcggatagtccgaagaggttaagtgccgcaatcggcaaagcatgggaggaaggagtttgcggtatccgtagtgcaactcgactagaaaatataatgtggaagcaaatcagtaacgaactcaatcatattttattagaaaacgatatgaaatttacagtggtcgttggtgatgcaaatggaatactagcacagggtaagaaaatgatcagaccccagccgatggaacataaatattcttggaagtcatggggaaaagctaagattataggagctgatatacaaaacactacattcataattgatggaccggacacaccagaatgcccggataatcagcgcgcttggaatatatgggaggtggaagattacggttttgggatatttacgacaaacatttggctcaaattaagagatagctatacacaaatgtgtgaccatagattaatgtctgctgccataaaggactcaaaagcagtgcacgcagacatgggctactggatagagtcagagaaaaatgaaacctggaagctagctcgcgccagtttcatagaagtgaaaacttgtacgtggccgaagtcccacaccctatggtccaatggcgtgctagagtcggaaatgattataccaaaaatatacggcggtcctatcagccaacataattatcgtccaggttatttcacccaaaccgcaggtccatggcacttggggaaactggaacttgattttgacttatgtgaaggaacgacagtagtagtcgacgaacattgtggaaatcgtggtccatctttgagaacaaccaccgtcactggaaaaattatacatgaatggtgttgtagatcttgtacgttaccaccactacgattcagaggagaagatggatgttggtatggaatggagatcaggccggtaaaagaaaaggaggaaaatctagtaagatcgatggtatctgcagggtccggagaagtagatagttttagtctaggcatcttatgtgcttctattatgattgaagaggttatgcgaagtagatggagccgtaaaatgttaatgacaggcactttagctgtatttttgcttttaataatggggcaactaacctggaatgatttaataagattatgtattatggtcggagcaaacgcatcagaccgcatggggatgggaacaacctaccttgcccttatggcaacattcaaaatgcgaccaatgtttgcagtaggattactatttagacgtctcacttcccgagaggttcttcttcttaccattggtctttccttagtggcatcagtagaactccccaattcactagaggagcttggagatggtcttgcaatgggaataatgatgctcaaattactcacagagttccaacctcaccagctttggactaccttattatctctaacatttataaaaacaacattaagtttagactatgcctggaaaacaacagctatggccctgtccatagtcagtttattccctctctgcctctctacaacaagtcagaaaacgacgtggctgccagtattgttaggaagtttcgggtgcaaacctcttacaatgtttttaatcacagaaaataaaatatggggacgaaagagctggcctcttaacgagggtataatggcaatcgggattgtgtcaatattactatcatcattgcttaaaaatgacgtgcctctcgcaggaccacttattgctggtggtatgttaattgcatgctacgtaataagcggcagcagtgcagacttgagtttagaaaaagccgccgaagtatcctgggaacaagaggcggaacacagtggcacatcacacaacattctggtcgaagttcaggatgatgggactatgaagataaaagacgaagaacgcgatgatacactaactattcttttaaaagcaacgttacttgctgtgtccggagtttatcccatgagtattccagctactttatttgtttggtatttttggcagaagaagaaacaaagaagtggcgtgctatgggacacaccatcacctccggaggtagaaagagcagtgctcgacgatggtatatatagaatcctccagcgaggacttcttggaaggagtcaggtcggcgttggtgtatttcaggatggagtgtttcacaccatgtggcacgtaacacgcggagctgttttaatgtatcaaggaaaaagattggaaccttcttgggcatctgtcaagaaagacctaatatcatacgggggaggatggaggtttcaagggtcgtggaatacaggcgaggaggtgcaagtgattgccgtggaacctggcaaaaaccccaaaaatgtacaaaccacccccggaacatttaaaacaccagaaggtgaagtaggtgcaattgctcttgacttcaaaccaggtacatcaggatctcccattgtgaatcgagaagggaaaatagtaggtctatacggaaatggcgttgtaacaacatccgggacctatgtgtcagccattgcacaagcaaaggcatcccaagaagggccgctcccagagatagaagatgaagtatttaagaaacgcaacctgacaatcatggacctacatccaggatcaggaaaaacgcggcgatacctaccagcaattgtacgcgaagctataaaaagaaaactacggactctaatcctcgcaccaaccagagttgtcgcaagtgaaatggcagaggcattaaaaggtatgcccataagatatcagacgacagccgtgaaatcggaacatacggggagagaaatagttgacctgatgtgtcatgcaactttcactatgcgtttactgtcaccggttagagtacccaattacaatatgataattatggatgaggcacactttaccgacccagcctctatagcagctagaggttatatctctaccagggtggggatgggcgaagccgcagctatattcatgactgcaactcctccaggatcggtagaggcttttcctcagtcaaacgctgttatacaagatgaagaaagggatattccggaaagaagctggaactctggatatgattggattacagattttccaggtaaaacggtttggtttgtgccctctataaagtcaggcaatgatattgccaactgcttacggaaaaacggcaaacgtgttatacagctatcaagaaaaacttttgacacagagtatcagaaaactaaaaacaatgattgggactatgttgtgacaacagatatcagtgaaatgggggcaaactttagagcagacagagttatagacccaagaaggtgcctcaaaccagtcattttgaaagacggaccagaaagggtgatacttgcggggccgatgccggtaactgtagcttcagcagcgcaaaggagaggccgaattggccgaaatcagaataaggaaggcgaccagtatgtatacatgggtcaaccattaaataatgacgaagaccatgcacactggactgaagccaagatgctacttgataatataaatacaccagaaggcattatacccgctttattcgagccagaacgcgagaaaagtgcagccatagatggggaatatagattacgtggagaagcaagaaagacttttgtagagctgatgcgaagaggtgatctaccagtctggttaagttataaggttgcatccgaaggatttcaatactctgatagacgatggtgcttcgatggagagagaaataatcaggttttagaagaaaatatggatgtggagatttggactaaagaaggagaacgaaagaagttacgtccgaggtggttagatgctagaacctatagtgatcctctagcactacgcgaatttaaggaatttgctgctggtagacggtccgtcagtggagatctaatattagaaataggtaaacttccccagcatttgacgttaagagcgcagaatgcccttgacaacttagtcatgttgcataactctgaacaaggaggaaaagcctaccgacacgcaatggaggaactaccagacactatagaaacactcatgttgcttgcactgatcgccgtacttacaggcggtgttaccctcttctttttatccggcaaaggcttaggtaaaactagcattgggttactatgcgtaacagcatcttcagccctgttgtggatggccagcgtagagccgcattggattgccgcatcaattatactagagttctttttaatggtcttactaataccggaacccgaccggcaaaggacgccacaggataaccagttagcctatgtcgttataggattattatttatgatcttgaccgtagccgcaaatgaaatgggtttactagaaactactaagaaagacctaggtatagggcacgtagctgccgaaaatcaccaacacgcgacgatgttagacgtcgatcttagacctgcaagcgcctggacattgtacgccgtggcaactacagttattacgcctatgatgcgacatacaatcgaaaatacaacggccaatatttcacttactgctatagcaaatcaggcggctattcttatgggtttagacaaaggttggcctattagtaaaatggatataggtgtcccactcctcgcccttggatgttacagtcaagtcaatccccttactctaaccgccgctgtcttgatgttagtcgctcattatgctataatcggacctggattacaagccaaagctacacgagaagcacaaaagagaactgcagcgggaataatgaagaacccaacagtggatggtatagtagccattgatctagacccagtcgtctacgacgccaaattcgaaaaacagctgggccagataatgctcttgatactatgcacgtctcaaattctattaatgcgaacgacgtgggcactctgtgagagtattactctagcgacaggtccgctgacaaccttatgggaaggtagcccgggaaaattctggaacacgactatagctgttagcatggcaaatatattccgtggcagttacctcgctggagctgggttagccttttcccttatgaaaagtttgggagggggtaggcgtggaaccggtgcccaaggtgaaacattgggtgaaaaatggaagagacaattaaatcaactatccaagtcagaatttaatacttataaacgttccgggattatggaagtagatagaagcgaagcgaaggagggactaaagagaggagagacaacaaaacacgcggtctctaggggaacagcaaaattacgttggtttgtcgaacgtaatctagtaaaacctgagggaaaagtaatagatctcggatgtggacgcggagggtggtcgtactattgtgcaggattaaagaaagtaacagaagtaaaaggttatacaaaaggaggaccaggtcatgaagaaccaattcctatggccacatatggttggaacttagtcaaactccattcgggaaaagatgtattctttatgcctcccgaaaaatgtgacaccttattatgtgacataggagaatcatcgccaaatccaacaattgaagaaggaagaacattacgggtactcaagatggttgaaccctggttacgagggaaccagttctgtataaaaatactaaatccatacatgccaagcgtcgttgaaacattggagcaaatgcaacggaagcatggagggatgttggtacgaaatcctctatcgcgtaatagcacacacgaaatgtattgggtatcgtgcggcacgggaaatattgtatccgccgttaacatgacctctaggatgttgctcaaccggtttactatggcgcatagaaagcctacttatgaacgcgacgtagaccttggcgcagggacaagacatgttgcagtggaacccgaagtggcaaacttagatataatcggtcagaggatcgaaaacattaagaatgaacacaaatcaacatggcattacgacgaagacaatccctataagacatgggcttaccatggttcctatgaggtaaaaccatccggttctgcgagttcgatggtaaatggtgtagttagattgctaacgaaaccgtgggatgtaatccctatggtaacgcaaattgctatgacagacactactccatttggtcaacaaagagttttcaaggaaaaagtagataccagaacacccagggctaagaggggaaccacacaaattatggaggtcacggctaaatggctgtgggggtttctaagcagaaataagaaaccaagaatatgtactagagaggagttcacaagaaaagtgagatctaacgcagcaataggggcggtatttattgatgaaaatcagtggaactctgcaaaagaagcggtagaagacgaaagattttgggacttggtacaccgtgaaagagaattacataagcaaggtaaatgtgcaacatgtgtatacaacatgatgggtaaaagagaaaagaagttaggcgagttcggtaaagcaaagggaagtagagcaatatggtatatgtggctaggagctaggttccttgagtttgaagcgttaggattcatgaatgaggatcattggttctcaagagaaaatagcttaagcggggtggaaggagagggccttcacaaattgggttatatcctacgagatatatcaaaaatcccaggtggaaacatgtacgctgacgatactgctggatgggacacaagagtaactgaggacgatttacaaaacgaggctaaaataactgatataatggaacctgaacacgcactgctagctacaagcatctttaaactaacctatcaaaacaaagtagtaagagtccaaaggcctgccaagaatggaactgttatggatgtaataagtagaagagatcagcgtggttccggccaggttggtacatatggcttaaacacttttactaatatggaagtccaactaatccgacaaatggagagcgaaggaatatttttaccttcagagctagaaacaccgaacctcgctgaaagagtattagactggttggaaaaacatggtgcagaaagattaagaagaatggcaatttcaggcgacgactgtgttgttaaaccgatagatgacagatttgcaactgcccttactgctctaaatgatatgggtaaagtacgaaaagatatcccacagtgggagccgagtaagggctggaatgattggcaacaagtgccattctgttcacatcactttcatcaattaatcatgaaagacggacgtgagatagtcgtgccatgcaggaaccaagacgaattggtgggtcgagcacgggtttcccaaggtgcaggctggtcactcagagaaacagcgtgcctggggaaaagttacgcacaaatgtggcagctgatgtattttcaccgtcgggaccttcggctagctgctaatgctatatgtagcgcagttccagtagactgggtgccaacaagtagaactacgtggtctatacacgcgcatcatcaatggatgaccacggaagatatgttatctgtatggaatcgagtatggattgaagaaaacccatggatggaagacaagacccacgtgtcatcatgggaagaggtaccttacttaggcaaaagagaagaccagtggtgtgggagtctcatcggtctaactgcaagggcgacgtgggctactaatatacaagtagctatcaatcaggttagaagactaataggtaatgagaactatcttgactatatgacatcaatgaagaggtttaagaatgaatctgatcctgaaggcgcactctggtaa

SEQ ID NO: 21300 - RNA, 9879 nt, synthetic construct
  misc_feature 1..9879: note = derived and/or modified CDS sequence (opt6) from DENV-1__FJ898433__SS-prME
  source 1..9879: mol_type = other RNA
agcgtaacaatgttactaatgttactaccgacagcactcgcatttcatcttacaactagaggaggggaaccacatatgatagtaagtaaacaagaaagaggtaaatcactcctctttaaaacaagtgccggtgtaaatatgtgcacacttatagccatggacctcggcgaactctgcgaggacacaatgacatacaaatgtccccaaataaccgaagccgagccggatgatgtagactgttggtgcaacgcaactgatacatgggtgacatatgggacttgctctcagacaggtgaacaccgacgagagaaacgaagcgtggcgttagctcctcatgtcggacttggccttgaaacacgaacggagacctggatgagctctgaaggagcctggaagcaaatacaacgtgtagaaacctgggcattgcggcatcctggattcaccgttacggcactattccttgctcatgccataggaacctccattacgcagaaaggcataatattcatactacttatgttagttactcctagtatggcaatgagatgtgttggaataggaaacagagattttgtagaaggtttgtccggagcgacgtgggttgacgtagtattagagcacggatcgtgcgttacaacaatggctaaaaataaaccgaccttagatattgaactcttgaaaactgaggtgacgaatccagccatattacgaaaactatgtattgaggcgaaaatttctaacaccacaacggacagcagatgtccgactcaaggggaggcaacattagttgaggaacaagatgcgaattttgtttgtagacgaacctttgtcgatagagggtggggtaacggttgtggtctttttggcaaaggttctctactaacgtgtgcaaaattcaaatgcgtgaccaaattagaaggaaaaatagttcaatatgaaaatcttaaatactcagtcatagtaaccgttcatacaggagatcagcatcaagtaggaaacgaaactacagaacacggtacaatagctacgattacccctcaagcgccgacatcggaaatccaattgacagattatggtgcactaacattagattgctcaccgaggaccggtcttgattttaatgaaatggtattacttactatgaaagaaaaatcatggctagtacataaacaatggttcctcgatctccccctgccgtggacgagcggggcgagcacgtcacaggagacatggaatcgacaggacctacttgtaacctttaaaacggcacatgcgaagaaacaggaagtcgtagtactgggaagtcaggaaggtgcgatgcataccgcactcacaggcgcgactgaaatacagacaagtggaaccacaacaatctttgccggccatcttaaatgccggttaaaaatggataaactaaccttaaaaggcacgagttacgtaatgtgtacgggaagttttaaattagagaaagaggtggctgaaacgcaacatggaacggttctagtgcaagttaaatatgaaggtactgatgcgccatgcaaaatcccattcagcacacaagacgagaagggagtaacgcaaaatggacgattaattactgcaaaccctatagtcacggacaaggagaagccagtaaacattgagactgagcctccctttggtgaatcatacattgtagtaggtgcaggagaaaaggccttaaaactctcctggttcaagaaaggaagttccataggaaaaatgtttgaagcgacagccagaggagctagacggatggctatcctaggagacactgcctgggattttggatcaataggtggggtgtttacaagtgtaggaaaacttgtgcatcaagtattcggtacggcatatggggtgctattttctggggtctcatggactatgaaaataggtatcggaatcttgttaacatggttgggtctcaatagtcggtcaacttcattaagtatgacttgtatagcagtaggaatggtgacactttatttgggtgtcatggtgcaggcagattcagggtgtgtgatcaattggaagggaagagaattaaaatgcggttcaggaatattcgtcacaaatgaggtacatacatggacggaacaatataaattccaagcagacagtcccaaaaggctgagcgcggccataggcaaggcttgggaagaaggcgtctgtggtattcgaagtgcaacgcggctcgaaaacattatgtggaaacagatttcaaatgaattaaatcatatattactcgaaaatgatatgaaatttacagtagtagtcggagatgccaatgggatcctagcacagggtaagaaaatgatacgcccacaaccaatggagcataaatactcctggaaaagctggggtaaggctaaaatcattggggcagatatacagaatacaacgtttattatagacggtcctgatactccagagtgtcccgataaccagagggcttggaatatttgggaagtcgaagattacggatttggaatctttaccacaaacatctggctcaaattaagagattcatacacgcaaatgtgtgatcatcgactgatgagtgcagcaataaaggactccaaagcagtacacgctgatatgggttactggatagaatcagagaaaaatgagacatggaaactagctagagctagtttcatagaagttaaaacatgtacatggccgaaaagtcacacactatggtccaacggagttttagagtccgaaatgataatacctaagatatatggaggtcccattagtcaacataactatcgaccaggatatttcacacagactgctggaccctggcatcttggtaaactggaattggattttgatagctgtgaaggcactaccgtagttgtagatgaacattgcgggaatcggggaccttcattaaggactactacggtaactggaaaaatcatccatgagtggtgttgcaggagttgtacgctacccccactcagatttagaggagaagacggctgttggtatggaatggagatacgaccggtaaaagaaaaggaggagaacttggtaagaagtatggtgagtgcagggagcggagaagttgactctttttctttaggtatattatgcgtatcaataatgattgaagaagtaatgagatcccgctggagcagaaagatgttaatgacaggcactcttgcggtatttttgctccttataatgggacaactaacgtggaaagatctcataagactatgtataatggtaggtgcaaatgcaagtgataggatggggatgggaacaacttacctcgcgttaatggcaacttttaaaatgcgtcctatgtttgcagtaggactattatttagaaggctaaccagtcgtgaagttctgttactgactattggactgagccttgtagcatcagtcgaacttccaaattccttagaggagttaggtgatggtcttgcgatgggaatcatgatgctgaaattactgacagaatttcacccacatcagctttggacgactttattatccctgacatttatcaaaacgactctatctctagattatgcctggaaaacgactgcaatggcactctcaatagtttcactgttccctctttgtttgagcacgactagccagaaaactacgtggttgccagtactactaggatccttcggatgtaaacccctcactatgttcctgattacagaaaataaaatatggggccgaaaatcttggccattaaatgaaggaattatggcaataggcattgtatcaatacttctaagtagtttgctgaaaaatgatgtgccacttgcaggaccattgattgccggtggaatgctaatcgcttgctatgtaattagcggatcctctgccgatctttcactagaaaaagcggcagaagtaagttgggaacaagaagctgaacattcaggaacttcccataatatattagtcgaagtacaagacgatggaactatgaaaatcaaggacgaagaacgtgatgatacactcactatacttttaaaagctaccttattggcggttagtggggtttatccaatgagtataccagcaaccctgttcgtctggtatttttggcaaaagaagaaacaacgttccggtgtgctttgggacacaccctcaccacccgaagtagaaagagcagtactggatgatgggatctataggatattacaacgaggtctattaggtcgatcacaagtaggagtaggcgttttccaggacggtgtgttccatacaatgtggcatgtgacaagaggagcagtcttgatgtatcaggggaaacgactagagccaagttgggctagtgtcaagaaagacctaattagctatgggggtgggtggcggtttcaggggtcttggaacacaggagaggaagtacaagttattgcagtagaaccaggaaagaatcctaaaaatgtacaaaccactccaggaacattcaagactccggagggggaagtcggggctattgcattagatttcaaaccaggaacctctgggtctccaatagtaaatcgtgagggcaaaatagtaggcctttacggcaatggagtcgtgacaacctcaggcacgtacgtctctgcaatagcgcaggcaaaagcatcgcaagaaggccctctacccgaaatcgaagatgaagtatttaagaaacgaaacctcactataatggatttacatccaggcagcggcaagacaaggcggtacttgccggcaattgtaagagaagcaataaaaagaaaattaagaacgctaatacttgcaccgacccgcgtggtagccagcgagatggcagaggcgttaaaaggaatgccaattagatatcaaactacagcagtaaagagtgaacataccggtcgagaaatagtagatcttatgtgtcacgccacgtttactatgaggcttctcagtcccgtgcgtgtacccaactataacatgattataatggatgaagcacattttacggatcctgcctccattgcagcgcgcggctatatctcaacacgcgttggaatgggtgaagccgcagcgatattcatgaccgctacaccaccgggatctgtagaagcatttccacaatcaaatgctgtgatacaagacgaagaaagagatattccagaaagaagttggaatagtgggtacgattggataactgattttccgggtaaaacggtttggttcgtgccatccataaaatcgggcaacgatatagcaaactgcttgagaaagaatggaaagcgagtaatacaactcagcagaaaaacgttcgatacagaatatcagaagactaaaaataatgactgggactacgtagtgacgaccgatatctcagaaatgggcgcgaattttagagctgacagagtaatagatccaaggagatgcctaaaacccgttatactgaaagatggacccgaaagggtaatactcgcgggtccaatgcctgtaactgtcgcttcagctgcgcagagaagagggagaataggacggaatcaaaataaggaaggcgaccaatacgtctacatgggacaacctttgaataatgacgaggaccacgctcactggacagaggcgaaaatgctgttagataatattaatacacccgagggaattataccagcacttttcgaacctgaacgtgagaagtctgctgctattgatggtgaatatagattgagaggtgaggcacgaaagactttcgtcgaactgatgcggagaggtgatctaccagtctggctaagttataaagttgcgagcgaaggatttcaatactcagataggaggtggtgtttcgacggtgaaagaaacaaccaagtactagaagaaaatatggatgtagaaatatggaccaaagaaggtgaaagaaagaaactacgaccaagatggttggacgctaggacgtatagtgaccccctggcattacgagaatttaaagaatttgcggccggtaggcgctcagttagcggcgatttaattctcgagataggcaaactaccacaacatttaacattgcgtgctcaaaatgcattagataatttggtcatgctgcacaactcagaacaaggcggtaaggcttacaggcatgcaatggaagagttgccggatacgatcgagactctgatgttattagcactcattgcggtcctaacaggcggagtgacgttattctttttaagcggcaaaggtttaggaaaaacaagtataggattactatgcgtgactgcaagcagtgctctcttatggatggcttcagtagagcctcattggattgctgcatcaataatattagagtttttcttgatggttttactcatcccagagccggataggcaaagaacacctcaagacaatcaactagcttatgtagtcataggacttttgttcatgatactaactgtggctgcgaatgaaatggggttattggaaaccaccaagaaagacctaggtataggtcacgtcgctgctgagaatcatcaacatgccacaatgctcgacgtcgatttgaggccagcatctgcatggaccttatacgccgttgccactacagttatcactccaatgatgagacataccatagagaacacaaccgcaaatatcagtttaactgctattgccaaccaagcagcaatcttgatgggattagacaaaggatggccaatttcaaagatggacataggcgtaccacttttggctttaggatgttactcccaagtaaaccctcttaccctgacagcagctgtgttaatgctggtagcccattacgctataatcggtccaggattacaagcgaaggcaactagagaagcacaaaaacgcacggcagctggaataatgaaaaatccaactgtagatggcattgtcgctatagatttggacccggtggtatatgacgctaaattcgaaaagcaattgggacagattatgctattaatcttgtgcacatcacaaattttattaatgagaacaacttgggcattgtgcgagtcaataacactagcaactggacccttgaccactctatgggaaggatcgcccggtaagttttggaatacaacaattgctgtttcaatggctaatatttttagaggatcttacctggcaggcgcaggtctagcattcagtctaatgaagagtctaggcggcgggcggcggggaactggcgcacaaggagagaccctcggtgaaaaatggaaacgccaactgaaccagctaagcaagagcgaatttaatacttataaacgatcaggcattatggaagtagaccgttcagaagcgaaagagggattaaaacgcggagaaactacaaaacatgcagtgtccagaggaactgcgaaattaaggtggttcgtagaacgaaacttagtcaaacccgaaggtaaagttatcgatctaggttgtggaagaggagggtggagctactactgtgcaggtttgaaaaaggtgacagaagtaaaaggatacactaaaggcggtcctggacatgaagaaccaatacccatggcaacgtatggatggaatcttgttaagctccactcaggaaaagatgttttctttatgcctcccgaaaagtgtgatacgttattatgtgatataggggaaagttcacccaacccaacgatagaagaaggacgcacactaagagttttgaaaatggtggagccttggctgagaggcaaccagttttgcatcaaaatacttaacccctacatgcccagtgtcgtagaaacgctcgaacaaatgcagagaaaacatggaggaatgctggtaagaaatcccttgtcaagaaactcaacacatgaaatgtactgggtgtcgtgtgggacgggtaatatagtgtctgcagttaatatgacatcgagaatgcttttaaataggtttacaatggcccaccggaagcctacctacgaaaaggacgtggacttaggagctggaaccaggcacgtagcagttgaaccggaggttgccaatctcgatatcatagggcaaagaatagagaacatcaaaaacgaacataaaagcacttggcattacgacgaagataacccatataagacatgggcttaccacggaagttatgaagttaaaccgagcggctctgctagctcaatggtaaacggtgtagttaggctgctgacaaaaccgtgggatgttattccaatggtaacacaaatagcaatgacggatacgacaccattcggacagcagagggtcttcaaagagaaagtagatactcgtacacccagagcaaagaggggtacaacacaaattatggaggttacagcaaaatggctatggggattcctgagccgcaataagaaacccagaatttgtaccagggaggaatttaccaggaaagttagatctaatgcagcgattggtgctgtcttcgtagatgaaaatcaatggaactcagccaaagaggctgtagaagatgaaagattttgggacttggtccacagagaacgcgaattacataaacaaggaaagtgcgccacatgtgtatacaatatgatgggtaaaagagaaaagaaacttggggaatttggaaaggcaaagggttcgcgagctatctggtatatgtggttaggtgccagatttctcgagttcgaagcactgggttttatgaatgaagaccactggttctctcgtgaaaacagtttgagtggagtggaaggcgaaggtttacataaacttgggtatatattacgcgacataagcaagataccaggaggaaatatgtacgcggatgacactgcaggatgggatactcgaattacggaagatgaccttcagaatgaagccaaaataacagacattatggaaccagagcacgctctattagcaacttcaatatttaaacttacttaccagaacaaagtggtccgagtgcaacgaccggccaaaaatggcaccgtaatggatgtcatatcaaggagagatcagagggggagtggacaagttgggacatacggtttaaacacgtttactaatatggaagtccaactaataagacagatggaatcagaggggatatttctaccatctgaactagaaacaccaaatttggcggaaagagttctagattggctcggaaaacacggcgcggaacggctaaaacggatggcaatatctggagatgactgtgtagttaaaccaatcgatgatcgtttcgcgacggctctaacagcgttaaacgacatgggtaaggtacgtaaagacataccacagtgggaaccgtccaaaggctggaacgactggcaacaagtcccattttgtagccaccacttccaccaattaattatgaaagatggaagagaaatagtagtgccatgtagaaaccaagatgaattagtcggtagagctagagtttctcaaggagcagggtggagcctcaaggaaacagcgtgtctaggaaagtcgtacgcccaaatgtggcaattgatgtactttcacagaagagatctaagactggctgctaatgcaatatgtagtgctgttcccgtagattgggttcccacatcaaggacaacatggtcaatacatgctcatcatcaatggatgactacagaagatatgttatcggtctggaacagagtgtggatagaagaaaatccctggatggaagacaaaacacatgtatcatcatgggaggaggtgccctatttagggaaacgagaggaccaatggtgcggtagtctcatcggcctcactgccagagccacttgggcgacaaacatccaggttgcaattaaccaagtaagaaggctaatcgggaatgagaattacctagactacatgacttcgatgaaacgatttaagaacgaatctgatccggaaggagcactatggtaa

SEQ ID NO: 21301 - RNA, 9879 nt, synthetic construct
  misc_feature 1..9879: note = derived and/or modified CDS sequence (opt6) from DENV-1__FJ547088__SS-prME
  source 1..9879: mol_type = other RNA
agtgtaactatgctgctaatgttgctaccaacagcgttagcatttcatttaacaacacgaggaggagaaccccatatgatagtctctaaacaagaaagagggaaaagtctattatttaaaacgtcagcaggagtgaacatgtgtacactaatagctatggatctgggagaactatgtgaagacactatgacatataaatgccctcaaattacggaagcggaacccgacgacgtagactgttggtgcaatgcaaccgacacttgggtcacatacgggacgtgttcccagacaggtgaacaccggcgtgacaaaaggagtgtcgctttagcccctcatgtcggcttaggactagaaacgaggacagaaacatggatgtcaagtgaaggagcttggaaacaaatacaaagggtagaaacttgggccttaaggcatcctggctttactgtgattgccttgtttttagcacatgccataggaacctctattactcaaaaagggataatttttatcttactaatgttggtgacgccatcaatggcaatgcgatgcgtagggataggaaaccgtgattttgttgaaggcctatccggtgccacatgggtagatgtagtattagaacacgggtcgtgcgtaacgacaatggctaaaaacaaaccaacactagacatagagctattgaaaacggaagtaactaatcccgcaatcctgagaaaactatgcatagaagccaaaattagcaacacaaccacagatagtagatgtcccacacaaggagaagctaccttagtcgaagaacaagacgccaatttcgtatgcagaaggacatttgttgatcgtggatggggcaacggatgtggcttgtttgggaaaggttcgttactgacttgcgcaaaatttaaatgcgttacgaaattggaaggtaaaatcgtgcagtacgaaaatttaaaatatagcgttatagtgacagtccatacaggagaccagcatcaagttggaaacgaaacaactgaacatggtaccatagctacaataacacctcaggcgccaacgtcagaaatccagctaacggattatggtgctctgactcttgattgttctcccaggacgggccttgattttaacgagatggtgctattaacaatgaaagagaaatcctggttagttcataaacaatggtttttagacctcccactgccttggacctcaggagcaagtacttctcaagaaacctggaatagacaagatctgttagtaacattcaaaacggcgcatgccaagaaacaagaggtagtggtattaggctcacaagaaggtgcgatgcacaccgcattaactggagcaactgagattcagacgagtggaacaactacaatatttgcaggacacctgaaatgcaggctaaaaatggacaaattgactttaaaaggtacctcatatgtaatgtgcacaggaagttttaagctggagaaagaagtcgcagaaacccagcatggtactgtactggtccaagtaaaatacgaaggaacagatgcaccatgcaagattccatttagtacacaagatgaaaagggcgtgacccaaaatggaagattaatcacagccaatccaatagttactgataaagaaaaaccagtaaacattgagacggaacctcctttcggagaaagctacatcgtagttggtgccggggaaaaggctttgaaactaagttggttcaagaaaggaagctccataggaaagatgttcgaagcaacagcaagaggggcaagacgaatggcaattttgggtgatactgcttgggactttggaagcataggaggggtttttacctccgtgggtaaattagtacatcaggtcttcggaacagcatatggagtcctattctcaggagtatcctggacaatgaaaatcggaatcggaatattactgacctggcttggcttgaacagcaggagtacctccctgtcaatgacatgtatagcagtaggaatggtaaccctctatttaggggttatggtgcaggctgattcaggatgcgttataaactggaagggaagagaattaaaatgcggctcgggtatatttgttacaaatgaagtgcacacgtggactgaacagtacaaatttcaagcagactcgcctaaaaggttatcggccgcaattggcaaggcttgggaggagggagtatgtggaataagaagtgcgacgcgacttgagaacataatgtggaaacaaatttctaatgagctaaatcacatacttttagaaaacgatatgaaatttaccgtagtagtcggagatgcaaacggtatattagctcaaggcaagaaaatgataagaccgcaaccgatggagcataaatacagttggaagtcttggggtaaagctaaaattataggagctgatatccagaacactacattcataattgatggtccggacacaccagagtgtccagataatcaacgagcctggaacatatgggaagtcgaagattatggttttggaatattcaccaccaatatttggcttaagctgagagatagctatacacaaatgtgtgaccaccgacttatgagcgccgccataaaagattccaaagctgtgcatgcagacatgggatattggatcgaatccgagaaaaacgagacttggaagttagcaagagcttcttttatagaagtaaagacttgtacatggcccaaatcacatacactctggagcaacggagttctagaatcggaaatgattatacctaaaatatatgggggtccaatatcacagcataattatagaccaggctattttacccagacggcggggccatggcacctagggaaactagagttagatttcgatctttgtgaaggaacaacagtcgtagtagacgaacattgtggaaatagagggcctagcttacgcacgactactgtaacgggaaaaattatacacgaatggtgctgcagatcatgtacgctaccacctctgcgattcaggggtgaagacggttgctggtatggtatggaaataagaccagtgaaggaaaaagaagaaaacttagtaagatctatggttagtgcgggcagcggagaagttgattctttcagtctaggaatactatgcgcttctataatgattgaggaagtcatgaggtcgcggtggtcgagaaagatgttaatgacgggcactctagcagtatttctattattaatcatgggacagttgacctggaatgatctcatacggttatgtataatggtaggcgctaatgcatcggatcgaatggggatgggcacaacatatctcgctctaatggcgactttcaaaatgcgccctatgtttgccgtaggactattgttcagaagattaactagccgagaagttttactgctaacaataggacttagcctggtggcatctgtcgaactaccaaattcacttgaggaacttggagatggcctagcgatgggtattatgatgctaaaacttctaaccgaatttcaaccacaccaactatggacgacactcctaagcctaacgttcatcaaaactaccttatcacttgattacgcctggaaaaccacagcaatggcgctaagcattgtaagtctctttccgttgtgtttaagtacaacatcccagaaaactacttggctacccgttctcctaggatcattcggctgtaagcctttaacaatgttcctaataactgaaaacaaaatttggggacgaaaatcctggcccctcaacgaaggcataatggctataggtatcgtttccatattgctttcttctttacttaaaaacgatgtaccattggccgggcctctaatagcgggtggcatgttaatagcatgctacgtcattagtgggtcctcagcagacttgtctttagagaaggcagcagaagtaagttgggagcaagaagcggaacactcgggaacaagtcataacatccttgtagaggtacaagacgatggaacgatgaagattaaagacgaagaaagagacgataccctcaccattctacttaaagcaactttactcgccgtgtcgggggtatatccgatgagtatacctgccacgttatttgtttggtatttctggcagaagaagaaacaacgtagtggagtgttgtgggatacacccagtcccccagaagtcgaacgtgccgtcttagacgacggaatttaccgtatcttacagagaggtttattaggtaggtcacaagtgggagtgggagtatttcaggatggagtcttccatactatgtggcatgttacaaggggtgcagtgctaatgtatcaaggtaaaagattagaaccaagctgggcatcggtgaaaaaggatttaataagttatggcggcggttggaggtttcaaggctcatggaatactggcgaagaagtgcaggtaatagcggtagaaccaggcaaaaaccccaaaaatgtccaaacaaccccaggtacatttaaaaccccagagggagaagttggagcaatagctctggattttaaacctggaacatcaggctcacctattgtaaatagggaaggcaagatagtaggtttgtacggaaatggcgtagtcacaacatcaggtacctatgtttcagcaattgctcaagctaaagcctctcaagagggtcctttaccagaaatagaagatgaagtgttcaaaaagcgcaacctaacaattatggatttacatccaggatcaggtaaaactaggagatatctccctgcaatcgttcgagaggccatcaaacgaaaattacggacattgatcctggccccaacacgagttgttgcgtcggaaatggcggaggccctcaaaggtatgccaattaggtatcaaacgaccgcggtgaaatcagaacataccggtagagaaatagtagacctaatgtgtcatgctacatttactatgagattactaagcccagttagagtcccaaactacaatatgataataatggatgaagcccatttcacggatccggctagtattgctgcgagaggttatataagcacaagagtaggtatgggcgaagcagctgctatattcatgacggcgactccaccaggaagtgtagaggcttttccacagagcaacgccgtcattcaagatgaagaaagagatatcccagaaagatcctggaactctggatacgattggattaccgactttccagggaagaccgtttggttcgttccgtcgataaaaagtggtaatgacattgcgaattgtctcaggaaaaatgggaagagagtgattcaattatcaagaaaaacgttcgataccgaatatcaaaagaccaaaaacaatgattgggactacgtggtaacaacagatataagcgaaatgggggctaacttcagagcagaccgagtcattgatccaagacgatgtttaaagccagtcattcttaaagatggccccgaaagagtcatcctcgcaggacccatgcctgtaactgtagcgtcggcagcacaaaggcgaggaagaatagggcgtaatcaaaacaaggaaggcgaccaatatgtttatatgggacaaccccttaataacgacgaagaccatgcacactggactgaagcaaaaatgcttctagataatataaatacgcctgaagggattataccggcactttttgaaccagaaagggaaaaatcagctgcgatcgatggtgagtatagattgaggggagaagcaagaaaaacatttgtagaattaatgcgtcggggcgatctacccgtatggttgagttataaggtagcatctgaaggtttccaatattcagatagaagatggtgctttgatggagaacgaaacaaccaagtattagaagaaaacatggatgtcgagatatggacgaaagaaggggagcgaaagaaattacgacctaggtggctagacgcaaggacatatagcgatccccttgcactaagagaatttaaagagttcgctgctgggcggaggagcgtatcgggagatcttattttagagattggtaaactaccgcaacatttaaccttaagagcacagaatgctctggacaacttagtaatgctacataatagcgaacaaggaggtaaagcataccgacacgccatggaagaactaccagacactattgaaaccttaatgctattagcattaatagcggtcttaacagggggagttacattattcttcttaagcggcaaaggtctagggaaaacatctataggtctcctctgtgtaactgcttcaagcgcattgttatggatggcatccgtcgaacctcactggatagcagcgagtattattttagagttctttttgatggtattgttaataccggaacctgatagacaaagaacaccacaagataatcaactcgcatacgttgttataggacttcttttcatgattctaacagtcgcagctaacgaaatgggcctgttagagacaaccaagaaagacctggggatcggacatgtcgcggccgagaatcaccaacatgcaacaatgcttgatgtggatttaagacctgcgagtgcttggacactctacgcagtagctacaactgttataacccccatgatgaggcacaccatagaaaacacaacagctaacatttcacttactgcgattgccaatcaagccgcaattctaatgggtctagataaaggttggccaataagtaaaatggatattggagtacctttactcgcattgggttgttacagccaagtaaatccattaaccctgactgcagcggtattaatgttagtggcacattacgctatcataggaccaggtcttcaagcaaaagctactcgtgaggcacagaagcgcacagccgctggaattatgaaaaacccaacagtagatgggatagtggccatagatttagacccagtcgtgtacgacacgaaatttgaaaagcaactaggacaaatcatgctattaatactgtgtacatcgcagatactactaatgcgaaccacgtgggcgttgtgcgaaagtattacgctagcgacagggccactgacaactttatgggaaggatcgccgggaaaattttggaacacaacgatagcagtctctatggcgaatattttccgcggttcgtatctcgctggagcgggattggcattctcgctaatgaagtcgttaggtggagggagacgcggaacaggagctcaaggagagacactaggcgaaaaatggaagagacagttaaatcaacttagtaagtcagagttcaacatttacaaacggtcgggcatcatggaggttgacaggtcagaagcgaaagaaggtcttaagcgtggagaaactacaaaacacgcggtatcaagaggaactgccaaactcagatggtttgtagaaagaaaccttgtcaaaccggaaggtaaagtgatagatttaggctgtgggcgcggcggatggtcttattattgtgcaggactcaagaaagtcacagaagtaaagggttatacaaagggcggcccgggacacgaagaaccaataccgatggccacttacggatggaatttggtgaaattacactcaggaaaagacgtattctttatgccaccagaaaagtgcgatacattattatgcgatataggtgagtcctcaccaaatcctacaatcgaagaagggaggacgctgagggtccttaaaatggtagaaccatggctccgtggaaaccaattttgtattaaaatacttaacccatacatgccgagtgtcgtcgaaacattagaacaaatgcaacgcaaatacggaggaatgttagtaagaaaccccctatcacgtaatagcacgcacgaaatgtattgggtgtcctgtggcaccggtaatatagtgtctgctgtgaatatgactagcagaatgctcctaaataggttcactatggctcacagaaaacctacatacgagagagatgtggatctaggagctgggacacgccacgtagcggtagaacctgaagtcgctaatctagacattatcggtcaaagaatagaaaatatcaaaaatgaacacaagagtacctggcattatgacgaagataatccatataaaacttgggcgtatcatggaagttacgaagtcaagccatcagggagcgcttcaagcatggtaaatggagtcgtgcgtctcttgaccaaaccatgggatgtaattccaatggttacacaaatcgctatgacagatactacccctttcggacaacaacgagtgttcaaggaaaaagtagacacccgtacacccagggcaaagagaggtaccacccaaattatggaagttacagcaaagtggctgtggggttttcttagccgtaataagaaacctagaatctgcacgcgagaagaatttacacggaaggtacgctcaaatgccgcaattggagcggtctttgtcgatgagaatcagtggaatagcgcaaaagaagctgtagaagatgaacgattttgggacttagtccatagagaaagagaactacataaacaaggtaaatgtgctacatgtgtatacaatatgatgggtaagcgagagaagaaacttggtgaatttgggaaagcaaagggatcacgagctatctggtatatgtggctaggagctcgattcctggagttcgaggctttaggatttatgaacgaagaccactggttcagtcgcgaaaatagcttatcgggtgtagaaggagaaggtttacacaaactagggtatattttacgagatatctcaaaaataccaggaggaaatatgtatgccgatgataccgccggttgggataccagaatcacggaagatgatctgcagaacgaagcaaaaataacagatattatggaacccgaacatgccctcttggctacaagtatattcaaactaacatatcagaacaaagtagtgcgcgttcagagacctgccaaaaatggcacagtcatggatgtaatctcaagacgagatcaaaggggctcaggacaggtcggaacctatggtttaaacacatttacaaatatggaagtacaattgataaggcaaatggaaagcgagggtatcttcctaccaagcgaactagaaacaccaaacctagccggacgtgtactcgactggctagaaaaacacggagctgaacgactaaagaggatggcaatttcaggtgatgattgtgttgttaaacccattgatgaccggtttgccacagcgctgactgccctcaacgacatgggaaaggtaagaaaagacattccccaatgggaaccttcaaagggatggaatgactggcagcaagttccattttgcagtcatcactttcatcaattaattatgaaagacggtcgtgagatagtcgtaccatgccgcaatcaagacgagttagtgggcagagcacgtgtaagtcaaggagcaggatggagtctgcgagagacagcttgcttaggaaagtcgtacgcacaaatgtggcaattaatgtacttccatagacgagacttgcgtttagctgccaacgctatatgctccgcggtacccgtagattgggtgcctaccagtcgaacgacatggagtattcatgcgcatcaccagtggatgactaccgaggatatgctatctgtctggaatcgagtatggatagaagagaacccttggatggaagataaaacacatgtatcctcatgggaagaagtgccttacctcggtaagcgagaagatcaatggtgtggcagtttaatcggacttaccgcaagggctacatgggcgacaaatattcaagtagcaataaatcaagtccgaagattaatcggaaacgaaaattatctggactatatgactagcatgaagagattcaaaaatgaatcagatccggaaggtgcattatggtaa

SEQ ID NO: 21302 - RNA, 9879 nt, synthetic construct
  misc_feature 1..9879: note = derived and/or modified CDS sequence (opt6) from DENV-1__FJ810419__SS-prME
  source 1..9879: mol_type = other RNA
tctgtgactatgttgttaatgcttctacctactgctttagcattccacttaacgactagaggaggcgaaccccatatgatagtctcgaaacaagaaagaggtaaatcactactatttaaaacctctgctggagttaatatgtgcactttgatagcaatggatctaggtgaactttgcgaagatacgatgacttacaaatgcccacaaataaccgaagcagaaccagatgatgtggattgctggtgcaatgcaactgacacatgggtcacgtatgggacttgctcgcaaacaggagaacatcgccgagacaaacggagcgtagcgctagctccacatgttggcctaggactagaaactcgtacagaaacatggatgtcttcggaaggagcatggaaacaaatacagcgagttgaaacatgggcgttgagacatcctggattcactgtaatagcattatttttagcacatgcaataggcacttctataacacaaaaaggaattatttttatacttctaatgttagtaacaccctcaatggcaatgagatgtgtaggtataggaaatagagatttcgtagaaggtctttcaggagcaacttgggtagatgtggtattggaacatggaagctgcgtcactacgatggccaaaaataaacctactctggatattgaattgctaaaaacggaagtaactaatcctgcaattctacgaaaattatgtatcgaagcgaaaatatccaatacaaccaccgactccaggtgtcctacacaaggggaagcgactctagtggaagaacaagacgctaattttgtttgccgtagaacatttgttgaccgtggatggggaaatggttgtggtctttttggtaaaggctccttattaacttgcgcaaaatttaaatgtgttacaaaattagaaggcaaaatagtacagtatgaaaacctaaaatattcggtgatcgtcacggtacatacaggcgaccaacaccaagtaggtaatgagacaacggaacatggtactatcgctacaataactcctcaagccccaacaagtgaaattcaattaacagactatggcgcactaacattagactgtagcccacgcactggcttagatttcaatgaaatggttctcttaacaatgaaagagaaatcatggcttgttcataaacaatggttcctcgatttacctttaccgtggacatctggagccagtacgagtcaggaaacatggaataggcaagacctcttagttacgttcaaaactgcacatgccaagaaacaagaagtggtagtcctcggatcacaggaaggagcaatgcatactgcactaacgggggcaacagagatacagacatcgggtactacaaccattttcgctggccatctaaaatgtagattgaagatggacaaattaacacttaagggtacttcatatgtaatgtgcacgggatcattcaaactcgaaaaggaagtcgcggagacgcagcatggcacagtcttagtccaagtaaagtatgaagggacagatgccccctgcaaaattccgttttcgacacaagatgaaaaaggggtaacacagaatggacgcttgataacagccaatccgatagtaaccgataaagagaaacccgtaaatatagaaacggaacctccttttggagaaagttacatcgttgtgggcgctggagaaaaggcattaaaactttcatggtttaaaaagggttcatctataggaaagatgttcgaggccacggcaagaggcgcgagaaggatggcgatcttaggagacactgcgtgggattttggttcaattgggggagtattcacatctgtaggtaaactcgttcatcaagtattcggcacagcatatggggtgcttttctcaggcgttagttggactatgaaaattggaatcggtatacttctcacatggcttggcttaaacagtcgatcaactagcttaagcatgacatgcatcgcagtaggaatggtgacactatatctaggtgtaatggtacaggcagattcaggttgtgtaatcaattggaagggtagggaattaaaatgtggatcaggaattttcgttacgaacgaggttcatacttggacagaacaatataaatttcaagcagatagcccaaaaaggttatcagcagcaatcgggaaagcctgggaagaaggagtttgcggaatacgatcagcaacacgtttggagaacataatgtggaaacaaatctctaatgaactaaaccatatactccttgaaaatgatatgaaatttacagttgttgtgggcgacgcgaatggaatacttgctcaaggtaagaaaatgatcaggccgcaacctatggaacataagtactcatggaaaagttgggggaaagcaaagattatcggcgccgatatacaaaacacgacattcataatagatggacctgatacaccagaatgtcctgacaaccaaagagcttggaatatttgggaagtggaagattacggctttgggatatttaccaccaacatatggctaaaattaagagattcctatacccagatgtgtgaccatagattgatgtccgcagcaatcaaggactctaaagcggttcatgcggatatgggctattggatagaaagcgagaaaaacgaaacttggaaactcgcaagagccagttttattgaagtcaagacgtgtacctggccaaagtcacatactttatggagtaatggggtgttagaatcggaaatgataattcctaaaatctacgggggtcccatatctcaacacaactaccgtccgggttatttcacacaaacggcgggaccatggcatttaggtaaattagagttagacttcgacctatgtgaaggaacaacagtcgtcgtagatgaacactgtggtaataggggaccgtctttaagaactacaacggtaacaggaaaaataatccacgaatggtgttgtagatcatgtactctaccaccattaaggtttcgaggagaagatggatgctggtatggaatggaaatacgaccggttaaagagaaagaagaaaacttagttcgaagcatggttagtgcaggttcaggagaagtcgacagtttttcactggggatactatgcgcaagcataatgatagaagaagtaatgaggagtagatggtcaagaaagatgcttatgacaggaacacttgctgtatttttgctcttaattatgggtcaattaacatggaatgacttaattagactttgcataatggtaggagccaacgcctcagaccgtatgggaatgggaactacatatctagcgctcatggccacgtttaaaatgagaccaatgtttgcagttggactgctattccggaggctaacctcgcgagaggttctactcctaacgataggattatccttagttgcatctgtagaactgcccaatagcttagaagagttaggggatggcctcgcgatggggatcatgatgttaaagctactaactgaatttcaacctcaccaattgtggaccaccttactttcacttactttcatcaagacgaccttgagcttagactatgcttggaaaactacagctatggctttatccattgtatcattatttccactatgtctcagtactacgtcacaaaagacaacatggttaccagtactcttagggtcgtttgggtgtaaaccattaacgatgtttctcattaccgaaaataagatctggggaagaaagagctggccattgaacgaaggcataatggcgatagggattgtgagcatccttctaagctcattgctcaaaaatgacgtgcccttagcaggaccacttattgcagggggtatgttaatagcctgctacgtaatttccggctcatcggcagacttatcactagaaaaagcagcagaagttagttgggaacaagaggctgaacatagcggtacaagccataatatcctcgtcgaagtacaagacgatggaactatgaaaatcaaagatgaagaaagggacgacacattgaccatactgttaaaagccacactgttagcagtttcaggcgtatatcccatgagtatacctgctacgttatttgtatggtatttttggcagaagaagaaacaaagaagcggagtattgtgggatactcccagccctccagaagtagagagagctgtgcttgatgatggcatatatcgaatcttacaaagaggtctgcttggcaggtcacaagtaggggttggagtttttcaagacggagtcttccacacaatgtggcatgtcacgcgaggagcagttcttatgtatcaaggtaagcgactagaaccaagctgggcgtccgtcaagaaagatctgatttcctatggaggaggatggcgatttcaagggagttggaatacaggtgaagaagtccaagttattgcagtagaacccggcaagaatccgaaaaacgtccaaacaacacctgggacgtttaaaacaagtgaaggcgaagtaggggctatcgcattagattttaagccaggaacatccggtagtcctatagtaaatcgagaagggaagatcgtggggctatacggcaatggagttgtaacgacttcaggtacatatgtgagtgcaatagcccaggctaaagcaagccaagaaggtccgctaccggagatagaagacgaagtcttcaagaaaaggaatttaacaataatggatttgcaccctggaagtggtaaaacaaggcgataccttccggcaattgtacgagaagccataaaacggaaactgagaaccctcatattagcacctacaagggtcgtagcaagtgaaatggcagaggcgcttaaaggaatgccaatacgataccaaacgacagccgttaaatccgaacacacaggcagagagatagtagatttaatgtgccatgctacttttacaatgcgtttactctcgccggtaagggttccgaactataatatgattataatggacgaagcacattttacagacccagcttcaattgccgcgcgtggttatattagcacgagagtcggcatgggtgaagcagcagccatatttatgacggccactccacctggctcagttgaagcatttccacaaagtaatgcggtgattcaagatgaggagcgcgacatacctgaacgttcatggaactcagggtacgattggattactgacttcccaggaaaaacagtgtggttcgttccctcaattaagtcgggtaacgacattgcgaactgccttcgtaaaaatggaaaacgagtaattcagcttagtagaaaaacctttgataccgaatatcagaaaactaaaaataatgactgggactacgttgttacaaccgacatatcggagatgggagcaaacttcagagcagatagagtaattgatccaagacggtgcttaaagcctgttattctgaaagacggcccagaacgagtgatcttagcagggccaatgcctgtaacagtagcaagcgcggcacagcgtcgaggaaggattggaagaaatcaaaacaaagaaggagatcagtatgtgtatatgggtcagcctttaaacaacgatgaggaccacgcgcattggactgaagccaaaatgttattagataatataaacacgccggagggtattattcccgctcttttcgaaccagaaagagagaaaagcgcagcaattgatggagagtatcgactaaggggagaggcaaggaaaaccttcgttgaattaatgaggagaggtgacctccctgtgtggttatcatataaagtcgcttctgaaggctttcaatattcggatagacgatggtgttttgacggtgaacgaaataaccaggtgttagaggagaatatggatgtcgagatatggacgaaagaaggtgaaagaaagaaactaagacccagatggctagacgcgcgcacatattcggatcccctagcacttagggaatttaaagaatttgccgcagggagacggtccgtgtcgggtgacttaatacttgaaataggaaaattaccccaacacttgaccttacgtgcgcagaacgcattagacaatctagtcatgttgcataactcagaacaaggtgggaaggcttatcgccacgcaatggaagaattacccgatacgatcgagaccctaatgttactagcgttaattgctgtactaaccggaggagtcacactcttcttcctaagcgggaaggggttaggaaaaacatcaattggtttattatgcgttaccgctagttcggcacttctttggatggcttctgtggaaccacattggattgcggcttcaataattctagagttcttcctgatggtcttattaattcctgaacctgataggcaaaggacaccacaggataatcaattggcatacgtagtaattggtcttctgtttatgatactgactgtagcagctaacgagatgggcctactcgagaccaccaagaaagatttagggattgggcatgtggccgcagaaaatcatcaacatgcaactatgttagatgttgatttacgccccgcctctgcatggacgttatacgcggtagcgaccacggtaataactccaatgatgaggcatactattgaaaatacgacagcaaacatctcccttaccgccattgctaatcaagctgcaatattgatgggtctagataagggatggcctatatctaagatggacataggtgttccacttctggctttgggctgttactcccaagtaaatcctctaacattgacggcggcagttctcatgttagtcgcccattacgcgatcatcggacctggtcttcaagctaaagctacacgtgaagcacaaaagagaacagctgcaggaataatgaaaaatcctactgtagatggcatcgtagctatagatttagatccagtggtttatgatgctaagtttgaaaaacagttaggacagattatgctattgattctctgcacttcccagatcttgctaatgcgaacaacctgggccctctgtgaaagcataactttggctactggtccgttaacaacactctgggagggttcaccgggaaaattttggaatacaacaatagctgtctcaatggctaatatattcaggggatcctacctagcgggagcaggattagcgtttagtttaatgaaatcgctagggggcggccgtaggggtaccggagcccaaggggaaaccctgggagaaaaatggaagaggcaattgaatcaactgtcaaaaagtgagttcaatacttataaacgaagcggcattatggaggtagataggtccgaagctaaagagggattaaaaagaggagagacgacaaagcacgccgtttctaggggtacagccaaattgagatggtttgtggaacggaacctagttaaaccggaaggtaaagttatagatttaggatgcggacgtggcggctggagttattattgtgcaggactaaagaaagtcactgaggttaaaggatacacaaaaggaggccccggacacgaagaacctattcccatggccacatacggttggaatctcgtgaagttatattccggaaaagacgtatttttcatgccgcccgagaaatgtgatacattactctgcgatataggagagagctcacccaatcctactattgaagaaggtagaactttacgagtcttaaaaatggtagaaccgtggcttagaggtaaccaattttgtattaaaattcttaacccctatatgccatcagttgtcgaaacattagagcaaatgcagagaaagcatggaggaatgctagttcgaaacccgctaagcagaaattctacacatgaaatgtactgggtttcatgcggtacaggtaatatcgtaagtgccgtaaatatgacatcaagaatgttgctgaatcgatttaccatggcccataggaaacccacgtatgaacgagacgttgatctaggtgcaggaacaagacacgtcgccgtagaaccagaggtcgctaacttggatataataggacaacgaattgaaaacattaaaaacgaacacaaatcaacttggcattatgatgaagataacccctataaaacctgggcttatcatggatcttacgaagtaaaaccttctggaagtgcctcatcaatggtaaatggtgtagtaagactattgacgaaaccatgggatgtcataccaatggtaacccaaatcgcgatgactgatacaacaccctttggacaacaacgtgtatttaaggaaaaagttgacaccaggacaccaagggctaagcgtggaacgacccaaataatggaagtaacagcgaaatggctttgggggtttttatcgcgaaacaagaaacccagaatatgtacaagagaggagttcacaagaaaagtaaggtctaatgcagccattggagcggtatttgtcgatgaaaaccagtggaactctgctaaagaagctgttgaagacgaacgtttctgggatttggttcacagggaacgagaactacacaaacaaggcaaatgcgcaacctgcgtatataatatgatgggcaaacgagagaagaaactaggagagttcggaaaagcaaaaggtagccgcgcgatatggtacatgtggcttggcgcaaggtttctagaatttgaagcattggggtttatgaatgaagatcactggttctctagagaaaatagtttatcaggagtcgagggagaaggccttcataaattaggatatattctccgggacatctctaaaattcccggcggtaatatgtatgcagacgataccgccggttgggatactagaattacggaggacgatctgcaaaatgaagcaaaaatcactgatataatggaacccgaacatgccctattagcgacctcaattttcaagttgacataccaaaataaggtagtaagggttcaaagaccagccaaaaatgggacagtgatggacgtaatatctaggcgcgaccagagaggttcgggtcaagtgggtacatatggactaaacacttttacaaacatggaggttcaattaattagacaaatggaatcagaggggatatttctaccatcagaactcgaaactcccaatttagcagaacgtgttttagattggctagagaaacacggagcagaacggcttaaaagaatggccattagcggagatgattgtgttgtcaaacctatcgacgatcgattcgctacggctttaacggctttaaacgatatgggaaaagtgcgaaaagatataccccagtgggaacctagtaaggggtggaacgactggcaacaagtcccattttgcagtcatcacttccatcaactaattatgaaagatggaagagaaatagtagttccgtgtaggaatcaagacgaactggtggggcgcgcccgggtttcgcaaggtgcgggctggtcattacgcgaaactgcatgcttaggaaaatcgtatgcacaaatgtggcaactaatgtacttccatcgaagagatctacgattagcagcgaatgccatatgttccgcagtccccgtagattgggttcccacttctagaactacttggagtatacacgcacatcaccagtggatgactacagaggacatgttgtctgtgtggaacagagtatggattgaagagaacccctggatggaggataaaacacacgtatcttcatgggaagaggtaccttatttaggaaaaagggaagatcaatggtgcggtagcttaattggactaactgcaagagcaacatgggctactaatatacaagtcgcaataaaccaagttagaagactgataggtaatgaaaattacttggattatatgacaagcatgaagagatttaagaacgagtcggaccccgagggtgcactgtggtaa

SEQ ID NO: 21303 - RNA, 9879 nt, synthetic construct
  misc_feature 1..9879: note = derived and/or modified CDS sequence (opt6) from DENV-1__FJ547068__SS-prME
  source 1..9879: mol_type = other RNA
agcgtaaccatgttattaatgctcctgcctactgcattggcatttcatttaactaccagaggaggtgaacctcatatgattgtttcaaaacaagaaagaggaaaaagtcttctatttaaaacgtccgcgggagtaaatatgtgtacgttgatagctatggatctaggggaattgtgtgaggatacaatgacatacaaatgcccccaaattactgaggcagaaccggatgacgtagactgttggtgtaacgctactgatacatgggtaacatatgggacctgcagtcagacaggagagcatcgtagagacaaacgttctgttgcgttagcaccccatgtcggtctcggacttgaaacgcgaactgagacatggatgagttcagaaggagcatggaaacaaatacaaagagtagaaacatgggcactcaggcatcctggtttcacagtaatagcactgtttcttgcgcacgcaatagggacatcaattacccagaaaggaataatttttatattgctaatgttagtgacaccctccatggctatgagatgtgtcgggataggaaacagagacttcgttgaaggacttagcggagcaacatgggttgacgttgtattggaacatggaagttgtgtaacaacaatggccaaaaataaaccaacattagatatagaactcctaaaaaccgaagttacgaatccggcaatactacgaaaattgtgcatagaagcaaaaatttctaacacaacaacagattctagatgtccaacacagggtgaagccactctcgtcgaagaacaagacgcgaatttcgtttgcaggagaacattcgtagacagaggatggggcaacggttgtgggttatttggcaaaggatctctactaacatgtgctaaattcaaatgcgtcactaaattagaaggcaaaatagtccaatatgagaatctcaaatatagtgtaatagttacagttcatactggcgatcaacaccaggttggtaacgaaactacggagcacggtacaatagcaacaataacaccccaagctccaacctcagagatacaacttacagactacggagcacttactttggactgctcccccagaactggactagacttcaatgagatggtactactaaccatgaaagaaaaatcctggctggttcacaaacaatggttccttgatcttccgctcccttggacctcaggggctagtacaagccaggagacatggaataggcaagacttattggtcacattcaaaacagcccatgctaagaaacaggaagtcgtggtgctgggctcgcaagaaggcgcaatgcacactgctctgacaggagcaacagaaatccagacatcaggaaccaccacaatctttgctggacacctaaaatgtagattaaaaatggataaattaaccttgaaagggacgtcatacgtgatgtgtacaggttctttcaaactggaaaaagaagtggcggagactcagcacggtacagttctagttcaagttaaatacgaaggtacagatgctccatgtaaaatacccttttcaactcaagacgaaaagggagtaacgcaaaacgggagattaataacagccaatccaattgtaacagacaaggaaaagcctgtcaatatcgagactgaaccaccattcggtgagtcatatatagttgttggggccggagagaaagcgttgaaactgtcatggttcaagaaaggcagttccatcggaaagatgtttgaagctacagcacgcggtgcacggcgaatggcaattttgggagatacagcttgggatttcggaagtataggtggcgtgtttacaagtgttggcaaattagtccatcaggtgtttggaacagcctatggcgtgctctttagtggtgtgtcatggactatgaaaattggaataggcatcctacttacatggctaggattaaactcaagaagtacaagtctaagtatgacatgtattgcggtcggaatggtaactctatatctcggcgtaatggtacaagctgatagcggatgtgtaattaattggaaaggtcgagaactcaaatgtggaagcggcatttttgtgacaaatgaagtgcatacctggaccgagcaatataaatttcaagcggatagtcctaaaagactaagtgccgcaatcggtaaggcgtgggaggagggggtatgcgggataagatcagctactagactggaaaatattatgtggaaacagatttctaacgaactaaatcacatactattggaaaacgatatgaaattcactgtagtagtgggtgatgcgaacggaatattagcacaagggaaaaagatgattagaccgcaaccgatggaacacaagtactcatggaaatcttggggtaaagcaaaaattatcggagcagacatacaaaacactactttcattatcgacggtcctgatactcccgagtgtcccgacaatcaaagagcgtggaacatatgggaagtggaagattacggtttcgggatattcacaactaatatatggctaaaattacgggacagctacacacaaatgtgcgatcatcggctaatgtcagcagccataaaagatagtaaggcagttcatgcggatatgggttattggattgagagcgagaaaaatgaaacctggaaacttgctcgcgccagttttattgaagtcaagacctgtacttggccgaaaagtcatacgctatggagtaacggcgttttagaaagcgaaatgataatacccaaaatctatggtggtccaatatctcaacataactacagacctggatactttacacagactgccggcccctggcatttaggcaaattggaactagatttcgatctgtgtgaaggcactactgtagtagttgatgaacactgcggaaatagaggtccctcactgcgtactacaactgttacaggtaaaatcatacatgaatggtgttgccgtagctgtacactgccaccgctacgttttagaggcgaagatggttgctggtatggaatggaaattagaccggttaaagaaaaggaagaaaatcttgttagatccatggtctccgccggatccggtgaagtagactcattctccttaggaatattatgtgcttccatcatgatagaagaagtcatgaggagtaggtggagccgaaaaatgcttatgacagggactttagcagttttcctcttactaataatgggacaactaacatggaacgatcttatacggttatgtataatggtcggtgcaaacgcttccgatcgaatgggcatgggaacaacttaccttgctttaatggctacatttaagatgcgaccaatgtttgcagttggactacttttcagacgcctgaccagcagagaggttctgctgctaaccatagggctatctttagctgcttctgttgagctaccaaattcactagaagaattgggagatggtcttgcaatgggaataatgatgttaaaattactaactgaatttcaacctcatcagttatggaccactctactttcactaaccttcataaaaacaacactatccctagattatgcatggaaaacaacagcaatggccttaagtatagtatcactattcccgctgtgcctgagtactacgtcacagaaaacaacatggctacctgtactattggggtcattcggctgtaagccgctcacaatgtttctaattactgaaaacaaaatatggggcaggaagtcgtggccgctaaatgaaggtatcatggctataggaatagtatcaatcttattaagctcattgctgaaaaatgatgtaccactggccggaccattaatagcgggtggaatgctgattgcgtgctatgtcatatctgggtcttcggctgatttaagtttagaaaaggctgcagaagtatcatgggaacaggaggcagaacactcaggtacatcgcataatatacttgtagaagtccaagatgatggaacaatgaaaataaaagatgaagaacgcgacgatactctgacaatcctactcaaagccacattgctcgctgtaagcggagtatatccgatgagtataccagcaaccctgtttgtttggtatttttggcagaagaagaaacaacggtcaggagtattatgggacacccccagccctcctgaagtagagagagcagtactagacgatggtatttatcgtatcttacaacgcggcttattgggaaggagccaggtgggagttggtgtatttcaggacggagtattccatacgatgtggcacgtaacgagaggtgcagtacttatgtaccaaggtaagcgcctcgaaccttcatgggcatcagtcaagaaagatttaattagttatggaggcggatggagattccagggatcgtggaatacgggggaggaagtacaggttatagcagttgagcccggcaaaaatccgaagaacgtacaaacgaccccagggacatttaaaacaccagaaggcgaagtaggtgcaatagcgttagatttcaaacccgggaccagtggatcccctatagtaaatagagaagggaaaatagtgggactttacggtaatggagtagttactacttctggtacctacgtcagcgctattgcgcaggccaaagcatcacaagaaggaccgcttccagaaattgaagatgaggtgtttaagaaacgtaaccttactattatggacctccatcccggatctggtaaaacgaggcgatatcttccggcgatagttagagaggcgataaagagaaaacttaggacactaatactagcacctactcgagtagtggcatccgagatggcagaggcactaaagggaatgccaattaggtatcaaactaccgcagtaaagtccgaacatactggtcgggaaattgttgatctaatgtgccatgctacattcacgatgagattgttgtcaccggtgagagtaccaaattacaatatgattataatggatgaagcacactttacggaccctgctagtatagctgctcgaggttacatatctacgagggtaggtatgggcgaagcagctgcgattttcatgaccgcgacgccaccaggatctgttgaagcattcccccaaagcaacgctgtcattcaagatgaagaaagagacatcccagaacgtagttggaactccggctatgactggataactgatttccccgggaaaacagtttggtttgtaccaagtataaagagcgggaatgatatagcgaattgcctgaggaaaaacggaaagagagtcatccaactaagtagaaagacatttgataccgagtatcagaaaaccaaaaataatgattgggactatgttgtaaccacggacatttcagaaatgggcgccaattttagagcagatagagtcatcgaccctaggagatgcctcaaacccgtaattcttaaagatggacccgaaagagtcatcttagcggggccgatgcccgtaactgtagcatcggcagctcaacgtcgagggagaataggaaggaatcagaataaagaaggtgaccagtatgtatatatgggccaacccctgaataatgatgaggatcacgcacactggaccgaagcaaagatgcttctcgacaatataaatacccccgaaggaattataccggcactatttgaacctgagcgagaaaagagcgcagcgattgacggagagtataggttaagaggtgaagcacgcaaaacattcgtagaactaatgcggcgcggagacttgccagtttggctgtcatacaaagttgcatcagaaggatttcaatatagtgacagacgctggtgttttgatggagaaagaaacaaccaggtactcgaagaaaacatggatgtagaaatatggacgaaagagggagagagaaagaaattacggcctaggtggcttgacgctaggacctacagcgatccactagccctcagagagttcaaggaatttgcagcaggacggaggagtgttagcggcgatttaatattagaaattgggaagttgccgcaacatctaaccctacgggcgcagaacgcattggataatttggttatgctgcataattcagaacaagggggcaaggcttacaggcatgctatggaggaactacccgacacaatagaaacattaatgctactagcattaatcgcggttttgacaggtggagttacattattctttctgtcagggaaagggttaggaaaaacatcaataggattgttgtgcgttacagcgagctcagccctcttatggatggcttctgtagaaccccactggatagcagcatcgataattctcgaatttttcttaatggtcctattaattccggaaccggacagacaaagaactccacaagataaccagcttgcatacgtggtcataggattactattcatgatccttactgtcgcagcaaacgagatggggcttctagaaacaacaaagaaagatttaggtatcggacatgtggcagctgagaatcatcagcatgccacaatgctcgatgtagatcttcggccagcttctgcttggaccctttatgccgtggcaacaacagtcatcacgccaatgatgcggcacacaatcgagaatacaacggctaacatctcacttacagcaattgctaatcaagctgccatcttaatgggcttagacaaaggatggcccatatcaaaaatggatataggagtgccattacttgctcttggctgttatagtcaagtaaatcctcttacattaaccgccgcagtcttaatgctggtcgcacattatgcaataataggacccggcctacaagcaaaagcaacacgagaggctcaaaaacggacagccgctggaataatgaagaatcccactgttgacggtattgtagcgatagatctagatcccgttgtctacgacgcaaagttcgaaaaacaattagggcagataatgttattgatcctatgcacgtcacaaatcctactgatgcgaacaacatgggcactatgtgagtcaataacactagccaccggtcctctgacgactctatgggaagggtcccctggtaaattctggaacacaacaatcgcagtatcaatggccaatatctttagaggcagctacttagccggtgcgggcctagcctttagtcttatgaaatcgttaggaggtgggcgcagggggacaggagcacaaggagaaactctaggagagaagtggaagagacaattaaatcaattaagcaagtcagaatttaacacatataaacgatcaggtattatggaagtagataggtcagaagctaaagaaggattgaaaaggggtgaaacgactaaacatgcagttagtcggggaaccgcgaagctcagatggttcgtagaaagaaatcttgttaagcctgaaggaaaagttattgatctaggttgcggacgtggaggttggagttattattgtgcaggattaaagaaagttactgaagttaaaggatacactaaaggaggtccaggtcatgaggaacccataccgatggcgacctatggctggaatcttgtcaagctacactctggtaaagacgttttcttcatgccgcccgagaagtgcgatactttattatgtgatataggcgagtcttccccaaatccaactatcgaggaaggcagaacactcagagtactgaagatggtagagccgtggctcagaggtaatcaattctgtattaaaatcctaaatccctatatgccatcggttgtggagacactagaacagatgcaaagaaagcacggcggaatgctagtaagaaaccctctaagcagaaattcaacccacgaaatgtattgggttagttgtggaacggggaatatagtttcagcagtcaatatgacgtcacgtatgctactcaatagatttacaatggcacatagaaagccgacctacgagcgcgatgtggatttaggagcgggaaccaggcacgtcgctgtcgaaccagaagtagccaatcttgatatcattgggcaacgaatagagaacatcaaaaacgaacacaaaagtacatggcactacgacgaagataatccttataagacttgggcatatcacggtagttatgaagttaaaccaagtggctcagcaagtagcatggtaaacggggtagtaaggcttttaacaaagccatgggacgttataccgatggtgacacaaatagctatgacggataccaccccgttcggacaacaaagagtattcaaagaaaaggttgatactaggactcctagagcgaaacgaggcaccacgcaaataatggaagttactgcaaaatggctttggggcttcctatcaagaaataagaaaccccgtatatgtactcgggaagagttcactagaaaggtaaggtctaacgctgctattggggcagtcttcgtagacgaaaatcagtggaatagcgcaaaagaagccgtagaagatgagagattttgggacctggttcatcgggaaagggaattgcataagcaaggtaaatgtgccacctgtgtatacaacatgatgggtaaaagagaaaagaaattaggtgagtttggaaaagctaaaggaagcagagccatatggtacatgtggttgggagcaaggttcttagagttcgaggcgttaggattcatgaatgaagatcactggtttagcagggaaaattcgctttctggtgtagaaggtgaaggattacataaactaggttatatactaagggatatctctaagatcccgggtggcaatatgtacgcagacgacactgctggttgggacacacgaattaccgaggatgatctccaaaacgaagcaaaaataaccgacataatggagccagagcacgccttattggctacatcgatctttaaacttacctatcaaaataaagtagtacgagtacaaaggccagccaaaaacggaacagtcatggacgtaatatccagaagagaccaacgaggctctggccaagtcggcacgtatggtttaaacacctttacaaacatggaggtccaactgataaggcaaatggaaagcgaaggaatattcttaccaagtgaacttgagactcctaacctcgcagaaagagttcttgattggttagaaaagcatggtgccgaacgattaaaaagaatggccatatcaggagatgattgtgtcgtcaagccaattgatgaccggtttgctacagcacttacagcactaaatgatatggggaaagtccgaaaagacataccccagtgggaacctagtaagggttggaatgattggcaacaggttccattctgctctcatcattttcaccaattaataatgaaagacggacgggaaatagtagttccatgtaggaatcaagacgagctagtaggtcgggccagagtttcccagggggctggatggtctctgagagaaactgcctgcctcggaaaatcatacgcacaaatgtggcagctcatgtatttccatagacgtgacttgaggttagctgccaacgccatatgttcagcggtgccagtagactgggtgccgacttcgcggacgacatggtctattcacgcccaccatcaatggatgacaactgaagacatgttaagcgtttggaaccgagtctggatagaagaaaatccatggatggaggacaaaacacatgtttccagttgggaagaggtaccgtatctaggaaagcgagaagaccagtggtgtgggtcattaataggattaactgcgagagctacctgggcaacaaatatacaggtagcaataaatcaagtaagacgactaattggaaacgagaattatcttgactacatgacatctatgaagcgttttaaaaatgaatctgaccccgaaggcgctctatggtga

SEQ ID NO: 21304 - RNA, 9879 nt, synthetic construct
  misc_feature 1..9879: note = derived and/or modified CDS sequence (opt6) from DENV-1__FJ562104__SS-prME
  source 1..9879: mol_type = other RNA
tcggtaactatgctgctaatgctgttacctaccgctctagcattccatttgacaacgagaggtggcgaaccccatatgatcgttagcaaacaggaacgcgggaaaagtctattatttaaaacatcagccggtgttaatatgtgcacactcatagcaatggatttaggcgaactttgtgaagatacgatgacctacaaatgcccacaaattactgaagcagaaccagatgacgtagattgttggtgtaatgcaactgatacatgggtaacatatgggacgtgctctcaaacaggtgaacaccgtcgggataaacgaagcgttgctctcgcacctcatgtgggtttggggcttgaaactagaacggaaacgtggatgagttcggaaggcgcatggaaacaaattcaaagagtagaaacctgggcattgagacacccgggtttcaccgtaatagcactgttcctagcgcatgcgataggaacatctattactcaaaaagggataatatttattctcctcatgctagtgaccccaagtatggctatgagatgtgtaggaataggcaatcgagactttgttgaaggattatcaggagcgacatgggttgatgttgtattggagcatgggagctgcgttacaactatggctaaaaataaaccaactctggacattgaattactcaaaacagaagtgaccaatccggcaatattgcgtaaattatgcatagaggcaaaaatttccaacaccacaactgactcaagatgcccaactcaaggtgaagcaacactcgttgaagaacaagatgcaaatttcgtatgtaggcgaacttttgttgaccgtggatggggtaatgggtgcggattgttcgggaaaggcagtttactcacttgcgctaaattcaaatgtgttacaaaacttgaaggtaaaatagtacaatatgaaaacctaaaatatagcgttattgtaacggttcataccggagatcagcaccaagtcgggaacgaaacaactgaacatggcaccatagcaactatcacacctcaagcacctacctctgaaattcaactaaccgattatggagcactaacactagactgctcacccagaacaggtttggactttaatgagatggttctgctaacaatgaaagaaaagagctggctagtacataaacaatggttcctagatttacccttaccttggacatccggtgcatctaccagccaggaaacgtggaaccgacaagacctactggtgacgttcaagacagcccacgcgaagaaacaggaagtagtcgtgctcggctcccaagaaggagccatgcacacagccctaacaggggccaccgaaatccagacatcagggacaacgacaattttcgcaggtcacttgaaatgtaggttaaagatggacaaattaacattaaaaggaacgagctacgtaatgtgcacagggagcttcaaacttgaaaaagaagtagctgaaacgcaacacgggacagtgttggttcaagttaaatatgaagggacggatgcaccttgtaaaatacccttctccacccaagacgagaaaggggtgacccagaatggccgactaatcacggcaaatccaattgtaactgataaagaaaagcctgtaaatattgaaacagaaccaccatttggagagtcatacattgttgtaggcgctggagaaaaagcattgaaacttagttggtttaagaaaggctcctcgataggaaaaatgttcgaagctacagcaagaggagcaagaagaatggcgatcctcggtgacacggcttgggatttcgggtcaataggtggcgtgtttacatctgtaggaaagttagttcaccaggtgtttggtacagcatatggggttttattttctggcgttagttggacaatgaagattggaataggtattttattgacatggttaggacttaacagtcgttccacatcactcagcatgacttgtattgccgtaggaatggtaactctctatttaggagtaatggtacaggcggactcaggatgtgttataaattggaaagggagagaactgaaatgcggcagcggaatttttgtaacgaatgaagtccatacgtggactgaacaatataaattccaagcagattcgcccaagcgactaagtgcagctattggtaaggcttgggaagagggcgtgtgcggcatacggtctgctacgagactggaaaatatcatgtggaaacaaatatcgaatgaactaaaccacatactcttggagaatgatatgaagttcacagtggttgtaggtgatgcaaatggaatattagcacaaggcaagaaaatgatccgaccccaacctatggaacacaaatattcctggaagagttggggcaaagcaaaaattataggggcagatatccaaaacacaactttcatcattgacgggccagatacgcctgagtgtccagataatcaacgcgcatggaacatatgggaagtagaggattatggatttggaatattcacaacaaatatatggcttaaacttagggatagttatacacaaatgtgcgaccataggctaatgagtgcagcaattaaagactccaaagcagtgcatgccgatatgggatattggattgagagcgaaaagaatgaaacttggaagctagcacgcgccagctttattgaggtcaagacttgcacatggccaaaaagtcacaccctctggtcaaacggagtgttagaatcagagatgataattccaaagatttacggaggacccattagtcaacacaactaccgcccaggatactttactcaaacagcaggaccatggcacttagggaaattagagttagactttgatctatgcgaagggaccaccgtcgtagtggatgaacactgcggtaatagaggtccaagcctcaggacgactactgtcacgggaaaaatcattcacgaatggtgttgccgaagctgtactttaccgccgttgcgattccgcggagaggatggttgttggtatgggatggaaatacgccctgtgaaagaaaaggaggaaaatttagttcgatcaatggtatcagcgggctcaggtgaagtcgatagcttttcattagggatcttatgcgcttcaatcatgatagaagaagtaatgaggtcacgctggtcaagaaagatgctaatgacaggcacattagcagtattcttactactgattatgggacaactaacgtggaatgatttaataagactttgtatcatggttggagcaaacgcttcagatcgaatgggcatgggtacgacatatctggctctaatggctacttttaaaatgaggcccatgtttgctgttggacttttatttagaagacttacatccagggaagttctgctcttaacaattggactaagtttagtggcgtcagttgaactacctaatagtttagaagaactcggagatggtctagcaatggggattatgatgctgaaactactaacagaatttcaaccacatcaattatggactacccttctatctttaactttcataaagacaacactatcactagactatgcatggaaaaccactgcaatggcccttagcatagtaagtctatttcctctatgtttgtcaaccaccagccagaaaactacctggcttcctgtattattaggctcgtttggatgtaagccactaacaatgtttttaataacagaaaacaaaatatggggtcgaaagagttggccactgaatgaaggaattatggctattggtatagttagtatactcctatcatccctgctaaagaacgatgttccactggcaggacctttaatcgcgggcggaatgctaatagcatgctacgttatcagtggctcaagcgcagacctaagcctcgagaaagcggcagaagtaagctgggaacaagaggccgaacactcaggaacatcacataatatacttgtagaagtccaagacgatggaacaatgaaaattaaagatgaggaaagagacgatacccttacgatattattaaaagcaacacttcttgctgtgagcggcgtatacccaatgtccatcccagcaacgctattcgtttggtatttctggcagaagaagaaacagcgttcaggagtactttgggatactccatcaccacccgaggtagaaagagcagtattagatgatggaatttacaggattttacaacgaggacttctaggaagatcccaagtaggggtgggtgtatttcaagatggagtatttcatacaatgtggcacgttacacgtggagctgtacttatgtaccaagggaaacgtctcgagccttcgtgggcaagcgtcaagaaagatctaataagctacggaggaggatggagattccaggggtcatggaataccggggaggaggttcaagtaattgcagttgaacccggtaaaaaccccaaaaatgtgcaaactacaccaggaacgttcaaaactcccgaaggcgaggtaggtgcaattgcgcttgatttcaaaccaggaacttccgggagtccaatcgtaaacagagaagggaaaattgtcggattgtacggaaatggggttgttactacaagtggtacatatgtcagtgcgatcgcgcaggcgaaagcaagccaagaagggccattgcctgaaatagaggatgaagtattcaagaaaagaaacttaacgattatggatcttcatccaggttctggtaaaacgcgaagatacctccccgccatagtaagggaggcgataaagaggaaactgagaaccctgatcttagctccaacacgtgtcgtagcgtcagaaatggcagaagctctcaaggggatgccaattcgatatcaaactacggctgtgaaatccgaacacacaggtcgtgaaatcgtagatcttatgtgtcacgcaacatttactatgagactcttaagtcctgttagggttcccaactacaacatgatcatcatggatgaagcacactttacagacccagcttcaattgcagcacgtggttacatatcaactcgggtgggaatgggtgaagcggccgcgatctttatgacagcaacgccacccgggtcggtggaagccttcccccaatcaaacgcggttatccaggatgaagaacgcgacataccagaacgatcatggaactcaggatacgactggattaccgactttcccgggaaaaccgtctggtttgttccttctataaaaagtggcaatgacatagccaattgtcttaggaaaaatggcaaaagggtgatacaactatctcgcaaaacctttgatacagaatatcagaaaactaaaaataacgactgggattatgtagtaactacggatattagtgaaatgggggctaactttagagcagatcgcgtcattgacccacgaagatgtttgaaaccggtaatactaaaggacggccccgaaagagtaatattagcaggacccatgccagtcacagtggcaagcgccgcacaaagaaggggcagaattggaagaaatcaaaacaaagaaggagaccaatacgtttacatgggacaacctttaaataatgacgaggatcatgctcattggacagaagcgaaaatgctactcgacaatataaatacaccagaagggatcataccagcgttatttgaacctgaaagggaaaaatcagcagcgatagatggagagtatcgtttaaggggagaagctcgcaaaacatttgtagaactcatgcgaagaggagatttaccagtctggttatcatataaagttgcttctgaaggcttccagtatagtgaccgcagatggtgttttgatggagaacgtaataaccaggttcttgaggaaaatatggatgtagaaatatggacaaaagaaggtgagaggaagaaactgcgaccacgatggttagacgctagaacttacagcgatccactagcattgcgagagttcaaagagttcgctgctggacgacgaagcgtgagcggggacctgatactggaaatagggaagttacctcaacacttaactctccgtgctcaaaacgctctcgataatttagtaatgctacacaacagtgaacaaggcggtaaagcgtatcgtcatgctatggaagaattaccagacactattgaaacgttaatgctattggcgctaattgcagtcttgacaggtggagttaccctcttcttcctatcaggaaagggtctcggtaaaacgagtatcggcctattatgcgtgaccgcatctagtgcactcctgtggatggcatcagtggagccacattggatcgcagcgtccattatattagagttctttttaatggtgttgctaatacctgagcctgatcgccaaagaactccacaagataaccaactagcctatgtagtaatcggattactgtttatgatactgacagtagcagcaaacgaaatggggttgcttgagacaacaaagaaagatttagggatcggccatgtagcagctgaaaatcatcagcatgcaactatgctcgacgttgacttaagaccagcctcagcgtggaccttatacgcagtagcaactacagttataactccgatgatgagacatacgattgaaaatactactgccaatataagtttaactgcaatcgccaatcaagcggcaatcctaatgggcctcgataaaggttggccaataagcaaaatggatataggagtaccattattagcgttagggtgttattctcaagtaaatcctctaaccttaactgcagctgtactcatgttagtcgcccattacgcaataatcggtccaggactccaagcaaaagcaacgcgagaagcccagaaaagaactgcagcgggaataatgaaaaatcctacagttgacgggatagtagccatcgatcttgaccctgtagtttatgatacaaaatttgaaaaacagcttgggcaaattatgctattgattctgtgtacgagtcaaatccttctcatgcgtacaacttgggcactatgtgaaagtattacgttagccacaggacccttaacaacgctatgggaaggttcaccaggaaaattttggaacactacaattgcggtaagtatggcgaacatattccgggggtcatatttggcaggggcaggtttggctttttcactaatgaaatctttaggagggggacgacgaggcactggagcgcagggagaaacattaggcgagaaatggaaaaggcaacttaaccaattatcgaaaagtgaatttaacatatacaaaagaagtggaattatggaagttgatcgaagcgaggctaaggaaggactgaaacgaggagaaactacaaagcacgctgtcagtcgaggaacagccaaattgagatggtttgtggagcgaaatttagtcaagccggaaggtaaagtcatcgacttagggtgtgggagaggtggatggagttattattgtgccgggcttaaaaaggtaaccgaggtaaaagggtataccaaaggagggccgggacacgaagaaccgattcctatggccacgtacggttggaacttagtcaaacttcactctggtaaagatgtgttctttatgccgcctgaaaaatgtgacacgctcctgtgtgacattggtgaatcgtcaccaaacccaactatcgaagaaggcagaacgctacgagtattgaaaatggtagaaccttggctcagaggaaatcagttttgtattaaaatattaaatccttatatgccatctgtggtagagactttagaacaaatgcagagaaaatatggaggtatgttagtcagaaatccactaagtagaaattctacacatgaaatgtattgggttagttgcgggacaggaaatatagtttcagcggttaacatgacctctcgaatgttactgaatcgttttaccatggcacatagaaaacctacctatgaaagagacgttgacctcggggcaggaacaagacatgtagcagtcgaaccagaggtagccaatttagacattattggccagagaatagagaatataaagaatgaacataaatcgacttggcactatgacgaagacaacccatataagacatgggcctatcatggttcatatgaagtcaagccatcaggcagtgcgagttcgatggtgaacggcgtcgttcgattacttacgaaaccgtgggacgtaataccaatggtaactcaaatagcaatgacagatacgacgcccttcggtcagcagcgagtatttaaagaaaaagtagacacacgaacgcccagggctaaaagaggaactacacagatcatggaagtcacagctaagtggttatggggatttctatctcgaaacaagaaaccacgtatatgcacacgagaagaatttacacgtaaggtcagaagcaatgccgctatcggtgcagtatttgtagacgaaaatcaatggaactccgctaaagaggccgtggaagatgagcgcttttgggacttagtacacagagaacgagaattacacaaacaaggaaaatgtgccacgtgtgtatacaatatgatggggaaaagggagaagaaacttggtgagttcggtaaggcaaagggctccagagcgatatggtacatgtggctaggagcaagatttttggagtttgaagccctaggattcatgaacgaagatcactggttctctcgtgaaaattcactctctggtgttgagggagagggactccataaactaggctacattttgcgtgatataagtaaaataccaggaggaaatatgtacgcggacgacacagcagggtgggacacaaggattacagaagacgacctacaaaatgaagctaaaataacagatataatggagcccgaacatgccttattagcaacttccatttttaaattaacataccagaataaagtggtgagagtacaaagaccggccaaaaatggtacggtgatggacgtaatatctagaagagaccaacgtggatctggccaagtaggcacatacggactaaacacgttcacgaatatggaagtgcagcttattcgacaaatggaaagtgaaggaatatttttaccaagtgaacttgaaactccgaatcttgcggaaagagtgttagattggttagaaaaacacggtgctgagcgattaaaaagaatggcgatcagtggggacgattgcgttgtaaaacctatagacgataggttcgcaactgcactgactgcactaaatgacatgggcaaagttcgaaaggatataccccaatgggaaccgtccaagggctggaatgactggcaacaggtccccttttgtagccatcactttcatcagctgatcatgaaagatggtcgggaaatagttgtcccatgtcgtaatcaagacgaattagtgggtcgcgcaagagtatctcagggggcaggatggtctctaagggaaacggcatgcttgggaaagtcgtacgcacagatgtggcaattaatgtattttcacagacgtgatttgagattagcagcaaacgcaatttgttcggcagtaccagttgactgggtgcctactagcaggacgacttggtctatacatgcccatcatcagtggatgactacagaggatatgctctcagtctggaaccgtgtatggatagaggaaaacccatggatggaagataagacacacgtatcctcttgggaagaggtgccatacctaggtaagagggaggatcaatggtgtggctctcttataggtcttaccgcaagggcgacctgggctacgaatattcaagtagcaataaatcaagttcggaggctaataggcaacgagaactacttagactacatgacaagtatgaaacggtttaagaatgaaagcgaccctgaaggggcactgtggtag

SEQ ID NO: 21305 - RNA, 9879 nt, synthetic construct
  misc_feature 1..9879: note = derived and/or modified CDS sequence (opt6) from DENV-1__GQ199857__SS-prME
  source 1..9879: mol_type = other RNA
agcgtcactatgcttctgatgcttttacctactgcgttagcatttcaccttactaccagaggaggcgaaccgcatatgatagtttccaaacaagagcgaggtaaatcattattatttaaaacttcagcaggggtaaacatgtgcacgttaatagcaatggatctaggagaactttgcgaagatactatgacctataaatgtccccaaataactgaagcagaaccagatgatgtggattgctggtgtaacgcaactgacacgtgggtaacttacgggacatgttcgcaaactggcgaacatcgaagagataaacgaagcgttgcattggctccacacgttggcttaggattagagacacgcacggaaacttggatgagctctgagggagcttggaaacaaatacagcgtgtagaaacttgggctttgagacatccaggattcactgttattgcattgtttttagcacacgcaataggaacgtcaataacacagaaaggaataatatttatactgttaatgttggtcactcccagtatggcaatgaggtgtgtggggattggaaatagagattttgttgaaggacttagcggtgcgacttgggtagacgtggtattagagcatggttcttgcgtaacaacaatggccaaaaacaaaccaacccttgacatagaacttttgaaaactgaagtaacgaatcccgcaattctccgaaaattatgtattgaagcaaaaatctctaacacaacgaccgactcaagatgtccgacacaaggggaagcaacacttgttgaagaacaggatgctaactttgtatgtcgaagaacgttcgttgatcgagggtggggaaacggatgcggactctttggaaaaggtagtcttctaacatgtgcgaaattcaaatgtgtaactaaacttgagggtaaaattgtacagtacgaaaacctcaaatatagtgttattgtcacggtacataccggagatcaacatcaagtgggcaacgaaaccaccgaacatggaacaattgctaccataacaccacaggcaccaacaagcgaaattcagctcacagattacggggctctgacactcgattgcagtccacgaactggtcttgactttaatgaaatggtgttgctaacgatgaaagaaaaatcttggttagtacataaacagtggttcttagacttaccactcccctggacaagtggagcttcaacatcgcaagaaacttggaacaggcaagatctcctggtaacctttaaaaccgctcatgccaagaaacaggaagtagttgttttaggatcgcaagaaggtgcaatgcacacagcactaactggagccaccgaaatccaaacctcaggaacgacaacaatatttgcaggccatttaaaatgccgattaaaaatggacaagctaaccctcaagggtacctcgtatgtgatgtgcaccggcagttttaagttggaaaaagaagtcgcagaaacccaacacgggactgtccttgtgcaagttaaatacgaaggtacggacgcaccatgtaagatcccgttctctacacaagatgagaagggagtgacacagaacggaagacttataactgcaaatccaattgtgaccgacaaagaaaagccagttaatattgaaacagagccaccttttggggaatcttatattgtcgtaggagcgggagaaaaggcattaaaactaagttggtttaagaaaggaagtagtataggaaagatgttcgaagccacagcacgaggtgcgaggagaatggcaatattaggagatacggcgtgggatttcgggtcaattggcggtgtatttacaagtgttggaaaacttgtgcatcaagtctttggaaccgcttacggagtcttgttctcgggggtaagttggaccatgaaaattggaataggaattttattaacttggttgggcttaaatagtcgaagtacaagtctaagcatgacatgtatagcagtagggatggtaactctgtacctaggagtgatggttcaggctgattcagggtgtgtaataaactggaaaggcagggagcttaaatgtggttccggaatctttgtaactaatgaagtgcacacatggacggaacagtataaattccaagccgatagtccgaaaagactatcagcagccataggtaaggcttgggaagaaggagtatgtggaatacgaagtgccacgagattggaaaatataatgtggaaacaaataagtaatgagttaaatcatattttactagaaaacgatatgaaattcacggtagtagtaggagacgcgaatggtatacttgcacaagggaagaaaatgatacgaccccaacctatggaacataaatattcctggaaatcatggggtaaggctaagataataggagctgacatccagaatacgacatttattatcgacggtccggacacccccgaatgtccagataaccaaagagcatggaacatatgggaagtggaagactacgggtttggtattttcacaactaatatctggctaaagttgcgagactcttatacccaaatgtgtgatcataggctgatgagcgctgcaatcaaagactccaaggcagtgcatgccgacatggggtattggatagaaagcgaaaagaatgagacatggaagttggctagagcgtccttcatagaagtaaaaacatgcacttggccaaaatcgcatacgctatggtccaatggtgttttagaaagtgaaatgatcatcccaaaaatatacggaggacctatttctcagcataactataggccgggatactttactcaaacagcaggtccgtggcacttaggaaaacttgaactcgattttgacttatgtgaagggactactgttgtggtagacgaacattgcggtaatcgtggtccatctttaaggacaactaccgtgaccggcaaaattatacatgaatggtgctgcaggtcttgtacattaccacccttgagattcagaggggaagatggttgttggtacggcatggaaattcgtcccgtcaaagaaaaagaagagaatctagtgagaagtatggtaagtgcgggttcaggagaggtcgattcattttcactaggtatattgtgcgcttctatcatgattgaagaagtaatgagatcaagatggagtagaaagatgcttatgacaggtacattagcagtttttctactactaatcatgggtcaattaacctggaacgacctaatacggttatgtatcatggtaggggcaaatgccagtgacagaatgggcatgggaacaacttacttagcattgatggctacattcaaaatgaggccgatgtttgcagtcgggttactgttcagaagactaacatcccgtgaagtccttctactgactataggtttatctttagttgcgagtgtcgaattacccaacagtctagaagaattaggagatggattagcgatgggtatcatgatgttaaaactactgacggaatttcagcctcatcagttatggacgacgcttttgagtttaacatttataaaaactacattgagtttagattatgcgtggaagaccacagctatggcattgtcaataattagcctatttcccctatgtttgagtactacaagtcagaaaacaacttggctaccagtattactcgggtccttcggctgtaagccattaaccatgttcctgattactgaaaataaaatatggggacgaaaaagttggccgctgaacgaaggaattatggcgatcggcatcgtctctatactattatctagtttactgaaaaatgacgttccccttgcgggacccttgattgccggtggtatgttaatcgcgtgttatgtcatttctggctcaagcgctgatcttagtttggagaaggctgccgaagtctcgtgggaacaggaagcagagcatagcggcacaagtcataacatcctagtcgaagtgcaagacgatggaacaatgaaaattaaggatgaagaaagggacgataccttaacgattttactaaaagcaacactcctagccgttagtggagtgtatccaatgtcgatcccagctacactattcgtatggtatttctggcagaagaagaaacagagatctggggtcctatgggacacacccagcccaccagaagtcgaaagagcagttttagacgatggtatttacagaatactacagagaggtctactcggtaggtcgcaagtcggagttggtgtctttcaggatggagtctttcacacgatgtggcatgtaactagaggcgcagtattaatgtatcagggtaaaaggttggagccatcatgggcgtcagtcaagaaagatctcataagctacgggggaggttggagatttcagggatcttggaacacaggggaagaagtgcaagtaatagcagtagagccaggcaaaaatcccaaaaatgttcagaccacacccggtaccttcaagaccccagaaggagaagtcggtgcaatagcattagattttaaacccggaacaagtggatctccgattgtgaatcgggaaggtaaaatagtaggactctatggaaacggagtagtaacgaccagtggaacttacgtatcagctatcgcccaagctaaagcgagtcaagaggggcccttacctgaaattgaggacgaagtttttaagaaaagaaacctaaccataatggaccttcatccaggctccggaaaaactcggagatatctgcccgctatcgtaagagaggcaataaaacgaaaattacgaacacttatactagcaccgacacgagtagtagcatctgaaatggccgaagcactcaaaggaatgcctataagatatcagacaacagccgttaagtccgagcacactgggcgagaaatagtcgacttaatgtgccatgcaaccttcaccatgcgcctcctatcaccagtgagagtacctaattacaatatgataatcatggatgaagcacactttacagaccctgcaagcatagcggctcgaggttacatatccacccgtgtggggatgggagaggccgcagcaatattcatgaccgctacacctccaggttccgtagaggcctttcctcaaagcaatgcggtcatccaagatgaagagagggatattccggagagatcctggaactcgggatacgattggataacggatttcccgggaaaaacagtatggtttgtacccagcataaagtctggtaatgacatagcgaattgtttaagaaagaatggcaaaagggtaatacaattgagtagaaaaacatttgatactgaatatcagaaaacgaaaaataacgattgggattatgtagtgaccacagatataagcgaaatgggcgctaattttagagccgatcgggttattgatcctagaaggtgtttgaaacctgtcatattaaaagacggtccagagcgggtaatcctcgcggggccgatgccagttaccgtagcctctgctgcacaaagaagaggacgaataggtcgtaaccaaaacaaagaaggtgatcaatatgtatatatgggacagccattgaacaacgacgaggaccatgcacactggacagaagcaaagatgttattagataatattaacacacccgaaggcataatacctgctctctttgagcccgaaagagaaaagtcagcggcgatcgacggagagtatcgtttgaggggagaagcacgtaagacatttgtggagcttatgagacgcggggatcttccagtctggctatcatataaagtcgcctcagaaggattccaatattcagataggagatggtgttttgatggagaaagaaataatcaagttttagaggagaacatggacgtagagatatggacgaaggaaggcgaaagaaagaaattacgacctaggtggcttgacgcaaggacttacagtgacccattagcactccgtgagtttaaagaatttgcagctggaagaaggagcgtatctggagatctcatactcgaaattggaaagctaccacaacaccttacacttagagcacaaaatgcgttagataacctggtaatgcttcacaacagcgagcaaggcggtaaagcctaccgacacgcaatggaagaactacccgataccattgagacgctaatgctcctcgcactaatcgccgttctaactggtggagtaactctattctttttatcaggaaaaggtttaggtaagacgtctataggacttttgtgtgttactgcttcatctgcacttctttggatggcttcagttgagccacattggatcgcagcgagcatcatcctcgagtttttcctcatggttctgttaattccggaacccgataggcagagaacaccacaggataatcaactagcgtacgtagtaataggactcctatttatgatacttactgtagctgcgaatgaaatgggtttgttggaaacaaccaagaaagacctgggaataggacatgttgctgcggaaaaccaccagcatgctactatgttagatgtagatttgagaccagcatcagcgtggactttatacgcggtagctacaaccgtcataactccaatgatgagacacacaatagaaaacacaacagccaatatatccttaactgccatagcgaatcaagcagctatactaatgggcctagacaagggatggccgatctcgaagatggatataggagtcccactcttagctttgggctgctattctcaggtgaaccctctaacattaactgccgccgtattaatgttagtggcgcattatgctataataggcccgggtctacaagcaaaggctactcgagaagcccaaaagaggactgcagcagggatcatgaagaacccaacggttgacgggattgtggcaatagatttagatcctgttgtatacgataccaaatttgaaaaacaattaggacaaattatgctactgatcctctgtacttctcaaatattactcatgcgaaccacatgggcactctgtgaatctattactttagctaccggacctctgacaactttatgggaaggttctccaggaaaattttggaatacaactatcgcagtaagtatggcgaatatattcagaggtagctatttagccggagcaggcctggcgttttcattaatgaaaagtctaggaggtggaaggcgtggtaccggagcccaaggcgaaacactaggagagaaatggaagcggcaattaaatcaactttcaaaatcagagttcaatatttataaaaggagtggcatcatggaagttgatagatcagaagcgaaagaaggactaaaaagaggggaaaccacaaaacatgctgttagccgaggaaccgcaaaattgagatggtttgttgaacgtaatttagtgaaaccagaaggcaaagtaatagacttaggatgcgggcgaggagggtggtcatactactgcgcaggccttaagaaagttaccgaggtaaaaggatatacaaaaggtgggccgggccacgaggaaccaattccaatggcaacttatggttggaatctagtaaagttacatagtggtaaagacgtgttcttcatgccacctgagaaatgtgataccctattgtgtgatattggagaaagttcgccgaacccgacaattgaagaaggacgaactctacgtgtattaaaaatggttgagccttggttacgtggtaatcaattctgtattaaaattctaaatccctatatgccatctgtcgttgaaacgcttgaacaaatgcagcgaaagtacgggggtatgttggttagaaaccctctgtcaaggaacagcacacatgagatgtactgggttagttgcggtaccggaaatatagtaagcgcagtaaatatgacaagccggatgcttctgaaccgctttacaatggcccaccgaaagccaacctatgagcgggatgtcgatctcggagcaggaacaagacacgtagcggtagaaccagaggtcgctaacttagatataatagggcaaagaatagaaaacataaagaatgaacataaatcaacctggcattacgatgaggataatccttataagacttgggcatatcatggtagttatgaggtgaagcctagcggatcagcctcatctatggtaaatggagtggtcagactattaacaaaaccctgggatgttatacctatggttacacaaattgcgatgactgacacaactccttttggtcagcaaagggtattcaaagaaaaagtcgatacaagaacacctagggcgaaacgaggcactactcagataatggaagtaacggcaaagtggctctggggattcttgagcagaaataagaaaccaagaatctgcacgagagaagagttcactcgcaaagtacggtccaacgctgcaataggtgcggtattcattgatgaaaatcaatggaactcagctaaagaagcagtagaagacgaaaggttctgggatttagttcacagagaaagggaactgcataagcaaggaaaatgtgcaacatgtgtatacaatatgatgggtaaacgtgaaaagaaattgggggaatttggcaaagctaagggttctagagctatttggtatatgtggctcggagctcgttttctcgaatttgaagcactaggattcatgaatgaagaccactggttctctagagaaaatagtttgtcaggtgtcgaaggagaagggttacataagctagggtatatattaagagatataagtaagatacctggtggcaacatgtatgccgacgacaccgctggctgggatactaggataactgaagatgacctacaaaacgaagctaaaataaccgatataatggaaccagaacatgcgttgctagcaacgtctatcttcaaactaacataccaaaataaagtggtacgtgtacagagacctgcgaaaaatggtacggttatggatgttataagcagacgcgatcagcgtggatcgggtcaagtgggaacttacggtctcaatacatttactaatatggaagtacaactcattagacaaatggaaagtgaggggatatttctccctagcgaactcgaaacccccaatctggcagaacgagttctcgattggttggaaaaacatggagccgaacgccttaaaagaatggctataagtggagacgattgtgtcgtgaagcccattgatgataggttcgcgacggcattaactgctctgaacgacatgggtaaagttcggaaagatattcctcagtgggaacctagcaaaggatggaacgactggcaacaagtacctttctgtagtcatcattttcatcaacttataatgaaagatggcagagagatcgtagttccctgtagaaatcaagacgagttggtcggtcgtgcacgtgtgtcacagggagccggatggtcgctacgtgaaactgcatgtctagggaaatcatatgcacaaatgtggcaattgatgtatttccaccgaagagacttaaggctagcagcaaatgccatttgtagcgctgttcccgttgactgggtcccgacatcccgaacgacttggagtattcacgcccatcatcaatggatgacaactgaagacatgttatcagtgtggaaccgagtatggatcgaggagaatccatggatggaagataaaactcatgtttcatcatgggaagaagtcccctacttaggaaagagagaagatcaatggtgtggtagtctaatcgggttaaccgcaagagcaacctgggccacaaatatacaagtagcgattaaccaagtccgccgactgatcggaaatgaaaattacttagattatatgacctccatgaagcgatttaaaaacgaaagtgatcccgagggtgccttatggtag

SEQ ID NO: 21306 - RNA, 9879 nt, synthetic construct
  misc_feature 1..9879: note = derived and/or modified CDS sequence (opt6) from DENV-1__GQ199858__SS-prME
  source 1..9879: mol_type = other RNA
agcgtaacgatgctcctaatgttattaccaactgctttagcgtttcatttgaccacgcgcgggggagaaccacatatgatcgtttcaaaacaagagcgtggaaaaagtctattatttaaaacttcagccggagttaatatgtgcaccctaatagctatggatctcggagaattgtgcgaagatactatgacatataaatgtccacaaatcactgaggctgaaccagacgatgtggactgctggtgtaatgcaaccgacacatgggtgacttacggtacctgttcccaaaccggggaacacaggagggataaaagaagtgtagcattggctccgcacgtagggttgggtcttgaaactagaaccgaaacttggatgagttccgaaggagcgtggaaacaaatccaaagagtcgaaacatgggcactacgacatcctggatttacagtcatagctctgtttttagcgcacgcaataggaacatctataacgcaaaaaggaataattttcatacttctgatgctagtaacgccgagcatggctatgagatgtgttggtattggaaacagagatttcgtggaaggactatcaggtgccacctgggttgatgtcgttttagagcatgggtcgtgtgtaacaacaatggccaaaaataaaccaacattggacattgaattattaaaaactgaagtgaccaatccagctatattaagaaaattgtgcatagaagcaaaaataagtaatacaacaacggactcacgatgtccgacccaaggagaagctactttggtagaagaacaagacgctaattttgtatgtcggcggacgtttgtggaccggggatggggtaatgggtgtggactgttcggcaaaggcagcttattaacatgcgctaaattcaaatgcgtcacaaaactagaaggaaaaatagttcaatatgaaaacttaaaatatagtgtcatcgtaacagtccacactggcgatcaacaccaagtcggtaatgaaactacggaacatgggacaatagcaactataacgccccaagccccaacatcggaaattcaattaacagattacggtgctttaacactcgattgtagccccaggacaggacttgattttaacgaaatggtcttattaactatgaaagagaaatcttggttggtacataaacagtggtttctagatctaccattgccatggacctcaggggctagtacgagtcaagagacttggaatcgtcaagatttactggtgacttttaagactgcccacgcgaagaaacaagaggtagttgtcctcggcagtcaagaaggagcgatgcataccgcactcaccggcgccaccgaaattcaaacctcaggtactactactatatttgctggtcacctaaaatgtcgattaaaaatggataagctaacactaaaagggacttcatatgtaatgtgtactgggagctttaagctagaaaaagaagtcgctgaaactcaacacggaacagtcctagttcaagtaaaatatgaagggaccgacgcaccatgcaaaatcccttttagtacacaggacgagaaaggtgtcacacaaaatggaagactgattactgcgaacccaatagttaccgataaagaaaagccagtaaacattgagactgaacctccattcggagagtcttatatagtagttggtgcgggtgaaaaagcgctcaaacttagttggtttaagaaagggagttcgataggaaagatgttcgaggccacagcccgaggagcaaggcggatggcgatattaggagacacagcatgggacttcggtagcataggtggagtattcacatcggtaggaaagctagtccatcaagtgttcggtaccgcatacggagtcctgttttccggagtatcttggactatgaagattggcataggcatactgctaacatggcttggactgaatagtaggagtacttcgttgtcaatgacttgcattgcagtaggaatggttacgctgtatctaggtgtgatggtacaagctgactccggttgtgtaatcaattggaaaggtagagaactaaaatgcggaagcggtatctttgtgactaacgaagttcacacatggaccgagcaatacaaatttcaagctgatagtcccaaacgattatcagcagcaataggcaaagcatgggaagaaggtgtctgtggcataagatccgccactagacttgagaacataatgtggaagcaaatatcaaacgagctcaaccacattttattagaaaacgatatgaaattcacagtagtcgtgggagacgccaatggcatacttgctcaaggcaagaaaatgatacgaccccaaccaatggaacataaatacagttggaaatcttggggtaaagccaaaataattggggcagatatacaaaacactacctttattatagatggtccagacactcccgaatgcccagacaaccaaagagcgtggaatatatgggaggttgaagattatggctttggtatattcacaacaaacatttggctaaaacttagagattcatacacgcagatgtgtgaccaccgtttaatgtcggcagcaattaaagacagtaaagccgtccatgcagatatggggtactggatagagagtgagaagaatgagacttggaaattggcccgtgcttcattcatagaagtcaaaacatgtacctggccaaaaagccacactctctggagtaatggagtcttggaatctgagatgattattcctaaaatatatggcgggccaatatcacagcataactacagacctggatattttactcaaactgcgggaccctggcatctcggaaaacttgaactggactttgatctatgtgagggcacaactgtagtagtagacgaacattgcggaaacagaggtccgagcttacgaacaactaccgtaacaggtaaaataatccacgaatggtgttgccgatcctgcaccttgcctccccttagattcaggggagaagacggatgctggtacgggatggaaatacgaccagttaaagaaaaagaagaaaacctcgtaaggtcaatggtatctgcaggttctggagaggtagattcttttagcttaggcatattatgtgcatcaatcatgattgaagaagtaatgcggtctcgttggtcgagaaagatgttgatgaccggaacacttgccgtatttctgttacttataatgggccaactgacatggaatgacctaatcaggttatgcataatggtgggagctaatgcatcggatagaatgggcatgggaactacataccttgccctcatggcaacattcaaaatgcgacctatgttcgctgtaggacttctcttcagaaggcttacatcccgggaagtcttactactaacaataggactgagtctggtcgcgtctgtagagttaccaaatagtttagaggaacttggagatggtttagctatgggtataatgatgctaaaacttttgactgaatttcagcctcatcaactctggactacattgctgagtcttaccttcattaaaacaaccctttcgcttgattatgcgtggaaaacaacggctatggcgctatctataatctcactatttccactatgcctttctacgacaagccagaaaactacttggcttcctgttcttctaggatcatttggttgtaaacctctaaccatgtttctaataacagaaaataaaatctggggaagaaagagctggcctctgaacgaaggtataatggcaataggcatcgtttctatccttttaagctctcttttgaaaaacgatgtcccgctggctgggccactaatcgcaggaggtatgttgatagcatgctacgttataagcggctctagtgcagatttgagtcttgaaaaagctgccgaagtttcctgggaacaggaagcagaacactccggaacaagtcataacattttggttgaagtccaagatgatggaaccatgaaaataaaagatgaggaacgagacgataccttaacaatactattgaaagcaacacttttggcagtgagcggtgtttatccaatgtcaatacccgcgacgttgtttgtatggtatttttggcaaaagaagaaacagagatcaggtgtgttgtgggataccccaagtcccccagaggttgaaagagcagtgctcgatgatggcatctaccgaatcctccagcgaggactcttaggcagaagccaagtgggtgtgggtgtttttcaagacggagtatttcatacaatgtggcatgtcacacgcggggcagtactaatgtaccaaggaaaaagacttgagccgtcatgggcctctgtgaaaaaggatcttatatcgtatgggggcgggtggaggtttcaaggttcgtggaatacaggggaggaagtacaagttattgccgtagagcccggaaagaatcccaaaaatgtgcagacaacgcccggtacttttaagacaccagaaggagaggtaggagcaatagcgctagattttaaacctggaacgagcggctcaccgattgtaaatagagaaggcaaaatagtgggactctatggtaatggagtagtaacgacgtcgggaacatacgtgagtgcaatcgcacaagctaaagcatctcaagagggccctttaccagaaattgaagatgaagtgttcaagaaacgtaatctcacaattatggatttacatcccgggtcaggcaagacaagacgatatttaccagctatagtacgagaagctattaagagaaaactacggacgttaatattagcacctacaagagtagtagcgagcgaaatggcggaagcactgaaaggaatgcccatacgttaccagacaacagcagttaagagcgaacataccggcagagaaatcgtggacttaatgtgtcacgccactttcactatgagacttttgagtcccgttcgtgtgcctaattataatatgataattatggacgaagcccattttaccgacccagcaagcatagctgctagggggtatatttctactcgtgttggtatgggagaagctgctgctatcttcatgactgccacccctccaggatctgtagaagcctttccccaatctaacgcagtaatacaagacgaagaaagagatatacccgagcgttcatggaactccggatatgattggatcactgatttccctggaaaaactgtctggtttgttcccagtataaaatccgggaatgatatcgcgaattgtcttcgtaaaaatggtaaacgagtcattcagttaagccgaaagactttcgacaccgaatatcagaagactaaaaataatgattgggattatgtagtaaccacagatatatcggagatgggagctaattttcgcgcagacagagtaatcgatccaagacgctgtctaaaacctgttattttgaaggacggtccagagcgagtaattctagctggtcctatgccagtgactgtggcatccgcagcgcagcggcgaggtcgtatagggaggaatcaaaacaaggagggtgatcagtacgtctatatgggacaaccattgaataacgatgaagaccatgcgcactggaccgaggcaaagatgttattggacaatatcaatacccctgaaggtataatccctgcacttttcgaaccggaacgagaaaaatccgcagccatagatggtgaataccgcttacgaggtgaagctcgtaagactttcgtagaactaatgcggcgaggagacttaccagtttggttgtcatacaaagtagcatcggaaggttttcaatacagcgacagaagatggtgttttgacggtgaaagaaacaatcaagtactagaagaaaacatggacgtagaaatttggacgaaggaaggcgagcgaaagaagctcaggccacgatggttagacgctagaacgtattcagatcctttagcattgagagaatttaaagagttcgcagcaggaaggcgttcagtatcgggcgatctaattctagaaataggaaaattaccgcaacatctcacactccgcgcacagaatgcattagataacttagtcatgttacataacagtgaacaagggggtaaagcatacagacatgccatggaggaacttcccgacacaatagagacactaatgcttctagcattaattgctgttctaacaggcggggtaacgctattctttctatctgggaaaggcttaggaaaaacaagtataggcctcctttgtgtaacggcatcaagtgcattactctggatggcatccgtagaaccacattggatagctgcttctataattctagagttctttctaatggtgcttttaataccagaaccggatagacaaagaacgccccaagataatcaacttgcgtacgttgttatcggtcttttattcatgatactaaccgttgctgcaaacgaaatgggcttattagaaacgacaaagaaagacttaggaatcggacacgtagcagcagagaatcaccaacacgctacaatgctagacgtcgacttaagaccagctagtgcctggactttgtatgcagtagctacaacagttatcacacccatgatgcgtcacactatagaaaacaccacagctaacattagtctaaccgccattgccaatcaagcggcgatcctaatgggcctggacaaaggatggccaatatcaaaaatggatattggagtccctcttcttgccttgggatgctattcacaggtaaatccactaactttaacagctgctgtattaatgttggtggcacattacgcgataatcgggccaggacttcaggcaaaagcaactagagaagcacagaaaagaacagcggcaggcataatgaagaaccctactgtagacggtatagttgcgatagatttagatccagttgtatacgacacgaaattcgaaaaacaactaggccaaataatgttacttatactgtgtacgtctcagatcctattaatgagaacaacttgggcactatgtgaaagtattacacttgcaacaggccctttaacaacactatgggaaggtagtccgggtaaattttggaacacgacaatagcagtttcaatggcgaatatcttcagggggtcctatctagcgggcgcgggactagcattctcgctaatgaaaagtctaggtggaggaaggagaggaaccggtgcccaaggcgaaacgttgggtgagaaatggaaacgtcaattaaatcaactatcaaaatctgaatttaatatctacaaaagaagtgggataatggaggtggacagatcggaggctaaagaaggactgaagcgaggggagactacaaaacatgcagtaagccggggaactgccaaattgagatggtttgtagagcgtaacctagtaaaaccagaaggaaaagtgatagatctgggatgtggtagaggtggatggtcatactattgtgctggacttaagaaagtgacggaagtaaagggctacacaaaaggaggtctgggtcatgaagaacccataccaatggcgacatacggttggaacttagtaaaactacacagtggtaaagatgtattctttatgcctccagaaaaatgtgatacactgttgtgtgatataggtgaatcaagcccaaatcctacgatagaagaaggacgaactctaagagttttgaagatggttgaaccatggctacgaggaaatcaattctgtattaagatattaaatccttacatgccaagtgtggtcgagacattagaacaaatgcagagaaaatacggagggatgctggttcgaaatcccctgtcccgtaatagcactcatgaaatgtattgggtgtcttgtggtacagggaatatagtctcagccgtaaatatgacatccaggatgcttttaaatcggtttaccatggcacatcgaaaaccaacgtatgagcgagatgtagacctaggagcaggaactaggcacgtggcagtcgaaccggaagtagcaaatctagacatcatcggccaacgaatagaaaatataaagaacgaacacaaatctacatggcactacgacgaagacaacccgtataagacttgggcttatcacggtagctatgaagtaaaaccgtcagggagtgcatcgtcaatggtgaacggagttgtacgtctactaacgaaaccgtgggatgtcatacctatggtaactcagatcgcaatgacagatacgaccccctttggtcaacagagagttttcaaagaaaaagttgatacacggactccaagggctaagagaggcacaactcagattatggaagtaaccgcaaaatggttatggggttttctaagtaggaataagaaaccacggatatgtacgagagaagagttcactcgaaaagtcagatcgaatgcagcaattggagcggtatttgtagatgagaatcagtggaactccgccaaggaagcagtagaagatgaaagattttgggacttagtgcatagagaaagagaattacataaacagggtaaatgtgcaacctgtgtctacaacatgatgggcaaacgtgagaagaaactaggagagtttggcaaagcaaagggatcaagggctatttggtatatgtggctaggcgcacgattcttagagttcgaagctcttggtttcatgaacgaagatcattggttctcacgtgaaaacagtttaagcggtgttgaaggcgaagggctacataaattaggatatattctaagagacattagcaaaattcctggaggtaatatgtacgcagatgatacagcgggatgggatacaaggattacggaagatgatctccagaatgaggctaaaataaccgacattatggagccggaacatgcactactagccacaagcatctttaaattaacctaccagaataaagttgtcagggttcaaagaccggcgaagaacgggaccgtaatggatgtgatcagtcgaagagatcagagaggatcaggtcaagtggggacttatggtttaaatactttcactaacatggaagtccaactcataagacagatggagtccgaaggcatatttcttccctctgaattggagactcctaacttagctgaaagggtacttgattggctagaaaagcacggagcagaacgtttgaagagaatggcaatcagtggggatgattgcgtcgtcaaacccatagacgatcggtttgcaacagcgctaactgcattaaatgatatgggcaaagttagaaaagatataccgcagtgggaaccatccaaaggctggaatgactggcaacaagtgccattctgcagccatcactttcatcaactaataatgaaggatggcagagaaatcgtcgttccttgcaggaatcaggatgaacttgtaggcagagccagggtcagtcaaggggcaggttggagtttacgtgagacagcatgcttgggaaaatcatatgctcaaatgtggcaactcatgtattttcatagacgtgatttaagactagcggcaaatgcaatctgttctgccgtacctgtagactgggtacccacatcacgaaccacatggagcattcatgctcatcatcagtggatgaccacagaagatatgttgtcagtatggaacagagtctggatagaagaaaacccatggatggaagataagacacatgtatctagctgggaggaagtaccatatttaggaaaaagagaggatcaatggtgtggatcgttgatcggtttgacagcaagagcaacatgggccacaaatattcaagtagcaatcaaccaagtgcggcggctgatcggtaatgagaactaccttgattacatgacatcgatgaaacgatttaaaaacgaatctgatccagaaggcgcactttggtga

SEQ ID NO: 21307 - RNA, 9879 nt, synthetic construct
  misc_feature 1..9879: note = derived and/or modified CDS sequence (opt6) from DENV-1__GQ199859__SS-prME
  source 1..9879: mol_type = other RNA
agcgttactatgttgttaatgttattaccaactgcattggcattccacttaacgactagagggggagaaccgcacatgatagtttctaaacatgaaagaggcaaaagtctcctgtttaaaaccagcactggagttaacatgtgtactttaatagccatggatttaggcgaactatgtgaagatactatgacttataaatgccctagaataacagaagcagaaccagacgatgtagactgctggtgcaatgcaacggatacgtgggttacatacggaacatgctcacaaacaggtgaacatagacgagataaaagaagtgtggcccttgcgccacacgtaggtctcggtttagaaacaagaacagagacatggatgagcagcgaaggagcttggaaacaaatacaaagagttgaaacttgggcattacgacatcccggattcacagttattgctctatttttagcacatgctatcggaacatccataacgcaaaaaggcatcatatttatattattaatgttagtgacaccgtcaatggcgatgaggtgtgtaggaatcggtaatcgcgatttcgttgagggtcttagcggagctacttgggtcgatgtagtattagaacacggtagctgtgtgactactatggctaaaaataaacccaccttagacatagaactactcaaaaccgaagttactaatccggcagtattaagaaaattatgtattgaagcgaagataagcaatacgacgacagattctcgttgcccaacacaaggagaagcgactttagtagaagaacaagacgcaaactttgtgtgtcgccgtacattggtagacaggggttggggcaatggttgcggtctatttggcaaaggtagtctgttaacatgtgcgaaattcaagtgtgttacaaaattagagggtaaaatcgtgcaatatgaaaatttaaaatactcagtaattgtaacagtgcatacaggcgaccaacaccaagtcggaaacgaaacaactgaacacggtacaatagcaactataacaccgcaagcgccgacatcagaaatacaattaacggactatggagcactgacgctggattgttctccccgtacaggcttagattttaatgaaatggtattattaacaatgaaagaaaaatcgtggcttgttcacaaacaatggttccttgatctaccactaccgtggacgtccggtgcaagtactagccaggagacctggaacaggcaagacctacttgttacctttaaaactgcacatgctaagaaacaagaagtagtagtgctaggaagccaggaaggggctatgcataccgccctaaccggtgcgaccgaaatacaaacatcaggaactacaactatatttgccggtcatcttaaatgtcgactaaaaatggataagttaaccctgaagggcacgagttatgtaatgtgcacaggaagttttaaactagagaaggaagtagctgaaacgcaacatgggacagtgcttgtccaagtaaaatacgaaggtacagatgcgccttgtaaaataccattctcaactcaagatgagaaaggggtcacacaaaatggaagactcataacggcgaacccgatagtgactgataaggaaaaacccgtaaacatagaaactgaacctcccttcggagaaagttatatcgtggtaggagcaggagagaaagccttaaaattatcatggtttaaaaagggctcctctatagggaaaatgtttgaagctacggcacgaggagcaaggaggatggctatactgggagatactgcgtgggattttggatcgataggcggagtatttacttccgtgggtaaattagtacatcaagtctttggcacagcatatggtgttttattctccggcgtgagttggactatgaagataggaataggaatactgctaacttggttaggtctaaattcaaggtctacaagccttagtatgacgtgtatagccgtcggtatggtaacactatacctcggtgtgatggtgcaggctgactcagggtgtgtgataaattggaaaggaagagaattgaaatgcggttcgggtatattcgtaacaaacgaagtacatacatggactgaacaatataaatttcaggctgatagtccaaaacgattaagtgcggcaataggaaaagcgtgggaagagggtgtctgtggaattaggagcgctaccagattagaaaacatcatgtggaaacaaatctcgaatgaactcaatcacattcttctagaaaacgatatgaagttcacagtggtagttggtgatgccaatgggattctagcacaaggaaagaaaatgataaggccgcaacccatggagcacaaatattcttggaaaagctgggggaaagccaaaatcattggtgccgacatacaaaataccacatttataatagacgggcctgatacaccggaatgtccggacgatcaacgagcgtggaatatatgggaagttgaggattatgggttcggtatttttaccactaacatatggctgaagttacgagactcatatacgcaaatgtgtgaccaccgattaatgtccgcagcgatcaaggactcaaaagctgtgcacgccgacatgggatactggatagaaagcgagaaaaacgaaacctggaaattagcgagagcttcttttatagaggtaaaaacttgcacttggcctaagtctcacactctttggtcaaacggagtcttggaatcggaaatgattatacccaaaatatacggtggccccattagccaacataattatagaccaggatactttactcaaacagcgggaccatggcatcttggaaaactggaacttgattttgatctgtgcgaaggtacaactgttgtagttgatgaacattgcggtaacagagggccgagtttacgtacaacaacagtaacaggaaagattatacacgaatggtgctgtaggtcgtgtacgttaccacccctaaggttccgaggtgaagatggatgttggtatggaatggaaatccgccctgtaaaagagaaagaagagaatttagtcaggtccatggtatctgcagggtcgggtgaggtagattcttttagtttaggtatcctgtgcgtatcaataatgatcgaagaagtgatgcgatctaggtggtcgaggaagatgctcatgactggaactctagccgtgtttcttctcttgattatggggcaactcacctggaacgacctaatacgattatgtatcatggtaggagctaacgcctcagatcgaatgggaatgggaacgacctacttagcattaatggccacatttaaaatgagacctatgttcgctgtaggtattttgtttagaagactaactagccgagaggtgctactgttaaccattggattgtcattagttgcttcagttgaattgccgaatagcctagaagaacttggcgatggattggcaatgggaataatgatgcttaaattattaaccgaatttcaaccacaccaattatggacaacattgctatcacttacatttataaaaactacactatcgcttgactatgcgtggaagacaactgcaatggctctaagcattgtatccctatttccgctatgtctctcaacaacttctcagaaaactacgtggctccctgtactgcttggctcattcggatgcaaaccattaacgatgtatttaatcacagaaaataaaatatggggtcgcaaaagctggccgattaacgaaggcataatggctattggaattgtcagcattttgttatcttccctactcaaaaacgacgtaccattggcaggccctttaatagcaggaggaatgttaatcgcctgttatgtcatttctggtagttcggccgacctaagcctcgaaaaagcagccgaagtatcttgggaacaagaagcggaacactcgggcacaagtcacaacattcttgttgaagttcaagacgacgggacaatgcggataaaggacgaagagaaagatgacaccttgacgattttattgaaagcaacgctactagctgtctcaggagtctaccctatgtcgataccagcgacattatttgtgtggtatttttggcagaagaagaaacaacggtcgggagttttatgggacacaccttcacccccagaagtagaaagagctgtgctggatgatggtatatatcgaatacttcagagagggttgctcgggagatcccaagttggtgtaggagtattccaagacggcgtctttcacacaatgtggcacgttaccagaggagcggtccttatgtatcagggaaaacgtcttgagccatcatgggcttccgttaagaaggatctaatcagctatgggggtggttggaggtttcaaggaagctggaataccggtgaagaagtgcaagtcatagccgtagaaccaggaaagaaccccaaaaatgttcaaacgacacctggaacattcaaaacaccagagggagaagtaggcgcaatagccctggactttaagcccggaacatcaggttcaccgatagtaaacagagaaggaaaaatcgttggtttatatggtaatggagttgtcacaacatcaggtacttacgtatctgcgattgcccaagcaaaagcatcacaggaagggccgctaccggagattgaggacgaggttttcaaaaagagaaacctcactataatggacctacatcctggaagtggaaaaacaagacgatatctaccggctatcgttagagaggcgatcaaacgcaagctgagaacgctgatccttgcaccaacacgagtagtagcgagtgaaatggcagaggctttgaagggtatgcccatacgatatcaaacaacggcagttaaatccgaacatacaggacgcgaaatagtagacctaatgtgtcatgcaacattcaccatgaggctactctctccagtgcgggtgcccaactacaacatgataataatggatgaggctcattttacagatccagctagcatagcggctaggggctacatcagtactagagtcggtatgggcgaggcagcagcgattttcatgactgcaacccctccaggttctgtagaggcattccctcaatctaacgcggttatacaggatgaagaaagggatattccagaacgcagttggaacagcggctatgactggataacggacttccctgggaaaacggtatggttcgtcccgtcgataaaaagcggaaatgacattgcaaattgcctaaggaaaaacgggaaaagggttatacaacttagcagaaaaacttttgacacagagtaccagaaaactaaaaataatgactgggactacgtagttactaccgatatatcagaaatgggagcaaacttcagagccgacagagtaatagatccacgaaggtgtcttaaacctgtcatactgaaagatggtcctgagagagtgatactagctggtccaatgccagttacggtcgcatctgctgcacaacgtcgaggtaggatcggtaggaaccaaaacaaggagggtgatcaatacgtatatatgggacagccactaaataatgatgaagaccacgcacattggactgaagcaaaaatgttacttgataacataaataccccggaagggattatcccagctttatttgaaccagaaagagaaaaatcagccgcaatcgacggagaataccggctccgaggggaagcacggaaaacatttgtcgaattaatgaggagaggtgatcttccagtatggctaagttataaagttgcaagtgagggattccaatatagcgatcgtagatggtgctttgatggcgagcgtaataatcaagtcttagaagaaaatatggatgtcgaaatctggacaaaagaaggcgaaagaaagaaactgcgaccgcgatggctagatgcacgcacatacagtgatccgctagcactgcgcgaatttaaggaatttgctgcaggacgaagatcggtctctggggacttaatcttagagattggaaaattgcctcagcacctgaccctaagggcccaaaatgcattagataatttggtgatgcttcacaattccgaacaaggaggaaaggcgtacagacatgctatggaggaattgccggatacaatagagacattgatgttactagctttaatagcagtattaactggaggagtaacacttttctttttgagtggcaaaggcttagggaaaacgagcataggattgctttgcgtaacagcatcatctgcattactctggatggcctcagtggaacctcattggatagcagctagcatcatacttgagttcttcttaatggtcttgctaataccagagcctgataggcagcggacaccacaggacaatcaacttgcatatgtcgttataggtctactcttcatgatattgacggttgcggcaaacgaaatgggattattagaaacaacaaaaagagaccttggaattggacatgttgcggctgaaaatcaccaacacgcaaccatgctcgatgtagatctgaggccagcatccgcttggacattgtatgcagtcgctaccacagtgataacaccgatgatgcgccatacaatagaaaatactactgcgaatatttcactaactgcaatcgcgaaccaagcagccattctaatgggtcttgacaaaggatggcccatatcgaaaatggatataggggttccactattggcacttggatgctatagccaagttaatccgctaactttaaccgccgcggtattaatgttggtggcacactacgcaataatcggtccaggccttcaggctaaagctacgagggaagcacagaaaaggactgccgctggtattatgaaaaatccaacggtagatggaatcgtagccatagatctcgaccctgtagtttacgacgcaaaattcgaaaagcagttgggtcaaataatgctcttaatcttatgcacctcccaaatattactcatgaggacaacatgggcactatgtgaaagtatcacactagcaaccggacctttgacgacgctttgggaaggatcaccaggtaagttctggaacactacaatagcagtatcaatggcaaacatatttaggggttcctacttagcgggagctgggctggcattcagcttaatgaaatctttgggcggaggccgaagaggaacaggagcacagggtgagacattaggggaaaagtggaaacgccaattaaatcaactgagcaaaccagaatttaatacctataaaaggtcaggcataatggaggtagaccgctcagaagcgaaggagggcttaaaaagaggggagacaacaaagcacgcagtaagtcgaggaactgcaaaattgagatggttcgttgagagaaacctagttaaacccgaaggcaaagtcattgatcttggttgtggtagaggaggttggtcctattattgtgcaggtcttaaaaaggtgacagaagtgaaaggctataccaaaggaggaccgggccatgaagaaccgatacctatggctacttatggatggaatttagtaaaactacactcagggaaagatgtctttttcatgccacctgaaaagtgtgatactctactatgtgatatcggcgaatctagcccgaacccaacaattgaggaaggcaggacacttagagttttaaagatggtagaaccctggctgcgaggaaatcagttttgcattaagattttgaacccatatatgcccagtgtagtcgaaactctagaacaaatgcaaaggaagcatgggggaatgcttgtccgcaacccattaagccgtaatagcacccacgagatgtattgggtaagctgtggtacgggaaacatcgtgtcagccgtcaacatgacaagtcggatgttactgaatagattcacaatggcccatcgaaaaccaacctacgaaagggatgtagatctcggtgcagggacaagacacgtagcagtagaaccagaagttgcaaaccttgacataatcggacaaagaattgagaatatcaaaaacgaacataaatccacatggcattacgacgaagacaacccttataaaacttgggcgtatcatggttcatatgaagtaaaacctagtggcagcgcaagttccatggtaaatggagttgtacgtctactaactaaaccttgggatgttatccccatggtgacacaaatcgcaatgacagacacaacaccatttggccaacaaagggtattcaaagagaaagtggacacgagaactcctagagctaaaagaggcacaacccaaattatggaagtaacggctaaatggctgtggggattcttaagtagaaacaagaaaccacgaatctgtacaagagaggagttcacaaggaaagttagatcaaacgccgcgattggagcggtctttgttgatgaaaatcaatggaactctgctaaagaagccgtggaagacgaaagattctgggacctagtccatcgagaaagagaactacataaacaaggaaaatgtgcaacgtgtgtatacaatatgatgggaaagagagaaaagaaactaggagaatttggcaaggcaaagggatctcgagctatctggtatatgtggcttggagcgagattcctggagttcgaagcactaggctttatgaacgaagatcactggttctcgagagaaaattctttaagtggagtagaaggagaaggactccacaaacttggatatattctgagagacattagcaagattccaggagggaacatgtatgcggatgatacagcaggatgggatacgagaataactgaagacgatctacaaaatgaagccaaaataaccgacataatggaacccgaacacgcacttttggcaacgtccatatttaaattaacataccaaaataaggtagtaagggtacaaagaccagccaagaatggtactgtaatggatgtgattagtaggcgcgaccagcgaggtagcggtcaggtgggcacgtacggactcaacaccttcacaaacatggaagtgcaactaatcagacaaatggaaagtgaaggtatattccttccctcagaattggaaacaccaaatctagcagaacgagtcctagattggctcgaaaagcatggcgcagaacgtctcaaaagaatggccatctcgggcgatgactgcgtggtgaaacccatagatgatagatttgcaacagcgcttaccgcgttgaatgacatgggaaaagtccgtaaagatattccacaatgggaaccatcgaaaggctggaatgactggcaacaagtcccattttgcagccatcattttcatcaattgattatgaaggacggccgtgaaatagtcgtcccatgtagaaaccaggatgaacttgtcgggagagcccgagtaagtcagggggcaggttggtcattaagggaaacagcatgtttagggaaatcatacgcacaaatgtggcaattaatgtactttcatcgtcgagacctaagactagcagcgaatgcaatatgttccgcagttccagtggattgggtccccacttctagaacgacctggagcatacacgctcaccatcaatggatgacaaccgaggatatgctcagtgtgtggaatagggtatggatagaagaaaatccctggatggaggataaaacccatgtgagttcctgggaagaagtcccttaccttgggaaaagagaagatcagtggtgtggttcacttataggcttaactgccagagctacctgggcaactaacatacaagtggccatcaatcaggttagaaggttaattggcaatgaaaattacctagattatatgaccagtatgaaaagatttaagaacgaatccgatcctgagggagcactctggtaa

SEQ ID NO: 21308 - RNA, 9879 nt, synthetic construct
  misc_feature 1..9879: note = derived and/or modified CDS sequence (opt6) from DENV-1__JF937645__SS-prME
  source 1..9879: mol_type = other RNA
agcgttactatgctattgatgctgttacccaccgcactggctttccatttaacaacccgagggggtgagccccacatgatagttagtaaacaagagaggggaaaatcattattgttcaaaacaagtgcaggagtcaatatgtgtacacttatagcaatggacctgggagaattatgcgaggatacgatgacatataaatgtccacaaataacagaagcagaaccggatgatgttgattgctggtgcaatgcaacagacacctgggtaacttatggcacatgtagtcaaaccggggaacataggagagacaaacgaagtgtagcgctagcaccccacgtgggccttggacttgaaactcgtactgagacgtggatgtctagcgaaggagcttggaaacagatacaaagagtagaaacttgggctcttagacaccctggctttacagtaattgcattgttcctagcacacgcaataggtacatcgatcactcaaaaaggaataatattcatactattaatgttagtaactccaagcatggcaatgaggtgcgtaggaattggaaatcgtgactttgtcgaaggcttatcgggtgcaacctgggtagatgttgtactggaacacggcagttgtgttactacgatggccaaaaacaaaccgactctagacatagagttgctaaaaactgaagtaacgaatcccgcgatactcagaaaattatgtatagaagcaaaaataagcaataccactacagattcaagatgtccaactcaaggagaagctacgttagtagaagaacaagatgcaaattttgtttgtagaaggaccttagttgaccgaggttggggcaacgggtgtggactgtttggaaaaggtagcttactcacatgcgctaaatttaaatgtgtgaccaaattggaggggaaaattgtgcaatacgaaaaccttaaatattccgttatcgtcactgtacatactggagatcaacaccaagtgggaaacgaaacgaccgaacacgggactatagcgactattactcctcaagctcctacctctgagatacaacttacggactatggggctttaactttggattgttcgccaagaacagggttagattttaatgaaatggtactgttgacgatgaaagagaaaagctggctagtacacaaacaatggttcttggatttaccattgccttggacatcaggagctagcacaagccaagaaacttggaatcgtcaagatctactggtcacgttcaaaacagcacacgctaagaaacaagaagtagtcgttttaggaagtcaagaaggagctatgcatacggcactcaccggggcaaccgagattcagacgtcgggtacaacaacaatttttgcgggacacttaaaatgtagactgaaaatggataaattaactctaaaaggtacaagctatgtaatgtgtacaggctcattcaaattagaaaaagaggtcgcagaaacacaacatggaactgtattggtgcaagtgaaatacgagggcaccgacgcaccatgcaaaatccccttcagtacgcaggatgaaaagggagttacacaaaatggtagactaatcacagcaaatcctatcgtcaccgataaggaaaaaccagtaaacatagagacagagcctccttttggagaaagctatatcgttgtaggagctggcgagaaggcattaaaactatcttggtttaaaaagggatcatcaatcggaaaaatgtttgaagcgacggcgcgtggtgcacgccgaatggcaattctaggtgatacagcctgggatttcgggtcaataggaggcgtttttacgtcagtaggtaagctagtacatcaagtatttggaacagcgtatggtgttctgttttccggggtttcatggactatgaaaatagggatcggtatactattgacgtggttagggctaaacagcaggagtacatcacttagcatgacttgcatagctgtcggcatggtgactctttatctaggagtcatggtccaagcagactccggatgtgtaataaactggaaagggcgtgagctaaagtgcggatccggcatttttgtaaccaacgaggtacatacttggacagaacaatacaaattccaagctgattcaccaaaacgtctctcggccgccataggcaaggcatgggaagaaggggtctgtgggatacgatcagcaaccagactagaaaacataatgtggaagcaaattagtaatgagcttaatcatatactactagaaaacgatatgaaatttactgtagtcgtaggtgatgccaacgggattctcgcacaaggcaagaaaatgatccgaccgcaaccaatggaacataaatattcatggaagtcatggggtaaagccaaaatcataggtgcagacatacagaatactacattcataatcgatggccctgatacccctgaatgcccagataatcaacgagcctggaacatatgggaagtggaagattatggctttggtatattcactacgaacatatggttaaagctccgagattcatacacacaaatgtgtgaccacagattaatgtcagcagcaataaaagactcaaaagcagttcatgcagatatgggttactggattgaaagtgagaaaaatgaaacatggaaattagctagagcatcctttattgaggtgaaaacctgtacctggccaaaatcccatacattatggtcaaacggagtattagaatcagaaatgataatacctaaaatttatggcggtccaataagtcaacacaattatcgtcccggctattttacccagacagcaggaccctggcatctgggaaaattggaacttgacttcgacctatgcgagggtaccacggtggtagtggacgagcattgtgggaatagaggcccgtcgttacggactacgacagtgacgggaaaaatcatacatgaatggtgttgcaggtcatgcacgcttccgccactgcgatttcgaggagaagacggatgttggtatggaatggaaataagacccgttaaagagaaagaagaaaatctagtaagatctatggtaagtgccggatcaggtgaagtagatagtttttcattggggatactatgtgcttctattatgatcgaagaagtcatgagaagtcggtggtctcgaaagatgctaatgacgggaaccctcgcagtgtttctactcttaataatgggccaattaacatggaatgatttaattagattgtgcattatggtcggagcaaatgcatctgatagaatgggcatgggaaccacttacttagctttaatggccacattcaagatgagaccgatgtttgcagtgggcctactatttcgtcgtttaacgagtcgtgaagtgttattactgactatcggacttagtttggtcgcctccgtagaactaccgaactcgctcgaagagttaggagatggactcgctatggggatcatgatgttaaaattattgacagaatttcaacctcatcaactatggaccacattattgtcgttaacattcataaaaacaacgttaagtttagattatgcttggaaaactaccgcaatggcacttagcatagtaagtttattccctttatgtttgtctacaaccagtcagaaaaccacttggcttcccgtactcctaggatcatttggctgcaagcctctcaccatgtttttaattacggaaaataagatttggggtagaaaatcatggccacttaacgaaggaattatggccataggtatagttagtatacttttaagtagtcttctcaaaaatgatgtaccgttagccggtcctcttattgcaggaggaatgcttatagcctgttacgtaatcagcggatcgagtgccgatctttcacttgaaaaagcagctgaggtttcgtgggagcaagaggcagaacatagcggaaccagccataatatattggtagaagtccaggatgacggaacaatgaaaataaaagatgaagaacgagatgataccttaacaattctcctaaaagccactctattggctgtgagcggcgtatacccgatgtcgatacctgcgacactctttgtttggtatttctggcagaagaagaaacaacgtagtggagtgctttgggatacgccaagtccacccgaagtagaaagagcggttctcgatgacggtatataccggatacttcaaagagggctactcggtagaagccaagtcggagtgggtgtattccaagacggtgtttttcatacaatgtggcacgtaaccagaggggcagttttaatgtaccaagggaaaaggttggaaccgtcatgggcgagcgtcaagaaagatctcatatcatacggaggaggatggagatttcaggggtcctggaatacgggggaagaagttcaagtaattgcagtcgaacctgggaaaaaccccaaaaacgtccagacgactccgggtacgtttaaaacgcccgaaggcgaagtaggggccattgcattagacttcaaaccaggtacctcaggaagtccaatagtaaatcgtgaaggcaaaattgtcggcttgtatggaaacggagtcgtaaccacttcgggaacctatgtttcagcgattgctcaagcaaaggcttcacaggaggggccattaccggaaattgaagatgaagtattcaagaaacgaaacttgacaataatggatctacacccaggcagcggaaaaacaagacgttacctacccgctattgtgcgggaagctatcaagagaaagctacgaacactcatattagctccaacaagggtcgtggcaagtgaaatggcggaagctctaaaaggaatgccgataagataccagactaccgctgttaaatccgagcacacggggagagagatagttgatctgatgtgtcatgcaactttcacaatgagattactatcacccgtacgtgttcctaattataatatgataatcatggacgaagcacacttcaccgatccggcatcaattgctgccaggggctatatatcaacgagagttgggatgggtgaagctgcagctattttcatgacagcaacacctccagggagcgtagaagcatttccgcaatctaatgcagtaattcaggatgaagaaagagatataccggagcgtagttggaacagtgggtacgattggataacggacttccctggtaaaaccgtatggtttgtccccagcataaagtcaggcaacgatattgctaattgcttacgaaagaacggcaagcgcgtaatacaactatcaagaaaaacattcgatacagaatatcagaaaactaaaaacaacgactgggattacgtggtcactacagatatatcagagatgggggcaaactttagagcagaccgagttattgacccacggagatgtttaaagccagttattttgaaagatggaccagagagagtgatattggctggcccaatgcccgtcacagtagcatctgctgctcaacgcagaggtagaatagggcgaaatcaaaacaaggagggagaccagtatgtttacatgggacaaccgctaaacaatgatgaagatcatgctcactggaccgaagctaaaatgctattagataacatcaacacaccggaagggattatcccggcccttttcgaacctgaaagggaaaagagcgcggcaatagatggcgagtatcgacttagaggagaagcaagaaaaacatttgttgaacttatgaggaggggagatctccctgtttggctgagctataaagttgcgtcagaaggtttccaatattcggacaggaggtggtgcttcgacggggaacgtaataatcaagtgctcgaggaaaacatggacgttgaaatttggactaaagaaggtgaaagaaagaaactaagaccgcgatggttagatgcgcgcacatacagtgacccactcgctctcagagagttcaaagaatttgcggctggccggaggagtgtttctggtgatttaatcttagaaatcggaaaactgccacaacacttaacgttgagggcgcaaaacgccctagataatctagtaatgttacataattcagaacagggtggaaaagcgtatagacatgctatggaagaattacccgatacgatcgaaacactaatgttattagccttaattgctgtactaactggaggggtaacacttttctttctgtcaggtaaggggttgggaaagaccagtatcggccttttatgtgtcacagcatctagtgcgctactttggatggcatcggtggaaccgcactggattgcagccagtattattctagagttctttcttatggtactacttataccagaacccgataggcaacgtacacctcaagacaaccaactcgcatacgtagtcataggacttttattcatgattctaactgttgctgctaatgaaatgggtttactagaaacaactaagaaagacctcggtataggccacgtagctgctgaaaatcatcaacatgcaactatgttggatgtagaccttagaccagcaagtgcatggacactttacgcagtagcaaccacagtaattacgccaatgatgcgacacactatagaaaacacaacagccaatatcagcttgactgcgattgccaatcaagcggctattctaatgggtctagataaaggatggcctatatccaaaatggatataggtgtacctctattagctctagggtgttattcacaagtgaatccattaactttaactgccgcagtgctaatgttagtagctcactacgcaattatagggccaggactgcaagcaaaagcgacaagagaagctcaaaaacgaacagcagccggaataatgaaaaatcctacggttgatggaatagtagcaatagacttggatcccgtggtatatgatgctaaatttgagaaacagctaggccaaataatgttattaattttatgcacctcacaaatcttactaatgcgaactacgtgggctctctgtgaaagtataactttagccacaggaccacttaccactttgtgggaaggtagtcctggaaaattttggaacaccacaatagcggtatcgatggccaacatatttcgaggatcttatctagcgggtgctggtctcgcattttcattaatgaagtctcttggaggtggaagaaggggaactggagcacaaggcgaaacactcggtgagaaatggaaaagacaactcaatcaattaagcaaatcggagtttaacacatataaacgtagcggaataatggaagtagatcgatcagaagcaaaagaaggacttaaacgaggtgagacgacaaaacatgcagttagtcggggaacggccaaattaagatggtttgtggaacgaaacttggttaaaccggaagggaaagttattgacttaggctgcggcagaggtggatggtcatactattgtgctgggcttaagaaagtgacggaagtaaaaggatatacaaagggtggacccggacatgaagaacctataccgatggccacctatggctggaacttagtaaagctacattccggaaaagatgtcttctttatgcctccggagaaatgtgatacactcctatgtgatatcggagagtcttcaccaaaccccactattgaagagggtagaactctacgcgtactaaaaatggtggaaccctggcttaggggaaaccagttctgcattaaaatactcaacccttatatgcccagtgtcgttgaaacgctcgagcaaatgcaaaggaagcacggtggcatgttagttagaaatcccctctcacgaaacagtactcatgaaatgtattgggttagctgtggaacagggaacatcgtctcagcagttaatatgacgtcccgtatgttgctcaatagatttacgatggcacaccgaaaacctacttatgaaagggatgtagatctaggagcggggactagacacgttgctgtagagcccgaagtggcgaatctcgatataataggccagcgaatagagaacattaaaaacgaacacaaatcaacctggcactacgatgaagacaatccctataaaacttgggcatatcatggttcatatgaagtcaaacccagcgggtctgcttcttcaatggtcaatggcgttgtgaggttattgacgaaaccttgggatgttataccaatggtgacacaaattgccatgacagacaccacgccatttggacagcagcgcgtatttaaagaaaaagttgatactcgaacaccccgggctaaacgaggaaccactcaaattatggaggtaaccgcaaaatggctttggggatttctatccagaaataagaaaccaagaatatgcacgagagaggaatttacaagaaaagtacgatcgaatgcagccatcggcgctgtgtttgtggacgaaaaccaatggaacagtgccaaggaagcagttgaagacgagcgtttttgggatttagtccacagagaacgtgagctccataagcagggaaagtgtgcaacctgcgtatacaacatgatggggaaaagagagaaaaagttaggtgaatttggaaaagcaaaggggtccagagctatctggtatatgtggttgggagcgagatttctagagttcgaggctttaggatttatgaacgaagaccactggttctcaagggagaactcgttgtccggagtggaaggagaaggactacataaactcggatatatactccgagatatatctaaaataccaggaggtaatatgtatgctgatgacacagcagggtgggatacgcggattactgaagatgacttacaaaatgaagctaaaatcacagatattatggagcctgaacatgctttactagcaacctctatattcaaattaacatatcaaaataaagtcgtaagggtacaaagaccagccaaaaatggaactgtcatggacgttatttcccgacgagatcaaagaggttcgggacaagttggaacttatggtctaaatacctttactaatatggaggtacaattgatacgccagatggagtctgagggaatatttcttccaagtgagctagaaacaccaaacctcgctgaaagggtgctggactggttagaaaagcacggagcagagaggttaaaaagaatggcaattagtggagatgattgtgtagttaagcctatcgatgaccgatttgcgacagcacttacagctctaaacgatatgggaaaggtgagaaaagatataccacaatgggaaccatctaaaggatggaatgattggcaacaagtcccattttgttcacatcattttcatcaattaataatgaaagatggtagagaaattgtcgttccgtgtaggaaccaggatgaattagtcgggagggcaagggtttcgcagggtgcaggatggtcgctgcgagaaacagcatgcctaggaaaatcctatgcacaaatgtggcagttaatgtatttccacagacgagatttaagattagcagcgaacgcaatctgtagcgcagtacccgtagattgggttccaaccagtagaacaacatggagcatacatgctcaccaccaatggatgaccactgaggacatgttatcagtatggaatcgagtatggattgaagaaaatccatggatggaggataaaacacacgtcagtagctgggaggaagtaccatatctaggtaaaagagaagaccaatggtgtggatcattaataggcttaacagcaagagcaacctgggcgaccaatatccaagtcgctatcaatcaagtacgacggctaataggaaatgaaaattatttagattacatgacgtcgatgaaaagatttaaaaacgagtccgacccggagggcgccttatggtag

SEQ ID NO: 21309 - RNA, 9879 nt, synthetic construct
  misc_feature 1..9879: note = derived and/or modified CDS sequence (opt6) from DENV-1__FJ850114__SS-prME
  source 1..9879: mol_type = other RNA
tccgttacaatgttattgatgttattaccaacggctctagcatttcacttaacaacaaggggtggtgaaccacacatgatagtaagcaaacaagaaaggggtaagagcttacttttcaaaacatcagctggtgtaaatatgtgtacactaatagcaatggaccttggagaactttgcgaagatactatgacatacaaatgccctcaaataacggaagcggaacctgatgacgttgattgttggtgtaacgctacagacacatgggtaacctatggaacttgtagccaaacaggggaacacagaagagataaacgaagtgttgcattagcgccacacgtaggactggggttagaaacccgaactgaaacctggatgagtagtgaaggagcatggaaacaaattcaaagagttgaaacatgggcgctacggcacccaggatttacggtcattgcgctatttttagcccatgcaattggcacgagtattactcaaaaaggcataattttcattcttttgatgcttgtaacgccgtctatggctatgagatgtgttggaattggaaaccgtgatttcgttgaaggcctgagtggagctacttgggtagatgtggttcttgaacacggaagttgcgtcactactatggctaaaaataaaccgactctagatattgaacttttaaaaacagaagttacttcgcccgcgatcctacggaaactctgcatcgaagcgaaaatttcgaacacaacaacagactcgcgctgtccaacacaaggggaagccactctagtcgaagaacaggatgcaaattttgtatgcaggcgtaccttcgtagaccgtggttggggtaacggatgcggactattcggcaaagggagcttattgacttgtgccaaatttaaatgcgtgactaaacttgaaggaaaaattgttcaatacgagaatctaaaatatagtgtaatcgtgaccgtccacactggagatcaacaccaagtagggaacgaaacgactgagcatggaacaatagccactattacacctcaagccccaacttcagagatacaattaacagattatggagcactcacattagactgttctcccagaactgggttagattttaatgaaatggtattattaaccatgaaagaaaaatcttggctagtacacaaacaatggtttctagatttaccgcttccctggacgtctggtgcctctacgagccaggaaacctggaataggcaagatcttctagtgacattcaaaacagcacatgcaaagaaacaagaggttgtggttctaggttctcaagagggagcaatgcatacggccttgactggtgctacagaaatccaaaccagcgggactactacaatatttgcaggtcatcttaaatgtagattgaaaatggataaattaactcttaaagggacgagttatgtaatgtgtacgggatcatttaaattagaaaaagaagtagcagaaacacaacacggcacagttctggttcaagtgaaatacgaaggaactgatgcaccatgtaaaataccattcagcacgcaagatgaaaaaggcgtaactcaaaacggaagactaataacagcaaacccgatagtaactgataaagaaaaacccgtgaatatcgaaacggaacctccttttggagagagctacattgtagtaggagccggagaaaaagcgctcaaactgtcgtggttcaagaaaggatcaagtataggcaaaatgttcgaagcaactgctagaggagctaggagaatggcgatactgggagatacagcatgggattttgggagtataggtggagtatttacaagcgtaggaaagttagtacatcaggtgttcggcacagcttatggggtccttttctctggagtttcatggacaatgaaaatagggataggaatactccttacctggctgggactgaatagcagaagcacgtctttaagtatgacgtgcatcgcagtaggcatggttaccttatacttgggggttatggtgcaagccgacagcggttgcgtaataaactggaaaggtcgtgaactcaaatgcggatcgggaatatttgtcacaaacgaagtacatacttggaccgaacagtataaatttcaagccgacagcccaaaacgattatcggcagcgataggtaaagcctgggaggagggagtttgtggtatcagaagtgcaacgcgtctcgaaaatataatgtggaaacagatttcgaatgaattaaatcatattttattggaaaacgacatgaagtttaccgttgtcgtgggagacgcaaatgggatactagcacaaggcaagaaaatgataaggccacaaccaatggaacataaatattcatggaaatcttggggcaaagcaaaaataatcggcgcagatatacagaataccacatttattattgacgggcctgacacaccagaatgtccagataaccaaagagcgtggaatatatgggaagttgaggattatggctttggtattttcactactaacatatggctgaagctacgtgacagttatactcagatgtgcgatcatcgtctgatgtcagcagccataaaagattcaaaagcagtacacgctgatatgggatactggatagaatctgagaaaaatgaaacctggaagctagcacgagcttcttttatagaagttaaaacttgtacttggccaaaaagtcataccttatggtcgaatggcgtactagaatcagagatgataataccaaaaacatatggaggaccaatttcgcaacataattacagaccaggatactttactcaaactgcaggaccgtggcatctgggaaagctagaattagacttcgatttgtgtgaaggaacaactgtggtagtggacgaacattgcggcaacagaggcccaagtctacgtacaactacagtaacaggaaaaataatacacgaatggtgttgtcgcagttgtacgttgccccctttgagattccgtggcgaagatggttgctggtacggcatggaaattaggccagtaaaggaaaaagaagaaaatctcgttcgatcgatggtttcagcagggagtggggaagtcgacagtttttcactaggcattctatgcgcatcaataatgattgaggaagtgatgagatcacgatggagtcgtaaaatgctaatgacaggaacattagcggtgtttttgttactgataatgggtcaacttacgtggaacgatctaatacggctttgcataatggtaggtgctaatgctagtgatagaatgggcatggggaccacgtatttagcactaatggcaaccttcaaaatgagaccaatgttcgcggtaggattactttttcgcagattaacaagcagggaagttttgctgttaacaattggcctgtcattagtagcatcggtagagctacctaattcattagaggaattaggggacggcctggccatggggattatgatgctaaaactattaactgaatttcaaccacatcaattatggaccactctattgtctttaacattcatcaaaaccacactgagcctggactatgcttggaaaaccactgcaatggcattaagtatagtgtcactctttccattatgtctttctacaacatcgcagaaaactacatggttaccagtcttgcttggaagtttcggttgcaaaccactaacaatgtttcttattacagaaaataagatttggggtcgaaaatcctggccccttaatgaggggataatggcaatcggtattgtaagtattcttctcagctcgttactcaaaaacgatgtaccgctagcaggtcccctaattgcaggcggtatgcttattgcctgctacgtaataagtgggagttcggccgacctctcgctggaaaaagccgcagaagtatcatgggaacaagaagccgaacactcaggaacttctcataatatcctagtcgaagtgcaagatgatgggactatgaagataaaagacgaagaacgggatgataccctaaccatattactcaaagctacgttactggcagtatcaggtgtctatccaatgtctatacccgctaccctatttgtatggtatttttggcagaagaagaaacaaagaagcggcgtcttatgggacactccaagtccccctgaggtcgaaagagctgttcttgacgacggtatatacaggatattacagaggggactactagggcggagtcaagtaggagttggtgtatttcaagatggagtgttccacacaatgtggcacgttaccaggggagccgtcttaatgtaccaaggtaaacgcttggaaccatcgtgggcctccgtcaagaaagatcttatatcatacggcggagggtggagatttcaggggagctggaacacaggggaggaggtacaagtaatagccgtagaaccagggaaaaaccccaaaaacgtccagactacacccggtacgttcaagactccagaaggcgaggtgggcgcgattgcactcgattttaaacctggcacaagcggatctcctatcgtgaatcgcgaaggtaagatagtgggattgtatggcaacggagtagtaactaccagtggaacatatgtatctgcgattgcacaagccaaagcatctcaagaaggccccctaccagaaatagaagatgaagtattcaagaaaagaaacttaacgattatggatcttcaccccggctcaggaaagacaagaagatacttacctgcaatagtcagagaggccataaaacgaaagctcagaaccctaatattggctcctacacgagtagttgcgtctgaaatggctgaagccttaaaaggtatgcccatacgatatcaaactacagctgtaaaaagtgagcatacgggtagagaaatagtcgacctgatgtgtcacgcaacgttcacgatgcgactactgtccccagtacgtgtacccaactacaatatgataattatggacgaagcacattttactgatccagcttcgatcgccgcacgagggtacatctcaacaagagtagggatgggtgaagcagccgcgatatttatgactgctacaccaccggggtcagtagaggcttttccgcaaagtaatgcagtaattcaagacgaagaacgtgatataccggagcgcagttggaacagcgggtatgattggataaccgatttcccaggtaagacagtctggtttgttccttccattaaatccggaaacgatattgccaattgtttacgtaaaaacggtaaaagggttatacaattgagccgaaaaacatttgataccgagtaccaaaagaccaaaaataacgattgggattatgttgttacaacagacattagtgaaatgggtgcaaacttccgagctgatcgcgttattgatccgagacggtgcttaaaacctgtgatactaaaagatgggccagagcgtgttatactggcaggtcctatgcctgttacagttgcaagtgcagcccaaagaagaggtcgaatcggaagaaatcaaaacaaagaaggagatcaatatgtatatatggggcaacccttaaataatgacgaagatcacgcacattggacagaggcaaagatgctactcgacaatataaacactccggagggaataatacccgctttattcgaacccgaaagagaaaaatccgcagccatagacggtgaatatagactcaggggcgaggcgcgcaaaacattcgtagaacttatgcgacggggcgatttgccagtatggctatcctacaaagtagccagtgaaggattccaatacagcgatagaagatggtgttttgatggggaaaggaataaccaagttctcgaagaaaacatggatgtagaaatatggacaaaagaaggagagaggaagaaattaaggcccaggtggctagatgcaagaacttacagtgatccgctcgctctcagggagttcaaagagtttgcagcaggtcgtagatcagttagcggagatctaatactagaaatcggaaaactcccgcaacacctcacccttcgtgcacagaatgcactagacaatttggtaatgttgcacaactccgaacagggtgggaaggcctatcgccatgccatggaagaactacctgatactatcgagacgttaatgctgctcgcccttatagcggttctaacagggggtgtaactctgtttttcttatccggtaaggggctaggaaagacttctattggactactctgtgtaaccgccagcagtgctctattatggatggcgtctgtagaaccccattggattgctgccagtataatattagagttctttcttatggtattactcatacctgaacctgatagacaaaggaccccgcaagataatcaactagcgtacgtagtcataggtctactattcatgatacttaccgtcgccgcaaacgaaatggggctattagaaacgaccaaaaaggacttaggtataggacacgtcgcagcagaaaatcatcaacatgcaactatgttagacgtagatttacgccccgcctcagcatggactttatatgctgtggctacaactgttatcacgcccatgatgagacacaccattgaaaacaccaccgcaaatattagccttacagcgatcgccaatcaagcagcgatactcatgggtctagataagggatggccgatatcaaaaatggatataggagtgccattacttgcactaggctgttacagtcaagtcaacccattaactctcaccgccgccgtcttaatgctcgtcgcccattacgcaataataggtcctggtcttcaagcaaaagccacccgagaagctcagaaacgaacggctgctggaatcatgaagaatccgacagtagatgggattgtagctattgatctagatcccgtagtctatgacgcaaaattcgaaaaacaattgggacaaatcatgttattaattctatgtacaagtcaaatactactaatgagaactacatgggcactttgtgagtcgataacattggcaacaggaccattgactaccctttgggaaggctctcctgggaaattctggaacaccacaatcgcagtaagtatggccaatatcttccgtgggtcctatttagctggagcaggattagctttctcactgatgaaatcattgggtggtggacgacgtggcacaggagctcaaggggagactcttggggaaaagtggaaaaggcaactaaatcaattatcaaaatcagagttcaatacatataaaagatccggaataatggaagttgatagaagtgaagccaaagagggactaaaaagaggggaaactacaaagcatgcggtatcacgaggaaccgcgaagttgcgatggttcgtagaaaggaacctggtcaaacccgaaggtaaagttattgatctcggatgtgggagaggaggttggagttactattgtgcagggttaaagaaagttacagaagttaaaggatatacaaaaggtggtccaggacacgaagaacctatacccatggcaacgtatggatggaatcttgttaagttgcattctggaaaagatgttttcttcatgccccctgaaaagtgtgatacactactgtgcgacataggtgagtcaagtccgaacccaacaatcgaagaaggaagaacgctcagggttttaaaaatggtagaaccctggttgaggggaaaccaattttgtatcaaaattctaaacccctatatgccaagtgtagtcgaaattttagaacaaatgcaacgtaaacatgggggaatgctagtgagaaatccattgtcgagaaactcgactcatgaaatgtattgggttagctgtggcactggaaatatagtctctgctgttaatatgacgagtcgcatgcttctaaatcgttttacgatggctcatcgcaaacccacctatgagcgcgacgtcgacttaggagcaggtacacgacatgtggcagtcgaacccgaggttgccaatttggacattattggacaacgcattgaaaatatcaaaaatgaacacaaatcaacatggcattacgacgaagataatccatataaaacgtgggcataccatggaagctacgaggtgaaacccagtggttcggcaagcagcatggtaaacggggtcgtcagattacttacaaaaccatgggatgtaatacctatggtaacacaaatagcaatgactgacacgacaccatttggacaacaacgcgtatttaaagaaaaagtagacacaaggacacctagagcaaaacgtgggacaacgcaaattatggaagtaacagcgaaatggttatggggatttttgtcgagaaataagaaaccacgtatttgcacgagagaagagttcacgcgcaaagtaaggagtaacgccgctataggcgctgtttttgtagatgagaatcaatggaactcagcgaaagaagcagtagaagacgaacgtttttgggatcttgtacaccgagaaagagaactacataaacaaggtaaatgtgccacttgcgtatacaacatgatggggaaacgagagaagaaattaggcgagttcgggaaagctaaaggatcccgcgctatatggtatatgtggctgggcgcgcgatttttagaatttgaggcattaggctttatgaatgaagaccactggttttcacgtgaaaattcgctaagcggagtggagggcgaagggctacacaaattgggttatatactaagagatattagtaaaataccgggaggtaacatgtatgctgacgacacagccggctgggatacccgtattactgaagatgatttacaaaatgaagctaaaattactgacataatggaaccagaacatgcattactagccacatccattttcaagctgacataccaaaacaaagttgttcgagtccaaagaccggccaaaaacggtactgtgatggacgttatatcaagacgtgatcaaaggggtagtggacaagttggaacttatggattaaatactttcactaacatggaggttcaattaatccgacagatggaaagtgaaggtatatttttaccgtctgaactcgaaactcccaatctcgcagaacgagtgttggactggctagaaaaacatggagcagaaagactaaaacgtatggctatatcgggagacgattgcgtggtaaaacccattgatgacagattcgcaacggcattgactgcactcaatgacatggggaaagtacgaaaagacataccgcagtgggaaccttctaaaggatggaacgattggcaacaagtaccattctgtagccatcattttcatcagttaatcatgaaagatggtcgagaaatcgtggtaccttgtaggaatcaagacgagctcgtgggtcgtgcacgtgtttcacaaggggcaggttggtcactacgtgaaacagcttgcctaggtaaatcttatgcccaaatgtggcagcttatgtattttcacaggagagatttacggttagcagccaatgcgatatgctcggcagtgccagtagattgggtacctacttcaagaacaacttggagtatccatgcacatcaccaatggatgacgacagaggacatgctgagcgtctggaaccgagtttggattgaagagaatccgtggatggaagataaaactcacgtgagcagttgggaagaagttccatatcttggaaaaagagaagatcaatggtgtggatcgcttatcgggttgacagctagagccacgtgggcgacgaacattcaagtcgcaataaaccaagtacgtaggttaattggaaacgagaattacctggattatatgatttcaatgaaaagatttaaaaatgaatccgatcccgaaggtgccttgtggtaa

SEQ ID NO: 21310 - RNA, 9879 nt, synthetic construct
  misc_feature 1..9879: note = derived and/or modified CDS sequence (opt6) from DENV-1__JN819402__SS-prME
  source 1..9879: mol_type = other RNA
tctgtaactatgctactcatgttgctacccacagctcttgcatttcatctgacaaccagaggaggtgaaccacacatgatagtatccaaacaagaacgtggaaaaagtctgttatttaaaacatcggccggagtaaatatgtgtacattaattgcgatggaccttggagaattatgtgaagataccatgacatacaaatgtccacaaataactgaagctgaacctgacgacgttgattgttggtgcaatgcgacggacacttgggtcacatacggaacatgttcacaaactggcgaacatcgacgagacaaaagatccgttgccctagccccacatgtcggcctcggattggaaacgcgaacagaaacctggatgagttctgaaggagcctggaaacaaatccaacgggtagaaacatgggctctacggcatcctgggttcacagttattgcattattcctagcgcatgcaataggtacatctatcactcaaaaaggcataatattcatattgctcatgctggttactccatcaatggcaatgagatgtgtcggtataggaaatagagatttcgtagaaggcttatctggagcaacatgggtagacgtggtactagaacatggttcctgcgtcacaacgatggctaaaaacaaacctactctggatatagaattattaaaaacagaagtaactaatcctgctattctgcgaaaactatgtatagaggctaaaatatcaaacacgacaaccgatagtagatgtccgacccaaggagaagcaacgcttgtggaagaacaagacgccaattttgtctgcagaagaacttttgttgacagaggatggggcaatgggtgtggcctattcggcaaaggatctttattaacatgtgcaaaattcaaatgcgttacgaaattagagggaaaaattgtccaatacgaaaatttgaaatacagcgttatcgtaacagtacacactggtgaccaacaccaagtcggcaatgagaccacagagcatggaactatagctacaattacaccacaagcaccaaccagtgagatacaattaacagattacggagcgttaacattagactgcagcccacgaactggtttagattttaatgaaatggtcctgttgacaatgaaagagaaaagctggctagtccacaaacaatggttcctggatttgccattaccgtggactagcggagcttccactagccaagagacatggaatcgtcaagacctattagttacatttaaaactgcgcacgctaagaaacaagaggtagtcgttttaggatcccaagaaggtgcaatgcatacggccttaaccggtgcaaccgagatccaaacctcaggaacgacgactattttcgcagggcatttaaaatgtagactgaaaatggacaaacttacactaaagggcacaagctacgtaatgtgtacgggatctttcaagctggagaaagaagtggcagaaacacaacatggtaccgtactcgtgcaagttaaatacgaaggaaccgatgccccatgtaaaattcccttttcaacgcaggatgaaaagggagttacccagaacggaagactgataacagcaaatccaatagtcaccgacaaagaaaaaccagttaatatcgagacagagcctccattcggtgagtcgtatatagtggtaggagcgggggagaaagctcttaaactatcttggtttaagaaagggagcagcataggcaagatgtttgaggccacagcgcgtggcgctcgtagaatggctattttaggagacactgcatgggatttcggtagtataggcggagtctttacatcagtaggaaagttagttcaccaagtattcggaaccgcctacggcgttctattctctggggtttcatggacaatgaagataggcatagggatcttattaacgtggctgggtttaaacagtcgctcaacatctctttcaatgacctgcatagcagttggtatggtaactctatacttaggtgtaatggtacaggcagattctggctgtgtcataaactggaaaggaagagaattaaagtgtggttcaggtatatttgttaccaatgaagtacatacatggacagaacaatacaagtttcaggctgactctccgaagagattaagtgcggccattggtaaagcctgggaggaaggcgtatgtggaatccgatcggcgactcgcctcgaaaacattatgtggaaacagatatctaatgaattgaatcacattcttcttgaaaacgatatgaaatttacagttgtagtgggcgacgctaatgggatcttagctcagggtaagaaaatgatacgaccccagccaatggaacataaatattcctggaagtcctggggcaaagcaaagataattggtgccgacatacagaacacaacatttataattgatggacctgacactcctgagtgtcctgacaatcaaagagcttggaacatttgggaagtagaagattatggttttggaatctttactacaaatatatggctcaaattaagagattcttatacacaaatgtgcgatcatcgactgatgtcagctgcaattaaggattctaaagcggttcatgctgacatgggctactggatagaaagtgagaaaaatgagacctggaaactcgcgagggctagtttcatagaggttaagacatgtacctggccgaaaagccatactctatggtcaaacggtgtacttgaaagtgagatgattatccctaagatatatggtgggccgatttcgcaacataattaccgtcctggttacttcacacagacagccggtccctggcacttaggcaaactagagcttgattttgatctatgcgaaggaacaacagtggttgtcgatgaacactgtggaaatcgcggaccatcactacgcactactacagtcacaggtaagattatacatgaatggtgctgccgctcctgcacgttacccccacttagattccggggagaagatggatgctggtacggaatggaaattagaccagtaaaagaaaaagaggagaacctcgtacgaagcatggtttctgcagggtcgggcgaggtggactctttctctctaggtatcctttgtgcttcaataatgattgaagaggttatgcgttcacgatggtctagaaaaatgcttatgaccggtacactagcggtctttttactcttaataatgggacaactaacgtggaatgatttaatacgactatgtattatggtaggagccaatgcaagtgatagaatgggtatgggaacaacttatctggcgcttatggccacttttaaaatgaggccaatgtttgcggtaggcctactatttcgtaggctgacctcccgtgaagttctactcttaaccataggattatcgttagtagcgtctgtagaactgcctaatagtcttgaagaactgggagatgggctagctatgggaataatgatgctgaaattactaacagaatttcagccacaccaactctggacaactcttctttcactaacttttataaaaacaacacttagtctagactacgcatggaaaacaacagctatggcactttcaatagtctcattatttcctctttgtcttagtactacgtctcagaaaacaacctggcttccagtcctactaggctcttttggttgcaaacccttaacgatgtttctaattaccgaaaataaaatatggggacggaaatcgtggccccttaatgaaggcataatggcgatcggtatagtctctatactactgtcttcattgcttaaaaatgacgtacctctagccggaccattaattgcaggcggaatgttaatcgcatgctatgtaataagtggttcctctgcagatctttcattggaaaaagcagcagaagtgtcgtgggaacaagaggccgaacacagtggcacgagtcacaacattcttgttgaagtgcaggatgatgggacaatgaaaatcaaagacgaagaaagggatgacactctaacaatactattaaaagcaacactgttagcagtatcaggagtctacccaatgtcaatacccgctacattattcgtctggtatttctggcagaagaagaaacagcgtagtggagtgctctgggatacgccaagtcctccagaagtggaaagagcagtactagatgacggcatatatagaatacttcagagaggcttattaggccgttcgcaagttggggttggagtttttcaggacggagtatttcatactatgtggcatgtcacgcgaggagcagtattaatgtatcagggaaaacggttagagccctcgtgggcatcagttaagaaagatttaataagctatggagggggttggaggtttcagggctcgtggaatacaggagaagaggttcaagtaatagcagtagaaccaggtaaaaatcccaaaaatgtccaaacaacgcctggaacgttcaaaactccagagggggaagtgggagcgattgctctcgacttcaagccagggacttccggatctccgattgttaacagggaaggtaaaatagtaggattgtatggcaatggcgtagttacaacttcagggacttacgtttccgctatagcccaggcaaaagctagtcaagaaggacctctccctgaaatagaagacgaggtttttaagaaacgaaacttaacgataatggacttacaccctggaagcggcaaaacacggcgatatctgccagccatcgtacgagaagccatcaaacgcaaactccggactctgatattagccccaacgagagtcgtggctagcgaaatggctgaggctttaaagggaatgccaatacgatatcaaacaacagcggtaaagtcggaacacactggacgagaaatagttgatctaatgtgccatgcgaccttcacaatgcgacttctatcaccagttagagttcctaattacaatatgattattatggatgaagcacatttcacagatccagcaagcattgcagctcgggggtatatttcaacaagagtcggtatgggagaggcggcggcaatattcatgacggctactccacctggaagtgtcgaagccttcccgcaatctaacgccgtaatccaagacgaagaacgagatatacccgagcgatcgtggaactcaggttatgattggataacagacttccccggtaaaactgtgtggttcgtacccagcattaaatcgggaaatgatatcgcaaattgtttaaggaaaaatggtaaacgagtaatacaactgagccgcaaaacttttgatacggaataccagaaaaccaaaaataacgattgggactatgtagtgacaacggacatatctgagatgggggcgaactttagagcggaccgcgttatagatccaaggcgttgcttaaaacctgtaatacttaaagatggcccagaacgagtaatattagcgggacccatgccagtaaccgtagcgagtgctgcacaacgtcgtggacgaattggccgaaaccaaaacaaagaaggtgaccaatacgtgtacatgggccagccattgaacaatgacgaggaccatgctcactggacagaagcaaagatgcttctagacaatattaataccccggaaggcattatacccgcgctatttgagccggaacgagaaaaatccgcagctattgatggtgaataccgattaagaggagaagcaagaaaaacctttgtggaattaatgcggagaggggacttaccagtctggctatcatacaaagttgcctccgaaggctttcagtactccgaccgacgttggtgtttcgacggcgaaagaaacaatcaagttctagaagaaaatatggatgtagaaatatggaccaaagaaggagaaaggaagaaattaaggccaaggtggctggatgcccgcacttattctgacccgttagcactaagggagtttaaggaatttgccgcaggtcggagatcagtatcaggggacctaatattagaaatcggaaaattaccccaacatctcactttaagagcacaaaacgcattagataatttagtcatgctacataattccgaacaaggaggtaaggcatatcgtcacgcaatggaggaactacccgatacaattgaaaccttaatgctactcgctctaattgccgttttaacgggtggtgttaccctattctttttgagtggtaagggattaggaaaaacctctatagggctcctctgtgtaacagcatcatctgctttattatggatggcatcagtggagccgcattggatcgctgcatcgataatcctcgagttctttctgatggttcttttaataccagaaccagatcgtcaacgaactccccaggacaatcaacttgcatacgtggttattgggctcctattcatgatactaactgttgctgcgaacgaaatggggttactagaaactaccaagaaggatttgggtataggacatgtggcggctgaaaatcatcaacatgctaccatgcttgatgtagacttacgtcccgcatcggcgtggactttatacgctgtagcaacaacggttataacacctatgatgcgacacaccatagaaaataccacagcaaatatttcactaacagccattgcaaatcaagcagctatattaatgggtctcgataagggatggccaattagcaaaatggatataggagtacccctcctggccttaggatgttattcacaagtaaatccactaactttaacagcagcagtactaatgttagtcgcacactatgcaataataggaccaggtctccaggcaaaagcaacgagagaggctcaaaagcgaacagcggccggaatcatgaaaaacccaaccgtagatggaatcgttgctatagacttagatccagtggtctatgatgcgaagttcgaaaaacaattaggacaaataatgttgctaattttatgtactagccaaatactcctcatgaggacaacttgggcgttatgtgaatcaataacattagcaacaggaccacttacaaccttatgggagggatcccctggaaaattctggaatactacaatcgcagtaagcatgactaatatatttcgaggttcttatttagcaggagcaggacttgcattttctctgatgaaaagcctaggaggcggccggcgaggcactggagctcaaggagaaactttaggagaaaaatggaaaagacaattaaatcagttaagcaaatcagaatttaatacttataaaagatcgggaattatggaagtggatcgcagcgaagcaaaggaaggtttaaagcgaggcgaaacaaccaaacacgcagtaagccggggcacagccaaactgagatggttcgttgaacgaaacttagttaaacctgaaggaaaagtaattgacttaggttgtgggcgaggcggatggagctactactgcgcgggtctaaagaaagtaactgaagtgaagggttatactaaaggaggtcctggtcatgaagaaccgattcctatggctacatacgggtggaacttagtaaaactacacagcgggaaagacgtgttctttatgcctccagaaaaatgtgatactctattatgtgacattggcgagagctcgccgaatcctacgatagaagaaggacgcacactaagagttttaaaaatggtagagccttggcttagagggaatcagttttgtattaaaatattaaacccatatatgccatccgtagttgaaacgttagaacaaatgcaacgtaagcacggagggatgttagttagaaatccgctcagtcgaaacagtactcacgagatgtattgggtcagttgtggaacagggaatattgttagtgcagtaaacatgactagcaggatgctactaaatagatttacaatggctcacagaaaaccaacgtatgaaagggacgtggatctcggcgcaggcactaggcatgtagcagtggagcccgaggtcgcgaatttggatataatagggcaaagaatcgagaatatcaagaatgagcacaaatctacatggcactatgatgaagataacccttataaaacgtgggcataccacggtagttatgaagtcaaaccttctggaagtgctagttccatggtgaacggcgtggtacgtttattaacaaaaccatgggatgtgattcccatggtgactcaaattgcaatgacggatactacaccatttggacagcagagggtttttaaagaaaaagtagatacgcgtactcctcgtgctaaaagaggaaccacacagattatggaagtgacagcgaaatggctatggggcttcctatcgcggaataagaaacctcgaatttgtacacgagaagaatttacaagaaaggtaagaagtaacgcagcaattggtgctgtatttgtagatgaaaaccagtggaactcagctaaggaagctgtggaagacgaaagattttgggacctagtacatagggaaagggagctacacaaacaaggaaaatgcgcgacatgtgtttataatatgatggggaaacgggagaagaaactaggtgaatttgggaaggccaaaggatcgcgcgcaatttggtatatgtggctaggcgcaagattcctagagtttgaggctttaggtttcatgaatgaagatcactggtttagtcgagaaaattccttaagtggagtcgaaggagaaggacttcataaattgggatatatactgcgtgatatcagcaaaattcccggcgggaacatgtatgcggatgataccgcaggatgggatacaagaattacagaagacgatttacagaacgaagcaaagataacggatattatggaacccgaacatgcacttcttgctaccagtatattcaaacttacatatcaaaacaaggtagtgagagtacaaaggcccgctaaaaatggaaccgttatggacgtaatatccagacgagaccaacgaggttcaggacaagtgggcacgtatgggttaaacacgttcacgaatatggaagtgcaattgataagattaatggagtctgagggtattttcttacccagcgaactcgaaactcctaatttggccgaacgagtcctggattggttggaaaagcatggcgccgaacgattaaaacgaatggcaatcagtggagatgactgcgttgttaagcccatagatgaccgattcgctactgcattaaccgcactgaatgacatgggtaaagtaagaaaggatataccacaatgggagccctcaaagggatggaatgattggcagcaagtgccattctgtagccaccattttcatcaacttataatgaaggacggaagagaaatagtggttccgtgtcgaaatcaagacgaattagtaggtagagctagggtatcccaaggggctggttggagcttaagagaaacggcgtgtttgggaaagtcgtacgctcagatgtggcaactgatgtacttccatagacgcgacctccggctcgcggcaaatgcgatatgctctgcagtaccggtagactgggtaccgacgtctagaacaacatggtctatacatgctcaccaccaatggatgactaccgaagatatgttaagcgtatggaatcgtgtgtggatcgaagaaaacccatggatggaagataaaacccatgtttcctcgtgggaggaagtgccatatttggggaaacgagaagatcagtggtgcggatccctaattgggctaacagctcgagcaacatgggctactaacattcaagtggctatcaatcaggtccggcgtttaataggaaatgagaactatttagactacatgacttccatgaaaagatttaaatcagagtctgaccctgaaggtgccttatggtaa

SEQ ID NO: 21311 - RNA, 9879 nt, synthetic construct
  misc_feature 1..9879: note = derived and/or modified CDS sequence (opt6) from DENV-1__FJ850113__SS-prME
  source 1..9879: mol_type = other RNA
tcagttactatgcttctaatgttattacctactgcattagctttccatttgactacccgaggaggagaaccacatatgatagtatccaaacaagaacgaggtaaatccttactgttcaaaacttcagcgggcgtcaatatgtgcactttaatagcaatggatctaggtgaactttgtgaagatactatgacttacaaatgcccacagataacagaagcagaacctgatgatgttgactgctggtgcaacgctaccgatacgtgggtgacctatgggacttgttcacaaactggggaacataggagggataaacgttctgttgcattggcacctcatgtaggactggggttggaaactaggactgaaacttggatgagctccgaaggtgcttggaaacaaattcaacgagtagagacatgggcattacgccacccagggtttacagtaattgcactatttttggctcacgcaatcgggacgagcattacacaaaaaggaatcatatttatattgcttatgctagtcactcctagcatggcaatgaggtgcgtcgggattggtaatcgtgacttcgtcgaaggactatctggggcaacatgggtagacgtggtattagagcatggtagttgcgtaactactatggccaaaaataaaccaacactagacatagaattactaaaaacagaagtaacaaatccagctatattaagaaaactatgtatagaagcaaagatatcaaacacgacaacagactcgaggtgtccgacgcagggtgaagcgactttagtggaggaacaagatgccaattttgtttgcagacgtacattcgtagacagaggttgggggaatggatgcggcctcttcggaaaaggatcattactcacatgtgccaaatttaaatgtgttacaaaactagagggaaagatagtccaatatgaaaatttaaaatattctgtaatagtaacagttcacactggtgatcaacatcaagtcggaaacgaaacaacggagcatggaacaattgcgactatcacaccccaagcacccaccagcgagatacagttaactgactatggtgccttaacattagattgctcccctagaactggtttagactttaatgaaatggtattattaactatgaaagaaaaatcatggcttgtacacaaacagtggttcttggaccttccccttccatggacttcaggagccagtacatcccaggaaacctggaaccgacaagacctattagtaacttttaagacggcccacgcaaagaaacaggaggtagtagtattaggatcacaggagggtgctatgcatacagcactcacaggcgccacggaaatacagacatcgggcactacaactatattcgcaggtcatcttaaatgcagacttaaaatggataaacttactcttaaaggaacaagctatgtgatgtgcactggctccttcaaacttgagaaggaggtcgccgagactcagcacggaactgtcttagtgcaagtgaaatacgaaggtacagatgctccttgtaaaattccattttccacacaagacgaaaaaggtgttactcaaaatggaaggcttataacagcaaacccaatcgtgactgacaaggaaaaacctgtcaacatagagacggagcccccatttggcgagtcatatatagtagtaggagctggtgaaaaagccctaaaactatcttggtttaagaaaggttcttcaatcggtaaaatgtttgaggccactgcacgcggagcgcgtagaatggctattttaggtgacactgcttgggactttggttcaatcggaggagtattcacatccgttgggaaactggttcatcaagtatttgggacagcatacggtgttttgttctcaggagttagttggacgatgaaaataggcataggtatcttgttaacttggcttggccttaactccaggtcgacatcactatcaatgacatgcattgctgtgggaatggttacattgtatctaggtgttatggtacaagcagacagcggatgcgttataaattggaaagggcgtgaattgaaatgtggaagcggaatatttgtaaccaacgaagttcatacatggacggaacaatacaagtttcaggctgattcaccgaaaagacttagtgccgccataggcaaagcctgggaagagggagtatgtgggataaggtcagcgacacggttagaaaatataatgtggaaacagatctcgaatgaattaaaccatatattattagaaaatgatatgaaattcacggttgtagtaggagatgcgaatggcattctagcacaagggaagaaaatgatccgaccacaacccatggaacataaatacagttggaagtcttgggggaaagcgaaaatcatcggtgcagatatacaaaatacgacctttattatagatggtccggacacgcccgaatgtccagacaaccagagggcgtggaatatatgggaagtagaggactatggctttgggatatttactacaaatatttggctaaaattaagagactcgtacacccaaatgtgtgatcatcgactgatgagtgcagcgattaaggacagcaaagcagtacacgctgacatgggttactggatagaaagtgaaaagaatgaaacttggaaactagctcgcgcgtcgttcatcgaagtcaaaacctgtacatggccaaagtcacacaccttgtggtcaaacggagttcttgaatcggagatgataataccgaaaatatatggcggacccatctctcaacacaattatagacctggttactttacccaaacagcagggccatggcatttgggtaaattagaattggacttcgatctatgtgaaggtacaacagtagtagttgatgaacattgtggaaacagaggtccatcactgcgtacaacaacggttactggtaaaataattcatgaatggtgctgtagatcttgcacattaccaccacttcgttttcgtggagaagatggttgctggtatgggatggaaatcaggccagtcaaagagaaagaggagaatctagtaagatcaatggtatccgcaggtagcggagaagtagactcttttagtctaggaattttatgcgcaagcataatgatagaagaagtcatgagaagtaggtggtcacgcaagatgctaatgacagggactctggcagtctttctattactgataatgggtcaattaacttggaatgacttgattcgactgtgtattatggtcggcgcaaatgcttcggatagaatgggaatgggcactacatatttagcattgatggcaaccttcaaaatgaggcctatgtttgctgtaggtttattatttcggcggttaacaagtcgcgaagtattgttattgacaattggactgtctctagttgcgtcagtcgaattaccaaacagcttagaggaattgggagatggactagcgatgggaataatgatgctgaaactgcttactgagttccaaccacatcaactatggaccactctcctaagtctgacatttataaaaactactttatcactcgattacgcttggaagacaactgccatggttctttctatagtctcattatttccactatgcttatcaactacatctcagaaaactacttggcttccagtactgctcggatcctttggttgtaagcccctaaccatgtttttaataactgaaaataaaatttggggaagaaaatcgtggcccttaaacgaaggaataatggccatagggattgtctccatcttattgtcgtcattactcaaaaatgatgtgccgttggcaggacccctcatagctggaggaatgttgatcgcatgctatgtgataagcggatcaagcgcagatctatcacttgagaaagcggcagaagtaagttgggaacaagaggccgaacactcgggaacaagtcataacattctagtcgaagtacaagatgatggaacgatgaaaataaaagacgaagaacgtgatgacaccctaacaatcttactaaaagcaacgttacttgcagtttccggggtatatccaatgagtatccctgcgactctctttgtatggtacttctggcaaaagaagaaacaaagatctggagtattgtgggatacccccagtcctcctgaagtagaacgagcagtgcttgatgatgggatttacaggattctccaaagaggactgcttgggcgaagtcaagtgggagtgggagtttttcaagacggagtatttcatactatgtggcatgttacaaggggagccgtcttgatgtaccaaggcaaaagacttgaaccatcttgggctagtgttaagaaagatctaatttcttatggtggagggtggcgtttccaaggttcctggaacacaggagaggaagttcaggttatagcagtagagccaggcaaaaaccccaaaaacgtacaaacaactccaggaacatttaaaacacctgaaggtgaggtaggcgcgatagcactggacttcaaaccgggcacaagcggatcaccaatagtaaatagagaggggaaaatcgtgggcttgtatggaaacggcgtcgtaacaacatctggtacatatgtaagtgcaatagctcaggctaaagcatcccaggaaggtcccttgcccgagattgaagatgaagttttcaagaaacgaaatttaactattatggatctacaccctggatcagggaagactcgtcgttatttaccagcaatcgtaagggaagcaatcaaacgcaaactacgcacacttatattagcgcctacaagagtcgtagcaagtgagatggctgaggcactaaaggggatgccaatacggtaccaaaccaccgctgtaaaatcagaacacactggcagagaaatcgtagatcttatgtgtcacgcgacctttactatgagactgctctcaccagtgagagtacctaactataatatgattataatggatgaagctcatttcacagatcctgcatctatagcagctcgagggtatattagtaccagagttggaatgggagaggctgccgctatttttatgacagcgacgccgcccggaagcgtagaggcatttcctcaatctaatgctgtcatacaagacgaggagagagatataccagaacggagctggaactcaggctatgattggattactgactttccaggaaagactgtctggttcgtcccatcaatcaaatccgggaacgatatcgctaattgcctacggaaaaacgggaaaagagttatacaattgagcagaaaaacctttgataccgaataccagaagactaaaaataatgattgggattatgtagtaaccacggatatatctgaaatgggggctaattttagagcagaccgagttattgatccaagaagatgtctaaaaccagttatactaaaggatggacctgaaagagtcatcttagctggaccaatgccagttacagtagcatctgcggctcaacggagaggtagaataggtcgaaatcaaaataaagagggtgatcaatacgtgtacatgggacaaccattaaataacgatgaggatcatgcacattggactgaagcaaaaatgttgttagataatataaacacaccggagggtataattccagcactgttcgaaccggaacgagaaaaatcagctgctatagatggagaatataggttaagaggagaagccagaaaaactttcgttgagctaatgagacgtggagacttgccagtatggttaagctataaggtggcaagcgaaggatttcaatattcagacagacgttggtgctttgatggtgaacgcaataaccaggtgctagaagagaacatggatgtagaaatttggactaaggaaggtgagaggaagaaactacgacccaggtggttagatgcgagaacttattcagacccactagcattgcgtgaatttaaagaatttgcggcgggccgccgcagtgtatcaggtgacttaatcctggaaattggcaaactcccacagcacctgacactacgcgcgcaaaacgcgctagacaatctggtcatgttacataactcagagcaagggggtaaagcctatcgccacgccatggaagaactaccagacaccattgaaactttaatgctactagccttaattgcggttctaactggaggcgtaactttattctttctatctggaaagggactaggaaagacttcaatcggtttactgtgtgttaccgcaagctcagcgcttttgtggatggcaagtgtagagcctcattggattgcagcctctataatattagaatttttcttgatggtcttattgattcccgagcccgatcgtcagagaactccgcaagacaaccagttagcgtacgtagtgattggtctattgttcatgatattgacggtagccgcaaatgaaatggggttgcttgagacaaccaagaaagatttggggatagggcacgttgcagcagaaaaccaccaacatgctactatgcttgacgttgatctgcgcccggcaagtgcttggacactatatgcagtcgccacaacagttataacgccaatgatgagacacactatagaaaatacaacagccaatataagcctgacagccatagcaaatcaagcagccatattgatgggcttagataaaggatggcctataagtaaaatggatattggggtgccacttctcgcacttggttgctactctcaagtgaaccccctaacgttaacggccgccgttcttatgttagtagcacattacgcaattataggtcctggtttacaagcaaaagctacccgagaagctcaaaaacgaaccgctgcgggcataatgaaaaacccaacggttgatggaatcgttgcgatcgacctggaccctgtcgtatatgacgccaaatttgaaaaacaactaggacaaataatgcttttaatcttatgcacctcacaaattttattaatgcggactacctgggcactttgcgaaagtattacattagccacgggtcctctgacaacactatgggaaggttcaccaggtaaattctggaacacaacaattgcggtctctatggctaacatattcagggggagttacttagcaggggcaggcctagcatttagtctaatgaagtctttaggtggagggcgaagaggaaccggggctcaaggagaaacgcttggagaaaaatggaaaaggcaattaaatcaactttcgaaaagcgaatttaatacttataaaagaagtggaataatggaagtagaccgcagtgaggcaaaggaaggattaaaaagaggagaaacgactaagcacgcggtgtcgaggggaactgctaaattaagatggtttgtggaaagaaacttagttaaaccggaaggaaaggtgatagatttaggttgtggtagaggaggatggtcatactattgcgctggactaaagaaagtaactgaagttaaaggatacacaaaaggtggaccaggacatgaagaaccaatccctatggccacatacggatggaacttggtcaaattgcatagtggtaaagacgtcttctttatgccacctgaaaaatgcgatacactgctttgtgatatcggtgaaagttcccctaatcccaccatagaagaaggccgtacactacgtgtattaaaaatggtagaaccatggttgagaggtaaccaattttgcattaaaattctcaatccttacatgccgtccgttgtagaaaccctggaacaaatgcagagaaaacacgggggaatgttagtgcgtaaccctttaagccggaacagcacacatgagatgtattgggtatcctgcgggacagggaatatagttagtgcagtaaacatgacaagcagaatgctacttaatcgattcaccatggcgcatcgaaaacccacttatgaaagagatgtagatttgggtgcgggcacaagacacgttgctgtagaacccgaggtcgcgaatttggacatcatagggcaacgtatagaaaatatcaaaaatgaacataagagtacctggcactacgatgaagataatccttataaaacatgggcataccacgggtcctatgaagttaaaccatctgggtcagcgagttcgatggtcaacggagttgtgagactattaaccaagccatgggatgtgattcccatggtaacacaaatagccatgacagacactactccattcggtcaacagagagtgtttaaagagaaagtagatactagaaccccaagagcgaaacgaggaacaactcaaataatggaggtgacggcaaaatggctatggggctttctaagtcggaataagaaacccagaatatgcacgagagaagagttcacaagaaaagtaagatcaaatgccgccataggagctgtttttgtcgacgaaaatcagtggaatagtgcgaaagaagcagttgaagatgagcgtttttgggatctagtacatagagagcgtgaactgcataaacaaggaaaatgtgcaacttgcgtatataacatgatgggaaaacgagagaagaaattaggtgagttcggaaaagctaaaggaagccgagcaatttggtatatgtggttaggggcacgttttcttgagttcgaggctctcggatttatgaacgaagaccattggttttcccgagaaaatagtctaagtggggtagaaggagaaggactacataaactaggttacatactgagagatatttccaagatccccggagggaacatgtacgcagacgatacagccggatgggacacacgtataacagaggatgatcttcagaatgaggcgaaaattacagacatcatggaaccagagcatgcactgttagctacgtcgatatttaaactaacatatcaaaacaaagtagttagggtacaaaggccagcgaaaaatggaacagtcatggatgtcattagcaggcgagatcaaagaggatcaggacaggttggcacgtatggtctaaacacttttaccaatatggaagtacaattgattcgacttatggaatctgaaggcatattcttaccctcggagctagaaacgccaaacctagccgagagagttttggattggttagaaaagcacggcgctgaacgcttgaaaagaatggccatctcgggggatgattgtgttgtcaagccaatagatgaccggttcgctacagctcttacagctctaaatgacatgggaaaagtaagaaaggatatccctcaatgggaaccctcaaaaggatggaacgactggcaacaagtgccattctgcagccaccattttcaccaactcataatgaaagatggtagggagattgtcgtaccatgtcgcaatcaagacgaacttgtaggaagggcaagagtgagccagggtgcgggctggtctttacgagaaactgcatgtcttggaaagtcatatgcacaaatgtggcaattaatgtattttcataggcgagatctaagactagcggcaaatgctatctgcagcgcggtaccagtagactgggtaccaacttcgcgaactacttggtcgattcacgcccatcatcagtggatgacaactgaggacatgttgtcagtttggaatcgcgtctggatagaagaaaacccgtggatggaagacaaaacgcatgtatctagctgggaggaggtaccatatctaggcaaaagagaggatcaatggtgtgggagcttaataggccttacggcgagagcgacctgggctacaaacatacaagtcgctataaatcaggtcaggcgcctaataggaaacgaaaactacttggactacatgacctccatgaaaagatttaaaagtgaaagcgatccagaaggagcgctctggtaa

SEQ ID NO: 21312 - RNA, 9879 nt, synthetic construct
  misc_feature 1..9879: note = derived and/or modified CDS sequence (opt6) from DENV-1__JF937635__SS-prME
  source 1..9879: mol_type = other RNA
tcggtaactatgttattaatgttaatgcccactgctcttgctttccatttaactacccgtggaggagaaccacatatgatagtcagtaaacacgaaagaggaaaagcgcttttatttaaaaccagtactggagtcaacatgtgtacattaattgcaatggatttgggagaattatgcgaagacactatgacgtataaatgcccgaggattacagaagctgagcctgacgacgtcgactgttggtgcaatgccactgatacttgggtaacgtacggtacatgttctcaaacaggggaacataggagagataaaaggagtgttgcgcttgctccacatgtaggactaggacttgaaacgagaactgaaacatggatgtctagtgaaggggcttggaaacaaatacaacgagtagagacatgggctctgcgccatcccggattcacggtgatagccctttttcttgcacatgccataggaacatcaattacccaaaaaggcataatttttattctattgatgttggtgactccatccatggcaatgagatgtgtggggattggaaatagagattttgttgaaggattgtcaggagcgacctgggtcgatgtcgtgttagaacatggttcatgcgtcacaactatggccaaaaacaaacccacactagacatagaattgcttaaaacagaggtcacaaatcctgcagtactccgaaaactatgcatagaggctaaaatatcaaatacaacaacagacagcagatgtccaacacaaggcgaagctactttggttgaggaacaagatgccaacttcgtttgcagacgtacttttgtagatagagggtggggcaacggttgtggcctattcggaaagggatcccttttaacatgtgcaaagtttaaatgtgttacaaaattagaagggaaaatcgtacaatacgaaaatttaaaatactcggttattgtaaccgtacatacaggtgatcaacatcaagtagggaatgaaacaacagaacacggaacaattgctacgatcacaccccaagcacccaccagtgaaatacaactaacagactacggtgcacttacactagactgctcacctcggacaggattagattttaatgagatggtattgctaacaatgaaggaaaaatcctggctagtacataaacaatggtttttagatttaccattaccatggacgtctggtgcctctacgagtcaggaaacatggaatagacaagatttgctcgttaccttcaaaactgcacatgctaagaaacaagaagtagtagtattaggcagtcaagaaggagcgatgcacacagccttaacaggtgcaactgaaatacagactagcggaactacaacaatcttcgctggacatctaaaatgtagattaaaaatggataaattaacattgaaaggaacatcatacgttatgtgtacagggtcattcaaactcgagaaggaagtagcggaaacacaacacggaacggtgctggtacaggtaaaatacgaggggacagacgctccctgcaaaattccgttcagtacacaagatgaaaagggagtcacacaaaatgggcgattaattactgctaacccgattgtaacagacaaagaaaagcctgtaaatatagagaccgaaccaccgttcggcgaatcatatatcgttgtaggcgcgggagaaaaagcattgaaactttcttggtttaagaaaggaagcagtatagggaaaatgtttgaagctacagctaggggagctagaagaatggcaattctcggagatacggcgtgggatttcggctccattggaggtgtttttacctcagttggtaaacttgtacaccaggtatttggtacagcatatggagttttattttctggggtaagttggacgatgaaaataggtatcggtatactcttgacatggctcggactaaatagtcgaagtacatcacttagtatgacatgcatcgccgtcgggatggtgaccctttacctgggtgttatggtacaggcagatagcggatgcgtgataaattggaaaggaagagaattgaaatgcgggtcaggaatatttgtcacaaacgaggtacacacttggaccgaacagtacaaattccaagctgactcccccaaaagactttctgcagctatagggaaagcgtgggaagaaggcgtatgtggaatacgaagtgccacgcgattagagaatattatgtggaaacagataagcaatgaactcaatcatatattattggaaaacgatatgaaatttactgtagtggtaggcgacgcaaacgggattctcgcacaaggcaagaaaatgattagaccacaacctatggaacacaaatatagctggaaaagctggggaaaggcaaaaatcataggagccgacattcaaaatacaacgttcattattgatggaccggatactccagaatgccccgatgaccagcgggcatggaatatctgggaggtagaagactacggatttggcatctttacaacaaacatctggttaaaactcagggacagctatactcaaatgtgtgatcacagactaatgtcagccgcaataaaagatagtaaagcggtgcatgcggacatggggtactggatcgaatcagaaaagaatgagacctggaaactcgctcgcgcatcattcatagaagtcaaaacatgtacatggccaaaatcccacacactatggtcaaatggagttttagaaagtgaaatgattataccaaaaatatacggcggtcccatttcacaacacaattacagacctggatattttacgcaaaccgccggcccatggcacttgggtaaattggagttagattttgacctctgtgaaggtacaactgttgtagtggatgagcattgcggtaatagaggaccatcgttacgaaccacaaccgtaaccggaaaaattatacatgagtggtgctgtagatcctgtactttgcctccgttacgatttcgaggggaggacggatgttggtacggaatggaaatccgaccagttaaagagaaagaagaaaacttagtcagaagtatggtaagcgcaggctcgggagaagttgattcgttcagcctaggcatcttatgtgtatcaatcatgatagaagaagtaatgagatcacggtggtcaagaaaaatgttaatgactggaactcttgcggtattcctattgttaataatggggcagctcacttggaatgatttaatacgattatgtataatggtaggtgcaaatgctagtgatagaatgggtatggggacaacgtatctggctttaatggctacttttaagatgcggcccatgttcgcggttggaatcttgttcagacgactaaccagtagagaagtacttttgttaacgattggtttaagtcttgtcgcctcagtagaattgcctaatagcctcgaagaactgggtgacggcttggccatgggtataatgatgcttaaattattaacagaatttcaaccacatcaactatggaccacgttattgagcctgacatttatcaaaactacactttctctagattatgcatggaaaaccacggccatggcgctcagtatcgttagcttatttcctctctgcttatcaactacaagccagaaaacaacctggctgccagtattactgggatctttcggctgtaagccgcttacaatgttcctgattacagaaaataaaatatggggtagaaaaagttggccgatcaatgaaggaatcatggctataggtatcgtcagtatattactctccagtttgctcaaaaatgatgtccctctcgcagggccacttatagcagggggaatgctaatagcctgttacgtaatttcaggctcaagtgcagacttatcacttgaaaaagcggcagaggtcagttgggaacaggaagcagagcactcaggcacatcacataatattcttgtcgaggtacaagacgatggtacgatgcgcattaaggatgaggagaaagacgacacattgacaatattactgaaagctacgctacttgcagtaagcggagtttatccgatgtctataccagcaactctttttgtttggtacttctggcaaaagaagaaacaaagatcaggagttctttgggatacaccttccccaccagaagtagaaagggcagtactagacgatggtatttatcgtattctacaacgaggtcttctaggtagatcacaagtaggagtaggagtatttcaagatggggtatttcacactatgtggcatgtgacacgaggagcagttttaatgtatcaaggaaagcggctagaaccctcgtgggcctccgtgaagaaggatctgatatcatatggtggcggttggagattccaaggttcttggaatacaggagaagaagtgcaggtaattgcagtggaaccgggaaagaatccgaaaaatgtccaaacaacacccgggacttttaaaacctcggaaggagaggtcggagccattgccttggactttaaaccgggcacatcaggatcaccaatcgtcaatcgagaaggcaaaatcgtcggcctttacggaaacggtgttgtaaccacaagtggtacttacgtatcagcgatagctcaagccaaaacatctcaagagggacctcctccagaaatcgaggatgaagttttcaagaagagaaacttaactataatggatcttcatccgggtagtgggaagacacgccgttatctcccagccatagtccgggaagctattaagagaaaactgaggacacttatcttggcaccaacaagggtagtcgcgtcggaaatggcggaggcattgaaaggcatgcccatacgataccagaccactgcagtaaaaagtgaacatactggaagggaaattgtagatctcatgtgtcacgcaacatttactatgaggttgctaagtcctgtgagagtgccaaattataacatgatcataatggacgaagcacatttcacagatccagcttcaattgctgcaagggggtatattagtacacgcgtgggcatgggagaagctgcagcaatcttcatgacggcaacacctccaggatcagtagaggccttcccgcagtccaatgcagtaatacaagatgaggaaagagatataccagaacgatcatggaatagtggttatgattggataacagactttccaggtaagacggtgtggtttgtcccttcaataaaaagtggtaatgatatcgcgaattgtcttaggaaaaatgggaaacgggtaatacagcttagtagaaaaacctttgatacggaataccaaaagaccaaaaacaacgattgggactatgtagtgactaccgatattagtgaaatgggtgctaactttcgcgcagatcgagttatagacccaaggagatgtttaaagcctgtaatactgaaggacggaccggagcgggtaatattggccggacccatgccggttactgtcgctagcgcagcccagaggcgtggtagaattgggaggaaccagaacaaagaaggagaccaatatgtttatatgggacaaccacttaataacgacgaagatcacgcacattggacagaggcaaaaatgttattggacaatataaacacacctgaaggcataataccggctttatttgaaccggaacgagaaaaatccgcggcaatcgatggagagtaccgcttgcgtggtgaagcaaggaaaacattcgttgaattgatgagaagaggcgatctaccagtatggttatcgtataaagttgcatcagaaggattccaatatagtgatagacgatggtgttttgatggagaaagaaataaccaggttttagaagaaaatatggatgtagaaatatggacaaaagaaggggaaagaaagaagttacgacctcgctggcttgacgccagaacatatagtgatcctcttgcattaagggaatttaaagaatttgctgccggaaggaggtcggtttcgggagatctaatcttggaaattggcaaacttcctcaacacttaactttaagagcgcaaaatgctttggacaatttagtaatgttacacaattcagagcaaggaggtaaagcgtaccggcatgcaatggaggagctcccagacacaattgaaaccctcatgttactcgccttgatagcagtcttaacaggcggtgttactttatttttcttgtccggaaaaggattaggaaagacatctatcggactactctgtgtaacagcctcgtcagctctcttatggatggccagcgttgaaccccattggatagcagctagtatcatcctagaatttttcttaatggtattgttaataccagaaccagatagacaaagaacgcctcaagataaccaactagcttatgtagttatagggttattatttatgattttgactgtagcggcaaacgagatgggactattggaaaccacaaaaagagatttaggaatcggtcacgttgccgcagaaaaccaccagcatgccacaatgctggatgtagatctaagacctgccagcgcatggaccctatacgcagtagcaactacggtcataacacctatgatgagacatactatcgaaaatacaacagcgaatatatccttaaccgctatagctaatcaagcagcaatcttaatggggcttgataagggatggccgataagtaaaatggatataggagtcccattacttgcattaggttgttactctcaggtaaaccccttgacactaacggcagctgttctgatgctagttgctcactatgcaattataggtcccggccttcaagctaaagcaacacgtgaagctcagaaaagaactgccgcaggaataatgaaaaatccgactgtagatggtattgtagccattgatctagatcccgtagtgtatgatgccaagttcgaaaaacaattaggacaaataatgctacttatattgtgcacatcccaaattttattaatgcgaacaacatgggcattatgtgaaagcatcacgcttgcaacaggaccacttacaactctatgggaaggaagcccaggaaaattttggaacactactatcgcagtgtcaatggcaaatatatttcgaggttcatatttggccggagcagggttggcattctcactcatgaaatcgctaggaggtgggagacgtgggacaggggctcaaggggaaacattgggtgaaaaatggaaaagacaattaaatcagcttagcaaaccagagttcaatacatacaaaaggtcaggaattatggaagtagacagaagtgaagcaaaagagggcttaaaacgcggcgagacaaccaaacatgctgtttcacgaggcactgcaaaactgagatggtttgttgaacgtaatctagttaaaccagaaggaaaagttattgatttaggatgtggccgcggtgggtggtcatattactgcgcgggactaaagaaagtaactgaagtaaaaggctacacaaaagggggccctggacacgaggaaccaatacctatggcgacttacggatggaacctagtgaaattacattcaggaaaagacgtcttctttatgcctcccgaaaagtgcgatacactgctttgcgatataggggagagctcaccgaatccaaccattgaagaaggaagaactctaagagtactaaaaatggtcgaaccttggttacgtggtaaccagttctgtatcaaaatattaaatccctatatgccgtctgtagttgaaactctagaacaaatgcagagaaaacatggtggtatgctagtacgaaatcctctttctaggaatagcactcatgaaatgtattgggttagttgtggtacagggaatatagttagtgctgttaatatgaccagccgtatgctattgaataggtttacaatggcccatagaaagccaacttatgaacgcgacgttgacttgggagcaggaacaagacatgttgcggtcgaaccagaagtagcaaatctagatatcattggacaaagaatcgaaaatatcaaaaacgaacataagagcacctggcattatgatgaggacaacccctataaaacatgggcctaccatggatcatatgaggtaaagccttcgggctcagctagtagtatggtaaacggtgtagtccgactgttgacaaagccctgggatgtaatcccgatggttactcaaattgcaatgacagatactacaccattcggacaacaaagagttttcaaagagaaagtcgacactaggacgccacgtgcgaagagaggcacgactcaaataatggaggtgaccgctaagtggctgtggggctttctatcacgtaacaagaaaccgcgaatctgcactagggaagaatttactcgaaaagtccgctcaaatgccgcgataggggcggtttttgtagacgaaaatcaatggaactctgcaaaagaagctgtagaggacgaaagattttgggacttagtacatcgagagcgagaacttcacaagcaaggaaaatgcgcgacatgtgtttataacatgatgggaaaacgggagaagaaattaggcgagttcggaaaggcaaagggaagtcgtgcaatctggtatatgtggttaggagcaagatttttagagtttgaggccctaggctttatgaatgaagaccactggttttcaagggagaatagcctaagcggagttgaaggtgaaggtttacataagttgggatatattttgagagacatctcaaaaatacccggtgggaatatgtacgcagatgatacagcaggttgggatactagaataacagaagacgacctccaaaacgaagccaaaatcactgacataatggaacctgaacatgctttgttagcaacatccatatttaaacttacatatcaaaataaagtagtcagagttcaaaggccggccaaaaatggcacagtcatggatgtcataagtcgtagagaccaaaggggaagtggacaagtcggtacatacggactaaatacatttacaaatatggaagtacaacttatacgacaaatggagtctgaaggaatcttcctaccttcagaattagaaacaccgaatctggctgagagggtactcgactggttagagaaacacggtgctgagagattaaaacggatggccatttctggagatgactgtgttgttaaacctatagatgatagatttgctacagcactgactgcgttaaatgacatggggaaagtacgcaaagacattcctcaatgggaaccgtcaaaaggatggaatgactggcaacaggtgccattctgctcccaccatttccatcaactcataatgaaggatggacgagagattgtagtaccgtgcagaaaccaagatgagctcgttggacgagcgcgagtgtctcaaggagcgggatggtctttgcgagaaactgcctgccttggaaaaagttatgctcaaatgtggcaactcatgtacttccaccgacgagatttaagactagcagcgaatgctatttgttcagccgtcccagtagattgggtacccacaagtaggacaacctggagtattcatgctcatcatcaatggatgacaacagaagacatgttaagtgtatggaatagggtctggatcgaggagaatccatggatggaagacaaaactcacgttagcagttgggaggaagtaccatacctagggaagcgagaagatcagtggtgcggatcattgataggactaactgctcgggcaacatgggccacaaatatacaagtcgcaattaatcaagtcaggaggctgataggtaatgaaaactatcttgactacatgacatcaatgaaaaggtttaaaaatgaatcagacccggagggagctttgtggtaa

SEQ ID NO: 21313 - RNA, 9879 nt, synthetic construct
  misc_feature 1..9879: note = derived and/or modified CDS sequence (opt6) from DENV-1__FJ024483__SS-prME
  source 1..9879: mol_type = other RNA
agtgtaaccatgttacttatgttgctacctacagcacttgcatttcatttaaccacccgtggtggggaaccacatatgattgtaagtaaacaagaaagagggaaaagtttactatttaaaactagcgcaggggtaaatatgtgcacgcttatagcgatggatctcggtgaactttgtgaagatactatgacatataaatgtccacaaataacagaagcagaaccagacgacgttgattgctggtgcaacgctacagatacatgggtaacatatggcacgtgttctcaaacaggagaacacagaagagacaaaagatcagtcgcattagcgcctcacgtagggttagggttagagacaagaacggaaacatggatgtcatctgagggcgcctggaaacaaattcaacgagtagaaacatgggcactaagacatcctggatttactgtgatagccctttttctagcacatgcgattggcacaagcataacacaaaaaggaattatattcattttactgatgcttgtaacacccagtatggctatgcgatgcgtagggataggcaatagagatttcgttgaaggcttatcgggtgctacttgggtagatgtagttctagaacacgggagctgtgtcacgactatggccaaaaataaaccaactcttgatattgaactactgaagacagaagttacaaatcccgcaatattaagaaagttatgcatagaagccaaaatttcaaacacaacaacggattctagatgtccaacccaaggggaggcaacgcttgttgaagaacaagacgctaatttcgtatgtagaagaacttttgtagatagaggatggggtaacggatgtgggctttttggtaagggatcattactaacctgcgccaaattcaaatgcgtaacaaaattagaggggaagatagtccagtatgaaaacctgaaatattctgttatagtaaccgtacacacaggtgaccagcatcaagtaggtaacgagacaacagaacatggcacgattgcaacaataacaccacaagcacctacgagtgaaatccaattaaccgactacggggcattaactttagactgctcaccacgaaccggtttagattttaacgaaatggtactacttactatgaaagaaaaatcctggctggttcataaacaatggtttttagatctcccactcccgtggacatcaggcgccagcacaagtcaagaaacgtggaatcgacaagatttgttggtaacttttaaaactgcacacgcaaagaagcaagaggtggtagttctaggatcacaagaaggtgctatgcatacagctttaacaggcgcaaccgaaatccaaacaagcggcactacaactatctttgctggtcacttgaaatgtagacttaagatggacaaattaacattaaaaggaacatcttatgtgatgtgtacaggatcattcaaactagaaaaagaagttgctgaaacacagcatggaaccgttctggtacaggttaagtatgaaggaactgatgctccatgtaaaattccgttcagtacacaagacgagaaaggtgtaacgcaaaacggaagactgattacggctaatcctatagtcaccgataaggaaaagcctgtgaacatagaaactgaaccgcctttcggcgagagttacatcgttgttggggcgggagagaaagcgttaaaactctcgtggttcaagaaaggatcttcaattggtaaaatgttcgaagcgacagctagaggtgcacggagaatggcaatacttggtgatacagcatgggactttggaagcatcggaggcgtatttacaagcgttggaaaactcgtccatcaggtgtttggaacagcttacggagtattattctctggcgttagttggacaatgaagataggtataggcatactcttaacgtggctcggactgaactcaagatcaactagcctgagtatgacgtgcatcgcggtagggatggtaacattgtacttgggggtcatggtacaagctgacagtggttgcgtaatcaattggaaaggccgtgaattaaaatgtgggagtgggatatttgtcactaatgaggtacacacttggactgaacagtacaaattccaagctgatagtcctaaaagattatcagcagcaataggcaaagcatgggaagaaggggtatgtggcatacgaagtgcaactcgattagaaaatataatgtggaaacaaattagcaatgaattaaaccatattctattagaaaatgacatgaagtttacagtagtagtaggtgacgcaaatggaatattagcacagggtaagaaaatgataagaccacaaccgatggaacacaaatactcttggaagagttggggaaaagcaaaaataattggagccgatatccaaaatacgacgtttattatagacggcccagatacacctgagtgtccagacaaccaacgggcatggaatatatgggaggttgaggattacggcttcggaatttttacgactaacatatggctaaaactacgagacagttatacacaaatgtgcgaccatcgcttaatgagtgcggcaatcaaagattcaaaagcggtacatgctgacatgggatattggattgaaagtgagaaaaatgagacctggaaactcgcccgtgcatcctttattgaagtgaagacttgtacatggcctaagtctcatacattatggtctaacggagtcctagaatcagaaatgataatcccaaagatatatggcggcccaatttcacaacataattacagaccaggctattatacacaaacagctggaccatggcacttaggtaaactagaactcgatttcgatctctgtgaaggtactaccgtcgttgtcgatgaacactgtggtaatcgaggcccaagcctcagaacgacgacggttacaggtaaaataatccacgaatggtgttgtagatcatgtacactaccacctttaaggtttagaggagaggacggatgctggtacggcatggaaatacgtccagtgaaagaaaaagaagaaaatttagtaagatcaatggtttccgcaggttccggggaagtggattcattttctttaggtatcttatgcgcatctattatgatagaagaggtcatgcgatctcgctggagtcgcaagatgctaatgaccggaactctcgcagtatttctgcttttgataatgggccaattaacctggaatgaccttataagactctgcataatggtgggcgcaaatgcctctgatcgtatgggaatgggaactacctacctagcacttatggcaacatttaaaatgcgcccaatgttcgctgtaggacttttgtttagaaggctaacttcacgagaagtgttactgctcactataggtttaagtttggttgcatcggtggagctacccaattcgctggaagagttaggagatgggttggcaatgggaatcatgatgctcaagctacttacggaatttcaaccgcaccaattatggacaacgttattatctttgacatttattaaaactactctatcactcgattatgcttggaaaactaccgcaatggcgttatcaattgttagcctattcccgctatgcttatcaactactagccaaaagacgacttggctgcccgtactgttggggtcatttgggtgtaaaccattaacgatgtttttgataactgaaaataagatttggggcaggaaaagttggcccctaaacgaaggaataatggcaataggaattgtctcaatattgttatctagtcttctcaaaaacgacgtaccacttgccggtccattaatagcaggaggaatgcttatcgcgtgctacgtaatttcgggaagcagtgcagatctttcgttagaaaaagccgcagaagtgtcatgggaacaggaagcagaacacagtggtacatcacacaatatactcgtagaggtacaagacgacggtacaatgaagatcaaggacgaggaaagggacgatacgttaactatattactaaaagctacattattggcagtttcaggagtatacccgatgagcataccggcaactctatttgtatggtatttttggcaaaagaagaaacaacgaagcggagtcctgtgggacacgccatcaccacctgaagtggagagagctgtcttggacgacggaatttatcggattctgcagagaggccttctgggaaggtcgcaagtaggtgtgggagttttccaagatggagtgtttcatactatgtggcacgttacacggggagcagtgttaatgtaccagggtaaacgactcgaaccaagctgggcctctgtcaaaaaggacctaatcagctacgggggcggatggagatttcaaggtagttggaatactggcgaagaagttcaagttattgccgttgaaccaggtaaaaatccgaaaaatgtccaaaccacgccagggacattcaaaacaccagaaggtgaagttggtgctatagcgttagatttcaagcccggaacaagcggcagcccaattgtaaatagagagggtaagattgttggactgtatgggaatggtgtagtaacaacttcaggaacctatgtatcagctatcgctcaagcaaaggcttcccaggaaggacccttacctgaaatcgaggatgaagtttttaaaaagaggaatttaacaattatggatttacatccaggctctggaaaaacccgaaggtacctaccagctatagtgcgagaggccatcaagcgaaaactgcgtacgctaatactcgcccctacacgtgtcgttgcaagtgaaatggcagaagctcttaaaggaatgcctataaggtatcaaacaactgccgtcaaatcagaacatacaggaagggaaatagtcgatttgatgtgccatgcgactttcacaatgcgtctactatcccctgtccgagttcccaattacaatatgataattatggatgaagcgcactttacagatcccgcctccatagccgcacgaggatatatatctacgcgcgttggtatgggcgaagctgcagctatatttatgaccgcaacacctccgggttcagtagaagcatttcctcaatcgaatgcagtaatacaggatgaagaacgagacattccagaaagaagctggaactcaggatatgattggataacagacttccctggtaaaacggtttggttcgtgccaagtataaaatccggcaatgatatcgcaaattgtctgaggaaaaatggaaaaagagtaattcaactatctcgtaaaacctttgacacagaataccagaaaactaagaataatgactgggattatgtagttactactgatataagtgaaatgggagcaaacttccgagcagatcgagttatagaccctcgccggtgtctgaaacccgtcatccttaaagatggtcccgagagggtaatcctcgctggtccgatgcccgtaactgttgcctcagcggcacaacgccgcgggcgcataggtcgtaatcaaaacaaggaaggagatcaatacgtgtatatgggtcaacccttaaataatgacgaggatcacgcacattggacggaagcaaagatgctgttagataacataaacacacctgaaggaataatacctgcgttattcgaaccagaacgagaaaagtcagccgctatagatggggaatatagattacgaggtgaagcgcggaagactttcgtagaattgatgcgtaggggagacctaccagtttggttaagctacaaagttgcttctgaaggatttcaatatagcgaccgcagatggtgtttcgacggcgaaaggaacaaccaggtgcttgaagagaacatggatgtagagatttggactaaagaaggagagaggaagaaactaagaccacgatggctagatgcaaggacttacagcgatccgctagctctacgtgagtttaaggaatttgccgcaggccgaagaagtgtttcaggtgacttaattctggaaatcggtaagctaccgcaacacttgacactgcgagcgcagaatgcactagataacttggttatgttacacaactcggagcaagggggtaaagcgtatcgtcacgcaatggaagaacttcccgatacaattgaaactttaatgctattagccttaatagctgtcctaacagggggagtgacattatttttcctatctggaaaaggactcggcaagacttcaatcggtttattatgcgtaacagcgtcgtctgcacttctatggatggcaagcgtggagccccattggatcgctgcgagcataattctagaatttttccttatggtattacttatccctgagccggaccgacaacgtacccctcaagataatcaattggcctacgtggtaatcggccttttatttatgattcttactgtcgcagcaaacgaaatgggactcctagaaactaccaaaaaggaccttggtattgggcacgtggcagctgaaaatcatcaacacgcgacaatgctagatgttgatctcagaccagcttcggcttggacactttacgctgtggcgacaacagtaataacacctatgatgcgacataccatagagaacacaaccgcaaacataagtcttacagcaatagcaaatcaagctgcaatactaatggggttagataaaggttggccaataagtaaaatggacataggtgtaccactattagcacttggttgttactcacaagtaaacccattaacattaacggcggccgtactgatgctagtagcccattatgcaatcataggaccagggttgcaagcaaaagccacaagagaagcacagaaaagaacggcagctggaattatgaaaaaccctacagtagatggtattgtcgcaatagacctagatccagtggtgtacgatgcaaaatttgaaaagcaacttggacagattatgcttttaatattatgtacgagtcaaatattattaatgaggacgacttgggcactctgcgaatcaatcaccctagcaaccggccctctaaccacattatgggagggatcgccaggcaaattttggaacaccacgattgctgtctcgatggcgaacatcttcagaggttcatatttagcaggggctggattagcctttagtttgatgaaatctctaggaggcggtagaaggggcactggtgcccagggcgaaacactaggagagaaatggaaaagacaactgaatcaactctcgaaaagcgaatttaacacatataaaagatcaggtataatggaggtagatagatcagaagctaaggaagggttaaaacgtggtgaaacgactaaacacgccgtgtcacgtggaacggcgaaactacgctggtttgtagagaggaaccttgtcaaaccagaaggtaaagttattgatcttggatgtggtcgtggaggatggtcatattactgcgcgggtctcaagaaggtgactgaagttaaaggttacacgaaaggagggccggggcacgaagaacctatacccatggctacttatggatggaacttagtaaaattgcactcaggcaaggacgtcttctttatgccaccagaaaaatgtgatacgttgctctgtgatattggtgagagtagtccaaatccaacaatagaagagggaaggacattaagagtcctaaaaatggtcgaaccatggttacgtggaaatcagttctgcatcaaaatacttaatccttacatgccttcagtagtagaaactttggaacaaatgcaaaggaaacacggagggatgctcgtacggaacccgctgtctcgcaattcaacccacgagatgtattgggtcagttgcggtacaggaaacatagtatcagctgtaaatatgactagccgtatgctgttaaaccgctttaccatggcgcacagaaagccaacttatgaacgcgacgtagatctaggagcgggcacacgacatgtagcagtcgaacctgaagttgcaaacctggacataataggtcaaaggattgaaaatatcaaaaatgaacataaaagcacatggcactacgatgaggataatccatacaaaacttgggcataccatggttcatatgaggttaaaccgagcggaagtgcatcaagcatggtcaacggcgtcgttcgcctattgacaaagccatgggacgtgataccaatggtaactcaaattgcaatgactgacaccacacccttcggacagcaaagagtatttaaagagaaggtagacacgagaaccccaagagccaagcgaggaaccacccaaattatggaagtgacagccaaatggttatggggcttcttaagtcgaaacaaaaagccaaggatctgtactagggaagagtttacacgcaaagtaagatcgaatgcggccataggagccgtcttcgttgatgaaaatcagtggaactccgcgaaggaagcagttgaggatgagagattctgggacttagtacatcgtgaaagagagttacataaacaaggaaaatgtgcgacatgtgtctataatatgatggggaaaagagagaagaaattaggggaatttggaaaagctaaaggttcaagagcaatatggtacatgtggctaggcgctagatttcttgaatttgaagcgttggggtttatgaatgaagatcattggttttccagagaaaacagtttttcaggagtagagggagagggacttcataaattgggttacatcctccgagacatatctaagattccgggaggcaatatgtatgctgatgacactgctggatgggacacaagaatcactgaggacgatctccagaacgaagcgaaaataacggacatcatggaacctgaacatgccttgcttgctacttctatattcaaactaacataccaaaacaaagtagtacgagtccaaaggcccgccaagaatggaactgtaatggacgtgatcagtagaagagatcaacgaggttccggccaagtcggtacatacggcttaaatacgttcacgaacatggaggtccaattgataagacagatggaatcagaaggaatttttctcccgagtgaacttgaaactccaaatttggcagaacgagttctcgactggcttgagaagcacggagccgaaagattaaaacggatggccatatctggagatgactgcgtagtgaaaccaattgatgatcgattcgcgactgctttaactgcactaaacgatatggggaaggtacgaaaagacatcccacaatgggaaccatcaaagggttggaatgactggcaacaggtcccattttgcagccaccacttccaccaattgatcatgaaggacggacgagaaatcgtagtgccgtgtagaaatcaagatgaacttgtaggacgcgctagagtgagtcaaggcgccggctggagcttgagggagacagcgtgtttaggaaaaagttatgcacagatgtggcagctaatgtatttccatagacgggatttgcggctagccgcgaatgcgatatgctcagcagttccagtagactgggtgcctacgtctaggactacttggagcattcatgcgcaccatcagtggatgacaacagaagatatgttaagcgtatggaatagagtgtggatagaagaaaatccctggatggaggataaaacacatgtttcatcgtgggaagaagtgccatacctcggcaaaagagaagatcaatggtgcggctccttaatcggactaactgcaagagcaacctgggccactaatattcaggtcgcaataaatcaagttagacgtttgatagggaatgagaactaccttgactatatgacgtcaatgaaacgctttaaaaacgaatcggatccagaaggagccctgtggtaa

SEQ ID NO: 21314 - RNA, 9879 nt, synthetic construct
  misc_feature 1..9879: note = derived and/or modified CDS sequence (opt6) from DENV-1__EU596504__SS-prME
  source 1..9879: mol_type = other RNA
agtgtaacaatgttattaatgttacttcctaccgcactagcatttcatctaacaacaagaggtggagaaccacacatgatagtgtctaaacaagaacggggtaagagcttgcttttcaaaacatccgcaggcgtcaatatgtgcacactcatagcaatggatttaggagaactttgtgaagataccatgacatacaaatgtcctcaaatcacagaagccgaaccagacgatgtagactgctggtgcaacgcaacagatacatgggtaacttacggaacttgtagtcaaaccggtgagcatagacgggataaaaggagtgtggccttagcaccacacgtcggcctagggctagaaacaaggacagaaacatggatgagcagtgaaggagcttggaaacagattcaaagagtagaaacgtgggcactacgccacccaggttttactgtcattgcattgtttttagcgcacgctataggtacatctataacacaaaaaggaataatctttatcctactcatgctggtgactccaagtatggcaatgcgatgcgtaggaatagggaatcgtgattttgtagaaggattaagcggtgcaacatgggtagacgtagtactggaacacgggtcatgcgtcaccacaatggctaaaaacaaaccaactctggacatagaactcctaaaaaccgaagtaacaaatccagcaatcctacgcaaactatgtattgaagccaaaatatcaaatacaactacagattcaaggtgtcctacccaaggcgaagccacccttgttgaggaacaagacgcaaactttgtatgccgaagaacatttgtcgatcgtggatggggaaacggatgtggacttttcggtaaaggatcgctattaacgtgcgcaaaatttaaatgcgtaacaaaattagaaggaaaaatagtacaatatgaaaacttaaaatactcggttatagttacagtacatacaggggatcagcatcaagttggcaacgaaactactgagcatggtacaatagcaacaattacaccgcaggcccccaccagcgaaatacaactgacggattacggtgccctgaccctagattgcagcccacgtactgggctagattttaacgaaatggttctcctaacgatgaaagagaaatcatggttagtgcataaacaatggtttttagatttacctttgccttggacatccggagctagtacatcgcaagagacatggaatcgacaagaccttcttgtaacatttaaaaccgcacatgctaagaaacaagaagtagtcgtacttggtagtcaagaaggagccatgcataccgctttaactggtgcaactgagatacagacctcaggtacaactacaatcttcgcaggtcatctaaaatgccgcttgaaaatggacaaattaacacttaaaggtacgagttacgtaatgtgcacagggtcattcaaactagaaaaggaagttgcagagacacagcatggtacggtcctggtgcaagtcaaatacgaaggcacggacgctccttgcaaaatacccttttcgacccaagatgaaaaaggagtaacccagaacggcagactcattacggcaaatccaattgtcacagataaagagaagccagtaaatatagaaacagagccaccttttggagagtcatatatagtagttggagcaggggagaaagcgttgaaattgtcctggttcaagaaaggttcatccataggcaagatgtttgaggctactgcaagaggggctagacgaatggcaattttaggagatacagcgtgggatttcgggagcataggaggggtctttacatcagtaggcaaattggtacaccaagtttttgggactgcatatggagttctatttagtggcgtctcctggacaatgaagattggcataggaatcctactaacatggctcggattaaactcacgaagcacctccctatccatgacatgctttgctgttggtatggtcacattgtatctaggagttatggtacaagccgactctggatgtgtaataaattggaaaggaagagaactaaaatgtggtagtggaatattcgtaactaatgaggtacatacatggactgagcaatataaattccaagcagattctccaaaacgcctctcagcagctataggaaaggcttgggaagaaggcgtatgtggaatcagaagtgctactagactagaaaacataatgtggaagcagataagtaatgagctaaatcatatactgctcgagaacgatatgaaatttactgtagttgttggagatgcaaacgggatacttgctcaaggtaagaaaatgataagaccgcagcccatggaacataaatatagttggaaatcgtggggcaaggcaaagataattggagcggatattcaaaacacgacgtttatcatagatggacctgacacaccggagtgtccggacaatcaacgagcctggaatatatgggaggttgaagactacggattcggaatattcaccacaaatatctggttaaaactaagggactcatatactcaaatgtgtgaccacagattaatgagcgcggcgatcaaagattcaaaagccgtgcatgcagatatggggtattggatcgaatctgagaagaatgaaacctggaaacttgccagagcttcgtttatcgaagtaaaaacatgtacatggccaaaatcccatacattatggtctaatggtgtattagagtcagaaatgattatccctaaaatatatggaggccctattagccaacataattatagacccggatattttacccaaacagcaggaccatggcatcttggtaaactagagctggacttcgacctgtgtgaaggaactacagtggtagtagacgaacattgcggaaatagaggaccgagtcttagaaccacaacggtcacaggaaaaataatacatgaatggtgttgcagatcgtgcactctaccacccttgagattcagaggtgaagatggttgctggtacggaatggaaatacgtccggtcaaggaaaaagaagagaaccttgtgcggtcaatggtgtccgcaggatctggggaagttgatagtttcagccttggaatactgtgtgcttcgataatgattgaagaagtgatgagatcgagatggagcaggaaaatgctcatgacgggcacccttgcggtgttccttctactaataatgggacaattaacttggaatgatttaattcgactatgtataatggttggcgctaatgcgagtgaccgaatgggaatgggtaccacttacttagcactaatggccacattcaaaatgcgtcctatgtttgctgttggactattatttcgaagactaacaagccgagaagtccttctgttaacaatcggcctgtctctcgtagcatcagtggaactacccaactcattagaagaacttggtgacggtttagcaatgggaatcatgatgttaaaattattaactgagttccagccacatcaactatggaccactctactatcattaacctttataaagacgacgttaagtttagattacgcgtggaaaactaccgctatggccctgtccattgtatcactctttcctctatgtctctcaaccacatctcagaagactacttggctgcccgtacttttaggttcatttggctgtaaacccttgacaatgttcctaatcacagaaaacaaaatttggggtaggaaatcctggcccctaaatgaaggcataatggctattggtatagtaagtatacttctcagcagtcttctgaagaatgatgtaccgctagcagggccactaatagccggaggaatgttgatagcatgttatgtaatctcaggaagtagtgccgacctttctctggaaaaagcagcagaagtaagctgggaacaagaggcggaacattcaggtaccagtcataatattctggtagaggtacaagatgacggaactatgaaaattaaagatgaggagcgagatgatactttaacaatacttttgaaagccaccttactagctgtaagcggcgtatatccaatgtcgattccggcaaccttgtttgtatggtatttctggcagaagaagaaacagcggtcaggggtactatgggacacgccgagcccaccagaagtcgaaagagccgtcctagacgatggtatctatcgaatactacaacgtggtctcctcggtaggagccaagtaggcgtcggcgtgttccaagacggagtatttcatacaatgtggcatgtaactagaggcgcagtcttaatgtatcaaggcaaaagattagaaccatcgtgggcaagtgtcaagaaagatttgatttcctacgggggtgggtggcgctttcaaggctcttggaacaccggagaagaagtacaggttatagcggttgagccgggaaagaatccgaaaaacgtgcagaccacacctggaacctttaagacaccagaaggtgaagttggcgctattgctttagattttaaacccggaacgtcgggctctcctatagtaaatcgagaagggaaaatagtagggttatacggcaacggagtcgttacaacatctggtacatacgtcagcgccatagcgcaagcaaaagccagccaagagggaccattaccagaaatagaagatgaagttttcaagaaaagaaacctaacgataatggatttacatcccggttccggaaaaacacgccgatatttgcctgctattgtccgagaagccatcaaacgaaaacttcgaacactaattctcgcaccgacgcgagtcgttgcatcagagatggcagaagcattgaaaggtatgccgataagatatcaaaccactgccgtaaaatcggaacatacaggcagagagattgtcgacctaatgtgccatgctacgtttacaatgagactcctaagtccagtccgtgtacccaattataatatgatcataatggacgaggcacactttacggacccggcgagtatagctgcccgaggatacattagtacgagagtcggaatgggtgaagcggccgcaatttttatgacggcaacaccacccggaagtgtagaagcatttcctcaatctaatgctgtaattcaagacgaagagagggacatacctgaacgaagttggaactctggctacgactggattacagatttccctggcaaaactgtatggtttgtcccctcaattaaatctgggaatgatattgcaaactgtttgcgtaaaaatggcaaaagggtgattcaattatcgagaaaaacgtttgatacagagtaccagaaaaccaaaaataacgactgggactatgttgtcacaacagatatctcagagatgggagcgaactttagagcagacagagtgatagacccacgacggtgtcttaagccagtgattttaaaagacgggcctgaaagagttattttggctggccccatgccggtcactgtagcttcagcagcacagagaaggggtaggatcggaaggaatcaaaataaggaaggtgatcaatatgtctacatggggcaacctttaaacaacgacgaagaccatgctcattggactgaagcaaaaatgttattagataatattaatacaccagaaggaatcatacctgctctttttgaacccgaaagagaaaaatcagccgctatcgacggcgagtaccgattgagaggtgaagcgcggaagacttttgtagaactaatgagacgcggtgacctacctgtgtggctctcatataaagtggcatcagagggattccaatatagtgaccgaagatggtgtttcgatggtgaaagaaataaccaagttctagaagagaacatggacgttgaaatatggacaaaggaaggagaaaggaagaaattaagaccacgatggttagatgcgagaacctactcggatcctctggctttaagggaatttaaagaatttgcagccggcagaagaagcgtatctggagatctgattttagaaatcggcaaattaccacagcatcttacactaagggcacaaaacgcgctagataacttagtcatgcttcataactcggaacaaggaggcaaagcatatagacacgctatggaagagttacctgataccatagagacgctcatgctcttagcgctaattgctgtattaaccggaggtgtaacgctctttttcctcagcgggaagggtctcggaaaaacttcaatagggttactatgcgtaactgcttcatcagctttattatggatggcgtcagtagaaccacactggattgccgcttcaatcatcttggagttcttcttaatggtgctccttatcccagaacccgataggcagcgaacgccccaagataaccaactcgcttatgtagtaattggcttactatttatgatactgactgttgcagcaaatgaaatgggcctactagaaacaactaagaaagatctcgggataggacatgtggcagccgaaaatcaccaacacgccaccatgcttgatgtagacctcagaccggcatctgcgtggacactatatgccgtggccacgactgttataaccccaatgatgcgtcacacaatcgaaaacacaacagcaaatatatcactaactgcaattgctaaccaagcagccatactaatgggtttagataaaggttggccgattagcaaaatggatataggcgtacctctgcttgcactcggttgttactcccaagttaatcctttaacattaacagctgcagtgttgatgttagtggcgcattacgcgataataggtccagggcttcaagcgaaagccacccgagaagcacaaaagcgcaccgcggcaggaattatgaaaaaccctactgtagacgggattgtcgccatcgacttagatcctgttgtatacgatgccaagtttgaaaaacaactaggccaaataatgttgctgatactatgcacttcacagatcctgttgatgagaactacttgggcgttgtgcgaaagtatcactttggctacaggcccattaacgacattgtgggaaggaagtccaggcaaattttggaatacaacaattgcagtttctatggcgaacatatttagaggatcttatttagcaggcgcaggtctagccttctcattaatgaaatcgttgggaggtggtcgaagggggacgggagcgcaaggggaaacactaggcgaaaaatggaaacgccagctaaaccaactctccaaatctgagttcaatacatataaaagaagtggtataatggaggtcgacagatccgaagctaaagaagggcttaaacgcggcgaaacaactaaacatgctgtatctaggggaactgcaaagttgaggtggtttgtagagagaaacttagtcaaacctgaaggtaaagttatcgatttgggttgcgggcgtggcggctggtcttattattgcgctggactcaagaaggtgactgaggtaaaaggttatacaaaaggaggacccggacatgaggaacctattcctatggccacctatggatggaacctggtgaagctgtattccggtaaagatgtattcttcatgcctccagaaaagtgtgatacactattgtgcgatattggcgagagcagccctaatccaactatagaagaaggtcggactctaaggattttaaaaatggtagaaccatggttacgtggtaatcaattttgcattaaaatactaaatccttatatgccttctgttgtagagacactggaacaaatgcaacgtaagcacgggggcatgttagtaagaaacccccttagccgcaattctactcatgaaatgtactgggtatcatgcggaactgggaacatagtgtctgccgttaatatgacgtccagaatgttgctaaatcgatttacgatggcacaccgaaaaccaacatatgagagagatgtggatcttggggcagggacaagacatgttgcagtagagccagaagttgccaacttagatataataggtcagagaattgaaaatatcaaaaacgaacataaaagtacctggcattacgacgaagataatccgtataaaacatgggcctaccatggaagttatgaagtaaaaccttcaggttcagcgagctccatggtgaatggcgttgtacgattactaaccaaaccttgggatgtaatacctatggtgacacaaatcgcaatgactgatactacaccctttggacaacaaagggtttttaaagaaaaagttgacacacgcaccccaagagccaaaagaggtacgacccagattatggaggtgacagctaaatggttatggggatttctgtccaggaacaagaagccacgtatatgtactagagaagaatttaccagaaaagtgcgaagtaacgcagctataggtgcagtttttgttgacgagaatcaatggaatagtgcaaaagaggcagtcgaggacgaaagattctgggacctagtacatagagaacgagaattacataagcaagggaaatgtgctacatgcgtttataacatgatgggaaagagggagaagaaattaggtgaatttggtaaagcgaagggatcaagagctatatggtacatgtggctcggagctcgatttttagagttcgaggctttaggatttatgaacgaggaccattggtttagccgagaaaatagtttatcaggagtagaaggagaaggattgcataaattgggatatatcttgcgagacattagtaaaatcccgggcggtaacatgtacgctgacgatacggctggatgggacacacgtataacagaagatgacttgcagaatgaagcaaaaattaccgacattatggaaccggaacatgcattactcgccacatcgatattcaagttgacatatcagaacaaagtggttcgcgtacaaagaccagccaaaaatggtacggtaatggacgtaataagtcgtagagatcaaaggggctccggacaagtcggcacttatggcctaaatacatttactaatatggaagtccagcttattcgccaaatggaatcagaaggtatattcctaccatcagaacttgaaacgccaaatttagccgaacgagtcttggactggttagagaaacacggcgctgaacgactcaaaaggatggccatctcaggggacgactgtgtagttaagccaatagatgacagattcgcaaccgcactgactgcattaaatgacatgggtaaagtacgaaaggacatacctcaatgggaacctagtaaaggttggaacgattggcagcaggttcctttttgctcacaccatttccatcaactaataatgaaagacgggagggaaattgttgttccttgtagaaatcaggatgagttggtaggtagagcaagggtaagtcaaggggctgggtggtctctcagagagaccgcatgcctcggaaaatcttatgcacaaatgtggcaattaatgtatttccatagacgagacttgcgattagctgccaatgctatttgctcggcagtacccgtggattgggtacctacctcccgtacaacttggtcaatacatgcacatcatcagtggatgaccaccgaggacatgttatcagtctggaatcgtgtatggattgaggagaatccatggatggaagacaaaacgcatgtaagctcatgggaagaagtaccatatctagggaagcgggaagaccaatggtgtggatcgctaataggattaacggcacgagcaacatgggctacaaatattcaagtagcaattaaccaagtgcgacgcttgatagggaatgaaaattacttagattatatgacctcaatgaagaggttcaaaaatgaatcagatccagaaggtgcattatggtga

SEQ ID NO: 21315 - RNA, 9879 nt, synthetic construct
  misc_feature 1..9879: note = derived and/or modified CDS sequence (opt6) from DENV-1__FJ024481__SS-prME
  source 1..9879: mol_type = other RNA
tcagtcaccatgttattaatgttacttccaacggcactcgcatttcatctgactactagaggtggtgaaccacatatgatagttagcaaacaagaacgggggaaatcactactatttaaaacatcagctggtgtgaatatgtgtactttaatagcaatggacttaggggaattatgtgaagatactatgacttataaatgtcctcaaattacagaagctgaacccgatgacgtggattgttggtgtaacgctacagatacatgggtaacttatggaacatgctcgcaaactggtgaacatcgaagagacaaacgaagtgtcgcattagctccgcacgtagggctaggccttgaaacacgaactgaaacctggatgtcgagtgagggggcatggaaacaaatacaaagagttgaaacctgggctttaagacaccctggctttacagtaattgctctctttttggcacacgctattgggacatctataacgcaaaaaggaataatatttatcctactcatgttagtaactccttctatggctatgcggtgcgtcggaataggaaatcgcgattttgtcgaaggtttgtccggggctacgtgggtagatgtagttttagaacatggaagttgcgtaactactatggctaaaaataaaccaacgctggacattgagctactaaaaacagaagtcactaaccctgcaattcttagaaaactctgtatcgaagcaaaaatttctaatacaactactgattctagatgcccgacacagggcgaagcaaccctggtagaggagcaagacgcaaattttgtctgtcgacggacatttgtagatcgaggatggggtaatgggtgtggtttgtttggtaaaggttcactactaacatgtgcaaaatttaaatgtgtaactaaattagaaggcaaaattgtgcaatatgagaatcttaagtattcggttatagtaacagtccacaccggagatcaacaccaagttggaaatgaaacaaccgaacatggaacaatcgcaacaattacacctcaagctcctacctccgaaatacagttaacggactatggcgcattaacactagattgttccccacgcactgggttagactttaacgagatggtgttactcacaatgaaagaaaaatcttggttagtgcataaacaatggtttctggatttacccttaccatggacctcaggtgcatcgacgagtcaagagacctggaatcggcaagacctcctagtaactttcaagacagcgcacgccaagaaacaagaggttgtagtactaggatcacaagaaggcgcaatgcatacagcactcactggtgcaacggagattcagacttcggggacaacgaccatatttgctggtcatctgaaatgcagattaaaaatggataaactaacactaaaaggtacaagttatgtcatgtgcacaggtagctttaaacttgaaaaagaggtagcagagacacaacacggcacggttttagtccaagtaaaatatgaagggactgatgcaccatgcaaaataccattttccacacaggatgaaaaaggagtcacgcaaaatggacggttaataacggccaacccgatcgttaccgataaagaaaaaccagtaaacatagaaacagagcctccatttggagaatcttatatcgtggttggtgctggcgaaaaagcattaaagttatcatggtttaagaaggggtcatccataggtaaaatgttcgaagcaacagctcgcggggcaaggcgtatggcaattctgggggacacagcgtgggattttggaagtattggtggggtattcaccagtgttgggaaactggtacaccaggtcttcggcactgcttatggcgtattgttttcaggtgttagctggactatgaaaataggaattggaatactattaacgtggctcggacttaatagtcgatcaacttctttaagcatgacatgtatagctgtgggtatggtcacactatacttgggtgttatggttcaagcggactcaggctgtgttataaactggaaagggagagaacttaaatgcggcagtggtatattcgtaacaaatgaggtacatacatggaccgaacaatataagttccaagcagactcgcccaaaagattaagtgcagcgatcggcaaagcctgggaggaaggagtctgcggaataaggtcggcgactcgactagaaaacatcatgtggaagcaaatttccaatgagcttaaccatattctactcgagaatgatatgaagttcactgttgtagttggagacgccaatggaatactcgcgcaaggtaaaaagatgattcgaccccaaccaatggaacacaaatattcgtggaaaagttggggaaaagcgaagatcataggagctgacattcaaaacacgacattcataatcgatgggcccgatacacccgaatgccccgataatcagcgagcatggaacatatgggaagtagaagactatgggtttggtattttcacaacaaacatatggctgaaacttagggattcttatacacaaatgtgtgaccaccgtttaatgtcggccgcgataaaagatagcaaagccgtacatgctgatatggggtactggatagaatccgagaaaaatgaaacttggaaacttgcaagagcttcatttatcgaagtaaagacttgtacgtggccgaagtcacatacgctgtggtcaaatggggtgttggaatctgaaatgattatacccaaaatttatggtggaccaatcagccaacataattatagaccgggctattttacacagaccgcaggaccatggcatctaggaaagttagaattagattttgatctctgcgaggggaccacagtagtagttgacgaacactgcgggaatcgcggcccaagtttacggacaaccaccgtaacaggtaaaattatacacgaatggtgctgtagaagctgcactcttccccctttgaggtttagaggcgaagacgggtgctggtacgggatggagattcgcccagttaaagagaaagaagaaaatctagtacgtagcatggtatctgctggctccggtgaagtagactctttctcgttgggaatcttgtgcgcgtcaataatgatagaggaagtcatgagaagtcgatggagcagaaaaatgttaatgacaggtacacttgcagtatttctccttctcataatggggcaattaacttggaatgacttaattagattatgcattatggtcggcgccaatgcatcggatcgaatgggaatgggaacaacatatctcgcacttatggccacatttaagatgcgtccgatgtttgctgtaggtttgctatttcgtagattaacaagtagagaagtattattattgacaattgggctttcactggttgcatcggtagaactacctaattcattagaagaattaggggatggtctcgctatgggtataatgatgcttaagttgctaacggaatttcaaccccatcagttatggactacattattaagtctaacatttattaaaacaacacttagtttggattatgcatggaagacgacagcaatggctcttagcatagtgtcgttatttccactctgcctcagtacgacttcacaaaagactacgtggctacctgtcctattaggctctttcgggtgcaaacccctaaccatgttcctaataacggaaaataaaatatggggaaggaaaagttggccattaaacgaagggatcatggcaatcggaattgtgtcgatcctactatcatcccttttgaaaaacgatgttccgttagcaggaccgctgatcgctggcggaatgctaattgcatgctacgttataagcgggtccagcgcagacttatcgttagaaaaggccgccgaagtaagctgggaacaagaagctgagcatagcggaacgtcacacaatatattagtagaagtacaagatgatggaacgatgaagatcaaagacgaagaacgagatgacacactaacgatacttctcaaagcaacgctactggcagtgtctggggtttatccaatgtcaatccctgctactctttttgtgtggtacttttggcagaagaagaaacaaaggagtggagtattatgggacacgccctccccacctgaagttgagcgagctgtcctagacgatggcatatataggatcctgcaaagaggcttgttaggaagatctcaagtaggagtaggagtattccaagatggcgtctttcatacaatgtggcatgtcacgagaggggcagtcttaatgtaccagggaaaaagattagaacccagttgggcttcggttaagaaggatttaataagttatggagggggatggaggtttcaaggatcatggaatacaggtgaagaagttcaagtgattgctgtggaaccaggtaaaaaccccaaaaatgttcaaactacacctggtacattcaaaactccagagggggaagtgggtgcaattgctctagattttaagcctggcacttccggctccccaatcgtaaacagggaaggtaaaattgttggtctttacggaaatggagtcgtaactacctctggaacgtatgtaagcgccatagcgcaggcaaaagcgtcccaggaaggaccgctgcccgaaattgaagatgaggtttttaaaaagaggaacttaactataatggacttgcatcccggtagcggaaaaacacgcaggtatcttcctgcaatagttagagaagctatcaaacggaaattacggactctaatattggctcccacgagagtggtagcgtctgagatggccgaagccttaaaaggaatgccaattagataccaaaccaccgcagttaaatccgagcacacaggaagagaaattgtggaccttatgtgccacgcaacttttacaatgagacttttatctccagtaagggtaccaaattataatatgattattatggacgaagcgcattttacagatcccgcgagcatagcggcgagaggctatatatccacccgggtgggtatgggtgaagctgctgctatttttatgacagctacaccaccgggttctgtagaagccttcccccaaagtaacgctgtaatacaagatgaggaacgagatataccagagagatcttggaactcaggttacgattggataacggactttccaggaaaaacggtctggtttgtaccaagcattaagagcgggaacgacattgctaattgtcttaggaaaaatggtaagagagtgattcagttatctagaaaaacttttgacacagaataccagaaaactaaaaacaacgactgggattacgtggtgacaaccgatatatctgagatgggtgcaaattttcgagctgaccgtgtaatagacccaagaaggtgtcttaaaccagtaattttaaaagacggacccgagagggtgatcctagcaggacccatgccagtgacagttgccagtgcagcgcaacggcgaggaagaataggtagaaatcaaaataaagaaggagaccaatacgtttatatggggcaacctcttaataacgatgaagaccatgctcattggacagaagctaaaatgctcttagataatataaatacgccagaaggtattattccagctctgttcgaaccagaacgcgaaaagtcagcagcaatcgatggtgagtatcgactacgcggcgaggctaggaagacatttgtagaactgatgagaaggggtgacctaccggtatggctcagctacaaggtagcatccgaaggatttcagtactcagataggcgttggtgtttcgacggagagcgcaacaatcaagttctcgaagaaaatatggatgttgagatctggacaaaagagggagagaggaagaaacttagaccccggtggctcgacgctcgaacatattctgatcccctcgctttacgagaatttaaagaatttgcagcaggaagaagatctgttagcggagatttaatcttagaaataggaaaattaccacaacatttaactttaagggcgcagaatgcattggacaatttggtgatgctacataatagtgaacagggcggtaaggcgtacagacatgcaatggaagaactgccggatacaatagagacactgatgcttttagccttgattgccgttctaacaggaggagtaactctcttctttttatccggaaaaggtcttggcaaaacgtctataggattattatgcgtgaccgcgtctagtgcactactttggatggcaagcgtggagccccactggatcgctgccagcataatactagagttcttcctaatggtgttactaatcccagaacccgacaggcaaagaactccgcaagataaccaactggcatatgtcgttatcggcctactcttcatgatattaacagtcgctgcaaacgaaatgggccttctagaaacaactaagaaagacttgggcataggtcacgtagcggccgaaaatcatcaacatgctacaatgttagacgtagatttacgtcctgcttctgcatggactctttatgccgttgctacaacagttataacccccatgatgcgccacacaattgaaaataccacggcaaatatcagtttaacagccattgcgaaccaagccgcaatactaatgggactagataaaggctggccaatttccaaaatggatataggtgtgcctttactagctttaggatgttattcgcaagtcaaccctctcacgcttacagctgctgtattaatgctggttgcccactatgctataattggccctggattacaagcgaaagcgacaagggaagcacagaaaagaaccgcggcagggataatgaaaaatccgacagtggacggtatcgtcgctatagacttagatcccgtagtgtacgacgctaaattcgaaaaacaattaggccagattatgctattaatattatgcacgtcacaaatattattgatgcgtacaacctgggcgctttgcgaatctattaccttggcaacgggcccgttaaccactctgtgggaggggtcgccaggtaaattttggaatactacaatagcagtatctatggctaatatatttaggggtagttatttggcaggagcaggccttgcattttcactaatgaaatcattaggaggtggtcgtcgaggtacaggagctcagggagagacactaggagaaaagtggaaaagacaacttaatcaattatccaaatcagaatttaatacatataaacgaagtggaataatggaagtcgacagaagcgaagcaaaagaaggattaaaacgtggcgagacgaccaagcacgcggtatcgagaggtacggcaaaactacgatggtttgtggaacgaaatttagtaaaaccagagggaaaagtaatagaccttggttgcggtagaggcggatggtcgtattactgtgcagggttaaagaaagtcacggaagtcaaagggtatacgaaaggagggccaggacacgaggaaccaattcctatggcaacctacggctggaatttagttaaattatatagcggtaaagatgtatttttcatgccgccagagaaatgcgatactctactatgtgatataggtgagtccagcccaaatccaaccatagaggaaggaagaacgctccgaatactcaaaatggttgagccttggctccgcggaaaccagttctgtattaaaatactaaacccgtacatgccgagcgtagtagaaaccttagaacaaatgcaaagaaaacatgggggaatgttagtaagaaatcctttatccagaaatagcacccatgaaatgtactgggtttcatgtggaactggtaatattgtgagcgctgtcaatatgacgtcacgtatgcttctcaaccgcttcacaatggctcatagaaagccaacatatgaaagggacgttgacctaggggcagggacacgccatgtagcggtagaacctgaagtggcaaacctcgatataatcggccaaagaattgaaaatataaagaatgaacataaatcaacctggcattatgatgaagataatccatataagacatgggcgtaccatggatcatacgaggttaaacccagtggatcagcatcaagcatggttaatggtgttgttaggttattaacaaagccgtgggatgtgattcctatggtaacacagattgcaatgaccgatacaactccgtttgggcagcaaagggtctttaaagaaaaagtcgatacgcgaactccgagagcaaaaagaggtactacccaaattatggaagtaactgccaaatggctgtggggttttctcagtaggaataaaaagccccgaatttgcactcgcgaggagttcactaggaaagtaagaagcaatgcagctataggagctgtgttcgtcgatgaaaatcaatggaatagtgcaaaggaagctgtcgaggatgagaggttttgggatctggttcacagagaaagagagttgcataaacaaggcaaatgtgctacatgtgtatacaatatgatgggtaaacgagagaagaaattaggcgagttcggaaaggcaaagggatcaagagcaatatggtatatgtggctaggggcaagatttttggagttcgaagcgctgggctttatgaatgaagaccattggttttcaagagaaaatagtttatcaggagttgaaggagaaggtttacacaaactgggatacatactgagagatataagtaaaattccgggcggcaatatgtatgccgacgacacggcaggttgggacacccgaattacagaggatgatcttcaaaacgaagccaaaataacggatataatggaaccggagcacgcgcttttggctacaagtatctttaaactaacttatcaaaacaaggtggtgagagtccagcggcctgctaaaaacgggacagtcatggatgtcatctctagaagagaccaaagaggttctgggcaagtcgggacatacggtctaaacacattcacgaatatggaggtacagttaattaggcagatggaaagcgagggaatctttttacctagcgaattggaaacgcccaatctggccgaacgagttctcgactggctagaaaagcacggtgcagaaagactaaaacggatggctataagcggggacgactgtgttgtcaaaccgatagacgatagattcgcgaccgcattgacagcactcaatgatatgggaaaggtacgtaaagatatcccccagtgggaaccaagcaaaggatggaatgactggcagcaagttccattttgctcacatcattttcaccaattaataatgaaagatggaagagaaattgtggtaccttgtagaaaccaagatgaacttgttggtcgagctcgggtatctcaaggggctggatggtcactgagagagacagcctgcctaggaaaaagctatgcacaaatgtggcaactcatgtattttcataggcgtgatcttcgactagctgctaacgctatctgtagcgcggttccagttgattgggtaccaacaagcagaacaacatggtctatacatgcacatcaccaatggatgaccacagaggatatgctgtccgtgtggaatagggtatggattgaagagaacccatggatggaagataaaacacacgtctcatcatgggaagaggtcccctatctaggcaagagagaagaccaatggtgcggttcgcttattggactaactgcgcgcgctacatgggcaactaacatacaagtagccattaaccaggttagacggttaattggaaatgagaattatctagattatatgacaagtatgaaaagatttaaaaatgaatcggatcctgaaggagcattatggtaa

SEQ ID NO: 21316 - RNA, 9879 nt, synthetic construct
  misc_feature 1..9879: note = derived and/or modified CDS sequence (opt6) from DENV-1__GQ199872__SS-prME
  source 1..9879: mol_type = other RNA
tcagtaacaatgttactgatgcttctgccaacagcattagcttttcatctaactacaagaggcggggaaccacatatgattgtttctaaacaggaacgtggaaaatctttattattcaaaacaagtgcgggagtaaatatgtgcacgttaattgcaatggacttaggtgagctctgtgaagatacaatgacttacaaatgtccgcaaatcacagaagcggaaccagacgacgttgattgctggtgcaacgcaacagatacgtgggttacctacggaacgtgttcacaaaccggcgaacaccgcagggacaaaagatctgtggcgctcgcaccacacgtaggtttaggattagaaactagaaccgagacatggatgtcatcagaaggagcgtggaaacaaattcaaagggtagaaacatgggctctacgacacccaggtttcacggtaatcgctttattcttagcacacgcaattggaacatcaatcactcaaaaagggattatattcatattattaatgttagtcacaccgagtatggcaatgcgatgtgtaggtatcgggaatcgagattttgttgaaggcttgtctggtgcaacctgggtggacgttgttcttgagcacggatcttgcgtcacaacaatggccaaaaataaacccaccctagacattgagttgctaaaaacagaagttacaaatcctgcaattctaaggaaactatgtatagaagctaaaataagcaatacaaccacagactcgcgttgccctactcaaggggaggcaacattagtcgaagaacaggatgcaaactttgtttgcagaagaactttcgtagatagaggctggggaaatgggtgcggtttatttggtaaagggagtctattgacttgtgcaaaattcaaatgcgtaactaaattagaaggaaaaatagtgcagtacgaaaatctaaaatattccgtaatcgttacagtacatacaggggaccaacatcaagtagggaacgaaacaactgaacacggaacaatcgcgacaattactccacaggcaccaacaagcgagattcaattaactgactatggagcattaacattagactgttcacccagaacggggttagatttcaacgaaatggtgcttctaactatgaaagaaaaatcatggctcgtacacaaacaatggtttctcgatctccctcttccttggacttcaggagcatcgacaagtcaagaaacttggaataggcaagatttattagttaccttcaaaacagcacatgccaagaaacaagaagtagtggtactggggtcgcaagagggtgcgatgcacacagcactaactggcgcaacggaaattcagacctcgggaacaactactatctttgctggccatttaaaatgtcgactaaaaatggacaaattaacattaaaaggaacttcatacgtgatgtgcacaggatcatttaaattagaaaaagaggtagctgaaacacaacatggcactgtattagtacaagttaaatatgagggtacagacgcaccatgcaaaattccctttagtacacaagatgaaaaaggtgtaactcaaaatgggcggctaataaccgcaaaccccatagtcacagataaagagaagcctgtgaatatagaaaccgaacccccattcggagagtcgtatatagttgtaggtgcaggcgagaaagcattgaaacttagttggtttaagaaaggctcaagcatagggaaaatgtttgaagcaactgctaggggagccaggcgaatggcaattctaggcgataccgcctgggactttggatctataggaggagtatttacttccgtaggtaaacttgtacatcaagtcttcggaaccgcatatggagtattattttcgggggtgtcatggaccatgaaaattggaataggaatattactaacgtggcttggactcaattcaagatcaacaagtcttagtatgacatgcatagcagttggcatggtcacactgtatctcggggtaatggtccaagcagactcggggtgtgttatcaattggaaggggcgcgagctaaaatgtggctctggtatatttgtgactaatgaagtacatacgtggaccgaacagtataaatttcaagctgattctccaaagaggttaagtgcggcaatagggaaggcatgggaggaaggagtatgtggcattaggtctgccacccgattagaaaatataatgtggaaacaaattagtaatgaattgaatcatatactactagaaaacgacatgaagttcacagtggtggtaggagacgcaaatggaatccttgcccaaggaaagaagatgataagaccccaacccatggaacataaatactcatggaaaagttggggaaaggctaaaatcataggggctgacattcaaaacactacattcataatcgatggtccagatacaccagagtgtccagacaatcaaagagcatggaatatctgggaagtcgaagactatggatttggaatattcactacaaatatatggttaaagctccgcgattcatatacacagatgtgcgaccacagactcatgtcagctgcaattaaagactcaaaagctgtacacgctgatatgggatactggatcgaatcagaaaagaacgaaacatggaagttagcccgtgcatcctttattgaggtcaaaacttgtacttggccaaagagtcatactctttggtcaaacggggtgctggaaagcgaaatgataataccaaagatctatggtggaccgatatcacagcataactacagaccaggatactttacccaaacagcaggaccatggcaccttgggaaactagaattggactttgacttgtgtgaggggaccacagtggtagtggatgagcactgtggaaatagaggtccatccttaaggactacaaccgtaacgggaaagattattcacgagtggtgttgtcgatcttgcacactacctccgctacgcttcagaggcgaagacgggtgctggtatggaatggaaataagaccagtaaaggaaaaagaagaaaacctagtccgtagcatggtttctgcaggatcgggcgaagtagacagctttagccttgggattctatgcgcttccatcatgatagaggaagtgatgagatcaagatggtctcggaagatgttaatgacaggcacattggcagtattcctcttgttaattatgggccaacttacctggaatgatcttatccggctctgcataatggtaggcgctaatgcatcagatcgcatgggtatgggaaccacgtacttggctttgatggcaacctttaaaatgagacccatgttcgcagtaggtctactatttcggagattgacatctagggaagtactattgctgacaataggactcagtttagttgcctcagtagaactacctaatagtctcgaagaattaggagatggactagcaatgggaataatgatgctaaagttactaaccgagtttcagccccatcaactctggacaactcttttatcattgaccttcatcaagacaaccctttcattagactacgcatggaaaacaactgcaatggccttgtcgatagtatccttatttcctctatgcttatcaaccacatcgcagaaaactacttggttacccgtcctattgggatcattcggatgtaaacccttgaccatgtttctaattaccgaaaataaaatttggggtcgcaaatcttggccactaaacgaaggaatcatggccataggaatcgttagtatactcttgagtagcttactcaagaacgatgtacccttagccgggccactgatagcaggagggatgttgatagcgtgttatgttatatcggggagcagcgctgatttatcgttggagaaagcagcagaggtatcgtgggaacaagaagccgaacattccggtacatcgcataacatattggtcgaagtacaagatgatggtacaatgaaaataaaggacgaagagagagacgatactcttaccatattactaaaagccactcttcttgctgtatctggagtgtaccccatgtcaattccagcaacattattcgtatggtacttttggcagaagaagaaacagcgctcaggtgtactttgggacactccttcaccacctgaagttgagagggccgtactggacgacggaatatatagaattttacagagagggctattgggacgatcacaggttggagtcggagttttccaagacggggtattccatactatgtggcacgttacacgtggcgccgtcttaatgtaccaagggaaacgacttgagcctagctgggcttctgtaaagaaagatctgatatcatacggaggaggatggagattccaggggagctggaacacaggagaggaggtgcaggttatcgcagtagaacctggtaaaaaccccaaaaatgttcaaacgacaccagggacatttaaaacgcctgagggggaagtaggagcaatcgcactagattttaaacctggtacaagtggaagcccaatagtgaatagagaaggtaaaatagtcgggctgtatggtaacggagttgtcacaacttccgggacatatgtgtccgccatcgcgcaggctaaagcaagtcaagaaggtccattacctgagatagaggatgaggttttcaagaaacgtaatttaacaatcatggatctacaccctggatctggtaagacacgaagatatttaccagccatagttcgtgaagcaataaaacgaaagctacgcactttaatattggcaccgactagggttgttgcttcagagatggcggaggcacttaaaggaatgcctatacgctatcaaactactgcagtaaaaagtgagcatacagggcgagaaatcgtcgacttaatgtgtcacgctacatttactatgcgtttattaagtccagtacgtgttccgaattacaatatgattataatggatgaagcccatttcacagatccagcaagcatagcagcaagaggatatatatcgacccgagttggaatgggagaagctgctgcaatttttatgacagcaaccccaccagggtcagttgaagcatttccacagagcaacgctgtgatacaagacgaagaacgggatattccagaaagatcatggaacagtgggtatgattggataaccgactttcccggaaaaacggtatggtttgtccccagtataaaatccggaaatgacatagcgaactgtttaagaaagaatggcaaaagagtgatacaattatctcgaaaaacattcgacaccgaataccagaaaactaaaaataacgattgggattatgtagttaccacggacatctcagagatgggagctaacttccgggcagacagagttattgacccaaggagatgtctaaaaccagtaatactaaaagatggtccggaaagagtgatactagcagggccgatgccagtcacggttgctagcgccgctcaacgacggggaagaataggacggaatcaaaataaggagggtgaccaatatgtatatatgggacagccactaaacaacgatgaagaccatgcccactggacagaggcaaaaatgctgctcgacaatatcaatactcctgaaggaattataccagctttattcgagccggagagggaaaaatcagctgccatcgacggggagtaccgactacgtggagaagccagaaaaacatttgttgaactcatgcgaaggggagatctacctgtctggctaagctataaagtagcaagtgagggatttcaatattcagataggaggtggtgttttgatggagaaagaaacaatcaagttttagaagaaaacatggacgtggaaatctggacgaaagagggagaacgaaagaaactcagaccacgatggctggatgctcgcacgtactcagatccactcgcattaagggagttcaaagaatttgcggccggtaggcgcagcgtcagcggtgatttaatattagaaatcggaaaactacctcaacatcttactctacgtgcacagaatgcgcttgacaacctagtgatgttacataactccgaacaagggggaaaggcatatagacatgcaatggaagagttaccagatactatagagactctaatgctactcgccttgatagccgtactaacaggcggggtgacattgttctttttatcgggaaagggactaggtaaaacaagtatagggcttctgtgtgttacagcatctagtgcattgttatggatggcaagtgtcgaaccacattggatcgccgcatctattatcttagagttctttttaatggtactactcatccctgagccagacagacaacgtacaccgcaggacaatcaattagcatatgttgtaattggattgttatttatgattctaacggtagctgcaaacgaaatggggcttctggagacaactaagaaagatctaggtattggccacgtagcggcggaaaatcaccagcatgctactatgttagatgttgatctcagacctgctagcgcatggaccttatacgcagtagccacaaccgtaataacccccatgatgagacataccatagaaaatacaacagccaacatatcacttactgcaatagcgaaccaagcagcaatccttatgggactcgataaaggatggccaatatcgaaaatggatataggtgttcctttattagcactggggtgttattcccaagttaatccactcactttaactgccgccgtattaatgctagttgctcactacgctatcattggtccaggactccaagcaaaagccacaagagaagcgcagaaaagaactgcagcgggtataatgaaaaatcctacggtcgatggaatagtcgctattgatctagatccagttgtatacgatgcgaagtttgaaaaacaacttggtcaaataatgttattaatactctgcacctcacagattctgttgatgagaactacatgggcgctatgcgaaagtattacgttagccactggaccattgacaacactatgggagggatctccaggcaaattctggaatacaacaatagctgtatcgatggctaacatatttagggggtcatatcttgctggtgcaggtcttgcattttcacttatgaagtctctgggcggtggaagaagggggactggggcacagggagaaacgttaggtgaaaaatggaaaagacaattaaatcaactatcgaaatccgaatttaatacgtacaaaagatccgggataatggaggttgacagatcggaggccaaggaaggacttaagcgaggagaaaccacgaagcatgcggtaagcagagggacggctaagttgcgatggtttgtagagagaaatctcgttaaaccagaagggaaagtaatagacctaggctgcgggcgaggagggtggtcatattattgtgccgggctaaagaaagttactgaggttaaagggtacaccaaagggggaccaggacatgaagaaccaataccaatggcaacttatggatggaatttggtaaaattacattcaggtaaagatgtattctttatgccccctgaaaagtgcgatacattgctatgcgatattggagagtctagtccaaaccccacaatagaagaaggtaggactttaagggtacttaagatggtagaaccatggttaagaggaaaccaattttgtataaagatattgaatccttatatgccatcggtagttgagacacttgagcaaatgcagcggaaacatggtggaatgttagtaaggaacccactttcaagaaacagtacgcatgaaatgtattgggtgagctgcggaactggcaatattgtttccgcagtaaatatgacgtccaggatgctgctaaatcgattcactatggcacacaggaaaccaacatacgaaagagatgtagatttaggcgcaggtacaaggcatgttgcagtggagccggaagtcgcaaacttagacatcattggtcaacgaatagaaaatataaagaacgagcataaaagtacgtggcattatgatgaagataatccatataaaacgtgggcctaccatggctcttatgaggtaaaaccgagcggtagtgcttcctcaatggttaatggggtagttagactcctaaccaaaccatgggacgttatcccaatggtcactcaaattgcaatgacagacacaacaccgtttggccagcaacgagtttttaaagaaaaagtggacacccgaactcctagagcgaaaaggggcaccacacagataatggaggtaactgctaagtggttatggggatttctatcgagaaataagaaacctagaatttgtactcgagaggaatttaccaggaaagtcagatcaaatgctgccataggggcggtttttgtagatgagaatcagtggaactcagccaaagaagcagttgaagatgaacgattctgggatctagtacatagagaacgagaattacacaaacaaggaaaatgcgcaacgtgcgtgtataacatgatgggcaaacgtgagaagaaacttggggaatttggtaaagccaaagggtctcgagcaatatggtacatgtggctaggagccagattcttagaatttgaagccttggggtttatgaatgaagatcattggttctctcgtgagaatagtttaagtggtgtcgagggggaagggctacataaacttggatacatcctaagagacataagcaaaatcccaggaggtaatatgtatgcagatgatacggctggctgggacacccgcattacagaagatgacttacaaaatgaagctaaaatcacggatataatggaacctgaacatgcattattagcaaccagcatttttaaattaacgtaccaaaataaagtagtaagggtgcagaggccagccaaaaatggaactgtaatggatgtaatttcccgtagagatcaaaggggatcaggtcaagtaggtacttatggtttaaataccttcacaaatatggaagttcagttaataagacaaatggagtccgaaggaatcttccttccgtccgaactagaaacgcctaatttggcggagagagtactggactggctcgaaaaacacggggcagaaagacttaagagaatggcaatatcaggtgatgattgtgttgtaaaacccatagatgacaggtttgctacagcactcacagcacttaatgatatgggcaaagttagaaaggatatcccgcaatgggagccgtcaaaaggatggaacgattggcaacaggtacctttttgttcgcaccatttccatcaactaatcatgaaagatgggagagaaatcgtggtaccctgcagaaatcaagatgaattagtcggcagggcccgggtgtcccaaggtgcggggtggtcactgcgtgagacggcttgtctaggtaaaagctacgcacaaatgtggcagctaatgtactttcatcgacgtgatcttcggttagcagcaaacgctatatgttctgccgtcccggtggactgggtcccaacatcccgaaccacatggagcattcacgctcatcatcaatggatgacaacggaagatatgttgtctgtttggaatcgagtctggatcgaagagaacccgtggatggaagacaagacccatgtttcgtcctgggaagaagtaccttatttaggaaagagggaggaccaatggtgtggatctctaattgggttaactgccagagcaacttgggcaaccaatatccaagtggccataaaccaagtaaggagactaataggaaatgaaaattatttggatcacatgacatctatgaaaagatttaaaaacgagtcggatcctgaaggagcattatggtag

SEQ ID NO: 21317 - RNA, 9879 nt, synthetic construct
  misc_feature 1..9879: note = derived and/or modified CDS sequence (opt6) from DENV-1__FJ410290__SS-prME
  source 1..9879: mol_type = other RNA
tccgtaactatgttactcatgctcttacctacagctttagcatttcacctaacaacgaggggaggcgaaccgcatatgattgtaagtaaacaagaacgaggcaaaagtttgctgtttaaaacttcagccggtgtaaatatgtgtacacttatagcaatggatctgggtgaattatgcgaagacaccatgacatataaatgtccacaaattacggaagcagagcccgacgatgtagattgttggtgcaatgctacagacacgtgggtgacgtacggtacgtgctctcagaccggcgaacatcgtcgagagaaacgtagtgtggcattagctccacacgtgggactcggcttggaaacaagaactgagacatggatgtcgagcgaaggcgcatggaaacagatacaaagagtagaaacatgggcgttacgacatcctgggtttacagtcatcgcactattcctagcacacgcaattggaacatccataacccaaaaaggaatcatatttatactcttaatgttagtaaccccttctatggcaatgaggtgcgtaggtattggtaatagagattttgtcgaggggttatcaggagcgacatgggtagatgtagttctagagcacggtagttgtgtaacgacaatggctaaaaataaaccaacattagacattgaattactgaaaacggaagtaacaagcccagcaattctacgaaaactttgcatagaagcaaaaatatcaaataccaccacagactctagatgtccaactcaaggtgaagcaacacttgttgaagaacaagatgctaactttgtttgcagaagaacattcgtagatcgaggctggggaaatggctgtggactttttggaaaaggatccttattaacttgtgcaaaatttaaatgtgttactaaacttgaaggaaaaatcgtacaatacgaaaatctaaaatacagtgtaattgtaacagttcatactggagatcaacaccaagttggcaatgagacaaccgaacacggaaccatcgcaaccattacaccgcaggctcctacatccgagatacagcttaccgactacggagcacttacattagactgttcacccagaactgggcttgattttaatgagatggtattattaacaatgaaagagaaatcttggcttgttcacaaacaatggtttttagatttacctctcccgtggacaagcggcgcgagtacaagccaagaaacttggaatcgccaagatcttttagttactttcaaaactgcgcacgccaagaaacaagaggtagtcgtcctaggatctcaagaaggcgccatgcatactgcactaacaggggcaacagagattcaaacgagtgggactacgactattttcgcaggtcatctaaaatgccgtttaaaaatggataagttaacactaaagggaacctcgtacgtgatgtgcacaggtagtttcaagttagaaaaggaagtagctgaaacgcaacacggtactgttcttgtacaagtcaaatatgagggaaccgatgcaccttgcaaaattccattttccacgcaagacgagaaaggagttacacaaaatggtaggctgataacggctaatcctatagttacagacaaagaaaaacccgtcaacattgaaactgagcctcctttcggagaaagttatatagtcgtaggggccggagaaaaggccttaaagctaagctggttcaagaaaggatccagtataggaaaaatgttcgaagccacggcaagaggagcccgaaggatggctatacttggtgacacagcttgggatttcggttccattgggggagtatttacatctgtaggaaagttggttcatcaggtttttggtacagcttatggagtcctgttttcgggagtaagttggacaatgaaaatcggtataggaatattattaacttggttgggactaaactcaagaagcacatccttatcaatgacgtgcattgcagttggtatggtaacgctttacctcggcgtaatggtacaagcagattctggatgtgtaataaactggaaaggtcgtgaattaaaatgtggctcaggcatctttgtcacaaatgaagtacacacatggactgagcaatacaaatttcaagcagacagtcccaaacgccttagcgccgcaataggaaaagcatgggaagagggggtttgtggtattagatccgcgacaagattagaaaatataatgtggaaacaaatttccaacgaactaaaccacatcttgttggaaaacgatatgaaattcactgtagtagttggtgatgctaatggcatattggctcaaggcaagaaaatgataaggccacagccaatggaacacaaatatagttggaagtcgtggggcaaggcaaaaataatcggtgcagacattcaaaatactacattcattatagatgggccagacaccccagaatgtccagataatcaacgagcatggaacatctgggaagttgaagattatggttttggtatattcacaaccaacatatggttaaaattgagagatagttatacgcaaatgtgcgatcaccgactaatgagtgcagccataaaagactctaaagccgtacatgcagatatgggttattggatagaatcagaaaagaatgaaacgtggaaattggctagagcttctttcattgaagtaaagacatgtacctggcccaaaagtcatacattatggtctaatggggtattagaatcagaaatgatcattccgaaaatttacggtggacccatatcccagcataattacaggccgggatatttcacccaaacagctggaccatggcacttgggtaagttagaactagactttgacctttgcgagggtacaaccgtggtagtcgacgagcactgcggcaacagaggcccaagccttagaaccacgacagtaaccggaaaaatcatacatgagtggtgctgcagaagttgcacacttccacctctgaggtttcggggtgaagacggatgttggtacggaatggaaattagacccgtgaaggagaaagaagaaaatctcgttagatctatggtaagcgccggttcaggcgaggtagatagtttttctcttggaattttatgtgtgtcgatcatgatagaagaggtaatgaggtcccgatggtcacgaaaaatgctaatgacaggtaccctagttgtgtttctattgctaataatgggccaattaacctggaaagatctaatcaggctctgtataatggtaggggcgaatgcttcagacagaatgggaatgggtactacttatttagcactgatggcaacttttaaaatgagaccaatgttcgctgtaggattattatttcgaagattgacaagcagagaggttttactccttacaataggactgtcattagttgccagtgtagaactacctaacagtctagaggaattaggggacggtttagctatgggaatcatgatgctcaaattgcttacagaatttcagcctcaccagttatggactaccttattatcgctaacatttataaaaacaacgctctcattagattatgcctggaaaacaaccgctatggcactatcgattgttagcctatttcctctatgtttaagcacaacgagtcagaaaacgacgtggcttccagtactactgggcagttttggatgcaagccacttacgatgttcctaattactgaaaataaaatttggggtaggaaatcgtggcctttaaacgaaggaattatggcaataggtatagtatcaatattgctgtcatctctactcaaaaacgatgtcccactcgccggaccattaatcgcgggaggaatgttgatagcatgctatgtcatatccggtagtagcgccgacctatcgctagaaaaagcagctgaggtgtcatgggaacaagaggcagaacatagcgggacttcgcataacattttggtggaagtccaagatgacggaactatgaagatcaaggacgaggagcgagatgatacgctaaccatcttactcaaggccaccctactcgctgtctctggagtgtaccccatgtcaatccctgcaactctttttgtttggtacttctggcagaagaaaaagcaaaggtcgggagtattatgggatacaccatcgccacccgaagtcgaaagagcggtgctagatgatggaatctatagaatattgcaacgtggactgttgggaagatctcaagttggggtgggtgtatttcaagatggggttttccatactatgtggcatgttacaagaggagccgtcttaatgtatcaaggtaaacgattggaacctagttgggctagtgttaagaaagatctaatcagttacggaggaggctggcggtttcaaggcagctggaataccggggaagaagttcaagtgattgcagtggaaccaggtaaaaatcctaaaaatgtacaaacgacaccaggaactttcaaaaccccagagggggaagtcggcgccattgcacttgatttcaagccaggtacctccggatcacctatagtaaatagagaggggaaaatagttggtttatatgggaacggagtcgtaacaacctctggtacgtacgtatcggctatcgcccaagccaaagcatcgcaagaaggcccactacctgaaattgaagacgaagtgtttaagaaaagaaacctaacaatcatggatttgcatccaggatctggcaaaactcgtagataccttcccgcgatagtcagagaagcgataaaaagaaaattacgaacacttatcttggcaccaacaagggtagtggcctcagaaatggccgaggcgttaaaggggatgccaattcgataccagacaaccgctgtaaagtctgaacacacaggacgagaaatagtggatctaatgtgtcatgcgacttttactatgcgtttattaagtccagtcagagtcccaaactataacatgataatcatggatgaggcgcattttaccgaccctgcatctattgcagcgaggggttatatttcaaccagggtgggtatgggtgaagcagccgctatattcatgacagccacgccgccaggttctgtggaagccttcccacaatcgaatgcagtcattcaagatgaggaaagagatattcctgaacgttcgtggaactcaggttatgactggattacggattttccaggaaagacggtatggttcgtgccttcgattaaatctgggaatgatatagcaaattgcctaaggaaaaatggtaagagggttattcaactaagtcggaagacttttgataccgaatatcagaaaactaaaaataacgactgggactacgtagtaactacagacatatccgagatgggggcgaattttcgtgcagaccgagttatcgaccctcgaagatgtctcaagccggtaattttgaaagatgggccagaaagagtcatcttggcaggtccaatgccggtgacagtagcaagtgctgcacaaaggaggggtagaataggtcgaaaccaaaacaaagaaggcgaccaatacgtatatatgggtcaacctttaaataacgatgaagatcacgcgcattggactgaggcaaagatgttactagacaatatcaataccccagaagggataatacctgcactgtttgaacctgaacgggagaaaagtgctgcaatagatggagaatacagacttcgaggggaagctagaaaaacgtttgtagaattaatgcgacgtggtgatctcccagtatggttgtcatacaaagttgcatcggaggggtttcaatacagcgataggagatggtgctttgatggtgagcgcaacaatcaagttctagaagagaatatggatgtggaaatatggacaaaggaaggagagagaaagaaattacgaccccgatggctagatgctaggacatactcagaccccctcgcacttcgagaatttaaagagttcgcagcaggtaggcgatctgtcagcggcgatctaatattggaaataggaaaacttccgcaacacctaacgctcagggcgcaaaatgcgctggacaaccttgtcatgctacacaattccgaacagggaggtaaagcatatcgacacgcaatggaagagttaccagataccatagagacattgatgctcttggccctaatagcagttttgactggcggagtaacactatttttcttatctgggaaagggcttggaaaaacgtctataggactattatgcgtcacggcatcaagtgccttactatggatggcctccgtagaaccgcattggatagcagcaagtattattttggagtttttcctaatggtcctgctaatcccagaacctgatcgccagagaacgcctcaagacaatcagttggcatatgtagtgataggcctactatttatgatcttaacagtggcagcaaatgaaatggggttattggaaacaaccaagaaagatttaggaataggtcatgtcgcagctgaaaatcaccaacacgcaaccatgctagacgtagatttgaggccggccagcgcgtggacgctatatgcagttgctacgacagtaataacgccaatgatgagacacaccatcgaaaatacaacagcgaacataagtttaactgcgattgccaaccaagcggccattctgatgggtctggataaggggtggcctatttcgaagatggacattggtgtgcccctactagcactagggtgttatagccaggtgaatccattaactctaacagccgcagtcttaatgttagtggcgcattacgctataattgggccgggtctccaagcaaaagctaccagagaggctcagaaaaggactgcggctggaataatgaaaaatcctacggtcgatggaatagtcgcaattgatcttgacccagtcgtatatgatgcaaaatttgagaagcaacttggtcagattatgttactgattctatgcactagccaaatattattaatgagaacaacatgggcactatgtgaatccataacgctggctacaggaccattgaccacactttgggaagggagtccgggcaagttctggaacaccactatagcagttagcatggcaaacatatttagaggatcgtacttagccggtgcaggccttgccttctcacttatgaagtccctagggggtggccgaagaggaacgggtgcccaaggtgaaacacttggcgaaaaatggaaaagacaactcaaccaattatcgaaaagtgaatttaatacgtacaagcgaagcggtatcatggaagtagaccgtttcgaagcaaaagaaggattaaaacggggtgaaaccacaaagcatgcagtctcaaggggaaccgcaaaattacgatggtttgtcgaaagaaacctagtaaaaccagaagggaaagtaatagatctaggatgtgggagaggtggatggtcttattattgtgccgggcttaagaaagttactgaagttaaagggtatacaaagggagggcctggccacgaggaacctatacctatggctacatacggctggaatttggttaaactccattctggaaaagacgtattctttatgccacctgaaaaatgtgatactctgttatgtgatatcggcgagtcaagtccaaatcctacaatagaagaaggacgtaccctaagagtattgaaaatggtagaaccttggttgagaggaaatcaattctgcattaaaatacttaatccatacatgccatcagttgtcgaaacactcgaacaaatgcagcgaaaacatggcgggatgctagttcgcaatccgttatcgcgtaacagcactcacgaaatgtactgggttagctgtggcaccggaaacattgtaagtgcagtcaatatgacgagccgaatgttactaaataggtttactatggcgcacagaaagcctacatatgagcgggatgtagacttaggagcaggcacacgccacgtagctgtcgagcctgaggttgcgaatttagacataatcggtcaaagaatagaaaatataaagaacgaacataaatcaacttggcactacgatgaagacaatccctacaagacctgggcttaccatggatcctacgaagtaaaaccaagcggctctgcgtctagcatggtcaatggtgtggtaaaattattaactaaaccctgggatgtcataccaatggtaacgcaaattgccatgacagataccacgccattcggacaacagcgcgtcttcaaagaaaaggttgatacgagaacaccacgagcaaaacgaggtactacccagatcatggaagtaacagctaaatggctctggggtttcttgtccagaaacaagaaacctagaatctgcacccgtgaagagttcacaagaaaagtacgttcaaacgcggcaatcggagcagtctttgtagatgaaaatcaatggaacagtgcaaaagaagccgtagaagatgaaagattttgggatctagttcatcgcgaaagggagttacataagcaggggaaatgtgcgacttgcgtctataatatgatggggaagagagagaagaaattaggagaatttggcaaagccaaaggatcacgggctatatggtatatgtggttaggggccagatttctcgagtttgaggctttgggttttatgaatgaagaccattggttctcaagagaaaattcattaagtggggtagaaggagaggggctccacaaactgggatacatcctaagagatattagtaagatccctggaggaaacatgtatgcagacgatactgccggttgggatacaagaataacagaagatgatttgcaaaatgaagctaagatcactgacatcatggaaccggaacatgccttattagctacttctattttcaaactaacatatcaaaataaagtagttagagtgcaacggccagccaaaaatggaaccgtgatggacgttataagccgccgcgaccagcgtggttcagggcaagtgggaacatatggtcttaatacgtttacaaacatggaagttcagctgatacgacagatggaatcagaaggaatctttttaccatcagaactagaaacaccaaatttggctgaacgtgtgttagattggctagggaaacatggggcagaacgattaaaacgaatggctatcagcggggatgattgtgttgttaaaccaatagatgacaggtttgcaactgcattaactgctttgaatgacatgggaaaggttagaaaagatataccacaatgggaaccatctaaaggatggaatgattggcaacaagtaccattctgcagccatcacttccaccaattaataatgaaggatggaagggaaatagtagtaccttgtcgaaaccaagacgaattagttggccgtgcaagagtaagtcaaggcgccggctggtcgctgagggaaacagcatgtctaggcaagagctacgctcaaatgtggcaactgatgtatttccatcgacgagacctaagattggctactaacgccaagtgttcagctgtcccagtagattgggtaccaacaagcaggactacatggagcatacatgcacatcatcaatggatgacgactgaagatatgctaagtgtatggaatagagtgtggattgaagaaaatccgtggatggaggacaaaacgcacgtctccagctgggaagaagtaccatatcttggtaagcgtgaagaccaatggtgtggaagcctcattggccttacagctagagccacgtgggcgactaacatccaagtcgcaattaatcaagttagacgtttaatcggtaacgaaaattacctagattacatgacatccatgcgaagattcaagaacgaaagcgacccggaaggagcactctggtaa

SEQ ID NO: 21318 - RNA, 9879 nt, synthetic construct
  misc_feature 1..9879: note = derived and/or modified CDS sequence (opt6) from DENV-1__FJ024423__SS-prME
  source 1..9879: mol_type = other RNA
tctgtgactatgctcctgatgctattgccaactgcactagcgtttcacttgactactcgaggaggagaaccacatatgatagtaagcaaacaagaaaggggaaaatctctcctatttaaaacttctgccggtgtgaatatgtgtacactaatagcaatggatctaggggaattatgtgaagacacaatgacgtacaaatgcccacagataacagaagcggaacccgatgatgttgattgttggtgcaatgcaaccgacacatgggtaacgtacggaacgtgcagtcaaacaggagaacaccgtagggataaacgaagcgtggcgttagcccctcatgtagggttagggctggaaactagaaccgaaacctggatgtcaagtgaaggtgcctggaaacaaatccaaagagtggaaacttgggctttaaggcatccagggttcactgttgtagctttctttttagctcatgcaataggtacaagtattacccaaaaaggaattatatttatattgttaatgctggtaacaccctctatggcaatgcgatgcgtaggaattggaaacagagacttcgttgagggcctcagtggtgcgacatgggttgatgttgtattagagcacgggtcctgtgtgacgaccatggccaaaaacaaaccaactttagatatcgagctattaaaaacagaagtaactaatcccgccatccttcgtaaactctgcatagaagcgaaaatatctaacactacaactgattcaagatgtcctacacagggtgaggcaactcttgtagaagaacaagatgccaatttcgtttgtcgaagaacttttgtagacagaggatggggcaatggatgcggcctttttgggaaaggctctttactaacttgtgcgaaatttaaatgtgtgacaaaactagaaggtaaaatagtacaatatgaaaaccttaaatattcagtaattgtgacggtacacaccggagaccaacaccaagttggtaatgagaccacagaacacggcacgatagcgataataacaccacaagcaccaacatccgagatacaactcacggactatggagctttgacccttgattgttcaccacgaacagggctagatttcaatgagatggtactacttacaatgaaagagaaaagctggctagtgcataaacaatggttcctagatttaccattaccctggacgtccggagcaagcaccagtcaagagacatggaatagacaggatcttctagtaacatttaaaaccgctcatgctaagaaacaagaagtggtcgtactaggcagtcaggaaggagcaatgcacaccgcactgactggagcaacggaaatacaaacatctggaacgacaactatttttgctggtcaccttaaatgcagactaaaaatggacaaacttacattaaaaggaacatcatacgttatgtgtaccggtagtttcaagctagaaaaagaagtagcagaaacacagcatgggacagtactggtgcaagtgaaatacgaggggacggatgcaccatgtaaaatcccttttagtacccaagatgagaagggagtgacgcaaaacggaaggttaataacggctaacccaatagtaactgataaagaaaaacctgtaaacattgagacagaacctccattcggagagtcctacattgttattggcgcaggggaaaaagctctgaaattatcttggttcaagaaaggtagttcaataggtaaaatgtttgaagcaaccgctagaggcgccagaagaatggctattcttggtgatactgcttgggattttggcagtatagggggtgtatttacaagcgtagggaaattagtccaccaagtctttggtactgcatatggcgttcttttcagcggcgtaagctggacaatgaagatagggataggcatactacttacatggctaggtctgaacagcagatcaacctctctttcaatgacatgtattgcagtcggaatggttaccctatacctcggtgtaatggtgcaagcagatagtggctgtgtaattaattggaagggcagagaactaaagtgtggaagtggtatttttgttacaaatgaggtacatacttggactgaacagtacaaatttcaagcagattcacctaaaagactatcggctgcgataggtaaagcatgggaagaaggtgtctgtggcattcgttctgcgacgagacttgaaaacattatgtggaaacaaatatccaatgaattaaatcatatattattagaaaacgacatgaagttcaccgtagttgtaggggacgcaaatggtattcttgcacagggcaagaaaatgattagaccgcagccgatggaacacaaatattcctggaagtcatggggaaaagcaaaaattataggggcggacatacaaaataccactttcataatcgacgggccagatacgcctgaatgtcctgacgatcaaagggcatggaacatatgggaggtggaagactatggtttcggaatattcacaacaaatatatggctgaaactgagggattcttatacgcagatgtgcgatcatcggcttatgagtgcagcgatcaaagacagtaaggctgtgcatgcagatatgggatattggatagagagcgagaaaaatgagacatggaaactagctcgggcatcatttatcgaagtaaaaacatgtacctggcctaagagtcacacactatggtctaacggtgtgctagaaagcgaaatgattataccaaaaatatatggaggacccatctctcaacataactaccgaccagggtattttactcagacagccgggccctggcatttaggaaaacttgaactcgattttgacctatgcgagggaaccaccgtagtggtagatgaacattgtggaaaccgaggacccagcttaaggactacaactgtcacgggtaaaatcatacacgaatggtgctgtaggtcatgcactctccctcccctcagatttcgaggtgaagatggatgctggtatggaatggaaatacgcccagtgaaagaaaaagaggagaatcttgtacgttcaatggttagcgcgggatcgggagaggtagatagtttcagtctagggatactatgcgcgagcattatgattgaggaggtaatgagatccagatggagcagaaaaatgcttatgacagggaccctagcagtcttcctcttattgataatgggacagttaacttggaatgatctaattcgattatgtattatggttggagctaacgcttctgatagaatggggatgggaactacatacctagcgttaatggcaacttttaagatgaggccaatgtttgcggtcggactactattcagaagattgacctcgagagaggttctcttgttaactattgggcttagtctagtggcttcagttgagcttcctaatagtttggaagagttaggcgacggattagcaatgggaataatgatgctaaaactacttacggaatttcaaccacaccaattatggactactttacttagtctgacattcattaaaactacgctaagtcttgattatgcttggaagactactgcaatggcgttgtcgatagtatcattatttcctttgtgtctgtccactaccagtcaaaagactacatggctaccggtccttcttggttcatttggttgcaaacccttaacaatgttcctaataacggagaataaaatctggggaagaaaaagttggccgctaaacgaaggaattatggcaataggcattgtatcaatattgttatcgagtttactaaagaatgatgtaccattagctgggccattaatagcgggtggaatgctgatagcatgttatgtaatatccggatcctcagctgacttatcgcttgaaaaagcagcagaggtctcatgggaacaagaagctgagcattcaggaactagccacaatattctggtagaggttcaagatgacggtaccatgaaaattaaagatgaggaaaaagatgacacgctcacaatattacttaaagcaactttactggcagtttctggtgtgtatccaatgagcatcccggcaacattatttgtatggtacttctggcagaaaaagaaacaacgatcaggagtcctatgggacactccatcccctccagaggtggaaagagcagttttagatgacggtatataccggatccttcagaggggactcctaggtagatcccaggtgggtgtaggagtatttcaggacggagtatttcatacaatgtggcatgtaacaagaggggcggttcttatgtaccaaggaaaacgattagaaccgagttgggctagcgtgaagaaagatctcatttcatatggaggaggatggcggtttcagggaagttggaacacaggggaagaagtccaagtaattgcggtggagccaggtaaaaatcccaaaaatgtacaaacgacaccagggacgtttaaaacgccagaaggtgaagtaggagctatagcgttagatttcaaaccgggaaccagtggaagccctattgtcaatcgcgagggcaaaatagtaggattgtatgggaatggagtagtaacaacaagtggaacatatgtctcagcaatagcccaagcaaaggctagtcaagaaggcccacttcctgaaattgaagatgaggtttttaagaaaagaaacctgactattatggacctccatcctggttcaggtaaaaccagaaggtatctaccggcaatagtgagagaagccataaaacgaaaattacgaacactaatcttagcaccgaccagagtagtagcaagtgagatggcagaggctttaaaaggtatgcctattaggtatcagacaacagctgtcaaatcagaacatacgggacgtgagattgttgatttgatgtgccatgcaacctttaccatgcgactgttatctcccgtaagagtacctaactataatatgatcattatggacgaagcacacttcacggatcccgcttcgatcgccgcaagagggtacatttcgaccagagtaggcatgggtgaagcagctgctatttttatgacggctaccccgccaggatcagtagaagcctttccacaatctaatgccgtaatacaagatgaggaacgagacatcccggagcgttcgtggaatagtgggtatgactggataaccgatttcccggggaagactgtgtggttcgtaccaagtattaaatctggaaatgatattgcgaattgtttacggaaaaacggtaaaagagtcattcaattaagtcgaaaaacatttgacacagaataccagaaaacgaaaaacaatgactgggattacgtagtaacaaccgatattagtgaaatgggtgctaatttccgtgcagatcgcgttatagatccacgacgatgcttaaaaccagttattttaaaggatggtcctgaacgggtaatattagcaggtcctatgccggttactgtggcaagtgcagcacaaaggcgtgggagaataggtcgtaaccagaacaaagagggggatcaatatgtttatatggggcaaccattaaataacgacgaagatcatgcacactggaccgaggccaaaatgttacttgataacataaatactccagagggcatcatcccagccctatttgagccggaacgtgagaaaagcgccgccatagatggtgagtatagattaagaggagaagcgcgtaaaacttttgtagagcttatgagaagaggagatctacctgtctggttaagctacaaagtagcttccgaaggatttcaatatagtgaccgaaggtggtgttttgatggggaaaggaacaaccaagtactcgaagaaaatatggatgtggaaatttggactaaagaaggtgaaagaaagaaacttagaccgcggtggttggatgcaaggacgtattcagatcctcttgctttgcgtgaatttaaagagttcgcggcagggcgcagatccgtcagtggagatttgattctggaaataggtaaattaccccaacatctaacccttcgcgcacaaaacgccctagacaacctggtaatgttgcacaattctgaacaaggaggaaaggcctaccgtcatgccatggaagagttaccggatacgatagaaacgttgatgttattagcgctcatagcggtactaacgggaggagtgacattgttcttcttatcaggaaaaggactagggaagacatccatcggactattatgcgtcaccgcgagttctgcattgctatggatggcaagtgtagaaccccactggattgctgccagtattatcttagaatttttcttaatggtcctattgattccagaacccgatcggcaacgaacaccacaagataatcaactcgcctacgttgtcataggtctgctattcatgatacttaccgtagctgcaaatgaaatgggattattggaaacgacgaaaaaggatttggggattggccatgttgccgcagaaaaccaccagcatgctactatgctagatgtcgacttaagacctgcgtcggcatggaccctgtatgcagtggccaccactgtcatcaccccaatgatgcgtcatacaattgagaacacgacagcaaatatctctttaacggccattgcgaatcaagccgcaatattaatgggtttggataaagggtggcctattagcaaaatggacattggtgtaccactgcttgcgttagggtgctacagtcaagtgaacccccttacactcacagccgctgtcctaatgctagtggcgcattacgcaatcattggcccgggcttacaagctaaggctacacgggaagcccaaaaacggaccgccgctggaattatgaaaaatcctactgttgatggtatagttgcgattgatctagatcctgttgtttatgacgcaaaattcgaaaagcaacttgggcagataatgcttctaattctttgcacatcacaaatactcttaatgcgaaccacgtgggctctatgtgaaagtattactctggcaactggtccattgacaacactctgggaaggtagccccggaaagttttggaatactactatagcggtgagtatggcaaacatttttcggggaagctaccttgcgggtgctggtctcgctttttcgctaatgaaatccttaggcgggggaaggcgtggtacaggcgctcagggtgaaactttaggagaaaaatggaaacgacagctaaaccaactgtcaaagtcagaatttaacacttataaacgatcagggataatggaagtagatagatctgaagctaaggagggactaaaaaggggagagacgacgaaacacgcagtgtctaggggcacagctaaactccgatggtttgtagaacgaaatctagttaagccagaaggaaaggttatagacttaggttgtggacgaggcggatggagctactactgcgctgggttaaagaaagttacagaagtaaaaggttatacaaagggaggtcccggtcatgaggaaccaattccaatggctacctatggatggaacttagttaaattgcattcaggaaaagatgtcttcttcatgccaccagaaaaatgcgatacgctgctttgcgatataggtgaatcgagtcctaacccaacaatagaagaaggacgtacgttaagagttcttaaaatggtagagccgtggctaagaggcaatcaattttgcataaaaatattgaatccgtacatgccatcagtagtagagactttagagcaaatgcaaagaaaacacggaggaatgttagttaggaaccctctcagccgaaactcaacgcacgagatgtattgggtaagttgcggaacaggcaatatagtctcagctgtgaatatgacatcacgaatgctgcttaacagattcacaatggcacataggaagcctacctatgaaagagatgtagatctcggggctgggacgaggcatgtggcagtcgaacctgaagttgcgaacttagacatcataggacagcgaatcgagaatatcaaaaacgaacacaaatctacctggcattacgatgaagataacccatataaaacttgggcgtatcatggatcgtatgaagtcaagcctagcggaagtgcctcttccatggtaaatggtgtagttagattgctaacaaaaccctgggatgtgatacccatggtcacacaaatagcaatgaccgatactaccccttttggtcaacagcgagttttcaaagaaaaggtggacaccagaacaccacgagcaaaacgtggcaccacccaaattatggaggtaaccgccaagtggctatggggtttcttaagccgtaataagaaacctagaatttgcacacgagaagagttcacaaggaaggtaaggtctaatgcggctattggtgccgtattcgtggacgagaatcaatggaacagtgctaaggaggcagtagaggatgaaagattttgggatcttgtacatagagaacgtgaattacacaaacaaggaaaatgtgcaacctgcgtgtataatatgatgggtaagcgcgaaaagaagttaggtgagttcggcaaagcaaaaggtagcagagctatatggtatatgtggctcggtgcacgttttctagaatttgaggctttgggattcatgaacgaggatcattggtttagcagggaaaattctctctccggtgttgagggcgagggcttacataaattgggatatatattaagagatataagtaaaatacctggtgggaacatgtacgcggatgatactgcgggttgggatactagaataacagaagatgatctccaaaatgaagcaaaaataacagatataatggaacctgaacatgcgttactagcaacaagtatttttaaactgacatatcaaaacaaagttgtaagagtgcaacggcccgctaaaaacggaaccgtgatggatgtgataagtagaagagatcagcgcggttctggacaagttggaacctatggtctaaacacatttactaatatggaggtacagcttataagacaaatggagtcagaggggatattccttccttcagaactagaaacaccaaacctcgcaaaacgggtattagattggctagaaaaacatggtgctgaaaggttaaaaagaatggcaatatcaggtgatgattgtgtcgtaaagcccatagatgatagatttgcgactgcgctaactgctttaaatgatatgggcaaagtgagaaaggatatcccgcaatgggaaccaagtaaagggtggaatgattggcagcaagttcctttctgctcacatcactttcatcagctcattatgaaagatgggagagagatagttgtaccgtgtaggaatcaagacgaactcgttggcagagctagagtgagccaaggagctggatggagcctaagagaaacagcgtgtctgggaaaatcctatgctcaaatgtggcaacttatgtattttcatcgcagagatctcagactcgccgccaacgcaatatgcagtgccgtaccagtggactgggtccctacatcaagaacgacgtggtcaatacatgcacatcatcagtggatgacaacagaagacatgttatcagtgtggaaccgggtttggatagaagaaaatccatggatggaggacaagactcatgtgagtagttgggaagaagttccatatttgggaaaaagagaagaccaatggtgcggtagcttgatcggattaacggccagagctacttgggcaacaaacattcaggtggcgattaaccaggtaaggagattgattgggaacgagaattatctcgactacatgacaagtatgaaacgattcaagaacgaaagcgatccagagggcgcactctggtag

SEQ ID NO: 21319 - RNA, 9879 nt, synthetic construct
  misc_feature 1..9879: note = derived and/or modified CDS sequence (opt6) from DENV-1__FJ547089__SS-prME
  source 1..9879: mol_type = other RNA
tctgtcacaatgctactaatgttactgccaactgcgcttgcatttcacttgactactagaggtggtgaacctcatatgatagtatccaaacaagaaagaggtaaatcactactttttaaaacatcggctggtgtgaatatgtgtacactaatagcaatggatctaggggaactatgtgaagatactatgacttacaaatgcccacaaatcacagaagcggaacctgacgacgtcgattgttggtgtaacgcaactgacacatgggtaacatatggaacgtgcagccaaacgggagagcaccgtcgggacaaaagatctgttgcattggcaccacacgtaggattaggattagaaaccagaactgaaacatggatgagctccgaaggggcatggaaacagatccagcgggtagaaacttgggctcttagacatcccggattcaccgtaatagcactattcttagctcacgctataggcacctcgatcacacaaaaaggaataatttttatactactgatgttagtaacaccatctatggctatgcgttgtgtgggtataggaaatcgggatttcgtcgaaggcctgagcggtgcaacatgggttgacgtagtcttggaacacggatcttgcgtgacaacaatggccaaaaacaaaccaactttggatatagaattactgaaaacagaggtgacaaaccctgcaatactaaggaaattatgtatcgaagctaaaatatctaacactactaccgactccaggtgtcccactcagggagaagcaacgttagtcgaagaacaagatgcaaatttcgtttgtaggagaacatttgtcgacagaggctgggggaacggatgtggactttttggcaaagggagtttattgacttgtgcgaaattcaaatgtgtaacaaaattagaaggcaaaattgtccagtatgaaaacttaaaatattcggtaattgtcacagttcatacaggtgatcaacatcaagtggggaacgagacaacggaacacggaacgatcgcaactattaccccacaagcgccaacgtcagaaattcaattaacggattacggggccctaactcttgactgctctccacgcaccggattggatttcaatgaaatggtgttactgacgatgaaagaaaaatcctggttagttcacaaacaatggtttttagatctacccctgccctggacaagtggcgcgtcaacatcacaagaaacatggaaccgtcaagacctcctagtaacatttaaaactgcacacgcgaaaaagcaagaagtggttgtccttgggagtcaagaaggagcaatgcatactgctctaacaggtgccaccgaaattcaaacaagtggaactactacgatcttcgcaggtcatttaaaatgtcgcttgaaaatggacaaactgacattgaaaggcacttcgtatgtaatgtgtacaggaagttttaaactggaaaaagaagtagcagaaacacagcatggtaccgttttggttcaagtgaaatatgaaggtaccgatgccccttgcaaaatacctttctccacgcaagacgagaaaggggtcacacaaaatggaaggcttattacagcaaaccccattgtcaccgataaagaaaaacccgtaaatattgaaacagaaccaccctttggagaaagttacatagtggttggtgccggtgaaaaagcactgaaattaagctggtttaagaaaggttcgagcattggaaaaatgtttgaagcaacagcccgcggtgcacgtagaatggctattctaggagatacagcatgggacttcggaagtattggaggagtatttaccagtgtaggtaaattagtgcatcaagtcttcggcacagcatatggagtactattttcaggagtttcctggacaatgaagattggaatcggtattttattaacatggctaggactaaattcccgttcaactagcttgtccatgacatgtatcgcagttgggatggttaccctttacctaggagtaatggtacaagcagattccggatgcgtaataaattggaaagggagagagctcaaatgtggatcaggaatatttgtcacaaacgaggtacatacatggacggaacaatataaattccaagccgattcacccaaaagactctcggcagctattgggaaggcatgggaagaaggagtttgcggcatcagatcagcgactagacttgaaaatattatgtggaagcagatctccaacgaattaaatcacatactcttagaaaacgacatgaagttcacggttgttgttggggacgcaaacggcatcttggcacaaggaaagaagatgatacggccacaaccaatggaacataaatatagctggaaaagctggggaaaagcaaaaatcataggagcggacatccaaaatacaactttcataatagacggaccagatacgccagaatgtccggataaccaaagagcttggaatatatgggaagtagaagattatgggtttggcatatttacaactaacatatggctcaaactacgggattcatacacacaaatgtgcgatcatcgccttatgtcagcggctataaaggacagtaaggcggttcatgcggacatgggttattggatagaatcagagaaaaatgaaacctggaaacttgcgagggcatcatttatagaggttaagacctgcacatggccaaaaagccatacgttgtggtctaatggtgttctcgagagtgaaatgataataccaaaaatttatggaggtccaataagtcaacacaattatcgacctggttatttcacccaaactgccggaccctggcatttaggaaaattagaattggattttgacctttgcgaaggaacaacagtagtcgtagacgaacattgcgggaaccgcggccctagtttaagaactacgacggtcaccggaaagactatacatgaatggtgttgccgatcgtgtactttacctccactgagatttcgaggagaagatggatgctggtacggaatggaaataaggcccgtaaaggaaaaggaagaaaatctcgtaagaagtatggtcagtgcgggttctggtgaggtggattcttttagcttaggcatactatgcgcctcaattatgatagaagaagtcatgcgatcacgatggagtcgtaagatgctaatgacaggcacactagccgtatttctgttactaataatgggacaattaacatggaacgacctaatacggctatgcattatggtaggagcaaacgcgagcgatcgaatgggcatggggactacttatttagctctcatggcaacgttcaaaatgcgacctatgtttgctgtcggcctgctgttccgtcgcctgacctccagagaagtactcttgctcacaataggtctatctctcgtagcaagcgtggaactgccaaactcgctagaagaactgggagacggtctagcaatgggaataatgatgcttaaattattgaccgagtttcaaccccaccaactgtggacaactctcctctctctaacttttataaaaacgactctgtcccttgattacgcatggaaaaccactgccatggcattaagtattgtatcattgtttcctttatgtctgagtactacaagccaaaagacaacttggctaccagtgctactaggtagctttggatgtaaacccttaactatgtttctgataactgagaataagatttgggggcgcaagagctggccattaaatgaaggtattatggctatcggaatagttagtatattattaagtagcttactcaaaaatgacgttcctctagccggtcctttaatcgccggtgggatgctaatagcttgctacgtaatctcaggaagttcggccgacttatctctagaaaaagccgctgaagtatcatgggaacaggaagccgaacattcaggtacatcgcacaacatattagtggaagtacaagacgacggtacgatgaagattaaagacgaggaacgagatgatactcttactatactattaaaagcgacacttttggctgtttctggcgtataccccatgtcaatacctgccacattatttgtatggtacttttggcagaagaagaaacaaagatcaggagtattatgggataccccgagcccacctgaggtagagcgtgccgtgctggatgacggtatttaccgtattctacagcgaggtttactaggaagatcgcaagtgggggtcggtgttttccaagacggagtattccatacaatgtggcacgtcacgcgaggagcggttctaatgtatcaagggaaacgattagagcctagttgggcaagcgtcaagaaagatctaatctcatatggcgggggatggagatttcaaggttcttggaacacaggggaggaagtacaagttatagctgttgagccaggcaaaaatccgaaaaacgtacaaaccacgccgggtacttttaaaacgcccgaaggagaagtaggtgctatagcgctagacttcaagcccggcacgtctggctcacccatagttaacagagaaggaaagatagtaggtttatatggaaatggagttgtaactacaagcggtacgtatgtatcggcgatcgctcaagccaaagcaagccaagaaggaccgctgcccgaaatcgaagatgaagttttcaagaaacgaaatcttacaataatggatttacatccaggttcaggcaaaacaagaagataccttccagccatagtacgagaagccataaaacgcaaacttagaaccctaatactagcacccacacgggtcgtcgcgtcagaaatggcagaagcgttaaaaggcatgcccatacggtatcaaacaaccgcagtaaaaagcgagcatacaggtagagaaatagtcgacttgatgtgccatgcaacatttacaatgcgccttctatccccggttcgtgtgcccaattataatatgataatcatggatgaggcacattttacggatccagcaagtatagctgctcgaggctacatatcaacacgagtaggtatgggagaagcagcagcgatctttatgacagcaacacctcctggtagtgtagaagcctttcctcaatcgaacgcggtgatacaggacgaggaacgggacatcccagaaagaagttggaacagcggctatgactggattacagattttcctggaaaaacagtatggttcgtaccttctataaaatcaggaaacgatatagctaattgcctaaggaaaaacggtaagagagtaattcaactatcaagaaaaacatttgatacggaatatcagaaaacaaagaacaacgattgggactacgtagttacaactgatatatccgaaatgggagccaattttagagctgatagagtcatagatccgcgacgttgcctaaagccagtcattctcaaagatggaccagaaagagtaatattagctgggccgatgccggttacagtagcatcagctgcccaaaggagaggtcgaataggaaggaatcaaaataaagaaggcgatcaatacgtatacatgggtcaacctctgaacaacgacgaggaccatgctcattggaccgaagcgaaaatgcttctagataacataaatacccccgaaggaatcattccagcgctgttcgagccagaacgagagaaaagcgctgctatcgacggagaatacagattaaggggtgaggcgagaaaaacatttgtcgaactcatgaggaggggtgatctacctgtatggttaagttacaaagtcgcatcggaaggtttccagtactcagatcgcagatggtgttttgatggcgaaagaaacaatcaggttttagaagaaaatatggacgttgaaatttggactaaagagggagaaagaaagaaattgagacctagatggctagatgcgaggacctattctgaccctcttgcgctaagggagtttaaggaatttgcggcaggaagaagatctgtatctggagatctcatcttagaaatcgggaaactgccacaacacttaacactacgagcccaaaatgccttggataacttggtaatgttgcacaattcagaacaaggtggtaaagcatacagacacgccatggaggaactaccagatactattgaaaccttaatgctgcttgcactaatagctgtactgaccggaggagtcactttattctttctcagtggcaaaggtctgggcaaaacgtctataggcctgttgtgcgtgaccgcttcaagtgctttactctggatggcaagcgtcgaaccacactggattgcggcatccataatacttgagttcttcttaatggtattactaattccagaacctgatagacaacgtacaccacaagataaccaattggcttacgttgtaataggcctactctttatgattttgacagttgcggccaatgaaatgggactattggaaactacaaagaaagatctcgggataggacacgtggcagccgaaaatcatcagcacgctactatgttagacgtagatctccgacccgcttcagcttggacattatatgcagttgcgacaacagtaatcacacccatgatgagacatactatcgaaaacacaactgcgaacatatctctcacagctatagcgaaccaagctgctatcttaatgggtttagacaaagggtggccaatctccaaaatggatataggagtccctttgttagctctaggatgctattcacaggttaaccctttaaccttaactgcagctgtattaatgttagtagcccattatgccattataggtcctggactacaggcgaaagcaacaagggaagcgcagaaaagaactgctgcgggtattatgaaaaacccaactgttgacggaatagtcgccattgaccttgatccagtggtgtatgatgcgaaattcgaaaagcagctgggccaaataatgttattaattttatgtacgagtcaaatacttttaatgcgaactacatgggcgctatgtgaatccataactcttgcaaccggacctctcactacgctctgggaaggatctcccggcaagttttggaatacaactatagctgtctcaatggcaaacatatttagaggttcatatctcgcaggcgcagggcttgcattctcgcttatgaaaagcctaggcggaggaagaaggggaacaggtgcacagggcgaaacacttggagagaagtggaaacgacaactaaatcagctgagcaaatcggaatttaacacatataaacgatctggaattatggaggtagatagaagcgaagctaaagaagggttgaagagaggagaaaccacaaagcatgcggtgtctagaggaaccgcaaagttaagatggtttgtagaacgaaacctggtcaaacctgagggaaaggtaatagatttaggttgcggacgaggcggctggagttattactgtgcaggacttaagaaagtgacagaggtaaaaggatacactaagggggtgccagcacgcgaagaacctattccaatggccacttatgggtggaacttagtaaaattgcatagtggcaaagatgtattcttcatgccaccggaaaagtgtgatacattactctgtgacattggtgaatctagtcctaacccaacgattgaagaaggcagaacattacgcgtattaaaaatggtagaaccatggctaagggggaatcagttttgcataaaaattttaaatccatacatgccatctgtcgttgaaactctggagcaaatgcagagaaaacatggtggtatgttagttcgtaatccactgagtcgaaatagtacccatgaaatgtattgggtttcatgtggtactggtaatatagtgtctgcggttaacatgaccagtaggatgttgctgaaccgttttactatggctcacaggaagccaacctacgaaagggatgttgatttaggagctgggacaagacatgtagccgttgaacccgaagtagccaatttagacataataggccagagaatcgaaaacatcaaaaatgaacataaatctacttggcactatgacgaagacaacccatacaagacgtgggcctaccacggatcgtatgaagtaaaaccaagcggctctgcatcatccatggtaaatggagtggtaagattgctgacaaaaccttgggatgtaataccgatggtaacacaaatagcaatgactgacacaacaccattcgggcaacaaagagtatttaaagagaaggtggacacgcgtacacctcgggctaaaagaggaaccactcaaataatggaggttaccgctaaatggttgtggggcttcttgtcgcgaaacaagaaaccaaggatttgcacacgagaagagttcactcggaaagtaagatcaaatgcggcaatcggagcggtgttcattgacgaaaatcagtggaatagtgcaaaagaagctgtagaagatgagcgtttttgggacttagtccaccgagaacgcgagcttcataaacaagggaaatgcgctacatgtgtatataacatgatggggaagcgagagaagaagttaggggagtttggcaaagcaaagggttcaagggctatatggtacatgtggcttggcgctagatttcttgagttcgaagcccttggatttatgaacgaagaccattggttcagtagagaaaacagcttatcaggggtcgagggagaaggcctacataagttaggttatattttgcgtgatataagcaaaatcccaggaggaaatatgtatgcggatgataccgcgggatgggatacaagggttaccgaggatgacctacaaaacgaggccaaaataacagatattatggagccagaacatgcactcttagccacgagtatatttaaactgacctatcaaaacaaagtagtccgggttcagagaccagccaaaaacggcaccgttatggatgtcatatcaaggcgagaccaacgtggatcggggcaagttggaacatatggattaaacacatttacaaacatggaagtccagctcataaggcagatggagtcggagggaatattcttgccaagtgaattagaaacacctaatctggctgaaagggttttggactggttagaaaaacatggcgccgaacgactcagaaggatggctatatccggtgatgattgcgtggtaaaaccgatcgatgacagattcgcgacagccttaactgcactcaatgatatgggtaaagtacgaaaagatataccgcagtgggagccttcgaaaggatggaacgactggcaacaagtacctttttgttctcatcattttcatcaattaataatgaaggacgggcgcgaaatcgtcgtcccatgtcgaaatcaggatgagttggttggtcgagcgcgagtatcacaaggcgccggatggtctctacgagaaacggcttgcttgggcaaaagctacgcgcagatgtggcagttaatgtacttccatcgacgtgatctaagacttgcagccaacgctatatgttcggcggttcctgtagattgggtccccacgtctaggactacctggtctatacacgcgcatcaccagtggatgactaccgaagatatgttatctgtgtggaatcgagtatggatagaagagaacccatggatggaagataaaactcacgtgtcaagttgggaagaagttccctacttaggtaaacgtgaagatcaatggtgcggctcccttatcggactaacagctcgagcaacgtgggcaaccaatatacaagtggctataaaccaagtcagaaggttaataggaaatgaaaactatttggattatatgacttccatgaagcgcttcaaaaatgaaagtgatcctgagggagccctttggtga

SEQ ID NO: 21320 - RNA, 9879 nt, synthetic construct
  misc_feature 1..9879: note = derived and/or modified CDS sequence (opt6) from DENV-1__FJ024484__SS-prME
  source 1..9879: mol_type = other RNA
tcagtcactatgttgttgatgcttctaccaacggcgttagcatttcacctgacgacacgaggaggagaaccacacatgatagtaagtaaacaagaaaggggaaaaagtttactattcaaaacaagtgctggggttaacatgtgcacacttatagcgatggacctaggagaactatgtgaagacaccatgacatacaaatgcccgcaaatcaccgaagcagaaccagatgatgtggactgctggtgtaatgcgactgatacatgggttacatacggaacatgttcacaaacgggggaacataggcgcgacaagaggtctgtagcacttgctccacatgtaggtctggggttagaaactagaacggaaacttggatgagttccgaaggagcatggaaacaaattcagagggtcgaaacatgggctttaagacacccagggtttacagtcgtagcattctttttagcacatgcaatagggacatcaattactcagaaaggtataatttttattcttttaatgctggttacgccctcaatggctatgcggtgtgttggaatcgggaacagagatttcgtagaaggattgtctggggcaacatgggtagatgtagtactagaacatggaagctgtgtgacaacgatggccaaaaataaaccaaccttggacattgaacttctgaaaaccgaagtgacaaatcctgctatcctgcgaaaactatgcattgaagccaaaatatcaaacacaacgactgattcccgatgtcccacacaaggtgaagccacattagtggaagaacaggacgcaaatttcgtttgtaggaggacattcgtggataggggatgggggaatggctgcggcctatttggaaaaggatcactactaacatgcgcgaagttcaaatgtgtaaccaaattagaaggcaaaatagtgcaatatgagaatctaaaatacagtgttatcgtaacggtgcacacgggagatcaacaccaagtgggtaatgaaacgaccgaacacggaaccatagccacaataaccccgcaagccccaacatccgagatacaattaacagattacggagcactaacactagactgcagcccccgaactggtctggattttaatgagatggtcttattaactatgaaagaaaagtcatggctggtgcacaaacaatggttcctggatctacccttaccctggacaagcggagcttcgacgtctcaagaaacttggaatagacaagacttgctagtcactttcaagacagcccacgccaagaaacaagaagtggtagtcttaggttcacaagagggtgctatgcacaccgctttgaccggagcaacggagatacaaacaagcggtacgaccaccatcttcgcaggtcacttaaaatgccggttaaaaatggataaacttactctaaaaggcacaagctacgtaatgtgtacaggttcttttaagctagaaaaagaagtcgcagaaactcagcatggcaccgtcctggtgcaagtaaagtatgaagggaccgatgctccatgtaaaataccatttagtacgcaagacgaaaaaggagtaacccaaaatgggagacttataactgcgaatcctattgttacagacaaggagaaacccgtcaatatagaaaccgagccaccattcggagagtcatatatagtgattggggctggggaaaaggcattaaaattatcgtggtttaagaaagggagtagtataggtaaaatgttcgaagcaaccgcacgaggtgcacggagaatggcaatactgggagatacagcatgggattttggatcaataggcggagtattcacaagcgttgggaagctagtacatcaagtgttcggaacagcctacggagtcctgttctcgggcgtcagctggacgatgaaaatagggatcggcatcctacttacttggttggggttaaattcaagatcaacaagcctctctatgacttgtattgcagtagggatggtaaccttatatttgggagtaatggtacaagctgatagcggctgcgtaatcaactggaaggggcgcgaattaaaatgtggatcaggaatcttcgttactaatgaggtacatacttggaccgaacaatataagttccaggccgactctccgaaaaggttgtctgctgcgatcggcaaggcatgggaagaaggggtttgcggaatcaggagtgcaacacgactagaaaacataatgtggaaacagatctcaaatgaattgaaccatatactcttggaaaacgatatgaaatttactgtagtagtaggggatgcaaatggaatattagcacaaggcaagaaaatgataagacctcaaccaatggaacacaagtatagttggaaatcgtggggtaaagcgaaaatcataggtgcggatatacaaaacacgaccttcataatagatggaccagatacaccggaatgtccggacgatcaaagagcttggaacatttgggaagtcgaagactatggtttcggcatctttacgactaacatatggctcaaacttagagatagttatacgcagatgtgtgatcatagacttatgtcggctgcgattaaagattccaaagccgtacatgcagacatgggttattggattgaatcggagaaaaatgaaacttggaaactagctcgggcgagctttatagaggtaaaaacctgtacttggccaaaatctcacaccctgtggagtaacggagtattagaaagcgagatgataattccaaaaatctatggcgggccgataagtcagcacaactatagaccgggatatttcacccaaacagcgggaccatggcatctaggaaaactggaattagactttgacctctgtgaaggtactacggttgtagttgacgaacattgcggtaatagaggaccatcattacgtactacaacagtaacaggaaaaataatccacgaatggtgttgccgttcttgcacactgccacctctaagattccgaggagaagatggatgttggtatggaatggagatcaggcccgtaaaagaaaaagaggagaatctagtgcgttccatggtgagtgcaggtagcggtgaagtggatagtttcagcctaggaatattatgcgcgtcaataatgatagaagaggttatgcgctccaggtggagtcgtaaaatgctgatgacgggtactctcgctgtgtttttgttactaatcatgggacaactcacctggaatgatcttataagattgtgtatcatggttggagcaaacgccagtgacagaatgggaatgggcacgacatatctagccctcatggcgacatttaagatgaggccgatgttcgcagtcggactactattcaggaggttaactagcagagaagtactcctactaacaataggcctcagcttggtcgcctcggtcgagctgcccaattctttagaagaattaggtgatggattagcgatgggaattatgatgttgaaattactaacagaatttcagccgcatcaattatggactaccctcctgtccctaacattcataaaaaccacacttagcttagactatgcgtggaaaacaactgccatggctctctccatagtatcattgtttccattgtgcttaagtactacaagtcagaaaactacctggttaccagtacttttgggctcatttggctgcaaacctttaacgatgtttcttataacagagaataaaatttggggccgtaagtcctggcctttaaacgaaggaataatggcaattgggattgtctcaatacttttgagtagtcttttgaaaaacgatgtacctctagcgggcccactaatagcaggaggaatgcttatcgcttgctacgtgatctcgggatcttccgcagatctaagcctggagaaagcagccgaggtcagttgggagcaggaagccgaacatagcggaacatcacacaatatattagtagaggtacaagatgatgggacaatgaaaattaaggacgaagagaaagacgatacactcactattttacttaaggcgactttgcttgcggtttctggagtatacccaatgagtattcccgccactttatttgtttggtatttctggcagaaaaagaaacaacggagtggagttttatgggatacaccttccccaccagaagttgaacgagccgttttagatgacggaatataccgcatactccaaagaggattgttaggtcgtagtcaggtcggtgtaggcgtgttccaagatggcgtctttcatacgatgtggcatgtaacaagaggggctgtcttaatgtaccagggtaaacgcttagaacctagttgggcaagcgtgaaaaaggatttgatatcatatggaggcggatggagatttcaaggatcctggaataccggtgaagaagtacaggtcatagctgtagaaccgggcaaaaatcccaaaaatgttcaaacaacgcctgggacattcaagacaccagagggggaagttggagccatagctttagattttaaaccaggcaccagtggttctcccattgtaaatagagaaggcaagatagtcggattatatggtaacggagtagtgacgacctcaggaacatatgtatctgcaattgcgcaagcgaaagccagccaggaggggccattacccgaaattgaggacgaagtatttaaaaagagaaatttaactataatggacctacaccctggaagcggtaaaacgaggaggtatctacccgcaatagtcagagaagctattaagagaaaattgagaacactaatattagcgccaacacgagtggtagcgtcagaaatggcagaggctttaaaaggaatgcctatcagataccagaccacagccgtaaagtcagaacatactggacgagaaattgtcgacctaatgtgtcatgcaaccttcacgatgcgtctattatctccggtcagagtaccaaattacaacatgataataatggatgaggcccattttacagacccagcatctatagcagcacggggttatataagcacacgtgtcggaatgggagaagctgcggcaatatttatgaccgcgacaccaccaggaagtgtagaggcttttcctcaatcaaacgcagtcatacaagacgaggagagggacataccagaacggtcatggaatagtggctacgactggataaccgactttcctggtaagacagtttggtttgttcctagcataaaatctggtaatgatatagctaactgtctgcgtaaaaatggaaagcgagttatacagctttctagaaagactttcgatacggagtatcagaagacgaaaaacaacgactgggattacgttgttacaacagatataagcgagatgggagctaattttagagcagcacgggtaattgatccaagaaggtgtcttaagccagtgattttaaaggatgggccggagcgagtgatccttgcaggaccgatgccggttaccgtagcttcagctgcgcaaagaagaggaagaataggcaggaatcagaacaaagagggtgatcagtatgtctatatgggtcaaccattaaacaacgatgaggatcacgctcattggacggaagcaaaaatgttattagataatattaatacacccgagggcatcatacctgcgctgttcgaaccagaacgagagaaaagcgcagctatagacggagaatacagactaagaggggaagctcgcaaaactttcgttgaattaatgcgaaggggtgatttacctgtctggctctcatataaagtcgcatctgaagggtttcaatatagcgataggcgatggtgcttcgatggagaacgaaataatcaggttttagaagagaatatggacgttgaaatctggacaaaggagggagaaagaaagaaattaaggccacgttggttggatgcaaggacgtattcagatccgttagccctaagagagttcaaggaatttgccgcaggaagacgatcagtgtctggcgacctgatattagaaatcggaaaattacctcaacatttaacgttaagagctcaaaacgcattagacaatttagtaatgctgcataactcggagcaagggggaaaggcatatagacatgctatggaagagttacctgatactatagagactttgatgttattagctttaatagcggtattaactgggggtgtcacattattcttccttagcggaaaaggactgggtaaaacctcaattggtttactttgtgtaacggcaagcagtgcgctcttatggatggcatctgtcgaaccgcattggatagccgcttcaattatactggagtttttcctgatggttctcttgataccggaacctgataggcaacgaacaccacaagataatcaacttgcttatgtagtgatcggattattattcatgattctcacagtcgctgctaatgaaatggggttgctagaaactacaaagaaagatttgggaattggacatgtagccgcagagaaccaccagcatgcaaccatgctagacgtagatctgaggcccgcatcggcatggacattgtatgcggtcgccacaacagtcataactcctatgatgcgtcatacaatcgagaatacgacagcgaatatttcgcttaccgccatcgcaaaccaagcggcgattcttatgggtttagacaaaggatggccaatatcaaaaatggatataggggtcccactactagcgttgggatgttactcacaagtgaacccacttacactcacagcagcagttctaatgttggtcgcacactacgcaatcataggcccaggactccaagctaaggctacaagagaagcacagaaaaggaccgcagcaggaattatgaaaaaccccactgtcgatggaattgtagcaattgatctcgaccccgtagtctatgacgccaaatttgaaaaacaacttggtcagattatgctcctaattctatgcacctctcaaatacttttaatgagaacaacttgggctctgtgcgagagtataaccttagcaacaggaccgttaacgactctatgggaagggtcaccagggaaattttggaacacaaccatagcagtctctatggccaatatttttagaggctcatacttagctggtgcaggattagcatttagtctaatgaaaagtttaggaggtggaagacgaggaacgggagcacagggtgaaacacttggagagaagtggaagaggcaattaaaccaactaacaaaatccgagttcaacacatacaaaagaagcgggataatggaagttgatcgaagcgaagccaaagaaggattaaagagaggagaaaccactaaacatgcagtaagcaggggaacagcaaaattgagatggtttgtcgaaaggaacttagtaaagccagaaggaaaagtcatcgacctaggatgtggtagagggggctggagttactactgcgcaggacttaagaaagtaaccgaagtaaagggatacacaaaagggggacctggacatgaagaaccaattcctatggctacttatggatggaatcttgtgaaacttcatagcggcaaagacggcttctttatgccgcctgaaaaatgtggcacacttctttgtgacataggtgagtcgtcgccaaatcctacaattgaagagggaaggacactccgggttctaaaaatggtagaaccatggctacgaggtaatcaattttgtataaaaattctaaatccatacatgccaagtgtagtagaaacacttgaacaaatgcagcggaaacatggtggtatgttagtgagaaaccctttatcccgcaatagtactcacgaaatgtattgggtttcatgtggaacaggaaacatagtttcggctgtgaatatgacaagtagaatgttactgaaccgtttcaccatggcgcataggaagccgacttacgaaagagacgtggatttgggagccggaacgcgtcatgtggcggtagagcccgaggtcgcgaatcttgacataataggacagagaatagaaaatatcaaaaacgaacataagtcaacatggcattatgacgaagataatccttataaaacctgggcatatcatgggtcgtacgaggtaaaaccttctggaagtgcgtcaagcatggtaaacggagttgtcagacttctaacaaaaccatgggacgttataccgatggtaacccagatagctatgacagacaccaccccattcggacaacaaagggtattcaaagaaaaagtagataccagaacacctagagcgaagcgaggaacgacacaaataatggaggtaaccgccaagtggctatggggcttcttgtctaggaataagaaaccgaggatttgtacaagggaggaatttacacggaaagtaagatccaatgctgcaatcggagcagtttttgttgatgaaaaccaatggaactcagcaaaagaagccgtagaagacgaacgcttctgggacctggtacaccgtgagagagaactacacaaacaaggcaaatgcgctacatgtgtctataacatgatggggaagagggagaagaaactaggagagttcggtaaagccaagggaagtagagcaatatggtatatgtggcttggagctagattcctagagtttgaagcgttaggtttcatgaatgaggatcattggttttcgagagagaatagtcttagtggcgtagagggtgaaggactacataaattaggttacatactaagagatatctctaaaatacctggagggaatatgtacgcagacgatactgcaggatgggatacgagaatcacagaagacgatcttcaaaatgaagctaaaataacagacataatggaacctgaacatgccttgcttgcgacttctatatttaaactgacttatcaaaataaagtagttagagtgcaaaggcctgccaaaaatggtacggttatggatgtaatatcacgaagagatcagagaggcagtgggcaagtcggaacttacggtctgaacacatttaccaatatggaggtgcaactaatcagacaaatggaatcagaaggtatatttttaccttcagaacttgaaacgcctaatttggcaaaacgagttctagattggttagaaaagcatggagctgaaaggttgaaacgtatggctatatcaggcgatgattgtgttgttaaaccgatagatgacagatttgccacagcactcacagcactaaacgatatgggcaaagtaaggaaagatattccacagtgggaaccctctaaaggttggaatgactggcaacaagtgccattctgtagtcatcattttcatcagctaattatgaaagacggacgagaaattgttgtaccatgtcgaaaccaggatgagctagtaggtcgagcccgggtttctcaaggggctggctggagcttgagggaaacagcgtgcctcggaaagagttatgcacaaatgtggcagctcatgtattttcatcgtcgcgatttaagattagcagccaacgcaatttgcagcgccgtaccagtagactgggtaccaacaagccgtacaacctggtctatacatgcacatcaccagtggatgaccaccgaggacatgctaagtgtgtggaacagagtgtggatcgaagaaaacccatggatggaagacaaaactcacgtaagcagttgggaagaagtaccctacctaggcaaaagagaagaccagtggtgtggctctttgattggactcacagctagagccacctgggcaacaaacatacaagtggcgatcaatcaagtaagaagacttatcggaaacgaaaactatcttgattatatgaccagtatgaagcgtttcaagaacgaaagtgatcctgaaggagctctatggtag

SEQ ID NO: 21321 - RNA, 9879 nt, synthetic construct
  misc_feature 1..9879: note = derived and/or modified CDS sequence (opt6) from DENV-1__EU596503__SS-prME
  source 1..9879: mol_type = other RNA
agcgtaactatgttattaatgctattacctacagcgctagcatttcatttaacaacaagaggaggggagccccacatgatagtaagcaaacaagaacgaggtaaatctctactttttaaaacttcagccggggttaatatgtgtacgttgatagcgatggatctaggagagttatgcgaagatacgatgacatataaatgtccgcaaattacagaagcagagcctgatgatgtggattgctggtgcaatgcaacagatacgtgggtaacttatggtacctgttcacaaactggcgaacataggagggacaaacgtagcgtagcgctagcacctcatgttggtttagggttggaaacacgaactgaaacttggatgagcagcgagggcgcgtggaaacaaatacaaagggtcgaaacctgggcattgagacatccagggtttactgttatagccttatttttagcccatgcgataggtacgtccataactcaaaaaggtataatatttatcttgctgatgttggtaactcctagcatggcaatgcgatgcgtaggtattgggaaccgggattttgtagaaggactgagtggagcaacatgggtggatgtcgtattagaacatggttcctgtgtaactaccatggccaaaaataaacctacattagatatagaactattaaaaacagaggtaaccaaccccgctatactccgaaaattatgtatagaagcaaaaatcagtaatacaacaacggacagcagatgtcccacacaaggtgaagcaacattggtagaagaacaagacgccaattttgtttgtcgcagaacatttgtggacaggggatgggggaacggatgtggattatttgggaaagggtcattactaacgtgtgcaaaattcaaatgcgtaacgaaactggagggaaaaatagtccaatacgaaaatttaaaatactcagtaattgtgactgttcatacgggagaccagcatcaggtaggcaacgaaacaacagaacatggcactattgcaaccattaccccacaagccccaacatcagaaattcagcttactgattatggcgcattgactttggattgctctcctcgaacaggtcttgattttaacgagatggttctacttacaatgaaagaaaagtcatggcttgttcataaacaatggtttctagatctcccgctcccctggacatcaggtgctagtactagccaggaaacgtggaacagacaagatctactcgtaacttttaaaactgcacatgctaagaaacaagaggtagtcgtcttaggctctcaagaaggagcaatgcacacagcattaacaggcgctacagaaatacaaacaagtggaacaactacaatttttgcaggtcatcttaaatgccggctcaaaatggacaaactgactttaaaaggtacaagttacgtgatgtgcataggaagttttaaactggagaaagaggttgcggaaactcagcatggtaccgttcttgtacaggtgaagtatgaaggaacggacgctccttgcaagatccctttctcaactcaagacgaaaagggtgtaactcaaaatggacgtttgataacagcaaaccctatagtgacagataaagagaaacctgtaaatatcgaaacagaaccaccttttggggaatcttatatagtagtaggcgcaggcgaaaaagccttgaaattatcatggttcaaaaagggttccagtattgggaaaatgtttgaggccaccgcaaggggtgcacgaagaatggcaatccttggcgatacagcatgggattttggctcaatcggaggtatgttcacgtcagttggcaaacttgttcatcaggtattcggcactgcgtatggtgtattgttttccggcgtctcatggacaatgaaaatcggcatcggtatcttattgacttggctgggattaaactctagaagcacgagtctaagtatgacgtgtatagctgttggaatggttacgctttacttgggagttatggtgcaagctgatagcggatgcgtaatcaattggaaaggtagagaattaaaatgcggatcagggatcttcgttacaaacgaagtgcatacatggacggagcaatacaaattccaagcagatagtcctaagcgactatctgcagctataggaaaagcatgggaggaaggagtttgtgggataagatcagcaactaggttagaaaatattatgtggaaacagattagtaatgaattaaaccacatcttacttgagaatgacatgaaatttacagtggtggttggagatgctaacggcattttagcccaaggtaaaaagatgatccggccacagcccatggaacataaatatagctggaaaagctggggaaaagccaaaataattggagcggatattcaaaatacaaccttcataatagatggccccgacacaccagagtgtccggataatcaacgagcttggaacatctgggaagtcgaagactacggctttggtatttttacaactaatatttggcttaaactcagggatagttatacgcaaatgtgcgaccataggttaatgtctgcagcaattaaggactcaaaagctgtccatgcagacatgggatactggatcgaatcagagaaaaatgaaacatggaagttagcaagagccagctttatcgaagtcaaaacctgcacatggcccaaatcacatacactttggagtaatggagttttagaatcagaaatgattatacccaagatatatggaggtccgatttcacagcacaactatagacctggatactttacacaaaccgctggcccatggcatttaggcaaactagaattagactttgacttatgtgaggggaccacggtagtcgttgatgaacattgtgggaatagagggccatcccttagaactactacagttactggaaaaataattcacgaatggtgctgtcgaagttgtacacttccacctctacgtttcaggggagaagatggatgctggtatggtatggagattagacctgttaaggaaaaagaagagaacttagtgagatctatggtctcagcgggtagtggagaagttgattcattttcactaggcatcctatgtgcatcgataatgatagaagaagtaatgcgaagcagatggagcagaaaaatgctaatgacaggcacgttagcagtatttttattattgattacaggtcagctaacttggaatgaccttatacgtttatgcattatggtcggagccaacgcgtcggaccggatgggaatgggtacgacctatctcgcgctaatggccactttcaaaatgagacccatgttcgctgtaggattactattcaggcggttaactagcagagaagtcctgttactaactataggattgagtttggtagcgtcagtagaattaccaaatagcctagaagaactaggagacggactcgcgatgggcattatgatgttgaaacttctaacagagtttcaaccccatcaattatggacaactctcttaagtctaacgtttataaaaactacattaagtttagattatgcctggaaaaccaccgcaatggctctttccattgtgagtttattcccactctgcctaagcaccacttctcagaaaacaacctggctaccggtgcttctcgggagcttcgggtgtaaaccactcaccatgttcctaataactgaaaataaaatttggggacgaaagtcctggccacttaacgagggaatcatggcgattggcatagtaagtattctattatcgtcattgctaaagaatgatgtaccattagcagggccactaattgcaggcggtatgttaatagcgtgctatgtaatcagtggatcctctgcagacctgtcacttgagaaagccgcggaggtttcttgggaacaagaagcggaacacagcggaacaagtcataatattttagtggaagtacaagacgatgggacaatgaaaattaaagacgaggaacgtgatgatacgctgacgattctactgaaggccacgttgctagcggttagtggcgtttacccgatgtcaattccagccacactgtttgtctggtacttttggcagaagaagaaacaacgttcgggcgtattgtgggatacaccctctccgcctgaggttgaacgcgcagtacttgatgacggaatatataggatccttcaaagaggtttgttaggaagaagccaagttggtgttggtgtatttcaagacggagtctttcatacaatgtggcacgtaaccaggggtgctgtactaatgtaccaaggtaaaaggctagaaccatcttgggcttcggtgaagaaagatttaataagctatggaggcgggtggagattccaaggaagctggaacactggagaggaagtgcaagtcatcgccgtggaaccgggcaaaaatcctaagaatgtacaaacaacaccgggtacctttaagacgccggaaggagaggttggagcaatcgccttagacttcaaacctggcacgtctggcagtcctatagtgaacagggaagggaaaatcgtcggtctgtatgggaatggcgttgtcacaacctctggaacgtatgtatcagctatagcccaggcgaaagcatcacaggaaggtccactccccgagattgaggacgaagtctttaagaaacgaaatttaacaataatggacctacatcccggtagcggaaaaactcgaagatacctgccggccattgtacgagaagcaataaaaaggaaacttagaacactcatactagctccaactagagtagttgcttctgaaatggctgaagccttaaaaggtatgcctattagatatcaaacaactgcggtcaaatcagaacacacaggaagagaaatcgttgacctaatgtgccacgctacatttacgatgcggctattgtctccagtacgggttcctaattacaacatgataataatggatgaggcacattttactgaccctgctagcatcgcagcgagaggttacatatctacaagagtgggcatgggagaagcagctgcaattttcatgacggcaacaccacctgggtccgtcgaagcatttccacaatctaatgcggtgattcaggatgaagaaagagatattccagaaaggagttggaatagtggatatgactggattactgattttcccggcaaaactgtatggtttgtacccagtattaagtcaggtaatgatatagcaaactgcctgaggaaaaatggaaaaagggtcatccaactatcacgaaaaacttttgatacagagtatcagaaaaccaaaaataacgattgggattacgtagtaacgactgacatatctgaaatgggggcaaattttcgcgcagatagagtcatagatccaaggcgatgtctgaaaccagtgatcctgaaagatggccccgagagagtaattttagcaggcccaatgccagtcaccgtagccagtgccgctcaacgaagggggaggattggacgaaatcaaaacaaggagggagaccaatatgtttatatgggacagcctctgaataacgatgaggaccacgcccattggacagaagcaaaaatgttattagataacataaatacgcctgaagggattataccagctttatttgaacccgaacgagagaaatctgctgcgatcgatggagaatacagattaaggggagaagccaggaagacattcgtagaacttatgcgcagaggggacttacccgtgtggctctcctacaaggtagcgtccgagggatttcaatattcagacagacgctggtgcttcgacggggaacggaacaatcaagtgcttgaagaaaatatggacgtagaaatctggaccaaagaaggcgaaagaaagaaactacgtccacgatggcttgatgcaagaacgtattccgaccctttagctttgagagaatttaaagaatttgcagctggtcgaagaagcgttagcggcgatttaatattggaaataggcaaattaccacaacatttgacattaagagcccaaaatgcgctggataaccttgtaatgctacataatagtgagcaaggtggaaaggcttaccggcacgccatggaagaactaccagacacaatcgagaccttaatgcttttagcacttatagctgtcctgactggaggcgtaactctcttctttttaagcggaaagggtttaggcaagactagcattggactactttgtgtaacggctagtagcgccttactttggatggcaagtgtcgaaccacattggattgccgcctcaataattctagagttctttctaatggtacttttaataccagaaccagatagacagagaaccccacaagacaaccaactagcatacgtcgtgataggtctattgttcatgatattaacagttgcagcaaatgaaatgggcttacttgaaaccacaaagaaagacttaggaataggccacgtcgcagccgaaaatcaccaacacgctacgatgttggacgttgatctacgacccgcaagcgcttggactctttatgcagtagctacaacagtgataacaccgatgatgagacatacaatagaaaatactacagcgaacatcagcttgacagctatagctaatcaagcagcaatattaatgggcctagacaagggatggccaataagtaaaatggatataggtgtacccctgttggccctcggatgctattcacaagtaaacccattaacccttaccgcggctgttttaatgttggtagcgcattatgcgataatagggccaggcctacaagcgaaagcaactcgtgaggcacagaaaaggactgctgcaggaatcatgaaaaacccaactgtcgacgggatagtagcaatcgacttggatccagttgtttatgacgcaaagtttgagaagcagctaggacaaattatgctactaattctgtgtacaagccaaatattattaatgcgcacaacgtgggctctatgtgaaagtattacgctagcaacaggtccattgactactttatgggagggaagtcctggaaaattttggaatacaacaatagcagtaagtatggcaaatatatttagaggaagctacttggctggggcaggactagccttctcactaatgaaatcactgggagggggacgtagaggtacaggtgctcagggtgaaacattaggagaaaagtggaaacgacaattgaaccaacttagtaaatctgaatttaacacctataaacgaagtggcataatggaggtcgatcgttcagaagctaaagaaggcttaaaaagaggggagacaacaaaacacgcggtatcccgcggtactgcgaaactcagatggttcgtcgaaagaaacctggtgaaaccagaaggcaaagttatcgatctaggatgtggacgaggaggctggtcgtactattgtgcaggattaaagaaagtaactgaagtaaaaggatacactaaaggtggaccagggcatgaggaaccaattccgatggctacctatggatggaatttagtcaaactacatagtgggaaggatgtgttcttcatgccacccgaaaaatgtgacaccctcttgtgcgacattggagagagcagtcccaatcccacaatcgaagagggtagaactttgagagtattaaaaatggtcgagccgtggctaaggggtaatcaattctgtataaagatactaaacccgtacatgccatctgtcgtcgaaactctcgaacaaatgcaacgaaagcacggtgggatgttagtacgcaacccattgtctagaaatagtacgcacgagatgtactgggttagctgcggaacaggaaatatagtatccgccgtgaatatgacaagcagaatgttgcttaatcgatttaccatggcccacaggaaacctacatacgaacgtgatgtcgatctaggtgccggaacacgtcatgtcgccgtcgaaccggaggttgccaacttagacataattggacaaagaatagaaaatattaaaaatgaacataagtccacatggcattacgatgaggacaatccatataaaacatgggcatatcatgggtcatacgaggtaaaaccgtccggtagtgcatcaagcatggtaaatggagttgtgcgactgttaaccaagccctgggatgtcatacccatggtgacacaaattgctatgacagatacaacccccttcggccaacagagggtttttaaggagaaggtcgacactagaacacccagagcaaaacgcgggacgacccaaataatggaagtgactgccaaatggttatggggatttttaagccgaaacaagaaaccacgtatatgtacccgagaagaatttacccgtaaagtacgatcaaacgcagcaatcggagcggtattcgttgatgagaaccaatggaactccgccaaggaagctgtagaagatgagagattctgggatttagtacacagagaacgagaattacataaacaaggcaagtgcgctacttgcgtctacaacatgatgggtaaaagggagaagaaattaggagaatttggaaaggccaaaggaagtagagcgatatggtatatgtggctcggcgccagatttttagaatttgaagcactaggttttatgaacgaagatcattggttctcacgagaaaactcattgagtggagtggagggcgaagggttacataaactgggatatatcttacgagacatatcaaagatcccaggaggtaatatgtacgcagatgacaccgcgggatgggacacacgaataaccgaagatgacctacaaaacgaagcgaagatcaccgatatcatggagcctgagcatgcactattggcaacttcaatattcaaattgacctatcaaaacaaagtcgtccgagttcagcgacctgctaaaaatggtacagttatggatgttatttcaagacgagatcaaagggggagtggtcaagtggggacatatggactcaacacttttacaaacatggaagtgcaactgataaggcaaatggaaagtgaaggaattttcttaccgtcggaattagaaacacccaatctcgctgaaagagttttagattggctcgaaaaacacggtgcggaaaggttaaagcgaatggctatatctggggacgattgcgtagttaaaccgatagacgatagatttgccaccgctcttactgcattgaacgatatgggtaaagttagaaaagacatcccccaatgggaaccatctaaaggatggaacgattggcaacaggttccattctgttcccatcattttcaccaactgataatgaaagacggtagggaaatcgttgtaccatgtcgcaatcaagatgagttggtcgggagggctagagtctctcaaggcgccgggtggtcactaagggaaaccgcatgcctaggaaaatcatatgctcaaatgtggcaactaatgtattttcatcgcagagacttacgcctagcagctaacgctatctgcagtgctgttcccgtcgactgggttcctacaagcaggactacttggagtatacacgctcatcaccagtggatgacgactgaagacatgttgtcagtatggaaccgagtttggattgaagaaaatccatggatggaagataaaacacacgtatcatcctgggaggaagttccatatttaggtaaacgggaggatcaatggtgcggttccttaataggattaactgcgagagcaacatgggcaactaacatccaagtcgcgataaatcaagtaagaagattaattggtaacgaaaattatttagactacatgacttcaatgaagcgattcaaaaatgaatcggacccggaaggagcactatggtaa

SEQ ID NO: 21322 - RNA, 9879 nt, synthetic construct
  misc_feature 1..9879: note = derived and/or modified CDS sequence (opt6) from DENV-1__FJ024479__SS-prME
  source 1..9879: mol_type = other RNA
tcagtcacaatgttgttaatgttattgcctactgcattagcgtttcatctgacaacaagaggaggagaaccccatatgatagtgtcaaaacaagaacgcggtaaatcactattattcaaaacatcggctggcgttaatatgtgcacattaatcgcgatggatctcggagaactatgcgaagacacgatgacatataaatgtccacaaataactgaagctgaaccggatgatgttgattgttggtgcaatgcaactgacacttgggtaacttatggcacttgttcgcaaacgggagaacatagaagagataaacgaagtgtagcactagcaccacatgtgggacttgggctagaaactaggacagaaacctggatgtccagtgaaggcgcatggaaacaaatacaacgagtcgaaacctgggcgctacgtcatcctggctttactgtaatagctttatttctagcacacgcgattggaacctccataacccaaaaaggtattatattcatacttctcatgctggtaacgccatcaatggcaatgcgttgtgtcggtatagggaaccgagactttgtagagggactttctggtgcaacatgggttgatgtagtgttggaacatgggagttgtgttactacgatggccaaaaacaaacctactctagatatcgaattactaaagacggaggtaaccaatccggcgatcttaagaaaactctgcatagaagccaaaattagtaatacgactacggattcaaggtgtccaacccaaggggaggcaacgctagtagaggaacaagatgcaaattttgtatgccgcaggactttcgtggacagaggatggggtaacggttgtggacttttcggcaaaggctcgttactaacctgtgcaaaattcaagtgcgtaacgaaactagaaggcaaaatagtacaatatgaaaatttaaaatatagcgtgatagtaaccgtgcacacaggggatcaacaccaagtcgggaatgaaacgacagaacatggcacaatagctaccataacaccccaggctccaacaagcgagattcaactaacagattacggcgcacttactttggattgttccccaagaaccggcctcgatttcaacgaaatggtcttattgaccatgaaagaaaagtcttggttggtgcacaaacaatggtttcttgatctccctctaccgtggacaagtggagccagcacatcccaagaaacatggaacagacaggatttgctagtaaccttcaagacagcccacgctaaaaagcaagaagttgtagtccttggatcacaagaaggagccatgcacaccgctttaactggtgctactgaaatacagacatcaggcacaacaacgatattcgcagggcacctcaagtgtagactaaaaatggacaaattaaccttaaaaggtacaagttatgtaatgtgcacaggaagttttaagttggaaaaggaagtcgctgaaactcaacacggaacagttctcgtacaagtgaagtatgaaggtacagatgccccgtgcaaaataccatttagtactcaggacgaaaagggtgtaacgcaaaacgggagattaataacagccaacccaattgtcacagataaagaaaaacccgttaatatagagactgagccgccttttggcgaaagctatatagttgtgggagcaggagaaaaagcattgaaactttcatggtttaagaaaggatcatcgataggcaaaatgtttgaggcaaccgcacgtggagctaggaggatggcaattctaggagatacggcctgggactttggatcaatagggggagtttttacgtcagttggcaaacttgtacatcaagtgttcggaacagcttatggcgttttatttagtggcgtttcctggacgatgaaaattggcattggaatattactaacatggctagggctaaatagccggagtacttcactaagtatgacgtgtatagctgtaggaatggtaaccctatatctaggagtcatggttcaggctgactcgggatgtgtcataaactggaagggcagagaattaaaatgcggatcagggatctttgttactaatgaagtacatacatggacagaacagtataagttccaggccgactcaccaaagagattatcagccgcaatagggaaggcctgggaagaaggagtttgcggaataagatcagccacacgccttgaaaatataatgtggaaacaaatatctaacgagttgaatcatatactattagagaatgatatgaaatttaccgtagtggtgggcgatgcgaatggcattttagcccaaggcaagaaaatgatcagaccacaaccaatggagcacaaatacagttggaaaagttggggtaaagctaaaatcataggtgcagatatacaaaacaccacttttatcatcgatggaccggatacacccgaatgtccagacaaccaaagagcctggaacatctgggaagttgaggattatggattcggatttttcacaacaaacatctggttaaagctaagagattcctatactcaaatgtgcgaccataggctgatgtcagcagctatcaaagatagcaaagctgtacatgccgacatgggctactggatagaatctgagaaaaacgaaacttggaagctagcaagagccagctttatagaagtaaaaacttgtacatggcctaagtcacatacactatggtcgaacggagtgctcgaaagtgagatgatcatacccaaaatttacggtggcccgataagtcaacataattacaggccagggtactttacgcaaacagcgggaccgtggcatttaggtaaacttgaattggactttgacttgtgtgaaggtacaacagtagttgttgacgaacattgtggcaatagaggcccgtctctgcggacaacaactgtgaccgggaaaataatacatgaatggtgttgtaggagttgtactttaccaccccttagattccgtggagaagacgggtgttggtatggaatggagatacggccagtcaaagaaaaagaggaaaatctggttagatcaatggtatcagctgggtcgggagaggtggattcattctcacttgggattttatgcgcatctataatgatagaagaagtaatgcgtagcagatggtcaagaaagatgctaatgacaggaactttggctgtattcttgttattgattatgggacagctgacttggaatgacctaataagactttgtatcatggttggcgcaaatgcatcagatcgaatgggaatgggtacaacatatttagctttgatggctacatttaaaatgagacccatgttcgcagttggactcttatttcggagactaacgtcaagagaagttctattacttactataggcctgagcttagtagcatctgttgaattgcccaatagtttagaagaattgggcgatggattagctatgggcattatgatgctaaagctattgacagaatttcaacctcaccaactttggactactctattaagtctaacatttataaaaactaccctatctttggactatgcgtggaagactgcagcaatggctttgtcaatagtgagcttatttccattgtgtctaagtacaacttcccaaaagacaacctggctaccagtactccttgggtcttttggatgcaaaccattgactatgtttcttataactgaaaacaaaatatgggggagaaaaagctggccgttgaacgaaggtatcatggcaataggaatcgtttcaatattactaagttcattattgaaaaatgatgttcctctagcgggaccactgatagccggaggaatgttgatagcgtgttacgtaataagcggttcatccgcagaccttagtttggagaaagcagctgaggttagctgggagcaagaggctgagcatagcggtacaagccataatatactcgtagaagtacaagatgatggaacaatgaaaatcaaggatgaggagagggatgacaccctaacaatactcctaaaggcgacgctcttagccgtttcaggcgtttacccaatgtcaataccagcaacattattcgtatggtatttttggcagaagaagaaacagcggtcaggcgtactatgggacaccccctcgccaccagaggtagaacgtgcagtcttagacgacggcatatacagaatactgcagagaggactattaggacgatcacaagtgggagtaggagtatttcaagatggcgtattccatacgatgtggcatgtcactcgtggtgcagtattaatgtaccaaggaaaacgtctagagccaagttgggcaagcgttaagaaagacttaatctcctatgggggaggatggcgttttcaaggttcctggaacaccggagaagaagtgcaagtaatagctgtagaaccaggtaaaaatcccaaaaatgtacaaaccactccaggcacctttaagacacccgagggagaagttggagcgatagcactagatttcaaaccgggtacctcgggttcaccgatagtaaatcgagaaggtaaaatcgtaggcttatacggtaatggcgtggttacaacatccggcacctatgtgtcggcaatagcacaagccaaagcgagccaagaaggccccttacctgaaatagaagatgaagtatttaagaaaagaaacctaacaattatggatcttcatccgggcagtggcaagacaaggagatatctacccgcaatagtcagagaagcgataaaacgtaagttaagaacattaattctagcaccaacaagggttgtagcgtcagaaatggcagaagccttaaaaggtatgccaatcagatatcaaacaacagccgtgaaaagtgaacacaccgggcgcgaaattgttgatttgatgtgtcacgctacgtttaccatgcgacttctctccccggttagggttcccaactataacatgataataatggatgaagctcattttacggacccagcatcaatagcggcacgcgggtatataagtacgcgcgtaggaatgggagaagcagccgccatttttatgacagccacaccgccagggagcgttgaagcatttccacaaagcaacgccgtgattcaggatgaggagcgggatataccagagcggagttggaactcggggtacgattggattactgattttccaggaaaaaccgtttggttcgttccgagcattaaatcagggaatgacattgcaaactgtttaaggaaaaatggcaagagggtaatacaactatcacgtaaaacatttgatacagagtatcagaaaacaaagaacaacgattgggactacgtagtaaccacagacatttctgaaatgggagcgaatttcagagctgcgagagtgatagatcctagacggtgtcttaagcccgtaatattaaaagatggccctgaaagggttatactagccggtccaatgccagtaacggttgcttccgcggcacaaagacgcggtcgtatagggagaaaccaaaataaagagggtgatcaatacgtctatatgggccaaccactaaataacgatgaagaccacgcacactggaccgaagcgaaaatgcttcttgacaacataactacgccagaaggtatcataccagcactattcgaacctgaaagggaaaagagtgcagcaatcgacggagaaagtagattaagaggagaaccgcgaaaaacctttgttgagttaatgcgtcgaggtgaccttccggtctggctcagttataaagttgcatcggaaggattccaatactcagatagacgttggtgctttgatggcgagcgaaacaatcaagttctagaagaaaacatggatgtagagatttggcccaaagaaggagagcgaaagaaattgcgaccaagatggttggatgcacgtacttattcggatccattagcgctcggtgagttcaaagagttcggcgctggacggagaagtggcagcggagctttgattctagagattggaaaattaccacaacacttacctcttcgagcgcagaatggcctagacaaccttgtcatggtacataatagtgaacagggcggaaaagcatatcgacatgcgatggaagaactccccgacacaatcgaaacactgatgctgttggcattgattgctgtcctcacaggcggcgtaactttgttctttctctccggcaaaggactaggcaaaacctcgataggccttttgtgcgttacagcctcttcagcactattatggatggcatcagtagagccacattggatagcagcctcaataatattggagttctttttaatggttcttctaataccagaaccagatcggcagagaaccccacaagacaaccagctcgcatatgtagtaataggacttctgtttatgatattaactgttgcagcaaacgaaatgggactgctagaaactaccaagaaagacttgggtatcggccatgtagcggctgagaaccatcagcacgcaaccatgctggacgtcgacttgagacccgcgtctgcatggacattatatgctgtagcgacaacggttataacacctatgatgcgacataccatagaaaacacgactgccaatattagcctaaccgcgatagcaaatcaagctgctatattaatggggctggccaagggttggcccatctccaaaatggatattggagttccactactggctctaggatgttatagccaagttaaccccttaaccctaaccgcggcagtattgatgttggtagcgcattatgcaatcattggaccaggactccaagccaaggccacaagagaagcacagaaaagaacagcggctggcataatgaaaaatccaactgttgatggtatagtagccatagatctcgacccagtcgtctatgacgctaaatttgagaaacaactagggcaaataatgcttcttatactctggacttctcaaatcctgttaatgagaactacgtgggcgctaggggagtctattactctagctacgggacctttaactaccctgtgggaaggctcccccggtaagttctggaatactacaatagctgtctctatggcgaatatatttcgagggtcgtatctcgctggagcaggattagcattttcactcatgaagtcattagggggaggacgcagagggacaggtgcacaaggtgaaactcttggagaaaaatggaaaagacagttaaatcaactaagcaagagtgagttcaatacatataaaagaagtggcatcatggaagtagatcgatctgaagcaaaggaaggcttaaaaaggggtgaaacgacaaaacacgcagtaagtagaggtacggcaaaactaaggtggttcgtggagaggaatctggtaaacccagaaggtaaggttatagatcttggctgtggacgaggaggatggtcttactactgcgccggattgaagaaggttactgaggttaaaggttacacaaaaggaggacctggccacgaggaacccattcccatggctacctacggatggaacttggtcaagttgcattcaggaaaagatgtatttttcataccaccggaaaaatgtgacacactgttatgtgatatcggggaatcaagtccaaatcccacaatcgaagaaggtagaactctacgaggtctgaaaatggtagagccatggttgcgcggaaatcaattttgtattaagattttgaacccgtatatgcctagtgttgtagaaaccttagaacaaatgcagagaaagcacggagggatgctagttcgtaatccgttatcgcggaatagcacgcatgagatggactgggttagttgtggaactggtaatatagtctccgctgtgaatatgacgagcagaatgcttctaaacagattcacgatggctcacaggaagccgacatatgagcgagacgtggatctaggtgctgggacaagacacgttgcagttgaaccagaagtcgctaacttagacataattgggcaaaggatagaaaacatcaaaaatgaacacaaaagcacgtggcattacgacgaggataatccatataaaacatgggcttatcatggaagttacgaggtaaaaccatccgggtcagcatcaagcatggttaacggggtagttagactgttgactaaaccctgggatgtcataccaatggtgacacaaattgcgatgacagatacaaccccatttggacaacaaagagtgtttaaggaaaaagtagataccagaacaccaagagctaaacgaggcaccactcaaattatggaagtcacagcaaaatggttatggggttttctgtcgcggaacaagaaaccacgaatctgtacacgtgaggaatttacgcgaaaagttagaagtaatgcagctattggggccgtagttgtagacgagaatcaatggaatagcgcgaaagaagccggagaggatgagagggtgtgggatctaggagatcgagaaagagaactacataaacagggaaaatgtgcaacctgtggttataatatgatggggaaacgtgaaaagaaattaggtgagtttggaaaagccaaaggtagtagggcgatttggtatatgtggctaggcgcaaggtttttagagtttgaagcattgggattcatgaacgaagatcattggttcagcagagaaaattcactgagtggagtagaaggagaaggtcttcataaactaggatatattctacgagatataagtaagatacccggcggaaatatgtatgccgatgacacagcaggctgggatactaggattacagaagatgatctacagaatgaggctaaaattactgacataatggaaccagaacatgctctgctagccacatccatcttcaagttaacctatcagaacaaggtcgtaagagttcaaagacctgcgaaaaacggaacagtaatggacgttattagtaggagggcccaaagaggttcaggtcaggtgggtacctatggactgaacaccttcaccaacatggaggtacaactgatacggcagatggaaagtgagggaatctttcttcctagcgaactagagacacctaatctagcagaacgtgttttagattggttagaaaagcatggcgcagaacgtttgaagagaatggctatcagcggagacgactgcgttgttaaacctatagatgatcgattcgctactgctcttaccgcattaaatgatatgggcaaagtcagaaaggatataccccagtgggagcccagcaaaggttggaatgattggcaacaagtcgccttttggtcccatcactttcatcagttaataatgaaagatgggagggaaattgtagtaccttgcagaaatcaggacgaactagggggtagagcacgagtcagccaaggagcgggttggagcctccgggaaactgcatgtctcggtaagtcttacgcacagatgtggcagctaatgtacttccatcgtagagatctacgattagcggcaaatgcaatttgttctgcagtccctgtagattgggttccgacatctcgtacgacatggtcaatccacgcccatcatcaatggatgacaaccgaggatatgttaagcgtatggaatcgagtttggattgaagaaaatccttggatggaagacaaaacccacgttagtagttgggaagaagtgccctacctaggaaaacgagaagaccaatggtgtgggagtctaataggcctaactgcacgagcaacctgggcaacaaacatacaagtggctattaatcaagttagacgtttaataggcaacgaaaattatctagactatatgacaagtatgaagagatttaaaaatgaatctgatccggaaggagcattatggtaa

SEQ ID NO: 21323 - RNA, 9879 nt, synthetic construct
  misc_feature 1..9879: note = derived and/or modified CDS sequence (opt6) from DENV-1__FJ182002__SS-prME
  source 1..9879: mol_type = other RNA
agtgtcacgatgttattgatgttgttgccaacagctttagcattccacttaacaacacgaggaggtgaaccacatatgatagtatcaaaacaagagagaggtaagagcttgctatttaaaacttccgcaggagtaaatatgtgtactttaattgcaatggaccttggtgaactatgtgaagataccatgacatataaatgccctcaaataacagaagcagaaccagacgacgtagattgctggtgcaatgcgacagacacctgggtcacttatggaacatgctcacaaactggagagcataggagagataaacgaagcgtagcactggcaccacatgtaggattagggctagagactaggacggaaacatggatgtcgtccgaaggagcatggaaacaaatccaaagagttgaaacttgggctctgagacatccagggtttacagttattgctttatttttagcacacgctataggaacttctattactcaaaagggtattatatttatattattaatgttagtaacaccctcaatggccatgaggtgcgtaggaattggaaatcgagattttgttgaaggattgtcaggagcgacatgggtggatgtagttctggaacatggaagttgtgttacaacaatggcgaaaaataaacccaccctagatatcgaactgctcaaaactgaggtaacaaaccctgcaattttacgcaaattatgcatcgaagccaaaatatcgaacacgacgactgattcgagatgtccgacccaaggagaagcgacattagttgaagaacaagatgcaaatttcgtgtgccggcgaacgtttgtcgatcgaggatgggggaatggatgcggactatttggaaagggaagtttgcttacttgtgctaaattcaaatgcgtgaccaaactcgaaggtaagattgttcaatacgaaaatttgaaatactcagtaatagttacagtgcacaccggtgaccaacatcaagtcggaaacgaaacaacagagcatggaactatcgcaaccataacacctcaagcgccaacatcagaaatacaactaaccgactatggtgctttgaccctagactgctcacctcgtaccggattagactttaatgaaatggttttactcactatgaaagaaaagtcctggttagtacataaacaatggttcttagatttgccgttaccttggacttctggagctagcacttcgcaagagacttggaatcgtcaggatctcttggtcacatttaaaactgcccacgctaagaaacaagaagtagtagttttgggcagtcaagagggagcaatgcacactgcactaactggagctacggagatacaaacctccgggactaccaccatctttgcaggacatttgaaatgtaggttaaaaatggacaaacttacattaaaaggaacctcatatgttatgtgtactgggtctttcaaactggaaaaagaggttgccgaaacccaacatggaacagtacttgtccaagtaaaatatgaaggaacagatgcaccgtgtaaaataccattttcaacacaagacgaaaaaggcgtaactcaaaatggaagactaataacagcgaaccccatcgtaaccgacaaagaaaaaccagttaacattgaaaccgagccaccctttggagaatcctacatcgtagtgggcgcaggagaaaaggctttaaaattatcatggtttaaaaagggatctagcatagggaagatgttcgaggctacagcaagaggagcaagaagaatggctatcctaggggataccgcctgggactttggatccattggtggtgtgtttacctcggttggcaaacttgtacatcaggtatttggcacggcgtatggtgttcttttcagtggggtgtcttggacaatgaagataggcattgggatccttttgacttggttaggcctaaattcacgaagtacgtctttaagtatgacgtgcattgcagtaggtatggtaacactttacttaggagtaatggttcaagcagactcaggatgcgttataaattggaagggtcgagaattgaagtgcggaagcggtatctttgttacaaatgaagtccacacatggacagaacaatataaatttcaggcagatagccccaaaagactttcagctgcaataggcaaggcttgggaagaaggcgtgtgtggaatccggtcggcaactcgtctagagaacatcatgtggaaacagatatccaatgaattgaatcacatattattagaaaacgatatgaagtttacggtcgttgttggagatgctaatgggatccttgcacagggcaagaaaatgattaggccccaaccgatggaacataaatacagttggaaaagctgggggaaagccaaaattataggagcggacatacagaacactacatttattattgatggaccggatacccccgagtgccctgacaatcaaagggcttggaatatttgggaagtagaggattatggctttgggatatttacaactaatatctggctcaagttgagagatagttatacacaaatgtgcgaccaccgactaatgtcagcagccataaaagactcaaaggctgtacatgcagacatgggttattggatagagtcagagaaaaatgaaacgtggaaacttgcaagagccagctttattgaagtcaaaacatgcacgtggccaaaatctcatacattgtggagtaacggcgtcctggagagcgaaatgataataccaaaaatatacggaggaccaataagtcaacataattatcgaccaggttattttacacagacagcaggaccgtggcacctaggtaaactcgagctagattttgacttatgcgaaggtacaacagtcgtagtcgacgagcactgcggaaatcgcgggccctccttaagaacaacgacggttacaggaaaaataattcacgagtggtgttgtcgtagctgtacgctacccccattgcgctttagaggggaagatggatgttggtatgggatggaaattcgccctgtaaaagaaaaggaagaaaacttggtgcgatctatggttagtgcaggaagtggtgaagtggattcgttctcgctcgggatcctttgtgccagcataatgatcgaagaagtcatgaggtcaagatggagtaggaaaatgcttatgaccggaaccttggccgtgtttctattactaataacaggtcaattgacatggaatgatctaataaggctctgcattatggtgggtgctaacgcaagcgataggatgggaatgggaaccacttacctagctctaatggctacgttcaaaatgaggccaatgtttgcggttggattactcttcaggaggctaacatctcgagaggtactacttttgacaatagggctgtcacttgtcgcgtcagtggaacttcctaattcattagaagaattaggcgatggcctcgccatgggaataatgatgttaaaattgctcacagaatttcagccgcaccaactatggactacgctactatcattgaccttcattaaaacaaccctaagtctggattacgcttggaaaactaccgcaatggctttatcaattgtaagtttattccccctatgtttaagtactacctcacagaaaactacttggcttcctgtacttttaggcagctttggatgcaaaccactaacgatgttccttatcactgagaataaaatttggggcaggaaatcatggcctttaaatgagggaataatggcaattggaatcgtgtcaatactattatcttccttactcaaaaacgacgttccactcgcagggccacttatcgctggcggaatgctgatcgcatgctatgtgatatctggttcatctgcagatctatctcttgaaaaggcagcagaggtatcgtgggagcaagaggccgaacactctggcacaagtcacaatatattggtagaggttcaggatgacgggacgatgaaaataaaggatgaagaaagggatgacacattaacaatattattaaaagcaaccctattggccgtctcaggcgtttatcccatgagcattccggccactcttttcgtatggtatttctggcagaagaaaaagcagcgttctggggtgctatgggatactccttcgccgcccgaagtagaaagagcggtcttagatgatgggatttataggatattacagaggggattgttgggtcgaagccaagttggagtgggagttttccaagacggcgtgttccacacgatgtggcacgtgacaagaggggcggttctgatgtaccaaggaaagagattggaacctagctgggcgtccgttaagaaagatctaatctcttatggagggggatggagatttcaaggaagctggaatacaggagaggaggtacaggtgatagctgtcgaaccgggcaaaaatccgaagaatgtacaaacgactccaggcacatttaaaacacctgagggtgaagtgggtgctattgctcttgactttaagccaggtacttcaggaagcccaatcgttaacagggaaggtaagatagttggcctatacgggaacggggtcgtcaccactagcggcacatacgtgagtgccatagctcaagcgaaagctagtcaggaagggccattgcctgaaatcgaagatgaagtattcaagaaacgtaatttaacaataatggatctccaccctggtagtggcaagacaaggcggtatttaccagccatagttagggaggcgataaagcgaaaattaaggacgcttatcctagcaccgacacgagttgtagctagtgaaatggcagaagcactaaaggggatgccaatacgataccaaacaacggcagtgaagagtgaacatactggaagagagatagtcgatctgatgtgtcatgcgacattcaccatgcgccttttatcgccggtaagagttccaaattataacatgataataatggacgaagctcatttcactgacccagcttccattgcggcacgaggatatatctcgacaagagttggaatgggcgaagcagcggctatatttatgacggctacaccacccggctcggttgaggcttttccacaatcaaatgcagtaatccaagatgaagaaagagatatacccgaaagatcctggaatagcggatacgattggataacggacttccccggtaaaaccgtatggttcgtaccaagtattaaatcaggtaatgatatcgcaaattgcctaagaaagaatggtaaacgagtaatacaactctcaagaaaaacgttcgatactgaatatcagaaaacaaagaataacgactgggattatgtggtgacaactgatatatccgaaatgggggcaaacttccgagccgatagggttatcgatcctagaaggtgtttaaaaccagttatactgaaagacggcccggaaagagtaatcctagcaggacctatgccagtaactgtagcttccgctgctcaacgccgtggacggattggacgaacacagactaaagaaggggaccagtatgtgtacatgggccaaccgcttaataacgacgaagaccacgcccattggacagaagcgaaaatgctgttggctaacattaatacaccagaagggattatacccgctctatttgagccagaaagagaaaaatcgcctgctatcgacggcgaataccgtttaagaggagaagcaaggaaaacctttgtagaacttatgaggagaggggatttgcccgtatggctcagctataaagtagcaagcgaaggcttccagtatagtgataggcgctggtggtttgatggtgagcgaaataaccaagtacttgaagaaaatatggatgtcgaaatatggacaaaagaaggtgaaaggaagaaactcaggccccgatggttagatgctagaacatattccgacccgctggcacttggtgaatttaaagaatttggtgcgggaagaaggtccggtagtggagatttaattctagaaataggcaaactacctcagcacctaacgttacgagctcagaacggtctagacaatttagtaatggtccataactctgagcaaggtgggaaagcatataggcatgctatggaagaacttccagacacaatcgaaaccttgatgctcctagcattgatagccgtactaacaggcggagtcacactattctttcttagtggaaaaggtttgggaaaaacctctatcgggcttttgtgcgtgacagcatcatctgccttgctctggatggcctcagtagagccacactggatagcagcaagtattatacttgagttctttttaatggtactattaattccagaacccgatcggcagcgcacacctcaagataatcaattggcttatgtagtgataggacttctatttatgatccttactgtagcagcaaatgaaatgggtcttttagaaaccactaagaaagatttaggtataggtcatgtcgccgcggagaatcatcaacatgcaacaatgctagatgtcgacttacgtccagcgagtgcatggacactatacgcagttgcgaccactgtgataactccaatgatgagacacacaatagaaaacacaacagcaaacataagccttaccgcaatagccaatcaggctgcgatactaatggggttggacaaaggatggccaatctcaaaaatggacataggagtaccattgctagctttaggatgctatagccaggtgaatcccctaaccctaaccgcagctgtattaatgctggtagctcactatgcgattatcggaccagggctccaagctaaagcgaccagagaagcacagaaaagaacagcagccggtataatgaagaatccaactgtagacggtatagtggcgatcgacctagacccagttgtatacgatgcaaaatttgagaaacagttaggtcaaataatgttactaatactttgcaccagtcaaatattactaatgaggactacttgggccttatgcgaaagcataactctagctacaggtcctttgacaacactatgggaaggtagtcctggaaaattttggaatactacaatagctgtatctatggcaaatatattcagggggagttatctagcaggagcggggcttgcattttctctaatgaagagtttaggaggtggcagaaggggcacaggagcccagggggaaactctcggcgaaaagtggaagagacaacttaaccagctatcaaaatctgaatttaatacatataaaagatcgggaatcatggaggtagatagaagcgaggccaaagaagggctcaaaagaggtgaaacaactaagcatgcggtaagtagaggtactgcaaaattaagatggttcgtagaaagaaacttagtaaaaccggaaggaaaagtaatcgatttaggatgtggccgcggaggttggagttattactgcgcaggcttgaagaaagtaacggaggtcaaagggtacacaaaaggaggtcctggtcatgaagaaccaatacctatggctacatacggatggaatttggttaaactccattccggtaaagacgtcttctttatgccaccagagaagtgcgatacgctattgtgcgacataggagaatcctcgccaaatccgacaatagaagaaggaaggactttaagagtactaaaaatggttgaaccttggctccgaggtaatcaattttgtattaagatcctaaacccgtatatgccaagtgtagttgagacattagaacaaatgcagcgtaaacatggaggaatgctagtacggaaccctctgtcaagaaattcaacacatgaaatgtactgggtcagttgtggtacgggtaatattgtatcggcagttaatatgacatctcgtatgctgctcaatagatttacgatggcacatcgtaaacctacttatgaaagggatgtagacttaggtgcaggtacaagacatgtagcagtagagccagaagtagcaaacttagacataataggacaaagaatcgagaatattaagaatgaacataagagtacttggcattacgatgaagataatccttataaaacttgggcgtatcacggatcttatgaggtaaaaccctccggaagtgcaagctctatggttaacggtgttgtacgattgctaaccaaaccgtgggacgttatacctatggtaacgcaaattgccatgactgatacaacgccgtttggacagcaacgggtatttaaagaaaaagtagacacccgaactcccagagcgaagcgtggaacaacacagataatggaagttacagcaaaatggctttggggctttttgagccggaataagaaacctaggatttgtacgagagaagagtttacgcgaaaagtaagaagcaacgctgcgataggagccgtgttcgtagatgaaaatcagtggaatagcgcaaaagaagctggtgaggatgaaagagtctgggatctcgtagatagggaaagagaacttcacaaacaagggaaatggggaactggagggtataatatgatgggaaagagagagaagaaacttggagagttcggcaaagccaaaggatcccgtggaatatggtacatgtggttaggtgcaagatttttagaatttgaagcactaggatttatgaacgaagatcattggttcagtagggaaaatagcctatccggtgttgaaggcgaagggttgcacaaattaggctatatcctgagagatatctcaaaaatacctggtggaaacatgtacgcagacgatacagcaggctgggatacacgaattactgaagacgatcttcagaacgaagcaaagataacggacataatggagcccgaacacgcactgttagcaacgtcgatctttaaattaacatatcaaaataaagttgtgagggtacaaagacccgcgaaaaatgggaccgtgatggatgtaatatccaggagggatcaaagaggatcagggcaagtgggcacgtacggattaaatacttttactaatatggaagtccaacttatacgtcaaatggaaagcgaaggtatatttttgccttctgagttagaaacacccaatcttgctgaacgtgtcttagattggcttgaaaaacatggagcagagaggttaaagcgtatgccaataagtggtgatgactgcgtagtaaaaccgatagatgacaggttcgcgactgcattaactgcacttaatgacatgggaaaggttcgcaaagacataccgcagtgggaaccaagcaagggatggaacgactggcagcaagttcctttttggtcacaccattttcatcaattaattatgaaagacggaagagagattgtagtaccatgccgtaatcaagacgagctagttggcagagctagagtctcacagggcgctggctggagtctgcgagaaacagcatggcttggcaaaagctatgcacagatgggccaattaatgtacttccacagaagagacttaagattagctgccaacgcaatatggtcagcaggaccaggagactgggttcccacgtctcgcacgacgtggtcaatacacgcgcatcaccaatggatgacaacagaagatatgctctctgtctggaatagggtatggattgaggaaaacccttggatggaggataaaacacatgtgagcagttgggaagaagtgccgtatttaggaaagcgagaggatcagtggtgtggaagccttattggtttaacagcgagagcaacatgggccaccaatattcaagttgctataaatcaggtacgaagattaataggaaacgaaaactatctagattatatgacctccatgaaacgctttaaaaacgaatccgatccagagggagctctatggtaa

SEQ ID NO: 21324 - RNA, 9879 nt, synthetic construct
  misc_feature 1..9879: note = derived and/or modified CDS sequence (opt6) from DENV-1__FJ024482__SS-prME
  source 1..9879: mol_type = other RNA
agtgtaactatgctgttaatgctattgccaactgcactggcttttcatcttaccacacgaggaggtgaaccacatatgattgttagtaaacaggaaagaggtaaatcattactctttaaaacaagtgcaggagttaatatgtgcactttaatagcaatggaccttggagaactttgcgaagacacaatgacatataaatgtccacaaattactgaagcagaaccagatgatgttgactgttggtgcaatgcaacagatacctgggtgacgtatggaacttgttcacaaacgggggaacacaggagggataaaaggtctgttgcattagcaccacacgtaggattaggtcttgagacaagaacggaaacttggatgagcagtgaaggcgcctggaaacaaatccaacgggtggaaacgtgggcactgaggcatccaggttttacagttatcgctttatttttagcacatgctatcggaacctcaatcacacagaaaggcataattttcatattactcatgctcgtcacaccaagcatggcaatgagatgtgtcggaataggaaatagagattttgtagaaggattatcaggggcaacatgggtggatgttgtcttggaacacgggtcatgtgtgaccactatggcgaaaaacaaacctacattggacatcgaattgttaaaaaccgaagtgacaaacccagccattttacgtaaactctgtattgaagcaaaaatcagtaataccaccactgacagtcggtgccccacgcaaggagaggctacattagtagaagaacaagatgcaaactttgtttgccgtagaacgttcgtcgatcgaggttggggaaatggctgcggattgttcggtaaaggatcacttctaacatgtgcaaaatttaaatgtgtaactaaattggaaggaaaaatagttcagtatgaaaacttaaaatattcagtaattgtcacagtgcacacgggcgaccagcaccaagtaggtaacgagaccacggaacatggaactatagccacaataacgccccaggcaccaacatctgaaatacaactaactgattatggtgcattaaccttggactgttcaccaaggacaggtttggattttaatgagatggtattactaacaatgaaagaaaaatcctggttagtacataaacaatggttcttagatttaccacttccatggaccagcggtgcttctacttcacaagaaacctggaacaggcaagatctattagttacgttcaaaacagcccacgctaagaaacaagaagtcgtagtattgggatcgcaggaaggagctatgcatacagcgcttactggggcaacagaaatccaaacatccggaacgactacaattttcgcaggacatttgaaatgccgactaaaaatggataaacttacactcaaaggaacgagttacgttatgtgtacgggttctttcaaattagagaaagaagtagcggaaacacaacatggtacggttcttgttcaagtcaaatatgagggcaccgacgcaccctgtaaaatcccattccttactcaagacgaaaaaggggtaacacaaaatggtcgtttgattacagcaaatccaatagttacagataaagagaaaccagtgaacatagaaacggaaccaccttttggtgaatcatatatagtggtcggtgccggagaaaaggctttaaaattaagctggttcaagaaagggagttcgatcggaaaaatgtttgaagccacagctagaggagcaagaaggatggccatattaggagacactgcgtgggattttggatcaatcggaggagttttcacttcagttggtaagttagttcatcaagtgtttggaacggcatacggagtccttttctctggagtttcatggactatgaaaatcggaataggtatactgttaacatggcttggattaaactcgaggtccacttcactgtcaatgacctgtatagctgtaggaatggtgacactgtatttaggtgttatggttcaagcagacagcggatgcgtcataaattggaaagggcgggagcttaaatgtgggagcggaatattcgtcacaaatgaagtacacacatggaccgagcaatataaattccaggctgactcaccaaagcgattatccgccgccataggaaaggcatgggaggagggggtttgtggcatacgaagtgcaactagattagaaaatattatgtggaaacaaatctcaaacgaactcaatcatatcctattagaaaatgatatgaagtttacagtggtggttggagacgcaaatggtatattagcacaagggaagaaaatgatacgacctcaacctatggaacacaaatattcatggaagtcgtggggcaaagctaaaataataggagccgatatccaaaacacaactttcatcattgacggaccggacacaccagaatgtccagataatcagagagcctggaacatctgggaagtagaagattatggattcggcatattcacaacaaacatatggcttaaattacgcgattcttatactcagatgtgcgatcatcggcttatgtctgccgcaataaaagacagtaaagcagtgcacgctgatatgggatattggatagaaagcgagaaaaatgaaacctggaaactagcgcgtgcatcttttatagaagttaaaacttgcacttggcctaagtcacacactttatggagcaatggcgttttagaatcagaaatgataataccaaagatatatggaggacctatctcacaacataactatagaccaggctatttcacccagactgcaggaccgtggcacttgggaaaattagaactagatttcgatttatgcgaaggaactaccgtggtggtagatgagcattgcggtaaccgaggaccatccttaagaacaacaactgtaacaggaaaaataattcacgagtggtgttgccgctcctgtactttacctcctttaagatttcgaggggaagatggatgttggtacggaatggaaatcagaccggtaaaagaaaaggaagaaaatctagtaaggagcatggtgtctgcgggtagtggagaagtcgactcgttttcattaggaatactttgcgcatcgatcatgattgaagaagtaatgcgatcaagatggagcaggaaaatgctgatgacaggcactcttgccgtctttttacttctgataatgggacaactaacatggaatgatctaatcagactatgtattatggtgggtgccaatgcaagtgatcgaatgggtatggggacgacgtatttagcccttatggccacatttaaaatgaggcctatgtttgcagtcggactacttttccgaagattaacttcaagagaggttctccttctaacgataggtttaagcctagtagcaagcgttgaacttccaaattccctagaagagttaggtgatggattagcgatgggtataatgatgctcaaattacttacagaatttcaaccacaccaactttggacgactttactaagtttaacatttatcaaaacaactttaagcctcgattatgcatggaaaacaacagcaatggcattaagcatcgtatctttattccccctttgcctatcaactacatctcagaaaacaacatggttacccgtacttttgggatcctttggatgcaaaccactaactatgttcctcataacggaaaacaaaatttggggtcgtaaaagctggccacttaatgaaggaatcatggcgatcggtatcgtatcaatactattaagttcattgctaaagaatgatgtaccattagcaggacctttaattgccggtgggatgttaattgcatgctatgtcatttccggatcaagtgcagatctatcactcgaaaaagcagctgaggtgagttgggagcaagaagcagaacactcaggcacgagccataacatccttgttgaagttcaagatgacggtactatgaaaatcaaagatgaggaaagagatgacacgcttactatactccttaaagcaacacttttggcagtatcaggagtttatccaatgtcaatccctgcgactttgtttgtgtggtacttttggcagaaaaagaaacaaaggtcaggcgtattatgggacacaccatcgccgccagaagtagaacgcgcagttcttgacgatggtatatatagaatattacagcgaggacttcttggccgatcacaggtaggtgtaggtgtctttcaagatggagtcttccacactatgtggcacgtcactagaggtgctgtattgatgtaccagggaaagcgattggaaccatcgtgggcgtcagtgaagaaagatttgatatcttatggaggaggatggcgctttcagggatcatggaatacaggagaggaagtccaagtaatagcagtagagcccggcaaaaaccccaaaaacgttcagacaacacccgggacattcaaaacaccggaaggggaggtgggagcaatcgcacttgactttaagccaggaacatctggatcccctatagtgaatagagaagggaaaatagtaggcctttacggaaatggagttgtcaccacatctggcacgtatgtaagtgccatcgcacaagcaaaggcaagccaagaagggccattaccggagatcgaagatgaggtatttaagaaacgcaatctcaccatcatggaccttcatcccggtagtggaaagaccagacgctacttgccggcgatcgttcgagaggcgatcaagcgaaaacttaggaccttaattctcgcgcccactagagtcgtcgcatcagagatggcagaggcactaaaaggaatgccgataaggtatcaaacgacagcagtaaaatcagaacatacgggaagagaaatagtagacttaatgtgccatgccacattcacaatgcggttactgtcacctgttcgagttccaaattataatatgataatcatggacgaggcgcatttcaccgatcccgccagcatagcagcaagggggtatatctctacacgcgtagggatgggagaggccgcagcgatattcatgactgccacaccccctgggagtgtagaagccttcccccaatcaaatgccgttatacaggacgaagaaagagatatacctgagagatcatggaactcgggttatgattggatcacggacttccctggcaaaacggtttggtttgtaccatcaatcaaatcaggtaatgacattgcgaattgtctaaggaagaatggcaagcgagtaatacaactttcgaggaaaaccttcgacactgaatatcagaaaactaaaaataacgattgggactatgtagttacaacagatatttccgaaatgggagccaattttagggcagatagagttatcgacccacgcagatgcttaaaaccagtaatattaaaggacgggcccgaacgcgtaatcttagccggtccaatgccggtaactgttgcatctgctgcacaaagacgcggacgaattggccggaaccagaataaggagggagatcaatacgtatatatgggccaaccactaaataacgatgaagatcacgctcactggaccgaagccaaaatgcttctagacaatattaatacacctgagggaataattccagcgctattcgagccggaacgcgagaaaagtgcagccatagatggggagtatcgtttgcgaggagaagcaagaaagaccttcgtagagctaatgagaagaggcgatctacccgtttggttaagttataaggtagcaagtgaagggtttcaatattcggaccgcagatggtgttttgatggagaaagaaataaccaagtgctggaggagaatatggacgtcgaaatatggccgaaagaaggagagaggaagaaattacgaccccgttggttagacgcacgaacgtattctgatcctctcgcactacgagaatttaaggaatttgctgcaggcagacgtagtgtttctggggacctaattttggaaataggtaaattaccacaacacttaaccctgcgggctcagaacgcattggataacttagtaatggtacataatagtgagcaaggcggaaaagcgtacaggcacgctatggaagaattgccggacactatagaaactttaatgctacttgcattgattgcagtgctcactggaggagtgacgctattcttcctgagtggaaaaggtttaggtaaaacatcgataggcctcctgtgtgtaacagctagttctgcccttctatggatggcatccgttgaaccccactggatcgcagcttctattatattggagtttttcctaatggtattgttgatccccgaacctgatcgacagagaaccccacaagataatcaattagcttacgtagtgattggtctcctatttttaatattaacagtggcagccaacgagatgggcctattggaaactactaagaaagatttaggtataggacatgttgccgctgaaaaccatcaacacgctactatgctggatgtcgaccttcgtccggcttcggcctggacgctatacgcggtagctacgacagtaattacaccgatgatgagacacactatcgaaaacacaacagcgaatatcagcctgactgctatagcaaatcaggctgccatattgatggggttagacaaaggttggccgatttccaaaatggacataggcgtaccccttttagcattgggttgctacagtcaagttaaccccctcaccctcacagcagcagtcctaatgctagtagctcattatgccataataggtcctggcttacaagctaaagctacacgggaagcacaaaagcgaacagcagccgggattatgaaaaaccctaccgtagatggaatagtagctattgacctagacccagttgtatacgatacgaagttcgaaaaacagttaggccaaataatgttgttaattttgtgtacatctcagatactgctgatgagaacgacatgggcgttatgcgaaagtataacattagccacgggcccactgactactctttgggaaggaagcccaggaaaattctggaatactactattgctgtcagcatggccaatatctttaggggaagttatttggcaggagccggacttgcatttagtttaatgaagtctttaggtggaggtcggaggggtactggtgcacaaggcgaaacgcttggagaaaaatggaaacgccagttaaatcaattaagtaagtccgagttcaacacttacaaacgcagcgggatcatggaagttgacaggagcgaagcaaaagagggattgaaaagaggtgaaaccacaaaacatgcggtttcaagaggaaccgctaaattacgatggttcgtcgaacgaaacctggtcaaaccggaaggaaaagtcatcgaccttggctgtggaagaggagggtggtcttattattgtgccgggctaaagaaagtaacagaagtaaaaggttacactaaaggagggcccggccacgaggaacctatacctatggccacttatggatggaatttggtcaaacttcacagcggaaaagatgtatttttcatgccacctgagaaatgtgacaccctcctgtgtgacataggagaatcatcacccaatccaacaatagaagaaggtagaactttacgagtactcaagatggtagaaccatggctacggggaaatcaattttgtattaagatactcaacccttacatgccctcagtggttgagacattagagcagatgcaaaggaagcacgggggaatgctagtacgaaaccccctcagtaggaatagtactcatgagatgtactgggtgagctgtggaacaggaaacattgtgtcagcagtaaatatgacctctcgcatgctattgaatagattcacgatggctcaccgaaagcctacttatgaacgggatgtagatttaggggccgggacacgacatgtcgcggtagagcctgaagtagcaaatcttgatattataggtcaaaggatagaaaacatcaaaaatgagcataaatcaacttggcattatgacgaagataatccctataaaacctgggcatatcacggatcatatgaggtaaaaccaagcgggtccgcaagttctatggtgaacggggtggttagattacttaccaagccatgggatgttataccaatggtaactcaaatagctatgacagatactacgcctttcggacaacaaagggtatttaaagaaaaagtagatacaagaacacctcgtgctaaaaggggaaccacacaaatcatggaagttacagcaaaatggttatgggggttcctgagcagaaacaaaaagccgagaatatgtacaagagaagaatttacgaggaaggtgagatctaacgcagctataggcgcggtctttgttgacgaaaaccaatggaactcagcaaaagaagccgtcgaagatgagcgtttctgggatttggtacatcgcgagagggaactacataaacaaggaaaatgtgctacttgcgtttacaatatgatgggtaagcgtgagaagaaattaggagagtttggaaaagcaaagggcagtcgcgcaatatggtatatgtggctaggagcacgtttcttagagttcgaggcattaggctttatgaatgaggatcattggttctcacgtgaaaattctttttctggagtcgaaggcgagggattacataaacttgggtacatattaagagacataagcaaaatacccggaggaaatatgtacgctgacgacacggcggggtgggacacaagaataacagaagatgacctgcaaaacgaagcaaaaataaccgatatcatggaacccgaacacgcgttacttgcaacttctattttcaaactaacataccaaaacaaagttgtaagggtccagaggcccgccaaaaatggaacagtcatggatgtaatatctcggcgcgcacaacgaggaagtggacaagtgggcacttacggactaaatacattcacaaacatggaggtacaactaattagacaaatggaatccgagggtatatttctaccatcagaactggaaactccgaatctagccgaacgggtgctagattggctagaaaaacatggtgctgagagactgaaaaggatggctataagtggagacgactgtgtggttaaacctatcgatgaccggttcgctactgccttgacggcactaaacgcaatgggtaaagtacggaaagacataccccaatgggagccatctaaaggatggaatgactggcaacaagtcccattctgcagtcatcattttcatcaactaataatgaaggatggaagagagatagtagtaccctgtcgaaatcaagatgaacttgtaggacgggctcgtgtatcacagggtgcgggatggagcttacgcgaaaccgcatgtttgggaaagtcatatgcacaaatgtggcagcttatgtacttccacaggagagacttaagacttgcagcgaatgcaatatgcagcgcagttcctgttgactgggtcccaaccagtcggacaacttggagcatacatgctcaccaccaatggatgaccactgaagatatgttatccgtatggaacagagtatggatagaagaaaatccctggatggaagataagactcacgttagtagttgggaagaagtaccatatctaggaaagcgagaagaccaatggtgtggcagcttgatcgggctgactgcacgggcaacctgggctacaaatatacaagtggcaattaatcaggtcagaagactaataggtaacgaaaattatctagactacatgacctcgatgaaacggttcaagaatgagagcgatccagaaggcgcactgtggtga

SEQ ID NO: 21325 - RNA, 9879 nt, synthetic construct
  misc_feature 1..9879: note = derived and/or modified CDS sequence (opt6) from DENV-1__EU596501__SS-prME
  source 1..9879: mol_type = other RNA
agtgtaaccatgttgctcatgttgttacctaccgcattagcttttcatttaaccaccaggggaggcgaacctcacatgatcgtatctaaacaagaacgagggaaatcccttttattcaaaacaagtgctggagttaacatgtgcacgttaatagcaatggacctgggtgagttatgtgaagacacaatgacttataaatgtccccaaataactgaagccgagccggatgacgttgattgttggtgtaatgctacagacacctgggtaacatacgggacatgcagccaaactggtgaacaccgaagggacaaaaggagcgtagccttagctccacatgtagggctagggcttgagactaggacagagacatggatgtcatccgaaggagcatggaaacaaattcaacgagtagagacgtgggctttaagacatccgggtttcacagtaatcgcattattcctcgcacatgcgatcggaacatcgatcactcaaaaaggaataatatttatacttttgatgctagttacaccatcaatggccatgcgatgtgtcggtataggcaatcgcgattttgttgaaggattatctggagccacatgggttgacgtagtcttagaacatggatcttgtgtaactacaatggccaaaaataaaccaacattggatatagaactgcttaaaacggaagtcaccaatcccgctatattacgaaaactttgtattgaagcgaaaatttctaatacaacgaccgattcacgttgtccaacccaaggagaggcaacattagtagaagaacaagatgcaaactttgtttgccggagaacattcgtagataggggctggggtaacggttgcggattattcggcaaaggatcactcctaacatgtgctaaatttaaatgtgtgacgaaactagaaggtaaaatagttcaatatgaaaacctaaaatattcagtaatagttacagtacacactggagatcaacaccaagtcggaaatgagacaacagagcatggaacgattgcaactataacacctcaagcacccacatcagagatacaacttacagattatggagcgttaacactcgattgctcaccaagaaccggattggacttcaacgagatggttcttctcacaatgaaagaaaaatcctggctagtccataaacaatggtttcttgatctgcctttgccttggacctcgggagcaagcacatcccaagagacgtggaacagacaagacttgctagtcacattcaaaaccgctcacgccaagaaacaagaagtggtagtattgggtagccaggaaggtgcaatgcatactgcacttaccggtgctacagaaattcagacttccggtacaactactatctttgcaggtcacttgaaatgtcggctaaaaatggataaactgacgctgaaaggcacgagttacgtaatgtgtactggttcattcaaattggaaaaagaagtggcagaaacacaacacggcacggttttagtacaagtgaaatatgaaggtactgacgcaccatgtaaaatacccttcagcacacaggatgaaaagggagttacacaaaacggaagactcataaccgccaatccaattgttacggataaagagaaacccgttaacatagaaaccgaaccgccattcggagaaagttatatcgtagtaggggcaggcgaaaaggctttaaaattgtcatggtttaagaaagggtcgagtattggtaaaatgtttgaagcaactgcacggggagctagaagaatggcaatattaggcgataccgcctgggatttcggttctataggcggtgtgttcacatcagtcggaaaattagttcaccaagtattcggaactgcttatggagtgctgttttcaggcgtgagctggaccatgaagatcgggattggaatcctccttacatggcttggactaaattctaggagtacatctttatcgatgacttgtatcgccgtaggaatggtaactctgtacctcggagtcatggtacaagcagacagcgggtgcgtcataaactggaaagggcgagaattaaagtgcggaagtggcatttttgtcactaatgaagtacatacatggactgaacagtacaaattccaggcagattcaccaaagaggttatcagcagcaatagggaaagcgtgggaagagggcgtatgtggtatcaggagtgcaacccgattggaaaatataatgtggaagcaaataagtaacgaactaaaccacattcttctggagaatgatatgaaatttacggtcgttgtgggggacgccaacggcatcctggcccaaggtaagaaaatgataagaccccaaccgatggaacataaatacagctggaaatcgtggggtaaagctaaaataataggtgcggatattcaaaatacgacatttattatagacggccctgatacaccagaatgcccagataaccaaagagcctggaatatatgggaagtggaggattatgggtttggcatttttacaaccaatatatggttaaaattaagggatagctatactcaaatgtgcgatcatcgtctaatgtcggcagcgataaaagattcgaaagcagtgcatgctgatatgggatactggattgagtcagagaaaaatgagacatggaaattagcaagggctagttttatcgaagtcaaaacctgtacatggcccaaatcacatacactgtggtccaacggtgtgttggaaagtgaaatgataataccaaaaatatacggaggcccaatcagtcaacataattaccgtcccggttactttactcaaactgcgggcccgtggcacctaggaaagctcgaactagatttcgacttatgtgaagggaccactgtggtcgtcgacgaacactgtggcaacaggggccccagtctcagaactaccactgtaactggcaagataatacatgaatggtgctgtagatcctgtacactgcctccccttaggtttcgaggcgaagatggatgctggtatggtatggagatacgtcctgtaaaagaaaaggaggagaacttagtcagatccatggtctccgcgggatcaggtgaagtcgactcgttctctcttggtatcttgtgtgcttctattatgatagaagaggtaatgcgtagccgatggtcaagaaaaatgctcatgacgggaactctcgcagtgtttcttctccttataatgggacaactaacatggaatgatcttatacgtctctgtataatggtaggcgctaatgcaagtgatagaatggggatgggaacaacataccttgctcttatggcgacttttaagatgaggcctatgtttgcggtagggttgttatttcgaagactaacgtcaagggaagtactgttgctcacaattggattgtcgttagtagcaagcgttgaattaccaaattcactcgaagaactaggagatggattagcaatggggattatgatgttgaagttactaacagaatttcaaccccaccaactatggacgacacttttatcgctaacattcataaaaacaacactttctctcgattacgcgtggaaaacgactgcgatggccctctcaattgtttccctgttgcccctatgtttgtcaaccacatcacagaaaacaacatggctacccgttttgttaggtagttttggatgtaagcctcttaccatgtttttaataaccgaaaataagatatgggggagaaaatcgtggcctctaaacgaagggattatggcaataggtatagttagcattctcttatcgagcctacttaaaaatgatgtcccactagccggaccgcttatagccggaggtatgctgatagcatgttatgtaatatctggttccagcgcagatctatcgcttgagaaagctgcagaggtttcatgggaacaagaagccgaacacagtggaacttctcataacatactcgttgaagtacaagatgatggtacgatgaaaattaaagacgaagaaagagatgacacattgaccatactattgaaagcaacgctcttagcagtgtctggagtttaccctatgtcaataccggcgacattattcgtatggtacttttggcaaaagaaaaagcaacgatcaggggtattatgggacacaccatcaccgccggaagtagaacgtgcggtattagatgacggtatatacagaatcatgcaaagaggtttgcttggaagatctcaggtaggcgtaggagtatttcaggatggagtttttcacaccatgtggcatgtgacacgaggagcagtgctaatgtatcaaggcaaaaggttagaaccatcgtgggcatcagttaagaaggacctaattagttatggcgggggctggagatttcagggatcatggaatacaggagaagaagtacaagtaatcgcagttgaaccagggaagaatcctaaaaatgttcaaacaactccaggaacatttaaaacactagagggagaagtaggagcaatagcgttggactttaaacccggaacttctggatcgccaatagtgaatagagagggaaagatcgtcgggttatacggaaacggagtagtgaccacaagcgggacatatgtctcagccatcgcgcaagccaaggcttcccaagagggtccgttacctgaaatcgaagacgaagtctttaagaaaagaaatctaaccattatggatttacacccagggagtgggaaaacaaggcgataccttcctgcaattgtgagggaagcaattaaaagaaagttacgaactctaatcctagctcccacacgagttgttgcatcagagatggctgaagcgcttaaggggatgccaataagataccaaacgaccgcagttaaatctgagcacacaggacgcgaaatagttgacctgatgtgtcacgcaacattcacaatgagattactatccccagtacgtgttcccaattacaacatgattattatggatgaagctcatttcaccgatcctgcttcaatagctgcaagaggatatataagtactagagttggtatgggggaggcagcagctattttcatgacagcaacgcctccaggatcagtagaggctttccctcaatcgaatgcagtaatccaggatgaagaaagagacattccggaaagatcatggaactctggttatgactggattacagatttccctggtaaaactgtgtggtttgtacccagcataaaatccggtaacgacattgctaactgtttaaggaaaaatggcaaacgtgtcatacaactctcgcgaaaaacatttgacacagaataccaaaagaccaaaaataacgactgggactatgtagttactacagatatttccgagatgggagctaatttcagggcggacagagtgatagacccaaggaggtgtttaaagccagtaatcctaaaagacggtcctgaaagagttatattagcgggaccaatgcctgtgactgtagcatctgctgcgcagcgacggggacgtattggaagaaatcaaaataaggaaggcgatcagtatgtttatatggggcaacctcttaacaacgacgaagatcatgcacactggactgaagcgaaaatgctactagataatataaataccccagagggaataatccctgctctatttgaaccggaaagagaaaaatccgccgcaattgacggcgaatatcgcctcaggggagaagcacggaaaacattcgttgaattgatgcgcagaggagatcttccagtatggctgagttataaagtggcgtcagaaggattccaatacagtgaccgacgctggtgttttgatggggaacgaaataaccaggtacttgaagagaatatggatgtagagatatggacaaaagaaggtgaaagaaagaagttaaggccccgatggctagatgcgcgtacatatagtgatcctctagctttacgtgaatttaaagaatttgcggcaggtagaaggtcagtatcaggagatttaatattggagatcggaaaactaccacagcatttgaccttacgcgcacagaatgctctagacaatttagtcatgttacataattctgaacaaggtggaaaggcatacagacatgccatggaggaactacctgatactatcgagacgctaatgttattagcactaatagccgtgctgacaggtggtgtgacgttattctttctttctggaaaggggcttggaaaaacatcaataggattgctatgcgtaacagcgagtagcgcactcctatggatggcatccgtagagccccactggatcgccgcttcaataatattggaatttttcttaatggtattgttaataccagagccggatagacaacgaacaccgcaagacaatcaattagcctacgtggtcataggtctactttttatgatattaaccgtggcagctaacgaaatgggattattagaaactactaagaaggatttgggaataggccatgtcgcagcagaaaatcaccagcatgctaccatgttagatgtcgatcttagaccagcctcagcgtggaccctctatgcggtggcaacgactgtcataacaccaatgatgcgacatacgatcgaaaataccactgcaaacataagtttaacagctattgccaatcaggcagcaatattgatgggactagacaaagggtggcctatttcaaaaatggatataggagtgcctttactcgcactcggatgctacagccaagtcaatccgctgaccctaacagccgcagtactcatgttggtcgctcattacgccataatcggcccgggtctccaggcaaaagcgacaagagaggcacagaaaaggactgcagcagggataatgaaaaatccaacagtcgatggaatcgtcgctattgatttggatccggtagtttatgatgcaaaatttgaaaagcaactgggacaaataatgctgctaatattgtgtacatcccaaatattattgatgcgcactacgtgggcactttgtgaatcgattaccttggcaaccggcccgcttacaacattgtgggaaggctcacccggcaaattttggaatactaccatcgctgtcagtatggcaaacattttcagaggatcctacttagcaggggcaggtttagccttttccttaatgaaaagtttaggcggaggtagacgggggacaggggcgcagggggagactttgggagaaaagtggaagcggcaattaaatcaactctcaaagagcgaatttaatacttacaaaaggagtggcataatggaagtggatagatcggaagctaaagaaggtctgaagagaggagaaaccactaaacacgctgtatcaaggggcacagccaaacttagatggttcgttgaacgaaacctagttaaacccgaagggaaagttatagatctagggtgtggtcgaggaggttggtcttattattgtgcaggattaaagaaagtaacagaggtaaaaggatatacaaaaggtggtcccggccatgaggaaccgataccaatggctacatacggttggaatttggtcaaattacattcaggaaaagacgtcttcttcatgccacctgaaaagtgtgatacgctactatgcgacattggagaatctagtccaaaccccactatagaagaaggcagaactttgcgagtcttaaaaatggtggaaccttggttgagaggtaaccagttttgtataaaaatcttaaatccctacatgccatccgttgtagaaacacttgaacaaatgcaaagaaaacatggtgggatgttagtacgtaacccgcttagtagaaattcgtcacatgaaatgtattgggtcagctgtggaactgggaacatcgtatcagctgtaaacatgacgagtcgaatgttactgaatagatttactatggctcacagaaaacctacgtatgagagggatgtcgacttgggagcaggtacaagacatgtggcagtagagcccgaggtcgctaatctagacataattggccaacgaattgaaaacataaagaatgaacataagtctacgtggcactatgatgaagacaacccatacaaaacatgggcctaccatggtagttatgaagtaaagccgtcaggatcagccagttccatggtaaatggtgtagtgcgcttacttactaaaccctgggatgtcattccaatggttactcaaatagcgatgacagacacaacacccttcggtcaacaaagggtatttaaagaaaaagtagatacgaggaccccaagggctaaaagagggactacgcaaatcatggaggtaacagcaaagtggttatggggatttttgtctcgaaataagaaaccgagaatatgcacaagagaagaatttacaagaaaggtcagatcgaatgcagccattggagcagtatttgtagacgagaaccaatggaactctgcaaaagaagctgtggaggacgaaagattttgggatcttgtacatcgagagcgtgaactccataaacaaggaaagtgtgcgacatgtgtatacaatatgatgggcaagcgcgagaagaaacttggtgaatttggaaaagcaaaaggcagtcgagctatatggtatatgtggttgggcgctagattcttagaatttgaagccctgggatttatgaatgaggatcattggttttcacgtgaaaatagcttaagcggcgtcgagggtgaggggctccacaaactaggttacattctacgagacatcagcaaaattcccggaggaaatatgtacgctgacgatacagcaggttgggatacacgaataactgaagatgatctccaaaatgaggctaagataactgatatcatggagcctgaacacgctcttttagcaacatccatattcaaactaacgtaccaaaacaaggtagtcagagtccaaaggcctgctaagaatggaactgtaatggatgtcatttccagaagagatcaaagaggaagcgggcaggttggaacttatggtcttaacacttttacaaatatggaagttcaactaatacgacaaatggagtcggaaggtatatttttaccttcagagttagaaaccccaaatttggcagaaagagtgctagactggctagagaaacatggagcggagaggctaaaaaggatggcaattagtggcgacgattgcgttgtaaaacctatagatgatagatttgcaactgctttgaccgccctgaacgacatgggtaaagttagaaaggacatccctcaatgggaaccatcaaaaggttggaatgactggcaacaagtcccattttgttcacatcatttccaccagctaattatgaaggatggccgcgaaatagttgttccttgtcgtaaccaagacgaattagtcgggagagcgagagtatcccaaggagctggttggtcactaagagaaactgcatgtttaggtaaaagctacgcgcaaatgtggcaactgatgtattttcaccgtagggatctaagactcgcagcgaatgctatatgttcggcagtcccagtagactgggtccccacttcaaggactacgtggtcaatacatgcacatcaccaatggatgaccactgaggacatgttatctgtatggaacagagtatggatcgaggagaatccatggatggaagacaaaactcatgtaagcagttgggaggaagttccgtatcttgggaaaagggaagatcagtggtgcggaagccttatcggactaacggcaagggcgacatgggctacaaacatccaagtcgcaatcaaccaggtcagacgattaatagggaacgaaaattatttagactacatgacctctatgaaaaggtttaagaacgaaagcgatccagagggagctttgtggtaa

SEQ ID NO: 21326 - RNA, 9879 nt, synthetic construct
  misc_feature 1..9879: note = derived and/or modified CDS sequence (opt6) from DENV-1__FJ898437__SS-prME
  source 1..9879: mol_type = other RNA
tcagttacgatgctcttaatgctactccccactgcgttagcttttcacttaaccactagagggggcgaaccccatatgatagtaagtaaacaagaacgagggaaaagtttactatttaaaaccagtgccggtgttaatatgtgtacattgatagctatggacctcggagaattgtgtgaagataccatgacatacaaatgcccccaaataacagaagcagaacccgatgatgtagattgctggtgcaacgcaacagacacttgggtaacatacggcacctgttcccaaactggggaacatcgccgtgataaacgttcggtcgcactagcaccacatgtaggtctcggcttagaaacgaggaccgaaacatggatgagttcagaaggtgcttggaaacaaattcagagagtggaaacatgggcattacggcaccccggatttacagtcatcgcactatttttggcccacgcaatcggaacttcaataactcaaaaaggcataatttttatactcctgatgttagttacaccgagtatggctatgcgctgtgtcggaataggaaaccgcgattttgttgaagggttatcaggagcaacctgggtagatgtagttttagaacatgggtcttgtgtaacaacaatggccaaaaataaaccgaccctcgacatcgaactactcaaaactgaagtgacgaatccggcgatattacgaaaactttgcattgaagcaaaaatctcaaatacaacaacagattctagatgcccaacccaaggtgaggccactttggtcgaggagcaggatgcaaattttgtttgtcgacgtacatttgtagatcgaggatggggtaatggctgtggattgttcggaaaaggatcactgctcacgtgtgcaaaatttaaatgtgtcacaaaactggaaggaaaaatagttcaatatgaaaacttaaaatattcagtaatcgtaacagtacataccggtgatcaacaccaagttggaaatgaaacaaccgaacatggaaccatcgcgactataacaccacaagcacccacaagtgaaattcaattgaccgattatggcgccttaacactagattgcagcccacgtaccggtttagattttaatgaaatggtactgctaactatgaaagagaaatcatggctagtccataaacaatggttcttagacttgcccttaccgtggacatcgggggcaagtacatcccaagaaacttggaatcgtcaggacctcctagtaacatttaaaactgcccatgctaagaaacaagaagtagtagtacttggaagtcaagaaggcgcaatgcatacagcgctaactggagcaacagaaatacaaacgtcgggcacaactaccatattcgcaggacatctaaaatgtcgactaaaaatggataaactcaccttgaaaggaacatcttatgttatgtgcacaggatcatttaaattagaaaaagaggtagcagaaactcaacacggaacagtgctggttcaagtaaaatacgaaggtacagacgctccatgtaaaatccccttctcaacacaggacgaaaaaggagtcacacaaaacggccgcttgatcacagcaaaccccatagtaactgataaagagaaaccagtaaatatagaaacagagcctccatttggtgagtcgtacatcgttgttggtgctggagagaaagcccttaaactatcgtggtttaagaaaggaagttctattggaaaaatgtttgaggcaactgctagaggagcaagacgcatggcaattctaggggacacagcatgggactttggttcaataggtggagtattcacgtcggtaggaaagttagttcatcaggtatttggaacagcatacggagtactcttttctggcgtttcatggacaatgaagatcggtataggaattttactaacatggctcgggcttaattcacgcagtacatcgctaagcatgacctgtatagccgtaggaatggtaacactatacctcggagttatggtacaagcagatagtggttgcgtaataaattggaaaggaagggaattgaagtgtggcagtgggatttttgtaaccaatgaagttcacacatggactgaacagtacaaatttcaggccgacagtccaaaaagactttcagcagcaatcgggaaagcctgggaggaaggtgtgtgcggtattaggagtgcaacacgcttggaaaacataatgtggaaacaaataagcaacgagctaaatcacattttgctagaaaatgatatgaaatttacagtagtggttggcgatgcaaatggaatacttgcacagggcaagaaaatgatacgcccacaacccatggagcacaaatattcttggaagtcttggggaaaggctaaaataataggcgccgatatccaaaatacaacattcataatagatggacctgatactccagaatgcccggacaaccagcgggcatggaacatttgggaagtagaagactatgggtttggtatattcaccactaatatatggcttaaattacgtgattcctatacacaaatgtgcgatcatagactaatgtcagccgcaattaaagattctaaagcagtccacgcagatatgggttattggatagaatctgagaaaaatgaaacgtggaaattggcacgtgcgtcttttatagaagttaagacatgtacgtggccaaaatcacatacgctttggagcaatggagtactcgagagtgaaatgattatcccaaaaatatatggaggaccaatttcgcaacacaactacagaccaggatatttcactcagaccgctgggccatggcatttgggcaaactggaactagattttgacctctgtgaaggaactacggtagtcgtggatgaacactgtggtaatagaggtcctagtctccgtacaactacagtgaccggaaaaataatacatgagtggtgctgtaggagttgtactttgcctcccctaagattccgtggtgaagatggttgctggtacggaatggagattagacctgttaaagagaaagaagagaacctggtcaggagcatggtgtcagctgggtcgggcgaagttgatagtttttctttgggtatcttgtgtgccagtataatgatagaagaggttatgagaagtcgatggagcagaaagatgttaatgacaggaacactcgcagtatttctactactcatcatgggacaactaacatggaatgatcttataagattgtgtataatggttggagcaaatgcatcagacagaatgggaatgggtaccacctacctagcattaatggcgactttcaaaatgcgacctatgttcgcggtcggcctcctatttcgacgattaacgagccgagaagttctgctattaaccattggacttagtcttgtagcatcggtcgaattaccgaatagtttagaagaattaggcgatggactagcaatgggcataatgatgctgaaactattaaccgaatttcaaccacatcaactgtggaccactctactgtcattaaccttcatcaaaacaacattaagtttagactacgcatggaaaacaaccgccatggctttaagtatcgttagtcttttcccattatgcctaagtacgacttcgcagaaaactacctggttaccggtgctactaggttcatttggatgtaaaccgctgacaatgttcctaattaccgaaaataaaatttggggccgtaaatcatggcccttgaatgaagggataatggcaatcgggatagtatcaatacttttatcaagtcttctaaagaacgatgttccattagctggacctcttatagcaggcgggatgcttatagcctgttatgttatttccgggagtagtgctgatctttcgttagaaaaagcggctgaagtttcatgggaacaagaggcagaacatagcggtacctcgcacaatattctggtagaagtacaagatgacgggacaatgaagattaaagatgaagaaagagatgatactttaacaattttgttaaaagcaacattgcttgcagtaagtggagtgtacccaatgtcaataccggctacactatttgtctggtacttctggcagaagaagaaacagagaagcggcgttctatgggatacaccatcgcccccagaggtagaaagggctgtgcttgacgatggaatatatcgcatcctccaacgcggtttactagggcgtagtcaggtgggcgtaggtgtcttccaggacggggtttttcatacaatgtggcatgtaactagaggagctgttctgatgtatcaaggaaaacgactggagccaagttgggcaagtgtcaagaaagatctaatatcctatggaggaggatggaggttccaaggaagttggaacacaggcgaagaagttcaagtcatagctgtagagccagggaaaaacccgaaaaatgttcaaacgaccccaggtacattcaaaactcccgaaggtgaagtaggtgcgattgctctagattttaaaccagggacgagcggatcccctatagtaaacagggaaggaaaaatcgtaggattgtatggtaatggcgtagtaactacatcagggacgtacgtaagcgctattgcccaggctaaagcaagccaagaaggaccattaccagaaattgaggacgaggtgttcaagaaaagaaatctcacaataatggacctacatccggggtcgggtaaaactagacgctatttacctgctattgtacgcgaagccataaagagaaagctgagaacactaattctcgcgccaacacgagtggtagccagtgaaatggcagaagccctcaaagggatgcctatacgatatcaaacaacagcggtaaaatcagagcacacaggacgcgaaatagtagacttgatgtgtcacgcaacatttactatgaggttacttagcccagtacgcgttccaaattataacatgattatcatggatgaggctcactttacagaccctgcatctatagcagcgcgtgggtatatcagtacacgagtgggaatgggtgaggccgcggcaatttttatgactgcaaccccaccgggaagcgtcgaggctttcccccaatcgaacgccgtaatacaagatgaagaacgggatatccctgaaagatcttggaactcgggttatgattggattactgatttcccaggtaagacagtttggttcgttccttcaataaaaagcggaaacgatattgcaaattgccttaggaaaaatggtaagagagtaattcaattatcaaggaaaacctttgacactgagtatcagaaaacgaagaataatgattgggattatgtcgtaactactgacatttcggaaatgggtgcaaacttccgagctgatagagtcatagatccacgacgatgcttgaagccagttatactaaaagacggacctgaacgcgtgatcttagccggaccaatgcctgtgactgtcgcttcagctgcgcaaagaaggggacgaattggacggaaccagaataaagaaggggatcaatacgtgtacatgggtcaaccgctaaacaatgacgaggatcacgcccactggacggaagcaaaaatgttacttgacaacattaacactccagaagggataatacctgctttatttgagccggaacgcgagaaatccgcggcaatcgatggagagtatcggttgagaggagaagcgagaaaaacattcgtagagttaatgaggagaggagatctacccgtatggttatcatacaaagttgcgtcagaaggattccagtattctgaccgccgatggtgcttcgatggtgaacgtaacaatcaagtactagaagaaaacatggatgtcgaaatatggacaaaggaaggagaaaggaagaaattgagaccaagatggctagacgctcgcacatactcggatccattagcacttcgagaatttaaagaatttgctgcaggaagaagaagcgtatcaggtgatctgatcttagagataggcaagttaccacagcatttaacgttacgagcacagaatgctttggataatctagtaatgctgcacaacagtgagcaaggtggcaaggcttacagacatgctatggaagagttgccagacactatagaaactctgatgctgttagcgctaatcgcggttctgacaggaggagtcactttattctttttaagtggcaaaggactaggtaaaacatctattggcttattgtgtgtgacggcgtcaagtgcgcttctatggatggcaagtgtagagccacattggatagcggcaagcattattctcgagttcttcttaatggtattattaataccagaaccagataggcaaagaacaccgcaagataatcaattggcatatgtagtaatcgggcttctcttcatgatcttaacggtagcagcaaatgaaatggggttgcttgagacaaccaagaaagatttaggcataggtcatgtagccgcagagaatcaccagcacgtaactatgcttgatgtagatcttagaccagcaagtgcatggacgctttatgcggtcgcgactacagtaataacacctatgatgcgacacaccattgaaaatacaactgcgaatatttctttaacagcaatagctaatcaagccgcaattctaatgggtttggacaagggttggccgatttcgaaaatggacattggtgttccactactagctctagggtgttactcccaagtaaatcctttaacgttaacggccgctgtattaatgttagtcgctcattatgcaataatcggtcccggattacaagcgaaggcgacgcgagaagctcagaagcgaaccgcagcaggaataatgaaaaacccaacggtagacgggatcgtagcaattgatttagatcctgtggtgtacgacgcaaaatttgaaaagcaactcggacagataatgttgttaatactctgtacctcacaaatcttattaatgaggacgacatgggctttatgtgaaagtattacccttgcaaccggcccactcacaactctatgggaaggcagcccaggaaagttttggaatactacaatcgccgtatctatggccaatatattcagaggatcatatttggcaggcgcaggtttagctttcagcttaatgaaaagtttaggcggaggccgtaggggcactggcgcacaaggagagacgctaggcgaaaaatggaaacggcaattgaatcaattaagcaaaagtgaatttaatacatacaaacgaagtggaatcatggaagtagatcggtcggaggctaaagaaggccttaaaagaggtgaaacgacaaagcatgccgtgtcaagaggaactgcaaagttaaggtggttcgttgaacgtaatttagtcaaaccggaggggaaagttattgacttgggttgtgggaggggaggttggagttattactgtgcaggtctaaagaaagtaactgaggttaaaggttacacaaaaggcggtccaggacatgaagaaccaataccgatggcaacatacggctggaatctagttaaactacattccggaaaagatgtatttttcatgcctccagaaaaatgtgatacgctgctttgcgatataggtgagtcgagccccaacccgacaatagaagaaggacggactcttcgagttttaaaaatggtggaaccctggctccgtggtaatcaattttgtataaagattttaaatccctatatgcctagtgtagtggaaacattagagcaaatgcaacgtaaacatggtggaatgttggtaagaaacccattatcccgcaattcaacccacgaaatgtattgggtctcttgcgggacaggtaacatagttagcgctgttaatatgaccagtcgtatgttacttaaccgttttacaatggctcatagaaagcctacgtatgaacgagatgttgatctaggggctggaacacgtcacgtggcagtagaaccagaggtagcaaatttggatataattggccagcgcatagaaaacatcaaaaatgaacacaaatccacatggcattatgacgaagacaatccttataaaacgtgggcgtaccacggaagttatgaagtaaaacccagtgggtcggccagttcaatggtgaatggcgttgttcggctactaactaaaccatgggacgtaattcccatggttacacagatcgctatgacagacactacaccattcggccaacaaagggtttttaaagaaaaagttgatactagaacacctagggctaaaagagggacaacccaaattatggaagtaacagcgaaatggttatggggattcctatcgaggaacaagaaacctcggatatgcaccagagaagagtttactcgaaaagtccgctccaatgccgcaataggagccgtctttatcgatgaaaatcagtggaatagcgctaaagaagccgtagaagatgaacgattttgggacttagttcatagagaaagagagttacataaacagggcaaatgtgcaacatgtgtttataacatgatgggaaaaagagaaaagaagttgggcgagtttgggaaagcaaaagggagtcgcgcaatttggtatatgtggctgggggcacgatttttggagttcgaggcattgggctttatgaacgaggatcattggtttagtagagaaaactccttatcaggtgtggagggagaaggactccacaaattgggatatatacttcgagacatctcaaagattcccggtggaaacatgtacgccgatgatacagccggatgggacacaagagtaacagaggatgaccttcaaaacgaagctaaaataacggatatcatggaaccagaacatgcactactggcgacatccatatttaaactaacataccagaataaagtagtacgtgtccagcgacctgcaaagaacggaacggtaatggatgtgatatcccggagagatcagagagggtcgggacaagtaggcacgtacgggctgaatacattcaccaatatggaagtacaactcatacgtcaaatggaatccgaagggatattcctaccatcggaactagaaacaccgaacctggcagagagagttttagattggttagagaaacacggagcagagcgcctacgtcggatggcaataagtggagatgattgcgtggtaaaaccaattgacgacaggtttgccaccgcactgacagcactgaacgacatgggaaaagtacgaaaagatattccccagtgggaaccatctaaaggatggaatgactggcagcaagtgcctttttgtagtcaccatttccatcagttaataatgaaggacggcagagagatcgttgttccatgtagaaaccaagatgaattggtcggacgtgctagggttagtcaaggagctggatggagtctaagagaaaccgcctgtttgggtaagtcatacgcacagatgtggcaattaatgtacttccaccgaagagacctgcggctcgcggcaaatgcaatttgtagtgcagtgccagtggactgggttccaacatcacgtaccacttggtcgattcatgcccaccatcaatggatgactaccgaggacatgttaagcgtatggaatagagtttggatagaagaaaatccttggatggaggataaaactcacgttagtagttgggaagaagtcccatatcttggaaagagagaggaccaatggtgtggtagtctcatcgggctaacagcgagagccacgtgggccacaaacatacaagtggctataaatcaagttagaagattgatcggtaacgagaattacttggattacatgacatcgatgaaaagattcaaaaacgagtctgatccagaaggggcactgtggtga

SEQ ID NO: 21327 - RNA, 9879 nt, synthetic construct
  misc_feature 1..9879: note = derived and/or modified CDS sequence (opt6) from DENV-1__FJ024480__SS-prME
  source 1..9879: mol_type = other RNA
tcagtaaccatgctcctcatgcttctgccaacggctttagcattccatttgaccactcgtggtggtgaaccgcatatgatagtttcaaaacaggaaagagggaaaagcctgttattcaaaaccagtgccggagtaaatatgtgtactcttatagcaatggatttaggggaactatgtgaagatactatgacgtataaatgcccacaaataacagaagcagaaccagatgatgttgattgctggtgcaatgcaacggacacctgggttacttatggaacatgttcacaaacaggagaacatagaagagataaaagatcagttgcactcgccccacatgtcggactaggattagaaacgagaacagaaacatggatgtctagtgaaggtgcatggaaacagattcagagagtagaaacatgggcattacgacatcctgggtttacagtcatagcgttattcctagcacacgctataggaacttcgatcacgcaaaaaggaataatcttcatattgctaatgcttgtaactccctctatggcgatgcgatgcgtcggaattggtaatcgagactttgtagaaggactttccggagcgacatgggtcgatgtagtgctagaacacggttcatgtgtcacgacaatggctaaaaataaaccaacgttagatatagaattattaaaaactgaagtaaccaatccagcaattttgagaaaattatgcatcgaagccaaaatatcaaatactacaaccgattcacgttgtcccacccagggtgaagcaaccctagtagaggaacaggacgcaaatttcgtgtgccgtagaactttcgtagacagaggatgggggaatgggtgtggcttattcggaaaaggatcactactcacatgcgcaaaattcaaatgtgtcaccaaacttgagggaaaaatcgtccaatatgaaaatctcaaatattctgtaattgtaaccgtgcacacaggagatcagcaccaagtaggcaatgaaactacagaacatggcacaatagcgacgattacaccacaagctcccacttcggagatacaactaacggattatggagcgctgactctagattgtagtcctcgtacaggactagattttaatgaaatggttctcttaacgatgaaagagaaaagttggttagtacataaacagtggtttttagatctcccattaccatggacaagcggcgcgtcgacgtctcaggaaacttggaatcgacaagatcttcttgtaacctttaaaacggctcacgctaagaaacaggaagttgtcgttttaggctcgcaagaaggagcgatgcatacggcgctaacaggcgcaacggaaatacaaacaagtggtactactacaatatttgctggtcacttaaaatgcagactaaaaatggacaaattaactcttaaaggtactagctacgtgatgtgtactggatccttcaaactcgaaaaagaggttgcagaaacacaacatggtacggttttggttcaagtgaagtacgagggtaccgacgcaccttgtaaaattccttttagcactcaggatgaaaaaggtgttactcagaatggaaggcttataacagccaatccaatagtaactgataaagaaaaacccgtcaatatagaaacagaacctccttttggggaatcttatattgttgtcggagcaggagaaaaagcacttaaactcagttggtttaagaaaggaagctcgataggtaaaatgttcgaagcaacagctcgcggagctcgaagaatggctatactgggcgacactgcttgggatttcgggtctataggtggggtatttacatcagttggtaagctagtccatcaagtatttggaacagcctacggagtattgtttagtggggttagttggactatgaaaattggtatcggaatattattaacatggctaggccttaactctagaagtacaagtctttccatgacatgtatagcagtggggatggtgaccctatatttgggcgtcatggtccaagcggattcaggatgtgtaattaattggaaaggccgagaacttaagtgtggctctggtatttttgtaacgaatgaagttcacacctggacggaacagtataaattccaggcagattcaccaaaaagattaagtgccgctattggcaaagcatgggaggaaggtgtttgcggcattcggagcgcaacaagacttgaaaatataatgtggaaacaaataagtaacgaattaaatcatatcctattagagaatgatatgaagttcacggttgtggttggagatgccaatgggatccttgcacaaggtaagaaaatgataagaccgcaaccaatggaacataaatattcctggaaaagctggggtaaagccaaaataattggggctgacatacagaatactacctttatcatagatggaccggacactccggaatgtcctgacaatcaacgagcatggaatatatgggaggtagaagactacggatttggcatatttacgacaaatatatggttaaaattgagggacagttatacccaaatgtgtgatcataggctaatgagcgccgcaatcaaagatagtaaagctgttcatgctgacatgggttattggatagagtcagagaagaatgagacctggaagttagccagggcttcattcatagaggtgaagacttgtacgtggcctaaatcacacacactttggagcaatggagttctagaatccgaaatgatcataccgaaaatttatggtggaccgatatcacagcataactaccgaccagggtattttacccaaacagcgggaccctggcacttagggaaattggaactagactttgacttatgtgaaggtacaacagtagtagtggatgaacactgcggcaatagaggtccatctctgcggacaaccacagttacaggaaaaataatccatgaatggtgttgtagaagttgtactttaccaccattgcgatttagaggagaggatggttgttggtacggtatggagatccgacctgtaaaagagaaagaagaaaatttggtccgtagcatggtaagtgcaggcagcggagaggtggatagcttcagcctgggtattttgtgcgcatcaataatgatagaggaagtcatgcgaagtcgctggtcgcgcaaaatgttaatgactggaacacttgcagtctttttattactaattatgggtcaacttacatggaatgatctcatacgattatgtataatggtaggggcgaacgctagcgacaggatggggatggggacaacttatttagcactcatggcaacatttaagatgaggcccatgtttgcagtaggcttacttttccgacgattaacatccagagaagtactattactaacaattgggctgagcctaatggcgtcggtcgaactacctaatagtctagaagaactaggcgatggccttgcaatgggcatcatgatgcttaaactcctcacagagtttcagccacaccaactttggacaacactcctatctttaacgttcatcaaaaccacactaagtctggattatgcatggaagaccactgcaatggccctatctatagtttcattgtttcccctgtgcctcagcacaacaagtcagaaaactacttggctaccagtattactcggttcctttgggtgcaaaccattaacaatgttccttattacagaaaacaaaatatggggtagaaaatcatggcccctaaatgaagggattatggctattggaatcgtctctattttattaagcagcttgttgaagaatgatgtccctttagcaggaccattaattgccggtggtatgctcatagcatgctacgttatatcaggaagttctgctgacttaagcctagagaaagcagccgaagtaagttgggaacaagaagcggaacatagcggaacttctcataacatactggttgaagtacaagatgacggtactatgaagataaaagatgaagagagagacgacacattaacgatactcctgaaagcgacactgctggcggttagcggagtttatcctatgagcattcctgctactctatttgtgtggtatttttggcagaagaagaaacaaaggagtggagtcttatgggatacaccatcacctcctgaagtagaacgagccgtactggacgatggtatatataggattctgcaaagaggtcttttaggacgttcacaagtcggggtaggagtatttcaagatggagtattccataccatgtggcacgtgacgcgaggagcagtacttatgtaccaaggcaaaagactagagccttcctgggcaagcgttaagaaagatcttatatcttacggtggtggatggagatttcagggttcgtggaacaccggagaagaagttcaagtgatcgccgtagaacctggcaaaaatcccaaaaatgtacagacaacacctggaacattcaagacccctgagggggaagtaggagcgatagcattggattttaaacctggaacatctggaagtcccatcgtgaacagagaaggaaaaattgtcggcttatatggaaatggggtcgtgacaactagcggtacgtacgtaagtgctattgcacaagccaaagcatcgcaagaaggcccattaccagagatagaagatgaggtatttaagaaaagaaacttgactataatggatttacatccaggctcgggaaaaacaagaagatatttacccgcgatcgtcagggaagcaataaaacgcaaactcagaactttaatattggctccaacgagagtcgtagcatctgaaatggcagaagctctaaaaggcatgccaatacgttatcaaacaactgccgtaaaatccgaacacacaggcagagagatagtggatttaatgtgccatgcaacctttacaatgagacttttatctccggtaagagtccccaactataacatgataataatggatgaggcccactttacagatccagcatcgatcgcagcccgtggatacatatcaacgagagtcggaatgggcgaagccgccgcaattttcatgacagcaactcccccaggatccgttgaggcttttccccaatctaacgcagtgatacaagatgaagaaagggatattcctgaacgatcatggaatagtggatatgactggatcacagattttcccggtaagacagtctggttcgtccccagtatcaaatcaggaaatgacatcgcaaactgtcttaggaaaaatggtaaaagagtgatacaattatctagaaaaacgttcgacactgaatatcagaaaactaagaataatgactgggattatgtggtcacgacagatatatccgagatgggggcaaacttcagagcagatcgagtgatagacccacgtagatgcctcaaacctgtaatactaaaggatggcccggaacgtgtcatacttgcaggacctatgcccgtaaccgtagcttcagccgcacaacggcgtggtcgtataggaagaaatcagaataaagaaggtgatcaatacgtatatatgggtcaacccttaaataacgatgaggatcatgcgcattggacggaagcaaaaatgctactcgataatatcaatacaccagaagggataatccccgcgctattcgaaccagaaagagaaaagtccgcagcgatcgatggagagtacaggttacgtggtgaggccagaaagacttttgtagagctcatgaggaggggagacctaccagtatggctaagctataaagtcgcgtcagaaggttttcagtacagcgatagacgatggtgctttgatggcgagagaaataaccaagtgttagaagaaaacatggatgttgaaatatggacaaaagagggagaaaggaagaaactacgaccacgatggctagacgcaagaacttatagtgatccattagcactacgagaatttaaggaatttgcagctggtcgacgaagtgtatctggagacttaatcttggaaattggcaaattaccccaacacttgaccttaagggcacaaaatgcgctggacaatctagtgatgcttcataacagtgaacagggtggaaaggcatacagacatgctatggaagaactaccggacaccatagagacattgatgctcctcgccctgattgctgtactcaccgggggtgtaactctatttttcctgtcgggaaaagggctcggtaagacgtcaattggcctgttgtgcgtaacggcttcttcggcgctattatggatggcttctgtggaaccacactggatagcagcgagcataatacttgaatttttcctgatggttcttcttatcccggagcccgataggcagagaacaccccaagataatcaactggcatatgtagtaatcggtttactttttatgattttgacagttgcagctaatgaaatggggttattagagacaacgaagaaagacttgggtataggccatgttgccgcggaaaaccaccaacatgccacaatgctggatgtagatttaagacccgcatctgcgtggacactctatgcagtggcgacaactgttattactcctatgatgaggcacactatagaaaatacgactgcaaatatatctctcactgccatcgcaaatcaagctgctatacttatgggcttagataaaggatggccaatatccaagatggatataggcgtaccgctgctagccctaggctgttatagtcaggttaatccattgacactaactgctgcagtgctaatgctggtcgcgcattatgcaataatcggacctggactccaagcaaaggctactagagaagcacagaaaagaacggcagcaggtatcatgaaaaatcctacagtagacggcatagtagcgatagacctcgatccagtggtctatgacgctaagtttgaaaaacaactgggacaaataatgctactaatattatgcacaagtcaaattctattaatgcgcacaacatgggcattatgtgaaagcataacgcttgctacaggacctctcacaaccctatgggaaggtagtcctggcaaattctggaacacaacgatagcagtaagtatggcaaatatattcagaggatcctacttggctggtgccggtctagcttttagcttaatgaagagtctcggtggaggcagacgagggacaggagcccaaggtgaaacactaggagagaaatggaaacgacaacttaaccaattaagcaaaagcgaatttaacacctacaaaaggagtgggataatggaagttgatcggtctgaggctaaagaaggtttaaaacgaggagaaactactaagcacgcggtgtcccgtggaactgccaagttgaggtggttcgttgaaagaaatcttgttaaacccgagggcaaggtcatagacctaggttgcgggaggggtggatggtcgtattattgtgcaggattgaagaaagtaaccgaagtaaaaggatacactaaaggcggtccgggccatgaggagccgataccgatggccacctatggctggaatttagtaaaactacacagtggcaaagacgtatttttcatgccacctgaaaaatgtgatacattattatgtgatataggtgaaagctctccaaatccaacgattgaagaaggtcgtacactacgtgtattgaaaatggtggaaccgtggcttcgcggaaatcagttttgtataaaaattctaaacccctatatgccttcagtcgtcgaaacattggaacaaatgcagagaaagcatgggggtatgctcgtcagaaatcccttgagcagaaatagtactcatgaaatgtattgggtatcctgtggtactggcaatatagtatctgccgtgaatatgacctcgcgaatgttattaaacaggttcacaatggctcataggaaaccaacttacgaacgagatgtggatctaggagcgggaaccaggcatgtagcagtagaacccgaagtggctaatttggatattattggacagaggatagaaaacatcaaaaatgaacataaaagtacttggcattatgacgaagataacccttacaaaacatgggcataccatggtagttatgaagttaaacccagtggaagtgcatcgagcatggtcaatggagtagtgaagttactgaccaagccctgggacgtaataccaatggtgacgcagattgcaatgacagacactacaccattcggtcaacaaagagtatttaaggaaaaggtagacactcgtacaccgcgtgcaaaacgcggtactacacaaatcatggaagttacagcaaaatggctctggggattcctttcaagaaataagaaacctcgaatatgcactagagaggagttcacgaggaaagtacgatcaaatgcagctatcggtgctgtttttgtagatgaaaatcaatggaactctgcgaaagaagccgtagaagatgaaaggttctgggatctagtacatagggaacgagaacttcacaaacaaggaaaatgtgcaacgtgtgtctataatatgatgggcaaacgtgagaagaaactaggtgaatttggtaaagcaaaaggaagcagagccatctggtacatgtggctaggcgccagattcctagaatttgaggccttaggatttatgaacgaagaccattggttcagtcgtgaaaactctctatcaggggtagaaggggaagggttacataaattaggatacatcttgcgggacatatctaaaattccgggaggaaatatgtacgcagacgacacggccggatgggatactcggataacggaagatgacctgcaaaatgaagctaaaataaccgacatcatggaaccggagcatgcactcttagctacaagtatcttcaaattaacgtatcaaaataaggtggtacgagttcagcggccggcaaagaacggtaccgtgatggacgtcataagccgtagagaccaacgaggaagtggccaagtaggaacatatgggctaaacacattcacgaacatggaggttcaattaattcgtcagatggagtcagaaggaatattccttccatccgagttggaaactccaaacctagctgaaagagtactagattggttggaaaaacacggggctgaacgattaaaacggatggcgatatcaggcgatgattgtgtcgtaaagccaattgacgatcgattcgccacagcattaacggctttaaatgatatgggtaaagtaaggaaggatattccccaatgggaaccatctaagggttggaacgattggcaacaagtgccgttctgttcacaccattttcaccaactaataatgaaagatggaagggagatcgtagtgccatgtagaaatcaggatgaactggttggacgtgcccgagtctcacagggagcaggttggtcattacgagaaactgcatgtctgggcaaaagttatgcgcaaatgtggcaattgatgtatttccatagacgtgatttacgactagcggcaaacgctatttgctccgctgttcctgtcgattgggtaccaacaagtcgtacaacatggtcgattcatgcccaccatcaatggatgactacagaagacatgttatctgtttggaatagagtgtggattgaagagaacccatggatggaggataagactcatgtcagctcgtgggaggaagttccatatttaggtaaaagagaagatcaatggtgtggatccttaattggcctgacagcaagagcaacatgggctacaaatatacaagtggccatcaatcaagtgcgtagactcataggaaacgagaactacctagattacatgacgtcaatgaaaaggttcaaaaatgaatctgatccagagggggctctatggtag

SEQ ID NO: 21328 - RNA, 9879 nt, synthetic construct
  misc_feature 1..9879: note = derived and/or modified CDS sequence (opt6) from DENV-1__FJ873814__SS-prME
  source 1..9879: mol_type = other RNA
tcagtgactatgctgttaatgttactgccgacagcattggcatttcacttaacaacaagagggggagaaccacacatgatagtgagtaaacaagaaagaggaaagagcttactgttcaaaacaagcgccggtgtaaacatgtgtacacttatagccatggacttaggagaactatgtgaagacacaatgacgtataaatgtccacaaataacagaagctgaaccagatgacgtggactgttggtgtaacgcaacggatacttgggtaacatacgggacctgcagccaaactggagaacatcgaagagacaaacgttcagttgctctcgcaccacacgttggattaggtttggaaactcgtactgaaacatggatgagctcagaaggagcctggaaacaaatacaaagagtagaaacatgggcactaagacatccagggtttacagtggtagccttcttcttagcacacgccataggaacgagtataacacaaaaaggaataatctttatcctcttaatgttagtaactccttcaatggccatgcgatgtgtcggaattggaaaccgcgatttcgtagaaggtttatcgggagctacttgggtagacgtcgtacttgaacacggaagctgtgtgactacaatggcgaaaaacaaacctactctagatatagaactattaaaaacagaagttactaatcccgcaatactaaggaaactatgcatagaagcaaaaatatcgaacacaacaactgactctcgttgtcctactcaaggggaagcaacactggtcgaagaacaagatgcaaacttcgtatgtcggcggactttcgtagatagaggttggggaaacggatgtggtctgtttggcaaaggcagcttactcacctgtgcaaaatttaaatgtgtcaccaaattagaaggcaaaatcgtacaatacgaaaacctaaaatattctgtaatagttactgtacacacgggcgaccaacatcaagtagggaacgaaacgacagaacatgggactatagctataattaccccacaagcgccaacatcggaaatacaactcaccgactacggggctctaacgctagattgctccccgagaacaggactagactttaacgaaatggttctactaactatgaaagagaaatcctggctggttcataaacagtggtttttagatttaccattaccttggacatcaggagcttcgactagccaagagacctggaatagacaagatttgttagtaacattcaaaacagcacatgcaaagaaacaggaggtagtcgtccttgggtcacaagaaggggccatgcacactgctttaacaggagccaccgaaattcagacaagtgggacgaccactatcttcgccggacacttaaaatgccgattgaaaatggataaactgactctgaaaggcacatcctacgttatgtgtacaggcagttttaaacttgagaaagaagtagccgaaactcaacatgggactgtcttagtgcaagtgaaatatgaaggtaccgatgcaccctgcaaaatcccattcagcacacaagatgagaaaggtgtaacacagaacggcagattaataacagcaaaccctatagtaaccgataaggagaagcccgtaaatattgaaacagaacccccgttcggagagtcgtatatagttattggtgccggagaaaaagctctcaaactatcgtggttcaagaaaggatcctctattgggaagatgttcgaagctacagcgagaggcgcgcgtagaatggcgattttgggagataccgcatgggattttgggagtatcggtggagtgtttacatccgttggaaaattagttcatcaagtttttggtacagcatatggagtgttattttctggcgtgtcctggacaatgaaaataggaatcggaattttactcacatggttgggccttaatagtaggtcaacttctttgagtatgacttgcattgcagttggaatggttactttgtacctcggtgttatggtacaagcagattcaggttgtgtaataaactggaaagggagggagctaaagtgtggcagtggcatatttgttactaacgaagtacacacgtggaccgaacaatataaattccaagcagattctcccaagcggttgtccgcagccataggtaaagcgtgggaagaaggagtttgtggcattagatcagcaacacgtttagaaaatataatgtggaaacaaatatccaacgaactaaatcacattctactggagaacgacatgaaattcacagtcgtagtgggggatgctaatgggatattggcacaaggcaagaaaatgataaggccacagccgatggagcacaaatactcctggaaatcttgggggaaggcaaagattatcggggcagatatacaaaacacgacttttatcatagacggacctgatacaccagaatgtccagatgatcaacgcgcttggaatatatgggaagtggaagactatggatttggtatatttacaaccaatatttggctaaaattgcgcgatagttatacacagatgtgtgaccacaggcttatgagcgcagcgataaaagactcaaaggccgtccatgccgatatgggatattggatcgaatcggaaaagaacgaaacgtggaagctagcgcgcgcctcattcatagaggttaagacgtgcacttggcctaaatctcatacattatggtcaaatggagtattggaatccgaaatgataattccaaaaatttatggtggaccaatctcgcaacacaattataggccgggatatttcacacaaacagctgggccgtggcacctaggaaaactagagctggattttgacctctgtgaaggcacaacagtagtagtcgatgaacattgtggaaatagaggacctagtctaagaaccactacagttacaggcaaaattatccatgaatggtgctgtcgatcttgtacgttgcctccgttacgattcagaggtgaagacggatgctggtatgggatggagataagacctgtaaaagaaaaagaggaaaatttagtaagatcaatggtatcagcagggtcaggtgaagtcgatagttttagcttgggcattctgtgcgcctccataatgatagaggaagtaatgagatcacgctggagccgtaagatgcttatgacaggaacgttagcagtgttcttgctgcttatcatgggccaacttacatggaatgatctaatccgtctctgcataatggttggcgctaatgctagtgatagaatgggaatggggactacgtaccttgcgcttatggctacttttaagatgagaccaatgtttgcagttggcttattattcaggagacttaccagcagagaagtattgctattaacaattggccttagtctagtcgcatcagtggagctaccaaatagtctggaagaactcggagacgggctagcaatgggtatcatgatgcttaaactactaactgagttccaacctcaccaattatggacgaccttgttaagcctaacttttataaagacaactttaagcctcgactatgcttggaaaaccaccgcaatggcactcagcattgtttcattattccctttatgtctatctacaacatcacaaaagacaacatggttgcccgtcttactaggcagtttcggatgcaagccattaacaatgtttctgatcacagaaaataaaatatggggacgcaaaagctggccacttaacgaaggaataatggcaataggtatagtttcaatcttattgagcagtttactgaaaaacgacgttccactcgctggcccattaattgcgggaggaatgctcatcgcatgttatgttatatccggctcaagtgccgatctatccctcgaaaaagccgctgaagtttcttgggaacaagaggctgaacactcaggaacatcacataatatacttgtcgaagtgcaagacgatggaacgatgaaaattaaggatgaagagaaagacgatacattaacaatacttctaaaagccacgcttttagcagtatcaggtgtgtacccaatgagcatacctgccacgttatttgtatggtatttttggcagaagaagaaacagcgtagtggcgtcttgtgggacaccccatccccaccagaagtagagcgtgctgtattggatgacggaatataccgaattttgcagagaggtttattaggaagaagtcaagtaggagttggggtctttcaagatggagtattccacactatgtggcatgtaactagaggggctgttttaatgtaccaaggaaagagattggagcctagttgggcgagtgtcaagaaagacttaatatcatacggaggtggctggcgtttccaaggctcctggaacacaggcgaggaggtacaggttatcgctgttgagccagggaagaatccgaagaacgtacagacaacaccaggtacatttaagacgccagaaggtgaagtgggagctattgcgcttgattttaaacctgggaccagtggtagtcccatcgtcaatagagaaggcaagatcgtaggcttatatggaaatggggtagtaacaacgagtggcacctatgtttcagcaatcgcacaagctaaagctagtcaggaaggacctctacctgaaatagaggatgaagtatttaagaaacgaaaccttaccattatggatttgcatcctggaagcggaaaaactagacgatacttacccgcaatagtaagagaggcaataaaaaggaagctgagaaccctaattctagccccgaccagagtcgtagcgtctgaaatggctgaggccttgaaaggtatgccaattcgatatcaaacaactgcggtaaaaagtgaacacactggtcgggagattgttgatctcatgtgccacgcaactttcacaatgcggctgttatcacccgtaagagtacctaactacaatatgataataatggatgaggcccactttacggatccggcatccatagcggcaaggggatacattagcacccgagtgggcatgggagaggcagcggctatcttcatgacagcaacacctccaggctctgtagaagcgtttccccaatcaaacgcagtaattcaagatgaagaacgggatattcctgaaagaagctggaacagtggctatgactggatcacggactttcccggcaagacggtttggtttgttccgtcgataaaatcaggaaacgacattgcaaattgtttacgtaagaacggaaagcgcgttatacaactaagcaggaaaacatttgataccgaataccagaaaaccaaaaataacgattgggactacgttgttactactgatatatctgagatgggggcaaattttagagcagacagagtaatcgatccaaggagatgtctaaaacctgtgattcttaaggatggaccagaacgagtgatcttagcaggaccaatgccagtaacagtagctagtgcagctcaacggagaggccggataggaagaaaccaaaacaaagaaggagatcagtatgtttacatgggtcaaccattaaataacgatgaagatcacgcacactggacagaagcaaaaatgttattagataacattaacactccagagggtataattcctgcattgtttgaaccggaacgtgaaaagtctgcggcgattgatggtgaatatcgcttgagaggggaggcacgcaaaacatttgtagaattgatgaggcgaggcgatcttccagtatggctatcatacaaggttgcatctgaaggatttcagtattctgaccgtcgatggtgctttgacggggaacgaaacaaccaagtattagaagagaacatggacgttgaaatttggaccaaagagggagaaagaaagaaattacgacctcggtggcttgatgcgcgaacgtattcagatcctctagcgctccgagaatttaaagaatttgctgcaggtagaagatcagtgagcggagacttaatactagagattggtaagttaccacaacatctaacattgagggcacaaaacgcacttgacaatcttgtcatgcttcacaatagtgagcaaggtggtaaagcgtatagacatgcaatggaggagctccccgacacaattgagacattgatgctcttagcattaattgccgttcttactggtggagtaactttattctttctaagcggaaaaggattagggaaaacatctattggcttactatgcgtaacagctagtagcgctttgctttggatggctagcgtggaacctcattggatcgcagcttctattattctagagttctttctaatggtattattaattccggagcccgatcgacaaagaaccccacaagacaaccaattagcttacgtggtgataggactcctattcatgatactaacagtagctgcaaatgaaatgggattattagagactactaaaaaggatctaggaataggtcatgtagcagcagagaaccatcaacatgcgactatgttagatgtcgaccttcgtccggcatctgcgtggacgttatacgctgttgctacaactgtcattactcccatgatgagacacactatcgagaataccaccgccaacattagcctaacggcaatcgcaaatcaggcagccattttaatgggattagataagggctggccgatttcgaagatggacataggagtacctttattagctttaggatgttacagtcaggtaaatcccctaaccttaactgcagctgtactaatgttggtggcacactatgcgataattggcccaggtttacaagcgaaagcaactcgagaagcgcagaaacgcacggcggctgggataatgaaaaacccgaccgtcgacggtatcgtagccatagatcttgatccagttgtctacgatgctaagtttgagaaacagttaggacaaatcatgttactaattctctgtacttctcagatcttactaatgcgtacaacctgggctttatgcgaatccattactcttgcgactgggccccttaccacgctatgggaaggctctccgggtaaattctggaatacgactatagcggtgtcaatggccaacatctttagaggaagctatttggctggtgccggattagcatttagtctcatgaagtcacttggcggaggtagaagaggaacgggcgcccaaggcgaaaccctaggggaaaagtggaagcgacaattaaaccaactttcaaaatccgaatttaacacttacaaacgcagtggcattatggaagtagatcgtagtgaagcaaaagaaggcttgaagcggggagagacgactaagcatgcagtcagccggggaacagcaaaattaagatggttcgtagaacgaaatttagtaaagccagaaggaaaggtaatcgatttaggatgcggaaggggagggtggtcttattattgtgctggattaaagaaagtaacagaagtaaaaggatatacaaaaggaggaccaggtcacgaagaatctattccaatggctacatacgcatggaatctcgtaaaattacattcaggcaaagatgtcttctttatgccacctgaaaaatgtgatactttactatgtgatattggggagtcatctccaaacccaaccattgaggaaggacgaaccctaagggtattaaaaatggtcgaaccatggttaagaggtaaccaattttgtatcaaaattttaaacccatacatgccctcagtggtcgaaacgctagaacaaatgcaaaggaaacatggcggtatgctggtaagaaatcccttaagtcgcaacagtacacatgaaatgtactgggtttcttgtggaacagggaatatcgtttctgcagttaatatgacatcgagaatgttactaaatcgtttcactatggcacatcgtaaaccgacgtacgagagagatgtagacctaggagccggtacgagacatgtagcagtagaacctgaagtcgcaaatttagatattattggtcagcgcattgaaaatataaagaatgagcataaatctacatggcattacgacgaggataatccttacaagacatgggcttatcatggaagttatgaagtaaaaccgtcaggttcagcttcttcgatggttaacggtgtagtacgtctacttactaagccttgggacgttatacccatggtaacacaaatagcaatgacagacacaacaccatttggtcaacaaagagtatttaaggagaaagtagacacaaggactcctagagcaaaaagaggcacaacacaaattatggaagtcacagctaaatggttgtggggattcttgagtagaaacaagaaacctcgaatatgcacaagggaagaatttacaagaaaggtacgttccaatgccgctattggcgcagtatttgttgacgaaaatcagtggaactctgccaaagaggctgttgaggacgagagattttgggaccttgtacatagggaaagagagctacataagcaaggaaaatgtgctacatgcgtatataatatgatggggaaacgagagaagaaacttggagagttcggaaaggcaaagggaagccgggctatatggtatatgtggttaggtgcacggtttctagaatttgaagccctgggctttatgaatgaagaccactggtttagcagggagaactctctttctggagttgagggtgaaggtttacataaattgggttatattctaagggatatctcaaagattccagggggaaacatgtacgccgatgatacggcaggatgggataccaggattaccgaagatgacttacaaaatgaggcaaagataacggacataatggagccagaacacgctttgttagccacttccatatttaaattaacttaccaaaacaaagtggttcgagtacaacgaccagctaaaaatggaactgtaatggatgtaatatcaaggagggaccaacgcggtagtggacaggtaggtacatatgggcttaacacattcacaaatatggaagtacaattaatacgacagatggaatcggaaggcatattcctaccatcagaactggaaactcctaacttagcaaaaagagtcctagattggttggaaaagcacggagctgagcgtttgaaacggatggcaatatcaggggatgactgcgtggttaagccgatagatgaccgtttcgcaaccgctttaaccgctcttaacgatatgggcaaagttagaaaagacattccacaatgggaaccaagtaaaggttggaatgattggcagcaagtccccttttgttcacaccactttcatcaactaataatgaaggatggaagagaaattgttgtaccatgtcgaaatcaggatgaattagttggtcgcgcgagagtatcacagggagcaggatggtctctgagagaaaccgcttgcttgggaaaaagctatgcgcaaatgtggcagttaatgtacttccacagaagagacctacgcctagctgcaaacgcaatatgttcagcagtcccagttgattgggtgccgacctcaagaaccacatggtccatccacgctcatcaccagtggatgacaacagaggatatgctatctgtatggaatcgtgtatggattgaagaaaatccttggatggaagacaaaacacacgtatcatcttgggaagaagtaccatacctaggaaaaagagaagaccaatggtgtggatcgcttatcggattaactgcacgagccacatgggctacaaacatacaagttgcaattaaccaggttcgacgattaataggaaatgaaaattatctcgactatatgacctcgatgaaaagatttaaaaatgaatcagatccagaaggagcattatggtga

SEQ ID NO: 21329 - RNA, 9879 nt, synthetic construct
  misc_feature 1..9879: note = derived and/or modified CDS sequence (opt6) from DENV-1__JN819403__SS-prME
  source 1..9879: mol_type = other RNA
tccgttactatgttgcttatgttgctgccaactgcattagcttttcatctcacaactagaggcggtgaaccacacatgattgtatcaaaacaggaaaggggaaaatcgcttttatttaaaaccagtgcgggtgtaaacatgtgtaccttgatagctatggatttgggcgaactatgcgaggatacaatgacttacaaatgccctcaaattacagaagcagaaccggatgatgttgactgttggtgtaatgctaccgacacgtgggtgacttatggaacatgtagccagacaggggaacataggagagataaaagaagtgtagcactcgctccacatgttggattaggactagagactagaacagaaacctggatgtcaagtgaaggggcatggaaacaaattcaaagagtagaaacatgggcactacggcacccaggtttcacagttattgcgttgtttctagcgcatgcaataggaacttcgattacacaaaaaggtataatatttatactcctaatgctagtaactcccagtatggctatgagatgcgtaggaataggaaatagggatttcgtagaagggttatcgggtgctacttgggtggatgtagtgctagaacatggaagttgcgtaacaacaatggcgaaaaataaaccgacattggatatagaattattaaaaacagaagttacaaatcctgcaatactcagaaaattatgtatagaagccaaaatatcaaatactactaccgatagtagatgtccgacccaaggagaagcaacgcttgtagaagaacaggatgcaaactttgtatgtagaagaactttcgtagatagaggatggggaaacggatgcggtttatttggaaaaggctcattgctaacatgtgctaaatttaaatgtgttacaaaactagaaggtaaaatcgtacaatatgagaacctgaaatattccgttatagtaacagtccacacaggggatcaacaccaggtagggaatgaaaccacagaacacggtactatagccacgataacaccccaagcgcccactagcgaaatacaattgacggactacggagctcttacgttggattgctccccaagaaccggactagattttaatgaaatggttctgctgacaatgaaagagaaaagctggttagttcacaaacaatggtttttagatctacctctgccatggacttctggagcatcaacttctcaggaaacttggaatagacaagacctattagtgacgttcaaaacagcacatgctaagaaacaggaggtagtggtactaggatcacaggagggcgcgatgcatactgcattaacgggggcaacggaaatacaaacttctggaacgactactatattcgcaggccatctgaaatgcaggttgaaaatggacaaactaacattaaaaggaacaagttatgtcatgtgcacaggttcgtttaaacttgagaaagaagtcgcggagacccagcatgggacagtgctcgtgcaagttaaatatgagggaacagatgcaccttgtaaaataccatttagtacgcaagacgaaaaaggagttactcaaaatggtagattaataaccgccaacccaattgtcacagataaagaaaaaccagtaaatatagaaaccgagccacccttcggagaatcatacattgtcgttggtgcaggcgaaaaagcattaaaattgtcatggtttaaaaagggatcttctattggaaaaatgttcgaagcaacggcaagaggcgcaagaagaatggcgattctgggagacaccgcttgggacttcgggagcatagggggtgtgtttacatcggtgggaaaattagtccatcaggtatttgggacggcgtatggagttttattttcaggtgtcagttggaccatgaaaataggcattggtatactattaacatggctaggattaaatagcagatccacctcactaagtatgacatgtatcgcagtagggatggttaccctatatctaggtgttatggtccaagcagattctggctgtgtaattaactggaaaggaagagaattaaagtgtggaagcggaatatttgttacaaacgaagtacacacatggactgagcaatacaagtttcaagcagattcacccaaacgcttatccgcagcaataggtaaagcctgggaggaaggcgtgtgtggaatacgctcggccacaaggctagaaaacataatgtggaaacagatctctaacgagctaaatcatattttgttagagaatgatatgaaattcaccgtggtcgttggtgatgctaatgggattctcgcgcaaggaaagaaaatgataagaccacaacctatggaacataagtattcatggaaatcatggggaaaagcaaagatcatcggtgcagatatacagaacactaccttcattattgacggaccagatacgccagaatgtcccgacaaccaaagagcatggaatatctgggaggtagaagactacggattcggaatattcacaacgaatatctggctaaagttaagagactcatacacccaaatgtgtgatcaccggttgatgtcagccgcaattaaagacagcaaagcggttcatgctgatatgggatattggatcgagagtgagaaaaatgaaacatggaaacttgcaagggcttcgttcatcgaagtaaaaacttgtacttggccaaaatcacatactctttggtcgaatggtgttttggaaagcgagatgatcattcccaagatatatggcggtcctatttcccagcataattatagaccaggctatttcacacaaacggcaggaccgtggcatctcggtaaactcgaacttgacttcgatttatgcgaaggaaccacagttgtagtagatgaacattgcggcaacagggggcctagtttaagaactacaactgtaacgggaaagattatccatgagtggtgctgtcgatcatgtacactaccacccttacgatttcgcggtgaagatggctgctggtacggaatggaaattcgcccagttaaagagaaagaggaaaacctagtacgtagtatggtgtccgctggaagcggcgaggtggacagtttcagcttagggattttatgtgcgagtattatgattgaggaagtgatgaggtcgagatggagtagaaaaatgttaatgactgggacattagccgtctttctactcctcatcatggggcaattaacgtggaatgacctgattagactgtgtattatggtaggggctaacgcttcggacagaatggggatgggcaccacgtatctagccctcatggcaacattcaaaatgagacccatgttcgcggtgggattattatttcgccggcttacaagtagggaagtattattattaacgataggattaagcctagtagctagtgtagaattgcctaattcattagaagaactgggagatggacttgcaatgggcatcatgatgctaaaactactcacagaatttcaaccacaccagctttggacaacactgttgtcgttaacgttcataaaaacaacgttgagtctggactatgcctggaaaacaacggcaatggcgctatcaatagtttcattattcccactctgcctatcaacgacgagtcaaaagactacctggctgccagtgctactgggctcatttggatgcaaaccattaacaatgttcctgataactgaaaataaaatttggggtagaaagtcctggccgctcaacgaaggcataatggctatcggcatcgtaagcattctactaagcagcttactcaaaaatgacgtcccacttgcaggacccttgattgctggaggaatgctgatagcctgctacgtaattagtggcagttctgcagatttgagcttagaaaaagctgcagaagtaagttgggaacaggaggctgaacatagcggcacaagccacaacattctagtagaagtacaagatgatggcacaatgaaaattaaggacgaagaacgagacgatacgcttacaattctcctaaaagcaaccctactagcagtaagcggagtatacccgatgagcataccagcgaccttgttcgtttggtacttctggcagaagaagaaacaacgtagcggcgtcctatgggatactccgtctccaccagaggtagagcgagccgtacttgatgacgggatctatcgcattctacaaaggggactgctgggtagatctcaagtaggtgttggtgtctttcaggacggtgttttccatacaatgtggcatgttactcgaggagcagttttaatgtatcaaggcaaaagactagaaccgagctgggccagcgtcaagaaagatttaatttcttacgggggaggttggcgatttcagggatcttggaacacaggagaagaagtacaagtgattgcagtagagccaggaaagaaccccaaaaatgttcaaactactcccggaacctttaaaactccagaaggtgaagttggagcaattgctttggattttaaacctggaacaagcggctccccaatagtaaacagggaagggaaaatagttggactatacggcaatggagtggtcaccacatcaggtacatacgtctcggcgatagctcaagccaaagcatcacaggaaggtccccttcccgagatagaagatgaagtctttaagaaacgaaatttgacaattatggacctccaccctggatcaggaaaaacacgtcgatacttacccgcgatagtacgagaggctataaaacgtaaactgaggacgttaatactagccccaacacgcgtggtagcatcagaaatggcagaagcactaaagggaatgcccatcagatatcagacaactgcggttaaatcagaacatacaggcagagaaattgtagatctgatgtgccacgcaacttttacaatgcggcttctcagcccggtgcgcgttcctaattataacatgataataatggacgaggctcatttcacggatccagcatccatagcggcgagaggttatatttcgacaagagtaggaatgggagaggcagccgcaatatttatgacagctacaccgcccggtagtgttgaagcatttcctcaaagtaacgccgtaatccaagatgaagaaagagacataccggaacgaagctggaacagcggttatgattggattaccgactttccaggtaagactgtatggttcgttccctccataaaatcaggtaacgatatagccaattgtctaaggaaaaatggcaaaagagttattcaactttcacgtaaaacgtttgatacagaatatcagaaaacgaagaacaacgattgggattatgttgttaccacagacatttctgagatgggggcgaacttccgcgctgaccgtgttatcgaccctaggaggtgtttaaaaccagtgatattaaaagacggtccagaaagagtaatactagcaggaccaatgcccgtaacagttgcgagcgctgctcaacgaagaggccgaattggtaggaaccaaaacaaagaaggagaccagtatgtatatatgggacaaccactaaacaatgatgaagaccatgcacattggacggaggcaaagatgttgttggacaacataaatactccagagggtatcatacctgctttatttgagcctgaaagggaaaaatcggccgcgatagatggagagtatagattaaggggagaagcacgcaaaacattcgttgaattgatgcgaaggggcgacttaccagtctggctttcatataaagtggcgtcagaaggattccaatatagcgacagacgctggtgtttcgatggtgagaggaataaccaggttctagaagaaaatatggatgttgagatatggactaaggaaggcgaaagaaagaaattacgaccgcgttggctagatgcgaggacctacagcgatcccctcgcgttgcgagaatttaaagagttcgctgcaggtcgtagatcagtttccggggatctcattctcgaaattggtaaacttccacaacatttaactttacgagctcaaaatgctttagacaaccttgttatgctacataattctgaacaagggggtaaggcctatcgtcatgcaatggaagaattgccagatacaatagaaacgctcatgttgttagcccttatagcggtattaacagggggcgttacccttttctttctttcagggaaaggtctcggaaagaccagtattggacttctctgtgtcactgcttcatctgcattattgtggatggcaagtgtagaaccccactggattgcggcatcaataattttggagttctttttaatggttctcttaattcccgaaccagatagacaaaggaccccgcaggataaccagcttgcttacgttgttattggtcttctatttatgatactcacagtagcagcgaatgaaatgggactgttagaaacaacgaagaaagatttaggtatcggccacgttgcggcagaaaaccatcaacatgctaccatgttagatgtcgatctaagaccagcttcagcgtggacattatatgcggtggcaacaacagtaatcacaccaatgatgcgtcatacaatagaaaataccacagcaaacatttcgctgacagcaattgcaaaccaggcagcgatattgatgggtttagacaaaggttggccaatcagtaaaatggatatcggcgtgcctttattagccttaggttgctactctcaggtaaatcctttgacactgacagcggcagtcctcatgctcgtcgcgcattatgcaataattggcccgggtttacaagcgaaagcaactcgcgaagcacaaaagcgaacggcagcagggattatgaaaaatcctacagtagatggaattgttgcgatagatctagatccagtagtatacgatactaagtttgaaaaacaactaggacaaataatgttgctaatattgtgtacgtcacaaatcttactaatgcgaaccacatgggccttatgtgaaagcatcaccttagcaactggtcccttaacaactctatgggaaggaagtccaggtaagttctggaatactaccatcgccgtcagtatggccaacatttttcgtggatcgtatcttgcaggagccggtttagcatttagcctaatgaaatcgctaggaggaggtcgtaggggaacgggtgcccaaggagaaactctaggtgaaaaatggaaaaggcaattaaatcaattaagcaaaagtgaatttaatacctataaaagaagcggaattatggaagttgaccgctctgaggctaaagaaggactaaaacgaggtgagacgactaagcatgcagtgtcacgaggaaccgcgaagctaagatggtttgtcgaaaggaacctcgttaaacccgaaggtaaagtcatagatctgggatgtggccgaggagggtggtcctactactgcgctgggctcaagaaagttaccgaggtgaaggggtatactaaaggaggaccaggccatgaagggcctattccgatggcaacctatggatggaatctagtcaaattgcacagtggtaaagatgtattcttcatgccaccagaaaaatgtgatactttactttgtgatattggagaaagtagtccaaaccctacaattgaagaaggtaggacgctcagagttctaaaaatggttgaaccctggctacgcggtaaccagttttgtataaaaatcctgaacccttatatgccgagcgttgtcgaaactttggagcaaatgcaaagaaaatatggcggaatgctggttagaaacccactcagtaggaactctacccacgaaatgtactgggtaagctgtggaaccgggaatatcgtaagtgcagtaaatatgacaagtcgcatgcttttaaaccggttcacaatggctcacagaaaaccaacatatgaacgagacgtggatctaggagcaggaactagacacgtagcagtagaaccagaagttgccaaccttgatattattggacaaagaattgaaaacatcaaaaacgaacataaaagcacctggcactatgatgaggataatccatataaaacatgggcctaccatggaagctatgaggtaaaaccttctggttccgccagctctatggtaaacggtgttgtacgactgttgacaaaaccgtgggacgtcataccaatggtcacgcaaatagccatgacagacactacgcccttcggccaacaaagggtatttaaagaaaaagtagatacaagaaccccaagagcaaaaagaggaacaactcaaatcatggaagtaacggctaaatggctgtggggctttctttccagaaataagaaaccccgcatatgcacaagggaggaatttacgagaaaggtacgaagtaatgcagctataggtgcggtgtttgtagacgaaaaccaatggaactctgctaaagaagctgtagaggatgaacgtttttgggacctcgtccacagagaacgtgaactacataaacaaggtaaatgtgcgacgtgtgtgtataacatgatgggaaaacgcgagaagaaactcggtgaatttggaaaggctaaaggctcaagagctatatggtacatgtggcttggtgctaggtttcttgagttcgaagcattaggatttatgaacgaagaccactggttctcgagagaaaatagtctttctggagtagaaggagaaggactgcataaactggggtacatactcagagacattagtaagatacctggaggtaacatgtacgcagatgatacagcgggctgggacacgcgaattaccgaagatgaccttcagaacgaagcaaaaataaccgacattatggaaccagagcatgcgctacttgctacgagtatattcaaattaacttatcaaaataaggtagtccgagtgcaacgaccggccaaaaatggcacagttatggatgtcatatcaaggagagaccaacgcggtagcggtcaagttggcacgtacggattaaatacctttacgaatatggaagttcagctgattcgacagatggagtctgaaggaatatttctaccaagtgaattagagacaccaaacctagccgagagggttctagattggctagaaaagcacggtgcggaacgcctcaaaagaatggctatatctggagatgattgcgtcgtgaaacctatcgacgaccgattcgctaccgcactaacagctctaaatgacatgggtaaagtaagaaaggatataccacaatgggagccatcaaaaggatggaatgattggcaacaagtacctttttgtagccatcattttcatcagttaatcatgaaagacggtagagagatagtcgtcccatgtagaaatcaagatgagctcgtcggccgagcacgtgtatcccaaggggctggatggagtctcagagaaacagcctgtttagggaaaagctatgcgcaaatgtggcaacttatgtatttccacagacgggatttaagattagcagcgaatgctatatgttcagcggtacctgtggattgggtaccaacctcacgaactacttggtcaattcatgcccaccatcaatggatgacgactgaggatatgctctcagtttggaatagagtctggatagaagaaaacccgtggatggaagataaaactcatgtttcaagttgggaagaagttccttatttaggtaaacgagaagaccaatggtgcgggtccttgatagggttgacggccagagccacatgggcaacaaacattcaagtagcaatcaatcaagtacgaagattgatcggtaatgaaaattaccttgattatatgacatcaatgaaaaggtttaaaaacgaatcggatccggagggcgctctctggtaa

SEQ ID NO: 21330 - RNA, 9879 nt, synthetic construct
  misc_feature 1..9879: note = derived and/or modified CDS sequence (opt6) from DENV-1__KF973453__SS-prME
  source 1..9879: mol_type = other RNA
agcgtaactatgttgctaatgttactccccactgcattagctttccatcttacaacacggggaggtgaacctcacatgattgtcagcaaacaagaaagaggaaaaagtctgctctttaaaacaagcgcaggggttaacatgtgtacgttgattgcaatggacttaggtgaactgtgtgaagacacaatgacatataaatgtccgcaaataacagaagcagaacctgatgatgtagattgctggtgcaatgcgacagacacgtgggtgacttacggcacatgcagccaaacaggtgaacatagacgtgacaagaggagcgtggccttagcgcctcacgtaggattaggattagaaacgcgcacagaaacgtggatgtccagcgaaggcgcatggaaacaaattcaacgcgtagaaacttgggcactcaggcacccagggtttaccgtaatagctttatttcttgcacatgctataggtacttcaattacacaaaaaggaattatttttattctccttatgctagtaacaccgagcatggcaatgcgctgtgtgggaatcggtaatagagatttcgtggaaggcctaagcggtgctacctgggtagacgtagtacttgaacacggttcatgcgtcaccacaatggccaaaaataaaccgaccctggacattgaattgctaaaaacagaagttacaaatccagcgatattaagaaaattgtgtatagaagctaaaatttccaataccacaacagacagtcgatgcccaacacaaggagaagcaaccctcgttgaagaacaagacgcaaattttgtctgtcgacggactttcgtagacagaggttggggaaacggttgtggattgttcggaaaaggtagtcttttgacatgtgcaaaattcaaatgtgttacaaaactagaaggcaaaattgtccaatatgaaaatctaaaatacagtgtaatagtaactgtacacaccggcgatcaacatcaggtagggaatgaaacaacagaacatggtactattgcaactataactccacaagcacccacgtctgaaattcaacttacggattacggagcactaacattagactgctcaccacgaacgggtcttgattttaacgaaatggtccttcttacgatgaaagaaaaatcgtggttagtacacaaacaatggttcttagatttaccacttccttggacgtcgggtgcgagtacttcacaagaaacatggaacagacaagacttgctggtaacgttcaaaactgcccatgcaaagaaacaagaagtcgtagtactagggagtcaagaaggagcgatgcacacagccttgactggagctacagaaattcaaacgtccggaactaccactatatttgctggacacctcaaatgtcgtctgaaaatggacaaattgacacttaaaggtacaagttatgttatgtgtactggttcattcaaactagagaaagaggttgcagagactcaacacggaacagtcttggtacaggtaaaatatgaagggactgatgcgccatgcaaaatcccgttttccacacaagatgaaaagggagttacacaaaacggacgactaataacagcaaaccctattgtaacggataaagaaaaaccggtgaacattgaaacggagcctcctttcggagaaagttacatagttgtaggagcgggtgaaaaagcactaaaactttcctggtttaaaaagggctcaagcattggaaaaatgttcgaggctaccgcaagaggcgcccgaagaatggctatacttggtgacacagcttgggattttggcagtatagggggtgtgttcacaagcgttggaaaactggtacatcaagtctttggtacagcatacggagttcttttctcgggagtttcctggacaatgaaaattggtataggaattttgctaacctggctcggacttaattcaaggagcacatcattaagcatgacatgcattgctgtaggaatggtaactttatacttaggggtgatggtacaagctgattctgggtgtgtcataaactggaaaggaagagagcttaaatgtggatctggaatcttcgttacaaacgaagtacatacatggaccgaacaatacaaatttcaagcggattctccgaaacgcttaagtgccgccataggaaaggcttgggaagaaggagtgtgcggtataagatcagctactaggttagagaacataatgtggaagcagatttctaacgaattaaaccatatattactagaaaacgacatgaaatttacagtagttgtaggagatgctaacggcatactagcacaagggaaaaagatgataaggccccaacctatggagcataaatactcctggaagtcttggggaaaagccaagataattggcgctgatattcaaaatacaacatttataattgatgggcccgacactccggagtgcccggacaaccaaagagcatggaatatctgggaggtggaagactacgggtttggaatatttacaaccaatatatggctaaaactacgggatagttatacacaaatgtgtgaccacaggcttatgagtgcagcaattaaagattccaaagcagtacatgctgatatgggttactggattgaaagtgaaaagaacgagacgtggaaacttgctcgtgcaagtttcatcgaagtgaaaacctgtacgtggcctaaatcacatacgttatggagtaatggcgtcctagagtccgagatgatcatacccaaaatatatggcggacctatttctcagcacaattacaggccaggatacttcacacagactgcaggaccttggcacctaggcaagttagaattggacttcgatctatgtgaagggactactgtagtagtcgatgaacactgcggaaatagaggaccaagcctcagaacgacaacagtaaccggaaaaataattcatgagtggtgctgcagaagttgcacactgccgccattaaggttcagaggcgaagatggttgctggtacggaatggaaatccgaccagtaaaggagaaggaagaaaatctagtacgaagtatggtttcagcaggaagtggagaggtagatagtttttcgctgggaatactatgcgcaagtatcatgatagaagaagtaatgcgatccagatggagtcgcaaaatgcttatgacagggacgctcgcggtgtttctcttattaataatgggacaactaacgtggaatgatctaatccgcttatgtataatggttggcgcgaatgctagtgataggatgggcatggggactacgtacttagctcttatggccacgtttaaaatgagaccaatgtttgctgtaggactactatttagaaggcttacatcccgagaagtgctgctattgactataggtttatctttggtggcaagcgtcgaactaccgaatagtcttgaagaacttggcgatggactagctatgggaataatgatgctaaaattactgacagagttccaacctcaccaactatggacgacgctcttgagtcttaccttcatcaagacgacacttagcctagactatgcatggaaaacaacagctatggcattatctattatatcactcttcccattatgtttaagcacaacatctcagaaaacgacctggctacctgttttattgggctcctttggatgcaagcctttaacgatgttcttaatcacagaaaacaaaatatggggaaggaagtcatggccccttaacgaaggaattatggcaataggtattgtaagtatcctcttatcgtcactattgaaaaatgacgttcctctagctgggcccctaatagccggagggatgctaatagcttgctatgtgatatcgggaagttcggctgacttaagtttggaaaaagcggctgaagtttcatgggaacaagaagcagaacactcaggaacatcccacaatattcttgtggaggtacaggatgacggaacaatgaaaattaaggatgaggaacgagatgatactttaaccatactcttgaaagctacgttactagcagttagtggagtgtatccaatgagtataccggcaacattatttgtgtggtacttctggcagaagaagaaacaaaggtctggggtcctatgggacacacctagcccacccgaagtagaaagagctgtattagacgatggaatctatagaatactgcaaagaggactactcggacgatctcaagtaggcgttggagtctttcaagatggagtatttcacacgatgtggcatgttacgagaggagctgtactaatgtatcaaggtaaacgactagagccatcttgggcatctgtaaagaaagacttaataagttatggagggggctggagatttcaaggatcgtggaatactggagaggaggttcaagtaatagcagtcgaaccagggaaaaatcccaaaaatgttcaaactactcctggcactttcaaaactccggagggagaggtaggcgcaatagccctggatttcaaaccaggaacatccggctccccaatcgtgaacagggaggggaagattgtaggattatacggaaatggtgtagttacgacaagtggaacttacgtatcagccattgcacaagctaaagcatcacaagaaggtccactacccgagatagaggacgaggtattcaagaaacgtaacctcactatcatggatcttcacccgggatctgggaagacccgaaggtatctaccagccattgtaagggaggcaatcaagaggaaactacgaactttaatcttggcacctaccagagttgtagcatcagagatggcagaagccctaaaagggatgccgatcagatatcaaacgaccgcagtaaaatctgaacataccggtcgggaaattgttgatcttatgtgtcacgctactttcaccatgcgtttattatccccggtgagggtaccaaactataatatgattattatggacgaagcacacttcacggatcccgccagtatcgccgcacgcggctatatatcgaccagggtaggtatgggcgaagcagcagcaatttttatgacagcaactcccccaggctccgtagaagccttcccccaaagtaatgcagttatacaagatgaagaacgagatatacctgaaaggtcctggaatagtggctatgactggataacagacttcccgggcaagacggtttggtttgtcccgtctataaaaagtggaaatgacatagccaattgtttaaggaaaaacggaaaaagagttatacaactgtctagaaaaacatttgataccgaataccaaaagactaaaaataatgattgggattacgttgtaactacagacatatcagaaatgggagcgaattttagagcagatcgcgtaattgatcctaggcgatgcttaaaacctgttattttgaaagatggacctgagcgagtaatattagcaggacctatgccggtgacggtagctagcgcagcccagagaagaggtcgcataggtaggaaccagaacaaggagggagaccaatatgtatatatgggacaacctcttaataatgatgaagatcatgcacactggaccgaagccaaaatgctattagataatataaataccccggaaggaataataccagcgttgttcgaaccggagagagagaaaagtgctgcaattgatggagaatatcgattgcgtggggaggcaagaaaaacttttgtagaattaatgaggcgaggagatctcccagtctggctatcttataaggtagcttccgaaggtttccaatattcagatagacgttggtgtttcgacggagagagaaataatcaagtattagaagaaaatatggacgtggaaatatggaccaaagaaggggaaaggaagaaacttcgtccacgctggttagatgctcggacatacagcgatccactagctctaagagagttcaaagagttcgcggccgggaggcgaagtgtttctggagatctcatcttagaaattggcaagctcccacaacatttgacattaagggctcagaatgctctcgataacttagtaatgcttcataattctgagcaagggggtaaggcgtatcgtcatgctatggaggagttacccgacacgatcgagacattaatgctattagcactgattgctgtccttaccggtggtgtcacattatttttcttaagtggaaaggggctgggcaagacttctataggtttactatgtgtcacagccagctcagcattgttgtggatggcatccgtggaaccgcactggatagcagcctcaataatcctagagttctttttaatggttttattaatccctgagccggaccgacaaaggacgccacaagacaaccagttagcctacgtcgttataggtcttttatttatgatactgaccgttgcagctaatgaaatggggttattagaaacaactaaaaaggatctggggattggtcacgtagctgccgaaaatcatcaacacgcgacaatgttagacgtggatctgagaccggcgagtgcctggactctttacgccgttgctactacagttataacgccaatgatgaggcataccatagaaaatactactgccaacataagtctgacggctatagccaaccaagctgcaatcctaatgggtttagataaaggatggccgatatcaaagatggatattggggtaccattgctagcattaggatgctatagccaagtgaatccactaactttaacggcagccgttctaatgctagtggcccactatgcaataatcgggccaggtttgcaagcaaaagccacacgtgaagcccagaaaagaacagcggcaggaattatgaaaaatcctacagtagacgggattgtagcgatagatctagacccagtagtatatgacactaagtttgaaaaacaattaggccaaataatgttactaattctatgcacatcccaaatattgttaatgcgtaccacgtgggctctttgtgaatccataacactcgcaaccggtccattaactacactctgggaaggttcacccggtaaattctggaatacgacaattgcggtgtcaatggcgaacatattccgaggatcatatttagccggagcggggttagcctttagtttaatgaaatctttaggtgggggacgcagaggtacaggagcacaaggtgaaacacttggggaaaaatggaaacggcaacttaatcaactgtctaaaagtgagttcaacatttataaacgatctggtataatggaggtcgatagaagcgaagctaaagaaggattaaagagaggggaaacgactaagcatgctgtcagcagggggacagccaaattgagatggtttgtagaaagaaatctagtcaaacctgagggaaaagtaattgacctaggttgcggccgaggcggatggagctactattgtgccggactgaagaaagtaacggaggtaaaggggtatacgaaaggtggcccaggccatgaagaacccattccaatggccacctatggctggaaccttgtgaaactccactcaggtaaagatgtattcttcatgccaccagaaaaatgtgacactttactgtgtgatatcggagaaagctccccaaatccaaccattgaagagggaagaacgctgcgagtcttaaagatggtagagccatggcttcggggaaatcaattctgcattaaaattttaaatccatacatgccttcagtagtcgaaacattagaacaaatgcaaagaaaatatggaggaatgctagtacgcaaccctttaagtcgtaatagtacacatgagatgtactgggtttcttgtgggaccggaaatatcgtctctgcggttaatatgacttccaggatgcttttaaatagatttactatggcccacagaaagcctacatacgaacgtgatgttgacttaggcgcaggaacacgacatgtagctgttgaacccgaagtagcaaatttagatataataggacaacggatcgaaaatattaaaaacgaacataagagtacctggcactatgatgaagataatccatacaaaacctgggcctaccatgggagttacgaagtgaagccctcaggttcagccagtagtatggtcaacggagttgtacgcttactaactaaaccctgggatgtaatccccatggttactcaaatcgccatgactgacacaacgccattcggccaacaacgggtcttcaaggaaaaggtagacactagaacgcctagagcaaagcgaggaaccacacaaataatggaagttacagcgaaatggttatggggctttttgagtaggaacaagaaaccacgaatttgtacaagagaagagttcacaagaaaagttagatcaaatgctgccattggcgcagtatttgtggatgagaaccaatggaatagtgccaaggaagctgtggaagacgaacgcttctgggacttagtacatcgggaacgagagttgcacaagcaaggtaaatgtgcaacttgtgtttataatatgatgggtaaaagggagaagaaattgggtgaatttggcaaggcaaaaggttctagagccatttggtatatgtggttaggtgcaagatttttagagtttgaagcattgggatttatgaatgaagatcattggttcagtcgcgagaatagcctgagcggagtcgaaggagaaggtttgcacaagctaggatatatattaagggacattagtaaaatacctggtggcaatatgtatgctgacgacacagcaggatgggacacgaggatcacagaagacgacttgcaaaatgaagcaaaaataacagacataatggaaccagaacacgccctattggctacctcaatatttaagttgacatatcaaaacaaagtagtgcgcgtccaacgtccggccaaaaacggaactgtcatggacgttatatcaagaagagatcaaaggggatcaggtcaagttggcacgtatgggctcaatactttcacaaatatggaagttcagctgattcggcagatggaatcagaaggaattttcctaccatcagagcttgagacgcctaacttagcagaaagagttctggattggcttgaaaaacatggcgctgaacgtctcaaacgcatggcgatatccggcgacgattgcgtggtcaagccaattgatgatagattcgcaactgcacttacagcccttaacgatatgggcaaagttaggaaagacattccccaatgggaaccaagtaagggctggaatgactggcagcaggtcccgttttgcagccatcattttcatcaattaatcatgaaggatggaagggagattgttgtaccatgtcggaaccaagatgagctagtaggtcgcgctagagtatcgcaaggtgctggatggtctctgagagaaacggcatgcttaggaaagtcctatgcgcaaatgtggcaacttatgtattttcataggcgcgatctcagactagcagcgaatgcgatatgcagcgcagtaccagtagattgggttccaaccagccgcacaacttggagtatacacgcacatcatcaatggatgactacagaggatatgctatcagtttggaatagggtgtggatcgaagaaaatccatggatggaagataaaacacatgtatccagttgggaagaggttccatatctcgggaaacgtgaggaccaatggtgtggatcattgattggactaacggctcgggcaacatgggccactaatatccaagtagctataaatcaggttagaagactaataggtaatgaaaactacttggattacatgacaagtatgaagcggtttaagaacgaatcagacccagagggggcgctatggtga

SEQ ID NO: 21331 - RNA, 9879 nt, synthetic construct
  misc_feature 1..9879: note = derived and/or modified CDS sequence (opt6) from DENV-1__KF973454__SS-prME
  source 1..9879: mol_type = other RNA
tccgtaacaatgcttttaatgttgttaccaacagcactagcctttcacctcactactagaggaggtgaacctcatatgatagtgtccaaacacgaaagggggaaatcattactgtttaaaacatcaaccggggtaaatatgtgcactcttattgccatggatctgggtgaattgtgtgaagacaccatgacgtacaaatgtccacgaattacagaagcagaacctgatgatgtggactgctggtgtaacgcaacagatacttgggtaacatatggaacttgctcacaaactggtgaacaccgacgagataaacgttcagttgcgctagcaccccacgtaggactaggactcgaaacacgcaccgaaacttggatgtcttcagaaggagcctggaaacaaatacaacgcgtcgaaacctgggctttaagacatccaggtttcacagttatagcactttttctcgcacacgcgattggaacctcgatcactcaaaaagggataattttcattctactcatgttggtgaccccctcaatggcgatgcgatgcgttggcattggaaatcgtgactttgttgaaggactgagcggcgccacctgggtagatgtcgtacttgaacacggaagttgcgtaacgaccatggctaaaaacaaaccaacacttgatatagaactattgaaaaccgaagtaacaaaccccgcagtactacggaaactgtgtatagaagcaaaaataagtaacacaacaaccgacagtcgctgcccaacacaaggagaagctactttggtagaagaacaagatgcgaatttcgtatgtagaaggaccctagtggacagaggatggggtaacgggtgcggcctttttggaaaaggctccctactaacatgtgcgaaattcaaatgcgtaaccaaattagaaggtaaaatcgtacaatatgaaaacctaaaatactctgtcatagtcactgttcatacaggtgatcaacatcaagtagggaatgaaactactgaacatggcacaatagcaactataactccccaagcgcccacttccgaaatccaacttaccgattatggtgcattggcgttagattgttcaccaagaacaggactagatttcaacgaaatggtcctcctaacaatgaaagaaaaatcatggttagtccataaacaatggtttctagatctaccactgccctggaccagtggtgccagcacaagtcaagaaacgtggaacagacaagacctattagttacattcaaaacggcgcatgccaagaaacaagaggtcgtagttttaggaagtcaagaaggcgcaatgcatacagcattaaccggtgcgacagaaatacaaacaagtgggacaactacgatctttgcaggtcatttaaaatgccgattaaaaatggataaactgaccctaaaagggacatcctatgtaatgtgcacaggtagttttaagctagaaaaagaagtcgctgaaactcagcatgggacagtacttgtccaagtaaaatacgaaggtacggacgcgccatgtaaaattccgttcagcacacaagatgaaaaaggagttacacaaaacggtcgacttataacagctaacccaattgtcacagacaaagaaaaaccagttaacatagaaacggagcctccattcggggaatcatatatagttgttggcgctggtgagaaggcattaaaattatcttggttcaaaaaggggtcatccattggaaaaatgtttgaagctacagctagaggcgccaggagaatggcaatcttgggagatacagcctgggatttcggaagtattggaggcgtttttacgagtgtaggaaagctcgtacatcaggtattcggcacagcatatggagtattattctcaggcgtatcttggacaatgaaaataggaataggaattttactgacgtggttgggactcaattccagatccacatcgctgtctatgacatgtatcgcggtcggtatggtcactttatatttaggtgttatggtacaagcggatagtgggtgtgtgataaattggaaaggtcgagaattaaagtgcggaagcggcatattcgtaacgaatgaagttcatacatggacagaacagtataaattccaagcggattcgcccaaaagactgtcagcagccattggaaaagcatgggaagagggggtctgcggcataagatcagccacaagactcgaaaatattatgtggaaacaaatatcaaatgaacttaatcatatcttattagaaaatgacatgaagttcactgtcgtggtaggtgatgcgaatgggattctagcacagggtaagaaaatgattagacctcaaccaatggagcataaatattcctggaagtcctggggcaaagcaaagataataggggcagacattcaaaatacgaccttcattatagatggtccagatacacccgaatgtccagacgatcagcgcgcgtggaacatttgggaagttgaagactatggttttggaatatttactacaaacatttggttaaagctaagagattcatatacacaaatgtgtgatcatcggttaatgtcagcagctattaaagattctaaggctgtacacgcagacatgggttactggatcgaaagcgaaaagaatgaaacgtggaaattagcacgcgcgtcatttatagaagtcaaaacgtgtacatggcccaaatctcacaccctttggtccaacggggtactagaaagcgaaatgataataccaaaaatctatggaggccccatatcacagcataattatagaccaggatattttacacaaactgcaggaccatggcacctcggcaagctagaactagattttgatttatgcgagggaacaacggtcgtcgttgatgaacactgtggtaatagagggcccagcctacgcactactaccgtaacgggtaaaattatacacgaatggtgttgtaggtcatgcaccctaccgccactcagattccgcggggaagacggctgttggtatggtatggaaataaggcccgtgaaggagaaagaagagaacttggtgagatcaatggtgtcggctggctctggagaagtagatagtttctctttaggtatcttatgcgtgagtattatgattgaagaagtaatgaggtcgcgatggtcgcgaaagatgcttatgacaggcacactcgcagtttttcttctgctcataatgggtcagcttacttggaacgacctcatacgtttatgtattatggtaggtgccaatgcatccgaccgtatgggaatgggtacaacgtatttagcattaatggctaccttcaaactccgacctatgtttgctgtgggaatactctttcgtcggctaactagccgagaagtactcttattaacaattggtctgtcactcgtcgcatcagtcgaactaccaaatagcttggaagaactcggggatgggttagctatgggcataatgatgctaaaactactaactgaatttcaaccacatcaattgtggactacattattaagtctcactttcattaaaacgacgctgagtctagattatgcgtggaaaacaacggcaatggccctatcaatagttagcttattccccatatgtttaagtactacatcccagaaaaccacttggctgcctgttttgctaggatcctttggttgtaaacctcttaccatgtacttaatcaccgagaacaaaatatgggggcgaaagtcttggccgattaatgagggaattatggcgattggtattgtaagtatacttttatcatccttattgaaaaatgacgttccgctagccggacctcttatcgctggtggaatgttaatagcttgttatgtgattagtggatccagtgcagatttaagccttgaaaaagcagccgaagtttcatgggaacaagaggcagaacattccggaacgtcacataacatacttgtagaagtgcaagatgatggaacaatgagaataaaagatgaagaaaaagatgacacacttactatattattaaaggctacattactcgcagtgtctggggtctaccccatgtcaattccagctactctttttgtctggtacttctggcagaagaagaaacagagatcaggagtattatgggataccccaagccctccagaagtagagagagcagtgttagatgacggaatctaccgtatacttcagagaggtcttttggggagatcacaagtaggtgttggcgttttccaagatggggttttccatacaatgtggcacgtaacacgaggagctgtattaatgtatcagggaaaacgactagagccatcctgggcaagcgtcaagaaagacttaatcagctacggtggcggatggagatttcagggaagctggaatactggagaagaagtacaagtaattgcagtagaaccgggtaaaaatcccaaaaatgtgcagacgacgcctgggacatttaaaacaccagaaggagaagttggggcaatagccttagattttaaaccaggcacatctgggagtcctattgtaaacagagaaggaaaaatcgtcggtttatatgggaatggggtcgtaacaacctcagggacttatgtctccgcgatagcacaagcaaaagcaagtcaagagggcccgttacctgaaatcgaagatgaagtatttaagaaacggaatttaacaattatggatttacaccctggctcaggaaaaacgagacgatatctgccagcaatagtccgtgaagcaataaaacgtaaattgagaacattgattctggctcccacgcgcgttgtagcaagtgaaatggctgaggcacttaaagggatgccaatcagatatcaaactacagctgtgaaaagtgaacacacaggtagagaaattgttgatctgatgtgtcatgccacatttacgatgagattattgtcgcctgtaagagtcccaaactataacatgataattatggacgaggctcactttacagatccagctagtatagcagcacgaggttacatatcaactcgtgttggcatgggtgaagccgcagctatttttatgacagcaacacctcctgggagcgtcgaagcgttcccacaatcaaatgcggtaattcaggacgaagaacgcgatatacccgagcgaagctggaactctggttatgattggattacggactttcctgggaagactgtctggtttgttccgagtataaaatctggaaatgatattgcaaactgtcttaggaaaaacggtaaacgtgtaatccagctttcacgcaaaacatttgacaccgaatatcagaaaacgaaaaacaacgattgggattatgtcgttaccacagatatatcggaaatgggagccaatttcagggcagatcgggttatagacccgagacgatgtctcaaaccggtcatattgaaagatggacctgaaagagtaattctagccggacccatgcctgtaacagtagcatctgcggcccaacggcgcggacgcataggaagaaaccaaaacaaagagggtgaccagtatgtttacatgggtcaacctctcaataacgatgaagatcatgctcattggactgaagcaaaaatgttactagataatataaatacacctgaggggataataccggctctattcgaaccagaaagagagaaaagtgcagctatcgatggagaatatcgtcttaggggcgaagcacgaaaaacttttgtcgagctaatgagacgcggtgatctacctgtatggctcagttataaagtggcatcagaaggattccaatatagcgacaggcgatggtgctttgatggagaacgaaataaccaggtactcgaagagaatatggatgtagagatctggaccaaggaaggtgagagaaagaaactgcgaccacggtggttagacgcaaggacgtactcagacccgttggccttaagagaatttaaagaatttgcggcaggacgcagatctgtttcaggtgacttgattttagagatagggaagctgcctcagcatcttacacttagggctcaatctgcacttgataatttagtaatgttacacaattcggagcaaggaggtaaggcttaccgacacgccatggaagaacttcccgataccatcgaaactttaatgttacttgctcttatcgcagttcttacaggaggtgtaatgctgttctttttatccggcaagggattaggtaaaacatcaattggtctgctgtgcgttactgcgagttcagcccttctatggatggcatcagttgagccccattggattgcagcttcgataattttagagttctttttaatggtattactgataccggaacccgatcggcaaagaacaccccaagacaaccaattagcttacgtagtaataggactgcttttcatgatcctcactgttgccgccaatgaaatgggcttactagagacaactaaacgagaccttggtataggtcatgtggcagcagaaaatcatcaacatgcaacaatgttagacgtagatttgagaccagcatccgcatggacactatacgccgtggcaaccaccgtaataacaccaatgatgagacatactatcgaaaacacgactgcgaatatttctctcacagcaatcgctaatcaggcagcaatattaatgggtcttgataagggatggcccatatctaaaatggatattggggtacctctattggctttaggatgttattcgcaagtaaatccattaacattaacggccgcagtacttatgctcgttgcgcattatgcgatcattggacctggacttcaagcgaaggccacccgagaggctcaaaaacggacagcagctgggattatgaaaaacccaacagtcgacggaatagtagccatagatctcgatccagttgtatacgatgcaaaattcgaaaaacaacttgggcagattatgcttctcatattatgtacaagtcaaatactattgatgaggacaacatgggccctgtgcgaatcgataacgttagctactggaccactcacaactctatgggaaggctcgccaggaaaattttggaatactacaatagcagtttcgatggctaatatattccgtgggtcttatctagcaggcgctggcctcgcattctccttaatgaagtcattgggaggaggccgtagaggcaccggagctcaaggagaaacactgggcgagaagtggaagagacaacttaaccagttatccaaaccggaatttaacacttacaaaaggtcaggaataatggaagtcgacagatccgaggctaaagagggacttaaaaggggtgagaccaccaaacatgcagtttctaggggaactgccaagctaagatggttcgtcgagaggaacctggtaaagccggaaggtaaagtgatagacctaggctgcggaagaggaggttggtcctactactgtgctggactaaagaaagttactgaagtaaagggatatactaaaggaggtccaggtcatgaggaaccaataccgatggcgacttatggttggaatctagtcaaactacactctgggaaggacgtattctttatgccgccagaaaaatgtgataccctcctctgtgatataggggaaagttcccccaaccctacaattgaagaaggtagaaccttaagagttttaaaaatggtcgaaccctggttacgtggtaaccaattctgcatcaaaatattaaatccctatatgcccagtgtcgtagagacacttgaacagatgcaaagaaaacatggaggaatgttagttcggaatccactatcaagaaactcaacacacgaaatgtattgggttagctgcggaactggaaatattgtatcagcagtaaatatgacgtcaagaatgttgttaaaccgatttacaatggcgcataggaagcctacttatgaacgcgatgtagatctcggagctggaactaggcatgtcacagttgagcccgaagttgcaaacctagatataatcggtcaacgtatagaaaatatcaaaaatgaacacaaatctacttggcattatgatgaagacaacccatataaaacttgggcttatcacggatcttacgaagtcaaaccttcaggttcggcttcttctatggttaatggagtagtccgattgttaacaaaaccttgggacgtaatacccatggtcacccagattgcgatgaccgataccacaccctttggacagcaacgggtcttcaaggaaaaagtggataccagaacccctagagcaaaaagaggtaccactcaaataatggaagtcacggcaaaatggctatggggatttctctcaagaaataagaaacctagaatctgtacacgcgaagaatttacaagaaaagttagaagcaacgcggcgataggggcggtattcgtcgatgagaatcagtggaacagtgcgaaagaagctgtagaagacgagcgtttttgggatttagttcatagagaaagagagcttcacaaacaaggaaaatgtgctacatgtgtctacaacatgatgggaaaaagggagaagaaactaggggagtttggtaaagctaaagggtcgcgcgctatttggtatatgtggttgggcgctaggttccttgagttcgaggctttgggatttatgaatgaggatcattggttttcgcgagaaaactcgttgtcgggtgtggaaggcgaagggctacataaactgggctacatactgagggacatatcaaaaatcccaggaggaaacatgtatgctgacgataccgcgggctgggacacacgaattaccgaagatgatcttcaaaatgaggcaaaaattaccgacattatggaaccagagcatgccctgttagcaacttccatattcaaactaacttaccaaaataaagttgttagggttcaacgcccagcaaagaatggtacagtgatggatgttatttctagaagagaccaaagaggatccggccaagttggcacgtatggcttgaacacctttaccaacatggaagttcagcttataaggcaaatggaaagcgaaggaatctttttgccaagtgaacttgagacacccaatcttgcagaaagggtactagattggttagaaaaacatggtgcagaacgcttaaaacgcatggcgatatcgggagatgattgtgtcgtaaaacccatcgatgatcgttttgccacagcactcaccgctctgaatgatatgggaaaggttaggaaggatattccgcaatgggaaccctccaaagggtggaacgactggcaacaggttccgttttgctcacaccactttcaccaacttataatgaaagacggcagagagatcgtagtaccttgcagaaatcaagacgagttagttggacgagcacgagtttcgcaaggtgcgggatggtcacttagggagacagcttgcttaggcaaatcctacgcacaaatgtggcaattaatgtattttcatagaagagacttaaggttagcagcaaatgctatatgctctgcagtacctgtagattgggttccaacatccagaaccacgtggagtattcatgctcatcaccaatggatgacgactgaggatatgttgagcgtctggaatagggtatggatcgaagaaaacccatggatggaagataaaactcatgtgtcatcatgggaagaggtgccctacctaggcaaacgcgaagaccagtggtgtggcagcctaatcggtttaaccgccagagcaacgtgggccacaaacattcaagtcgccataaatcaagtaagaagattgatcggcaacgaaaattatctagattatatgacatcaatgaaaaggttcaaaaatgagtccgaccccgaaggtgtgctatggtaa

SEQ ID NO: 21332 - RNA, 9879 nt, synthetic construct
  misc_feature 1..9879: note = derived and/or modified CDS sequence (opt6) from DENV-1__KF973455__SS-prME
  source 1..9879: mol_type = other RNA
agtgtgactatgcttctaatgttactaccgaccgcattagcgtttcatttgacaactcgaggaggagaacctcatatgatagtcagcaaacatgaaagaggaaaaagtcttctatttaaaaccagtacaggagtcaacatgtgcacattaatagctatggacttaggggaattgtgtgaagacacaatgacctataaatgtcctagaataacagaggccgaaccggatgacgtagactgttggtgtaacgcgacggacacttgggttacttacggcacctgtagccaaacaggcgagcatagacgagataaacgaagcgtcgcacttgctcctcatgttggtttaggtcttgagactcgtacagaaacctggatgagttccgaaggggcttggaaacaaatacaaagggtggaaacctgggcgctcagacatccaggctttactgtcatagccttatttctcgcacatgccatcggtaccagtattacgcaaaaaggcatcatattcatactcttaatgttggtaacaccaagtatggccatgcgttgcgttggaatcggtaatcgtgatttcgtagagggcttatcaggcgcgacatgggttgacgtggtgctagaacacggttcatgcgtgacaaccatggctaaaaataaaccaacattggatatagaattgctgaaaacagaagtgacaaatcccgcggtgttgaggaaactatgtatcgaagcaaaaataagtaacacgacaaccgacagtagatgcccgactcagggagaagcgactttagtcgaagaacaagatgctaatttcgtctgtagaagaacattagtagatcgtggttggggaaatggctgcggtctattcggaaaaggatcactgttaacctgtgcgaaattcaaatgtgtaaccaaactagaaggcaaaattgtccaatacgaaaatctcaagtactctgttatagtcacagtacacacaggtgatcaacaccaagttggaaatgagacaacagaacatggaactatagcgaccataacaccacaagcaccaacttcagaaatccaattgacagactatggagccttggcgttagattgctccccacgaacgggtcttgactttaatgagatggtcctgctcacaatgaaggaaaagtcatggctagttcataaacaatggtttctagacctcccattaccgtggacaagcggagcgtcaacatcccaagaaacgtggaaccgacaagacttattggttaccttcaaaacggcacacgccaagaaacaagaagtagtagtgctaggttcgcaagagggagcaatgcacactgcattaactggagcaacagagattcagacatcaggaactactacaatttttgcgggtcacttgaaatgtcgcttgaaaatggataagctaactttaaaaggaacgtcatatgtaatgtgcaccggttccttcaaactagagaaagaagtcgcagaaacgcaacacggaactgtcttagtccaagtaaaatatgaaggcacagacgctccatgcaaaattccatttagtacgcaagatgagaaaggagttacgcaaaacggcaggttaattactgcaaatcccatagtcacagacaaagaaaaaccagtaaacattgaaacggaaccaccttttggagaaagctacatcgttgtcggagcaggagagaaagcattgaaactttcatggtttaaaaagggtagttcgattggaaagatgttcgaagcaacggctcgcggggctagaagaatggccatactaggagacacagcctgggactttggttcaataggcggagtttttacaagtgtagggaaactggtgcaccaggtatttggaactgcgtacggcgtactattttccggagtatcttggactatgaagataggcatcggaattttgctgacatggctaggcctcaatagcaggagcacttcattatccatgacttgcatagcagtaggaatggtaacactttacttaggtgtgatggtgcaagctgattccggatgcgtaattaattggaagggaagggaactaaagtgcggtagtggcatatttgtaactaacgaggtccatacatggacggaacaatacaagttccaggcagactcacctaaacgtctaagtgcagctattggaaaggcatgggaggaaggtgtttgcggtattcgcagtgcaacacgtttggaaaatatcatgtggaagcaaatcagcaatgaattaaaccacatactgttggaaaatgatatgaaatttaccgtagtggttggtgatgctaacggtatcttagctcaaggcaagaaaatgataaggcctcaacctatggagcataaatactcatggaaatcatggggcaaagcaaaaattataggagcagacatacaaaatacgacgtttataatagatgggccagacacaccagaatgtcccgatgaccaacgagcatggaatatatgggaagtcgaggactatggatttggtatatttacaacaaatatttggcttaaactcagagactcatatacacaaatgtgtgatcataggttaatgtcagcagctattaaagatagcaaagctgtacacgcagacatgggatactggatagaaagtgagaagaacgagacctggaaactcgcaagggcatccttcatagaggtaaaaacatgtacgtggcctaagagccatacgttatggagcaacggagttttggaaagcgagatgataatcccaaaaatctacggcggcccaatatcacagcataactaccgaccaggttatttcacacaaacagcaggaccgtggcatttgggcaagctggagttagacttcgacctgtgtgaaggtaccacggtggtagtagatgaacattgcggaaacaggggtcctagtttaagaacaaccacagtaacaggcaaaataattcacgaatggtgttgccgtagctgtactctcccaccgttacgatttagaggggaagatggttgttggtatggtatggaaattcgtcctgtcaaggaaaaagaagagaatttagtcagaagcatggtatctgcagggtctggagaagtggatagtttctcccttggtattttgtgtgtaagtattatgatcgaagaagtgatgagatcaagatggtctagaaaaatgctcatgacagggaccttggcagtatttttgcttcttattatggggcagttaacctggaatgatctaatccgactatgtattatggtaggtgcaaatgcctcagacagaatggggatgggtactacttatttggcgctaatggccacattcaagctccgacccatgttcgcagtcggcattctttttaggagactaacatcacgtgaagtattacttctcacgattggactgtcgttggtagccagtgtggaactaccgaatagtctagaagagttgggagatggcctagctatgggtataatgatgctaaaacttctaacagaatttcagccccaccaactttggactactctcttatccctaacttttataaaaacgactctaagccttgactacgcatggaagactacagcaatggcgcttagcatagtttcattattccctatatgtctaagcaccacatcacagaaaacaacgtggttaccagtattattagggtctttcggttgtaagcccctaacaatgtatttaattacagaaaataaaatatggggacgaaagtcttggcccattaacgagggcattatggccataggaatagtaagcatattactgagctccctattgaaaaatgatgtgccgctggctggacctctaattgccggtgggatgctaattgcctgctatgttatatcaggatcaagcgccgacctaagtctcgagaaagcggcggaagtaagttgggaacaagaagcagaacatagcggaacaagccataacattctggtagaggttcaagacgatgggactatgaggattaaagatgaggagaaagacgatacacttactatattactcaaggcaactttacttgccgtgtctggagtatacccaatgtcaataccagctaccttattcgtatggtacttttggcaaaagaagaaacaacggtcaggagtattatgggatacaccctctccaccggaagttgaacgggcagtcctagatgatggaatctaccgcatactacaaagaggattactaggcagaagccaagtaggtgttggtgtattccaagacggagtttttcacaccatgtggcacgttacacgaggagcggttcttatgtatcagggaaaacgattagagccatcatgggcttcggtcaagaaagacctcattagctatggaggaggatggagatttcaaggcagctggaatactggagaagaagtacaagttattgcagtcgaaccaggaaagaaccccaaaaacgtccaaacgactcctggaacatttaagacccccgaaggcgaagttggggcaatagcactagattttaaacctgggactagcggatcccctatcgtaaacagagaaggaaagattgtcggcctatacggaaacggcgtcgtaactacgtctggcacctatgtaagtgcaattgctcaagcaaaggcttcacaagaagggccgttacctgaaatagaagacgaggtatttaagaaacgcaatctcaccatcatggatcttcaccctggaagtggaaaaacaaggagatacttacctgccattgtcagagaggcaataaagcgtaagctccgaacgcttatacttgctccaaccagggttgtagcgagcgaaatggcagaggcactcaagggcatgccaattcgctaccaaacaacggcggttaaaagtgagcatacaggacgcgaaattgtagatctaatgtgtcatgccacttttacgatgagattactatcaccggtaagggtcccgaactacaatatgataataatggacgaagcccactttacagacccggcttccatcgctgctcggggctatatttcaaccagggtaggcatgggtgaggctgcagcgattttcatgaccgctactccaccaggatctgtagaagcgttcccacaatcgaatgcagtaatacaggatgaggaaagggatattccagaaagatcgtggaacagtggttatgattggataacggacttccctggaaaaacggtttggtttgttcctagcataaaatcaggtaatgacatcgcaaactgcctcagaaagaacggaaaaagagtaatacaattaagtagaaagactttcgacactgagtatcaaaagaccaaaaacaatgactgggattatgttgtaacaacagacatatcagaaatgggtgcgaattttagggcagaccgagtaatagacccaagaagatgcttaaagccagttatactgaaagacggaccagaaagagtgatattagcgggacctatgcctgtaacggtagcgtcagctgctcaacggcgtggtagaattggacgtaaccaaaataaagaaggcgatcaatacgtatatatgggccaacctttaaacaatgatgaagatcatgcacactggacagaagctaaaatgctactagacaacataaacaccccagaagggataatacccgcgctatttgagcccgaacgggaaaagagtgcagcgatagacggtgagtatcggttacgcggagaagccagaaaaacattcgtagaacttatgagaagaggcgacctaccagtatggctttcatacaaggtggccagcgaaggattccagtattctgatcgtcggtggtgtttcgacggagagaggaataatcaagttttagaagaaaacatggatgtggagatttggacaaaggaaggggaaagaaagaaattacgtccgagatggcttgatgcacgtacgtattctgatccattagcactgcgtgaatttaaagagtttgccgcaggaagaagatccgtttccggtgatctaattctcgaaatagggaaacttccacaacacctgacattaagagcacaaaatgcattagacaatcttgtaatgcttcataattctgaacaaggtggtaaagcataccgccatgctatggaagagttaccggacacaatagaaactttaatgctattagcattgatagccgtcttgaccgggggagttatgctattctttctatcaggcaaaggactaggaaagacatctatagggctgctctgcgtaacagcctcttctgcactattatggatggcgtccgtagaaccacactggatagctgcttcaattatactagagttctttcttatggtacttctcatcccagagccggacagacaacgaactccacaagataatcagctagcctatgtagttatcggcctattattcatgatactaaccgtagccgctaacgaaatgggactgctggaaactactaagagagacttagggataggtcatgttgcagcagaaaatcatcaacatgccacaatgctagacgtagatttacatccggccagcgcgtggacattatacgcagtagctaccactgtaataactccaatgatgcgacacaccatcgagaacactacggcgaatatctcattaacagcaatagctaatcaggctgccattttgatgggattagataaaggatggcctatttcaaaaatggatattggcgtacctttattggcattagggtgttatagtcaagtcaatccattaacactaacagcagcagttttaatgctagtagcgcactacgccattataggaccagggttacaggcgaaagccacgagagaagctcagaaaaggactgcagccggaatcatgaaaaacccaacggtcgatggtattgtagcaatcgaccttgatcctgtagtttatgacgctaaatttgaaaaacaattgggacaaataatgttgctaatactatgtacaagccaaatattattgatgagaaccacttgggcattgtgtgaatcaattactttagctacaggacccctaactactctatgggaggggagccctggaaaattctggaacactacaatagccgtcagtatggcaaatatttttagggggagttatttagctggtgcagggctcgccttttctctgatgaaaagtctgggagggggaagaagaggtacgggagcacaaggtgagacgttaggggaaaaatggaaacgtcaactaaatcaattatcgaaaccggaatttaacacttataaaagaagtggaattatggaagttgatcgatccgaagcaaaagagggcctcaaaaggggagaaacgacaaaacatgctgtgtcacgaggaacagccaaattacgatggttcgtggaaaggaacctcgttaaacctgaaggtaaagtaatagatctcggctgtggccgaggaggatggtcttattattgtgcaggtctcaagaaagtcacagaggtaaaagggtatacaaaaggagggcctggtcatgaagaaccaatacccatggccacttacggatggaaccttgttaagttacatagcggaaaagatgtcttctttatgcccccagaaaaatgtgacacattgctatgtgacatcggtgaatcaagtccaaaccctacgatagaagaagggcgtacgttacgcgtgcttaaaatggtggaaccatggttacgtggcaatcaattttgtattaaaatactgaatccgtatatgccctcagtcgtcgaaaccctagaacagatgcaaagaaagcatggaggtatgcttgtacgtaatcctctatcgcgcaattcaactcatgaaatgtactgggtcagttgtggtacaggtaatattgtctcagcagtcaatatgacgtcaagaatgctacttaacagattcaccatggctcatcgaaaacctacttatgaaagagatgtcgacttgggggcaggaacgcgccatgtaactgttgaaccagaggttgccaatttagatattataggtcagcgtatagaaaacattaagaatgaacataaaagcacatggcactacgatgaagataacccttataaaacttgggcataccacggttcatatgaagtgaaaccctccggatctgccagttcgatggtaaacggagttgtaagattgttaacaaagccatgggatgtaataccgatggtaacacaaattgcgatgacagatactacaccttttggccaacaaagggtctttaaagagaaagtagatacacgaacaccaagggcaaaaagaggcaccacacaaatcatggaagtaacagcgaaatggttgtggggatttttgagccgtaacaagaaaccaaggatttgcacaagagaagaatttacacgcaaggttaggtcgaatgcagcaatcggtgccgtgttcgttgacgaaaaccaatggaacagtgccaaagaggcggtcgaagatgaacggttttgggacttagtccaccgggagagagaacttcacaaacagggcaaatgcgccacgtgtgtatataatatgatgggaaagagagaaaagaagctaggagaatttggaaaagctaaaggatctagagcaatttggtatatgtggttgggagcgagatttctggaatttgaagcactcggatttatgaatgaagatcactggttcagccgtgagaactccctctcaggggtagaaggagagggattacacaaattaggctatatcttgagggacatatcaaaaattccagggggaaacatgtacgcagacgacaccgcaggatgggacacacgcattacagaagatgacttgcaaaatgaagctaagattaccgacataatggaacccgaacatgcattacttgctacttccatctttaaattaacctaccaaaataaagtcgtaagagttcagaggcctgccaaaaacggaaccgtaatggacgtaattagtaggagagatcagagaggatcgggccaagttggcacatacggcttaaatacctttactaacatggaagtacagctcataagacaaatggaaagtgaaggaattttcttaccaagcgagttagaaacgcccaacctggcagaacgagtgctagattggctagagaaacacggtgcagaaagacttaaaaggatggccatatcaggagatgattgcgtggtcaaaccgatcgacgaccgattcgcaacagcgttaactgcgctaaatgatatgggaaaggtccgaaaggatatcccacagtgggaaccatctaagggatggaatgattggcaacaagtacccttttgcagtcatcatttccatcaattgataatgaaggacggaagggaaatcgtggtaccttgtagaaaccaggacgaattagttggtagagcacgtgtctcacaaggcgcgggctggtccctaagagagacagcatgcttaggaaaatcatatgcacaaatgtggcaattaatgtattttcacagaagagacctccggctagctgctaatgcaatatgctcagcagtcccagtcgattgggtgccaaccagtcgcaccacatggtcaattcatgcacatcaccagtggatgaccacagaagacatgctttcagtgtggaaccgggtttggatagaggaaaacccatggatggaagataagacacatgtttctagttgggaagaagtaccatatcttggaaagagagaagatcaatggtgtggatcactgattggattaaccgcacgagcgacttgggcgacaaatatacaagtagcgataaaccaggtacgccgtctcattggtaacgaaaattatttggactatatgacatctatgaagagattcaaaaacgagagcgatccggaaggagctctttggtag

SEQ ID NO: 21333 - RNA, 9879 nt, synthetic construct
  misc_feature 1..9879: note = derived and/or modified CDS sequence (opt6) from DENV-1__KF973456__SS-prME
  source 1..9879: mol_type = other RNA
tcagtgactatgctactcatgttattacccactgctctagcatttcacttaactactcgagggggagaacctcatatgattgtaagcaaacatgaacgtggaaaatcgctcctattcaaaacaagcaccggagtcaatatgtgcacattaatagctatggacctaggtgaactttgtgaggacaccatgacatacaaatgtccacgaataacagaagcagaacctgatgatgttgattgttggtgcaatgcaacggatacctgggtaacatacgggacttgctcccaaacaggggagcaccgtagagacaaacgcagtgtggccctggcgccacacgttggtctcggtttagagacaagaacagaaacttggatgagttccgagggtgcttggaaacaaatacaacgtgtagaaacatgggcacttcggcacccaggatttactgtaatcgccttatttttagcacatgcaatcggaacatctataacacaaaaagggataatttttattctgcttatgttggtaacacccagtatggcaatgagatgtgtggggataggaaacagagacttcgttgaaggactaagcggggcaacgtgggtagacgttgtcttagaacatggaagctgcgtgacaactatggccaaaaataaaccaacattagatatagaacttttaaaaacagaagtgacgaacccagcggttttgagaaaattatgcattgaagctaagatatccaatactactacagattcacgctgtccaactcagggggaggctaccctagttgaagaacaggatgccaattttgtatgtagaagaaccctagtcgacagaggttggggcaatggatgtggtctcttcggtaaaggatctctattaacgtgcgctaaattcaaatgtgttactaagttagaaggtaagatagtacaatacgaaaatcttaaatattcggttattgtaaccgtccatacgggtgaccaacatcaagtcggtaatgaaacaacagaacatggaactatagcaacgataactcctcaggctcctacatcggagatccaattaaccgactacggggcactagcccttgactgtagcccaagaacaggattagattttaatgaaatggttctacttacgatgaaagaaaagagctggttagttcacaagcagtggtttctagatttacccttaccctggacctcaggtgcttccaccagtcaggaaacgtggaacagacaggacctattagtaactttcaaaacagcacatgctaagaaacaagaggtagtcgtcctaggatcccaagaaggtgccatgcacacagctttaacaggggctacagagatacaaaccagcggaacaacgactatttttgcaggtcatttaaaatgtaggcttaagatggataaattgacgttaaagggtacctcatatgtaatgtgtactggcagctttaaactcgaaaaagaagtggcagagactcagcatgggacggtcttagtacaagtcaaatatgaggggacagacgcgccttgtaaaatacctttttcaactcaagatgagaagggagtaactcaaaatgggagattaattacggcaaacccaatagtgacagataaagagaaaccggtaaacattgaaactgagcctccatttggtgagagttacatagtagttggtgctggggagaaagcactcaaactaagttggtttaagaagggaagtagcatagggaagatgttcgaagcgactgcaagaggtgctcgcagaatggcgatcttaggagatactgcatgggattttggatctattggaggagtctttacatcagttgggaaacttgttcatcaagtgtttggaacagcatatggcgtcttgttttcaggtgtttcctggacaatgaagattgggataggtatactactgacctggctaggcttaaactctaggagcacctcgctaagtatgacttgcatcgccgtaggaatggtcacactctatctaggtgtaatggttcaggctgatagcggatgcgtgattaactggaaaggaagagaattaaaatgtggtagtggaatattcgttacaaacgaagtacacacatggacagaacaatataaatttcaagcggattcgcccaaaagactttcggcggctatcggcaaagcgtgggaggagggcgtttgtggtatcagatctgcaacaaggctagaaaatataatgtggaaacaaattagcaatgagctaaatcatattcttttagagaacgacatgaaatttacggtggtagtaggggatgcaaatggaatacttgcacaaggcaagaaaatgatacgaccgcaacccatggagcacaaatatagctggaaaagttggggaaaagccaaaataataggagctgatatccagaacacaacttttattattgatgggccagatacacctgaatgtccggatgatcagagagcatggaatatatgggaggttgaggattatggttttggtatatttacaacaaacatttggctaaaattaagggattcatatactcagatgtgcgatcataggttaatgtcagcagctataaaagattcgaaggctgttcacgcagacatgggctattggatagaatctgaaaagaatgagacatggaaactcgcacgagctagttttatagaagtcaaaacatgtacgtggcccaagtctcatactttatggtcgaatggtgtattagaaagtgaaatgatcatacccaaaatttatggtggaccaatatcacagcacaactacagacccggctatttcacacaaacagcggggccttggcatttaggcaaattagaattagacttcgatttatgtgaggggacaactgtggttgtagatgagcattgtggtaataggggcccaagtcttaggaccactaccgttacagggaaaataatacatgaatggtgttgtagatcttgtaccttgccaccactgagatttcgaggagaggatggctgctggtatggaatggaaattaggcccgttaaagagaaagaagagaatctggttagaagcatggtttctgcaggtagcggcgaagtagattcatttagcctaggcatactgtgtgtatctataatgattgaggaggtaatgaggagtagatggagtcgcaaaatgttaatgacaggcacactagcagtttttctattgctcataatggggcagttaacttggaatgacttgataagactttgtattatggtcggtgcaaatgcatcagaccgtatgggtatgggaacgacatatctcgctctaatggctacatttaagctgaggcctatgttcgcggtgggcattttattcagaaggcttacttctcgtgaagtacttctgttgacgattggattatcgttggtagcgtctgttgagttaccaaactcattagaagaactcggagatggtctagcgatgggaattatgatgttaaaacttctgacagaatttcagccacatcaattatggactacattgttgagtttaacatttattaaaacaacactttccctcgactatgcatggaagacgacggcaatggcccttagcatagtttcgttattccccatatgtctttcaacaacgagtcagaaaacgacctggcttcccgtgttgttaggttcattcggatgcaagcctttgacaatgtacttaattactgaaaataaaatatgggggagaaaatcgtggccaataaatgaaggcataatggcaataggtattgtatctatcttattatcatcactgctgaaaaatgatgttcctttagcgggacctctaatcgctggtggaatgttaatcgcatgctacgtaattagtggatcatccgctgatttatcattggagaaggctgcggaggtatcctgggaacaggaagcagaacacagtggaacaagtcataacattttagtagaggtacaagatgatggaacaatgagaataaaagacgaagagaaggatgatactttaacgattttactgaaagcaacgttactggctgtatcaggagtttatcctatgtcgattcccgcaacactattcgtctggtatttttggcaaaagaagaaacaaaggagcggagttctttgggataccccatctcctccagaagtagaaagggccgtccttgacgatggtatttataggatattacagcgcggattattaggtagaagccaagtcggagtaggcgtatttcaagacggagtgtttcatactatgtggcacgttacaagaggagcggttcttatgtatcaagggaagcgtttggaaccgagttgggcatctgttaagaaagatcttatcagctatggcggaggatggagatttcaaggaagttggaatacaggcgaagaagtgcaggtaatcgccgtagaaccaggcaaaaatcctaagaatgtacaaaccacgcctggaaccttcaaaactcctgaaggagaagtcggggccatagcactcgattttaaaccgggcacaagtggctctcccattgtaaatagagaagggaaaatagttggcttatatggtaatggagttgtgaccacatctggaacttatgttagtgcaatcgcacaggcgaaggcttctcaagaagggcctctaccagaaatagaagacgaagtatttaagaagcgcaatttaactatcatggatctgcacccaggcagtggcaaaacacgacggtacttaccagcgatagttcgggaagcaataaaaagaaagctgagaacactaatactagcaccaacacgagtggtagcttcagaaatggcagaggctttaaaaggaatgccaataagataccaaacaaccgccgtaaaatcagaacataccggaagagaaatcgtagatttgatgtgtcatgccacatttaccatgcgcttgctatcacctgttagggtgcccaattataacatgataattatggacgaagcacattttacagacccggcttccatagcagcaagaggctatatttccacaagagtcggtatgggtgaagcggctgccatattcatgaccgcgactccgcctggtagtgtagaggcatttccgcaaagtaacgcagtgattcaggatgaagaacgcgatataccagaaagatcatggaactctggatatgactggattaccgattttcccggtaaaactgtatggtttgtaccatcgataaaatcagggaacgatatcgcaaattgtttgcgcaaaaacggaaagagagttatacaattaagtaggaaaacattcgacacagaatatcaaaagaccaaaaataatgactgggactacgtcgttacaacagacatatccgaaatgggcgctaatttcagggctgatagagtaatagatccccgtagatgcctaaaacccgttattctgaaagatggtccagaaagggtcatacttgcaggaccaatgcccgtcacagttgcgagtgcagcccaaagacgaggtcggataggccgtaatcaaaataaagagggagatcaatacgtgtacatgggtcaaccgctgaataacgatgaagatcatgcccattggacagaggctaaaatgctattagataatattaacacacccgaaggtataatacccgccctttttgaaccagaaagagaaaagagcgcggctatcgatggtgagtatagactaagaggcgaggcaagaaaaacctttgttgaactaatgcgacgcggagacttgcctgtttggttgtcctataaggttgcaagcgaaggtttccaatattctgacagacggtggtgtttcgatggtgagaggaacaaccaggttctggaagaaaatatggacgttgaaatctggactaaggaaggagagaggaagaaactcagaccaagatggctagacgccagaacctattccgacccgctagcacttcgagaatttaaggaatttgctgcaggcagacgtagtgtttctggagatttaatattagaaataggtaagttacctcaacaccttactttgcgcgctcagaacgcacttgataaccttgtcatgctacataatagtgagcaaggtggaaaagcctatcgacacgcaatggaagaattgccggacactatagaaactcttatgttattggctttaatagctgtactaacaggtggcgtgatgctatttttcttatctggtaaaggacttgggaagacctcaatagggttattgtgcgtaactgcatcaagtgccctcctttggatggcgtccgtagagccacattggatagctgccagtataattttagaatttttcctgatggtgctactgataccagagcctgacaggcagcgtacacctcaagataaccagttggcctatgttgtaataggtcttctttttatgatcttaacagtcgctgcaaatgagatgggtctattagaaacgacaaaacgggacttgggcataggacatgtagcagccgaaaatcatcaacatgcaacaatgttagacgtcgatttacgtcccgcctcagcctggacactatacgcagtggctactactgtcataactccaatgatgagacataccatagaaaatacaaccgcaaatatctcattgacggcaatagctaatcaagccgcaatcttgatggggctcgataaagggtggccaatcagcaagatggatataggtgttccacttctggcattgggatgttatagtcaagtgaatccattaacattaaccgccgcggtgcttatgttagtagcccattacgcaataataggaccaggattgcaagcgaaagcgactcgtgaggctcagaagaggactgctgcaggcataatgaagaacccgaccgtagacgggattgtagcgatagatttggatccagtggtgtatgatgcgaagtttgaaaaacaacttggacaaatcatgctgctaattttgtgtacatcgcagatcctacttatgaggaccacatgggctttatgtgaaagtataacattggcgacagggccactcacgactttatgggaaggatcgcccggaaaattttggaatacaaccattgcagtttcgatggcgaacatattccgcggatcgtatcttgcaggagctggcctagcattctctttaatgaaatccttaggtggaggacgtagaggcacaggtgcacaaggtgagacattgggagaaaagtggaaaagacaactgaatcagttaagtaagccggagttcaacacttataagaggagcggtattatggaggttgataggtccgaggccaaagaaggtctgaaaagaggagaaacaaccaagcatgctgttagtagaggcactgcgaaattgaggtggttcgtagaacgaaacctagttaagccagagggaaaagttatagatctgggctgtggtagaggaggctggtcttactactgcgccgggctcaagaaagttactgaagtaaaaggctatacaaaagggggaccgggacatgaagaacccatccccatggcaacctacggatggaacctcgtaaaactccactcaggtaaagatgttttcttcatgccgcccgaaaaatgtgataccctcttatgtgatattggtgagtcatctcctaatccgacaatagaagaaggaaggacactaagggttttaaaaatggtagaaccatggcttcgaggcaatcaattttgtataaagatactgaatccatatatgcccagtgtagttgagactttggaacaaatgcaaagaaaacacggaggaatgctagtacgtaatccattatccagaaactcaactcacgaaatgtactgggtgtcttgtggcacgggaaatattgtatcggcagtaaatatgacatctagaatgttactcaatagatttaccatggcacataggaaacctacctacgagagagatgtggacctaggagcagggacccggcatgtcaccgtcgagccagaagtagctaatctagatatcattggacaacgtatagagaacatcaaaaatgaacataagtctacttggcactacgacgaagacaacccatacaagacgtgggcgtatcacggcagttatgaagtcaaaccaagtggttccgctagttcgatggttaatggggtcgtgagacttttaactaagccatgggatgttattccgatggtgacacaaattgctatgacggacacgacaccgtttggtcaacaacgcgtttttaaagaaaaggttgatacgcggacccctcgtgcaaagaggggtacaacgcaaataatggaagttacagcaaagtggctttgggggtttttgtcaaggaataagaaaccaagaatctgtactagagaggagttcacacgcaaggtcagatcaaatgcagcgatcggagctgtctttgtagacgaaaatcagtggaatagcgcaaaagaggcagttgaggacgaaaggttttgggatttagtccatagagaaagggagttacataagcagggaaagtgtgcaacatgtgtatacaatatgatgggaaaacgagaaaagaaacttggagaatttggcaaagcgaagggttcaagggctatatggtacatgtggttgggagccagatttcttgagtttgaagccttggggttcatgaatgaagatcactggtttagtcgagaaaacagcttatcaggtgtagaaggcgaaggactccacaaactagggtatattctgcgcgatataagtaaaattccaggaggaaacatgtacgcagacgatactgcaggttgggatacaagaataacagaagacgacttgcaaaatgaagcaaaaataacggacataatggaaccagagcacgccctactagcgacgagcatatttaaactcacttatcaaaataaggtcgtaagagttcagcgtccagccaaaaacggaacggttatggatgtgattagtagacgtgatcaacgggggagtggacaagttggaacgtatgggcttaatacttttacaaatatggaagtacaactaatacggcagatggaatcagaagggatatttcttcctagtgagcttgaaacaccaaatctagctgaacgtgttctggattggttagaaaaacatggggctgaacgactaaagaggatggcaattagtggggatgactgtgttgtaaaacccatagatgacagattcgccaccgccttgactgcccttaatgatatgggaaaagtacgaaaggatataccgcaatgggaaccctcaaaaggatggaatgactggcaacaagtcccgttttgctcacaccactttcaccaattaataatgaaggacggaagagaaatagtagtcccatgtagaaatcaagatgagttggtcggtagagcgcgtgtatctcaaggtgcaggctggagtttacgggagacagcgtgcttgggtaaatcatatgcacaaatgtggcagcttatgtatttccatcggagggacttaagattagctgccaatgcaatctgttctgctgtaccagttgattgggtacccacatccagaacaacgtggagcatacatgcgcaccatcaatggatgacaacagaggatatgcttagtgtatggaaccgggtctggattgaagagaatccgtggatggaagacaaaactcatgtgtcgtcatgggaagaggtgccttatttaggcaaacgagaagatcaatggtgtggaagtttaatcggtttaacggctcgggcaacttgggcgacgaacattcaagttgctatcaatcaagtgaggagattaataggaaatgaaaattaccttgattatatgacgtcgatgaagaggttcaaaaacgaaagtgatccagaaggagcattgtggtag

SEQ ID NO: 21334 - RNA, 9879 nt, synthetic construct
  misc_feature 1..9879: note = derived and/or modified CDS sequence (opt6) from DENV-1__KF973459__SS-prME
  source 1..9879: mol_type = other RNA
tcagtaactatgttacttatgttattacccactgcactagcattccatttaacaacaagaggcggcgagccacatatgattgtatcaaaacaagaaagaggtaaaagtcttctattcaaaacatcagctggggtaaatatgtgtacactgatagccatggatctaggtgaattatgtgaagatacactaacttataaatgtcctcaaataacggaggcggaaccggatgacgtagattgttggtgtaacgctaccgacacatgggttacttacggtacgtgcagtcaaactggagaacatagaagggacaaacggtcagtagctttggctccacacgtgggattagggttagaaacacgcacagaaacctggatgagttcagagggggcctggaaacaaatacaaagggtagaaacatgggctctgcgtcatccaggattcacagttatagctttgtttctcgcacatgctataggtacttcaattacacagaaaggaattatatttatactattaatgctcgtaacaccgtccatggctatgcgatgcgtgggaataggtaatagggacttcgtagaaggtctttctggtgcaacgtgggttgacgttgtattagaacatggatcttgcgtaacgactatggccaaaaataaaccaacattagatatagaattactaaaaacagaagtgaccaaccctgctattttaaggaaactatgtatagaagcaaaaattagtaatacaactacagatagtagatgtccaactcaaggtgaagccactctggtagaagaacaagacgccaatttcgtatgtcggcgaacatttgttgacaggggatggggcaacggctgtggtcttttcggaaaagggtcactgctaacgtgtgctaaattcaaatgcgtcactaaacttgaggggaaaatagtccagtacgaaaacttgaagtatagtgtaatagttactgtacatacgggagaccaacatcaagtcggaaatgaaacaacagaacacggaacgatcgctacaataactccgcaggctccaacgtcggaaatacaattaactgattatggtgctttaactcttgactgctcacctcgcacaggtctcgattttaatgagatggtgttactgacgatgaaagagaaatcttggttggttcataaacaatggtttctagatctccctcttccatggacaagtggagccagcacgtcacaagaaacgtggaatcgacaagatttgctcgttactttcaaaacagcccacgctaagaaacaggaagtggtcgtacttggatcacaggaaggcgcaatgcataccgctctgacgggagcaactgagatacaaacatcaggaacgacaaccatatttgcaggacatttgaaatgtaggttaaaaatggataaacttacactaaaaggtacttcatatgttatgtgcacaggtagctttaaattagaaaaagaagtcgcagaaacccaacatggaaccgttttagtacaagtcaaatacgagggtaccgatgcaccctgcaaaatacctttttcaacacaagacgagaaaggggttactcagaacggtcgtttaatcactgccaatcccatagtgaccgacaaggagaaacctgtcaacatagaaacagaaccaccctttggtgaaagttatatcgtggtcggagcaggagaaaaggcgcttaaactttcatggtttaagaaaggctcatcaatagggaaaatgttcgaggccacagcacgtggtgcgcgccgaatggcaatcctaggtgacacagcatgggacttcggatcaatagggggtgtgtttacctctgtaggcaaattagtacatcaagtcttcggaacagcctacggagtattattctcaggagtaagctggacaatgaagatagggattggaattttgcttacgtggctaggcctcaacagtcggtcgacaagtctgagcatgacatgtattgcagttggcatggtaaccctatatttaggtgtaatggtccaggcagattcaggatgtgtcatcaactggaaaggaagagagttaaaatgtggtagcggaatctttgtaactaatgaagttcatacatggacagaacaatacaaattccaagcagactcaccaaaacgtctttcggcagccatagggaaagcatgggaagaaggtgtgtgtggcataagaagcgcgaccagattagaaaacatcatgtggaagcaaatttctaatgaactcaaccatatattattagaaaacgatatgaaatttactgtcgtggttggtgatgctaacggaatattggcgcaaggcaagaaaatgattcgaccacagcctatggaacacaaatatagctggaaatcctggggaaaggctaagattataggcgcagatatccaaaacacaacatttataattgatggacctgacaccccagaatgtccagacaatcaaagagcatggaacatttgggaagttgaggattacggtttcggcatcttcactacgaatatttggttaaaactgagagatagttacacgcaagtttgcgatcacagactaatgagcgcggccattaaagactcaaaggcagtccacgccgatatgggatattggatcgaatccgagaaaaatgagacatggaaattagcaagggcgtcttttatagaagtaaaaacatgtacttggcctaaatcccacacgttatggagcaatggggttttagaaagcgaaatgataataccaaagatttacggtggaccaataagccaacataattatcgaccagggtacttcacacaaactgcagggccatggcatttaggcaaactcgaactagatttcgatttatgtgaaggtaccaccgtcgtggtagatgaacactgtggcaatcgaggtccatcattaagaactacaaccgtcacagggaaaatcatacatgaatggtgctgtaggagttgtactttgccacccctccgatttcgcggagaggatgggtgttggtatggtatggaaataagaccagttaaagaaaaggaggaaaatctagttagatctatggtttcggccggaagtggtgaagttgattctttatctttagggatattatgcgcctcaataatgatcgaggaagtaatgagaagccgttggtctaggaaaatgttgatgacgggcacactagctgtttttcttttgctcataatggggcaactgacgtggaatgatttgataagactatgtattatggtgggagccaatgcatcagatagaatgggtatgggtacaacctacttagctcttatggctacttttaaaatgcgtcccatgttcgctgtcggtttactatttaggagactaacaagtagggaagttcttttattaaccataggactttccttagtagcgtctgttgaattaccaaatagtctagaagaactgggtgacggactcgcaatgggtatcatgatgcttaaattattgacggaatttcaaccacaccagttatggacaacacttttaagtttgacatttattaaaactacactaagcctagattatgcctggaaaactactgcaatggctctgagcattatctccctttttcctttgtgcctatcgacgacatcgcaaaagacaacgtggcttccagtgttattagggagcttcggatgtaaaccacttaccatgttcctgataaccgaaaataaaatttggggtcgtaagagttggcctctcaatgaaggcattatggcgataggtattgtaagtatcctactttcttccttactaaagaatgacgtacctttggccggaccattaatagctggtggtatgttaatagcatgttatgtaatatcagggtcctctgcagacttgagtttggaaaaagcagcagaagtatcatgggagcaagaagcagagcattccggcacaagtcataatatcttagttgaagtacaagatgacggaactatgaaaatcaaagacgaagaacgagatgataccttgactattctactaaaggcgaccctcttggcagtcagtggagtatacccaatgtcaatacctgcaacattattcgtctggtatttctggcagaagaagaaacaaagatccggcgtgctctgggatactccatcgcccccagaggtagaacgagcagttctcgatgatggtatttatagaatcttgcaacgaggactactcggtagaagtcaggtgggtgtcggtgtattccaggacggtgtctttcatacaatgtggcacgtcacacgtggagctgtactaatgtatcaaggtaagaggttagaaccaagctgggcatcagtcaagaaagatctcatatcttacggtggaggatggagatttcagggatcctggaacactggtgaggaagtacaagtgattgcggtcgaaccagggaaaaatcccaaaaatgtacaaacaactccaggaacttttaaaacccctgagggagaagtcggtgcaatagcccttgattttaaaccaggaacgtcaggctcgccgattgttaatcgagaaggaaaaatcgttggcttatatggtaatggagtagtaaccacatcaggtacctacgttagtgccattgcccaagccaaagtctcacaggaaggtcccttaccagaaatagaggacgaagtattcaagaaaagaaatctaaccataatggacttacatccaggatccggcaaaacacgcagatatttgccggcaatagtaagagaagcaatcaaacgcaaattaagaacccttatactggcaccgacaagagttgtcgcctcagaaatggctgaagcactaaaaggaatgcccatcagataccaaactactgcagtaaagagcgaacacacggggcgcgaaattgttgacttaatgtgtcatgcgacctttacgatgcgtctcctctcaccagtcagagtaccaaattataatatgatcataatggacgaagctcatttcacagatcctgcaagcattgctgcacgtggatatataagtacacgagtgggcatgggcgaagctgccgcaatctttatgactgccacaccacctggatctgtcgaagcgttcccacaaagcaacgctgttattcaagacgaggaacgggacattccggagagatcgtggaactcaggatacgattggataacagattttcctggaaaaacagtttggtttgttccaagtataaaaagcggaaatgacattgctaactgtcttaggaaaaacgggaaaagagttatccaattatcacggaaaacgttcgacacagagtaccagaaaaccaaaaataacgactgggattatgtcgttactacagatattagtgaaatgggagcaaactttagagccgatcgcgttattgacccaaggcgatgtttaaaaccagttattttgaaagatggccctgagcgagtcatcttagccggacctatgccggtgacagttgcgagtgctgcccagaggagagggagaattggacggaatcagaacaaggagggagatcagtacgtctacatgggacaaccattgaacaacgatgaagatcatgctcattggacagaggcaaagatgctattagacaacataaatacaccggaaggcattatccctgcactttttgaaccggaaagggaaaaatcagcagctattgacggagaatatagattgagaggcgaggcgaggaaaacctttgtcgaattgatgcgcaggggagatttaccagtatggttgagttataaagtggcgtctgaaggatttcagtatagcgataggcgatggtgctttgatggggaaagaaataatcaggtactggaagaaaatatggacgtcgaaatttggacaaaggaaggtgaaagaaagaaactacgcccaaggtggttagatgcacgcacatacagtgaccccctagcacttcgagaatttaaagaatttgcagcaggtcgtcgttcagtaagtggagacttaatactggagatcggaaaacttcctcaacacttaaccttacgagctcaaaatgcccttgataatctagtcatgttacataactcggagcaaggaggaaaggcttatagacatgctatggaagaactgccagataccatcgaaactctaatgcttctcgcactgatagcagtactaaccggtggcgtaacactattctttctttcgggtaaaggactaggaaaaaccagcataggtcttctatgtgtgacagcgagtagcgcgttactatggatggctagcgtagaaccgcactggattgctgcatctataatattagaatttttcctcatggttctattaatccctgaaccagaccgacaaagaacaccacaagataatcagcttgcgtatgtagttataggattattgttcatgatccttacagtcgctgcaaacgaaatgggactacttgaaacaacgaagaaagatttagggattggtcatgttgctgccgaaaaccatcagcatgcaactatgctcgacgtagatcttagacctgcatccgcctggacattatatgcagtcgctactaccgtaatcacaccaatgatgcgtcacactattgaaaatacgacagcaaatattagcttaactgcgatcgctaatcaagctgctattcttatgggattagacaaaggttggcctataagtaagatggatattggagttccattactggcactaggatgttattcgcaagttaatcccttaaccctgacggcagcggttttgatgttagtagcacattatgctattataggacctggattacaagcaaaagctaccagggaagctcagaaacgaacggctgcaggaattatgaagaatccaacagtagatggtatcgttgccatagacttggatccagtcgtttacgacactaaatttgaaaaacaactaggacaaatcatgttactcatactttgtacaagtcaaatattgctaatgagaaccacatgggccctgtgcgagagtataacacttgcaactggtcccctgaccactctttgggaaggatctcccgggaaattctggaacactaccatagctgtatccatggctaatatattccgaggttcatacttagcaggagcagggttagcattctccttaatgaaaagtttgggaggcgggcgaaggggcactggcgcgcagggcgaaactttaggcgaaaagtggaagaggcaacttaatcaactctcaaaaagtgagttcaatatttacaaaagatctggtataatggaagtagataggagcgaagcgaaagaaggcttaaaaaggggtgaaacaactaagcatgccgtatccagggggacagctaaactacgttggtttgttgagcgaaatttggtaaagcccgagggaaaagtgattgatctcggttgcggaaggggaggctggtcttactattgcgctggactaaagaaagttacggaagtaaaaggatacactaaaggagggcccggccatgaggaaccaataccaatggcaacttacggatggaatctagttaaactacacagcggaaaggatgtcttctttatgccacctgaaaagtgtgacacattattatgcgatattggggagagctctcctaacccaactatagaggaggggagaacattgcgagtactcaaaatggttgaaccctggttaaggggaaatcaattctgtattaagatactaaacccttacatgccttccgtggtagaaaccttagagcaaatgcaacgaaaatatggaggtatgcttgtacgcaacccattgtcaagaaattcaactcacgagatgtattgggtatcttgtggtacgggcaatattgtttccgctgtaaacatgacctcaagaatgctactgaaccgttttacaatggcacaccgtaaaccgacatatgaaagagatgtagaccttggggcagggacgagacatgtagcggttgaaccagaagtagcgaatcttgacattataggccaacgaatcgaaaacatcaaaaatgaacacaaaagcacttggcattatgatgaggataacccttacaaaacatgggcatatcacggttcatatgaagtaaaaccatcaggaagcgccagttctatggtcaacggagttgttcgacttttaacaaagccatgggatgtaattccaatggtgacccaaatcgccatgacagacactacaccattcggacaacaacgggttttcaaggaaaaagtagatacgaggactccgagagctaaaaggggaactactcaaataatggaagtgaccgccaaatggctctggggcttccttagtcgaaataagaaaccgcgaatctgtacaagagaggaatttacgcgtaaagtcagatctaatgccgccataggtgctgtgtttgtagatgagaatcagtggaatagcgcgaaagaggctgtcgaggacgaacgcttctgggatcttgtacacagggaaagagagctacataaacaagggaaatgcgctacttgcgtttataatatgatgggaaagcgagaaaagaagttaggtgaatttggaaaagctaaaggatcaagggctatctggtatatgtggctaggagccaggtttttagaatttgaggcattaggattcatgaacgaggatcattggttttcacgtgaaaattcactttcaggtgtagagggcgagggacttcataagttaggatacatactgagagatataagtaaaattccaggtggtaacatgtacgcagatgataccgcaggctgggacactcgaatcaccgaggacgacctccaaaatgaagcaaagataaccgatatcatggagcccgaacacgcattacttgctacttcaatctttaaactcacctaccaaaataaagtggtgagagtccaacgacccgcgaaaaatggaacagtaatggacgtaatttctcgtagagatcaaaggggaagcggacaagtagggacatacgggctaaacacattcaccaatatggaagttcagctaattagacaaatggaaagtgagggaatatttttaccaagcgaactagaaacgccaaatttagctaagagggtactagactggctagaaaaacatggagcagaacgacttaagagaatggcaatatcaggagatgattgcgttgtcaaaccaatagatgatcgattcgcgaccgctttgacggcccttaacgatatgggaaaagtaaggaaagacatacctcaatgggaacccagtaaaggatggaacgactggcaacaagtcccattttgcagccaccattttcatcaattgattatgaaggatgggagggagatagttgtaccgtgtcgtaatcaagacgagctggtcggtcgggcccgagttagtcaaggtgcgggatggtctcttagagaaacggcatgtctgggtaagtcttacgctcaaatgtggcaattaatgtacttccacagaagagatcttagattagcagctaatgccatttgctcagccgtaccagttgattgggttcccacatcaaggactacatggagcattcatgcgcaccaccaatggatgacaacagaagacatgctatctgtttggaaccgcgtttggatagaagagaacccatggatggaggataagacacatgtatcgagttgggaggaggtcccttacctcggaaaacgagaagatcaatggtgtggtagtctgattgggttaacagcaagggcaacatgggcgacgaatatacaagtggcaatcaaccaagtcagaaggctaatcgggaatgaaaattacctagactatatgacaagcatgaagcggttcaagaacgaatctgatccagaaggagctctatggtaa

SEQ ID NO: 21335 - RNA, 9879 nt, synthetic construct
  misc_feature 1..9879: note = derived and/or modified CDS sequence (opt6) from DENV-1__KF973460__SS-prME
  source 1..9879: mol_type = other RNA
agtgtgaccatgctattgatgctgcttcctactgccctggcttttcatttaactactagaggtggagaaccacatatgatcgtatcgaaacatgaaagagggaaatccttacttttcaaaacaagtactggagtgaatatgtgtacattaatagctatggatctcggagaattatgtgaagacacaatgacgtacaaatgcccgagaataacagaagctgaaccagatgatgttgactgctggtgtaacgcaacagatacatgggtgacctatggaacatgtagtcaaactggagaacatagaagggataaaagatctgttgccctagcgccacacgtcggcttaggattggaaactagaacagaaacatggatgagttcggaaggagcttggaaacaaattcaaagggtggaaacctgggcactaagacatcctggatttactgtaatagccttattcttggcacatgctataggtacttcaatcacccaaaaaggaataatttttatactattgatgttagtaaccccatcaatggcgatgcgatgcgtaggtattggaaatagagatttcgtggaaggattgtcgggagcaacgtgggtggatgtagtgctggaacacggaagttgtgtaactactatggctaaaaacaaacctacattggacatagaattactaaaaacggaagttacgaaccctgccgtgttgaggaaattatgtattgaagcaaaaataagtaatacaacaacagactcaagatgccccactcaaggagaagctactctcgtggaagaacaagacgctaattttgtttgtcgtcggactttagtagaccgtggttggggaaacgggtgtggattgttcggtaaaggatcattactaacctgcgcaaaatttaagtgcgttacaaagttagaaggaaaaatagtccaatatgaaaacctgaaatatagtgttatagtgacagtgcatacaggcgatcaacatcaagtcggcaatgaaacgaccgaacacggaacaatagccacaatcacaccacaagcacctaccagcgaaatacagcttaccgattatggagcattggcactagattgttcaccaaggactggactagactttaacgaaatggtgcttctaacgatgaaggaaaaatcttggcttgttcataaacaatggtttttggatctgccgttaccctggacttcgggtgctagcacaagccaggaaacctggaataggcaagatttactggtcactttcaaaacagcacacgcgaagaaacaagaagttgtagttctgggttcacaggaaggcgctatgcatacggcgttaactggtgctacggaaattcaaacgagtggtactactactattttcgccggacacctaaagtgtcgattaaagatggacaaattaacattaaaagggacaagttatgtgatgtgcacgggcagcttcaaacttgaaaaagaggttgcagaaacacaacacggtactgtcctagttcaagtcaaatacgagggcacagatgcgccatgcaaaataccattcagtacgcaagatgaaaagggcgtcacacagaacggtagattgataacggccaaccccatagtgacagataaagagaaaccggtaaacatagaaactgaacccccttttggcgaatcttacattgtggtgggagctggagaaaaagctcttaaattatcttggttcaagaaaggatcttctattggaaaaatgtttgaggctactgctcgcggcgcgagaaggatggccatattgggggataccgcttgggattttggaagtatcgggggagtatttaccagcgtaggaaagttagtccatcaagtatttggaactgcttatggagtgttattctcaggagtaagctggacaatgaaaattggcataggtatcttattgacttggttaggtttaaactccagatctacttccttgagcatgacgtgtatcgctgtagggatggttaccttgtacttaggtgtgatggtacaagcagattctggatgtgttataaactggaaaggcagagaactaaagtgcgggtctggaatatttgtgactaacgaagttcatacctggacagaacaatacaaatttcaagccgacagtccaaaaagattgtccgcggccattgggaaagcgtgggaagagggcgtgtgtggaataagatcagctacaagactagaaaatataatgtggaagcaaatatccaatgaattaaatcatattttgttggaaaacgatatgaaatttacggtcgtggtaggtgacgcaaatgggatattagcacaaggtaagaagatgatacgaccgcagccgatggaacacaaatactcatggaagtcatggggtaaagcgaaaataataggtgcggatatacaaaataccacttttattatcgatgggccagacactccagagtgcccggatgatcagcgtgcttggaatatatgggaagtggaggattacggttttggaatattcactacaaatatctggctgaaattaagggactcgtacacgcaaatgtgcgatcacagactcatgtcagccgctataaaggattcaaaagcagtccatgccgacatgggttattggatagaatccgagaaaaatgaaacttggaaactagcacgggcatcatttatcgaagtgaagacgtgcacttggcccaaatcccacacactttggagtaacggcgtgttggaaagtgagatgataataccgaaaatatacggaggccctataagtcaacacaactatcgcccaggttattttacacagacggcgggcccttggcatctcggcaaattggagttagattttgatctatgcgaaggtaccactgtagtagtagatgagcattgtggtaatcgtggtccttccctgcgaacgacaaccgtaacaggaaagataatacatgaatggtgttgcagatcatgcaccctacctcccttacgatttcgtggtgaagacggatgttggtacggaatggaaatccgaccggtaaaggaaaaagaagaaaatttggtcagatcaatggtatctgcaggatccggagaagtcgatagtcttagtttgggaatcctatgtgtcagcataatgatagaagaggtgatgagaagtaggtggagccgtaagatgttaatgacaggcactctagcagtctttcttctcctgataatgggacagcttacctggaatgacttaatcagactgtgcataatggttggcgctaatgccagtgatagaatgggtatgggaacgacatacctcgcactcatggcaacatttaaattacgtccgatgtttgcagtaggcattctatttaggagactaacaagcagagaagttttattgctaacaataggtttatcgttagttgctagtgttgaattacctaactcattggaggaactaggagatggtttagcaatgggaataatgatgctcaaactgttaaccgaatttcaaccacatcagctatggactactttgctatctttaacatttataaaaactactttgtccctcgactatgcctggaaaacaacagcaatggcattaagtatagttagccttttccccctatgtttaagtacaacctctcaaaagaccacctggctaccagttttactagggagtttcggttgtaaaccacttacaatgtattttattacagaaaacaaaatctggggtcgaaagagctggcctataaatgaagggatcatggcaatagggattgtaagtatactcctgtctagtctcctaaagaatgatgtgcctttagcaggtcccctaatagccggaggaatgctgatagcgtgttatgttataagtggaagcagcgctgacttgtcgttagagaaagcagcagaagtgtcatgggagcaagaagcagaacattcaggaacttcccacaacattcttgtggaggtacaagacgatgggactatgagaatcaaagatgaggagaaagatgatacattaactatcttattgaaagccacacttctagctgtgtcaggagtctacccaatgtcaattcctgcaactctatttgtctggtatttctggcagaagaagaaacaacgttcaggagtattgtgggatacaccatcaccacccgaagtagaaagagcagtactagacgatggtatatacaggatattacaaaggggtttactaggacgaagccaagttggagtaggcgtatttcaagatggagtatttcatacaatgtggcacgttacgaggggagctgtattaatgtaccaaggaaaaagattagaaccatcatgggcgagtgttaaaaaggacttgatatcgtatggcggaggctggagatttcagggcagctggaacactggtgaagaagtacaggtgatagcagtcgagccaggcaaaaatcctaaaaacgttcagacaacccccggtacattcaaaaccccagaaggagaagtaggagcaattgctttagatttcaaaccaggaacctcgggctcaccaattgttaatagggagggaaaaattgtaggtttatacggtaacggtgttgttactacatccggaacgtacgttagcgccattgcccaagcaaaggcatcacaagaagggccactacccgagatagaagatgaagttttcaaaaagcgcaatttaactataatggatttacacccaggtagtggtaaaacacgtcgatatttgcctgctatagtgcgagaagcgataaaacgtaagctaagaaccctaatactagcgcctactagagtagttgcatcagaaatggcagaggctttgaaagggatgcccatccgatatcaaacaactgcggtaaaatcagaacacactggacgggaaatagttgatttgatgtgtcacgcaacgtttacaatgcgattattaagcccggtaagagtacctaattataatatgataatcatggatgaagcacatttcacagacccagcgtcaatagcagctaggggatacatttcaactcgagtcggaatgggcgaagcagcagcaatatttatgaccgcaactcctcctggttcagtagaggctttccctcagtcaaatgctgtaatacaagatgaagaaagggacatccctgaaaggagctggaatagcggatatgactggataacagacttccctggaaagacagtatggtttgtcccatccataaaatcaggaaacgatatagctaattgcctgagaaagaatggaaagagagtaatccagcttagtcgaaaaaccttcgacacagaataccagaaaacgaaaaataacgactgggattatgtcgtaacgacagacatatcagaaatgggggctaattttcgagccgacagagttatagatccccgccgttgcttaaaaccagtgatactcaaggatggaccggagagagtgatactagcagggccgatgccggttacagtagccagcgcggctcaaagacgggggcgtattggaaggaaccagaataaggaaggcgatcagtatgtctatatgggacaaccacttaacaatgacgaagaccatgcccactggaccgaagccaaaatgctgttggataatataaatactccagaaggaatcattccagccctattcgagcccgaacgcgagaaaagcgcagccatagacggcgaatatcgcttaagaggtgaagctcgcaaaacgtttgtagagctaatgagacgcggcgatttaccagtgtggcttagctataaagttgcctctgagggatttcaatattctgatagaagatggtgttttgatggtgagaggaataatcaagttcttgaagaaaacatggatgtggaaatttggacgaaagaaggagaaaggaagaaattgcgacctcgatggctggacgctagaacttacagtgatcctctagcacttcgcgagttcaaagaatttgctgcaggaagaaggtctgtttcaggagatctaatactagagattggtaaattaccacaacacttaactttgcgagcacaaaacgctcttgataatcttgtcatgctacataattcagaacaaggaggaaaagcatacagacatgccatggaagaactgccagatactatagaaactctcatgttgttggccctaattgcagtcttaacgggtggagtgactttatttttcctaagtggtaaaggcttaggaaagacaagcatcggccttctgtgtgttacagcttccagtgcgctgttatggatggcatccgtcgaaccacattggattgcagcaagcatcatactagaatttttcttgatggtattactcatccctgaaccagatcgccaaagaacaccacaggataatcagcttgcatacgtagttattggactgctattcatgattttaacagttgcagcaaatgagatgggactactagaaacaacaaaaagggatctcgggataggacatgttgctgccgaaaatcatcaacatgcaacaatgttagacgttgaccttagacctgcatctgcatggacactgtacgcagtggcaacaacggttatcacaccgatgatgagacacactatagagaacacaaccgcaaacataagtctaacagccatcgcaaatcaagcagccatactcatgggtttagacaaaggatggccgatctcgaaaatggatattggtgttccattattagccttaggctgttacagtcaggtgaatccactcacgttaacagcagcagtattaatgttagttgcacattatgcgataatcggaccaggtttacaggcgaaggctacccgagaggctcagaaaagaaccgcagcaggcataatgaaaaacccaacagtcgatggtatagtagctattgacctggaccccgtggtatacgacgctaaattcgaaaaacaattaggacagataatgcttctcatcctatgcatctcccaaatattattaatgcgaacgacatgggcactatgtgagtcaataacattggcaaccggaccattgaccacattatgggaagggtctccgggtaaattctggaacacaacaatcgccgtgtcaatggcaaacatatttagaggaagttacctcgccggagcgggtctcgcattttcactaatgaaatcattagggggaggtcgaagaggaactggagcgcaaggtgaaaccttaggggagaagtggaaaagacaattgaatcaacttagtaaaccagagtttaacacttataaaagatctggtataatggaagttgatagatcagaagcaaaggaaggacttaaacgtggagaaactacgaaacatgctgttagtagggggacagcaaaattacggtggtttgtcgagagaaatttagtaaagccggagggtaaagtaattgatttgggatgtggcagaggaggttggtcttactactgtgctgggctaaagaaagtcactgaggtaaaaggatatactaaaggaggtccgggtcatgaagaacctattcctatggctacttacgggtggaatctggtgaaattgcattctgggaaagatgttttctttatgcctcccgaaaaatgcgacactcttttgtgcgacatcggagaatcatcgccaaatccaaccattgaagaaggaaggacattaagagttctgaaaatggtcgaaccatggttgagaggaaatcaattttgcataaagatacttaatccatatatgccgtcagtagtggaaaccttagaacaaatgcagaggaaacatggaggcatgctggtcagaaaccctctatcacgcaactccacacacgaaatgtattgggtatcatgcggtacaggcaacattgttagcgcagttaacatgacctcaagaatgctactaaaccgatttacaatggcacatcgaaaaccaacatatgaacgggatgtagacttaggggcgggtacgcgacacgtagccgtagaaccagaggttgctaacttagacattatcggacagcgtatagaaaacatcaaaaacgaacataaaagtacttggcactacgatgaagataacccatacaaaacttgggcatatcatggatcctatgaggtaaaaccttcaggaagcgccagttcaatggtaaatggtgtagtgagacttctcaccaaaccatgggatgtaataccgatggtaactcaaatcgcgatgacggacacaacgcccttcggacagcaaagggtgtttaaagaaaaggtagatacaaggacacctagggctaaaagaggaacaacacaaattatggaagtaactgcgaaatggttatggggatttttatctcgtaataaaaagccacgaatatgtaccagagaagagtttactagaaaagttcgcagcaatgcagccataggtgcagtattcgtcgatgaaaatcaatggaactcagcaaaggaagcagtcgaagatgaacgcttctgggatctggtccaccgcgaaagggaacttcataagcaaggcaaatgcgcgacctgcgtatataatatgatgggtaagcgtgagaagaaacttggcgaatttggaaaggcgaaggggagcagggccatttggtatatgtggttgggggcaagattcttggaatttgaagcactagggtttatgaacgaggatcattggttcagtcgtgagaacagcttatcaggagtagagggagaaggattacataagttaggatatattctcagagacattagtaagatacctggaggtaacatgtacgctgatgataccgcgggatgggatactaggataactgaagacgatttacaaaatgaagcaaaaataacagatataatggaacccgaacatgcgttactggccacatcaatttttaagttgacgtatcaaaacaaagttgtgagagtacaaagacccgctaagaacgggacggtgatggacgttatatcacgacgggatcagcgcggaagcggacaggtgggcacttacgggttaaacacatttaccaacatggaagttcaactcatccgacagatggagtcagaaggaattttcttaccatctgaattagagactccaaacttagcagagagggtacttgactggctcgaaaaacatggcgctgaacgcttgaaaagaatggcaatatccggtgatgactgtgtagtcaagcctatagatgatagatttgctacagcgttaactgcattaaacgacatgggtaaagtaagaaaggatataccacaatgggagccatctaaaggatggaacgattggcagcaagtacccttctgttcccaccacttccaccaattaataatgaaagatggccgggaaattgtagttccgtgtcgaaaccaggatgaattggtagggagagcacgagtttcacaaggagcaggatggtcacttagagaaactgcatgtctaggtaaatcttacgctcaaatgtggcagcttatgtactttcaccgtcgtgaccttagactagccgctaatgcaatatgttctgcggtaccagtagactgggttccgacatctcgaacgacctggagcatacatgcgcaccatcagtggatgacaactgaagacatgctaagtgtatggaatagggtttggatagaagaaaatccgtggatggaagacaagacacatgtttcatcctgggaggaggttccttatttaggaaagcgagaagatcaatggtgtggtagcctcataggattaactgccagagcaacatgggctactaacatacaagtagcaataaatcaagtgcgaagactaatcggtaatgaatcatatttagattacatgacctcaatgaagcgcttcaagaatgagtctgatccagagggtgctttgtggtaa

SEQ ID NO: 21336 - RNA, 9879 nt, synthetic construct
  misc_feature 1..9879: note = derived and/or modified CDS sequence (opt6) from DENV-1__KF973461__SS-prME
  source 1..9879: mol_type = other RNA
tcagtaactatgctactcatgttattacccacagctcttgcgtttcatctaacgacgagaggaggagaaccacatatgattgttagtaaacaagaacgaggaaagagcttattattcaaaacgtcagcaggagtaaatatgtgcactttaatcgctatggatcttggagaactgtgtgaagacacaatgacatataaatgccctcaaataaccgaagcagaacccgatgatgtggattgttggtgtaatgctacagatacgtgggtgacctatgggacatgttctcaaactggagaacatagacgtgacaaaagaagcgtagccttagctccccatgttgggttaggactagaaacacgaacggaaacttggatgagtagtgaaggagcttggaaacaaattcaaagagtagaaacatgggcactcagacatccaggattcacagtaattgcactgtttcttgcacacgctataggaaccagcattacgcagaaagggattatcttcatcctactaatgctagtaactccaagtatggcaatgcgttgtgttggaattggaaatagagatttcgtggaaggtttatctggtgcgacctgggtggatgtcgtactcgaacacgggtcatgtgtaactacaatggccaaaaacaaaccaacactagacattgaactactaaaaactgaagtaacgaacccagcaatcttacgaaaattgtgcattgaagccaaaatatccaatacaaccacggattccagatgtccaactcaaggagaagcaaccttagtagaagaacaagatgctaatttcgtatgtagacgaacattcgttgacagaggatgggggaatggttgtggtctttttgggaaagggtcgttgctaacgtgtgcaaaattcaaatgtgtcacgaaactcgaaggaaaaatagttcaatatgaaaacctaaaatactcagttatagtaactgttcacacaggtgatcagcaccaagtaggtaatgaaactaccgaacacggaacaattgcgacaataacaccccaagcgcccacatcagaaattcagttgacagactatggagcactcacattagactgtagtccaaggaccggccttgattttaatgaaatggtgctattaacaatgaaagagaaaagttggctcgtccataaacaatggttcctagacctacccttaccgtggacgtcgggggctagtacaagccaggaaacatggaatagacaagatctcttagtaacgttcaaaacagcacatgccaagaaacaggaagtcgttgtattaggaagtcaagaaggggcaatgcatactgcgttaactggcgcaacagaaatacaaactagcggtaccaccaccatttttgctggacacctgaaatgcagattgaaaatggataaactgactttgaaaggaacatcatatgtaatgtgtacaggctcttttaagctagaaaaagaggtggctgagacacaacacgggacggtacttgtccaagtgaaatacgagggtactgatgccccctgcaaaattccctttagtacacaagacgaaaagggagtaacgcaaaatggccgtctaattacagcaaatccaatcgtaaccgataaagaaaagcccgttaatatagaaacagagccgccattcggagaatcttacattgtagtcggtgccggcgagaaagcattaaagttgtcttggttcaagaaaggctcatctatcgggaagatgtttgaagccacagcaagaggagcacgtagaatggctattttaggagacacagcttgggattttggaagtatgggaggtgtctttacaagtgtaggaaagctagtacatcaggtttttggaacggcatacggtgtcctgtttagtggggttagttggacgatgaaaataggtataggtattctattaacatggttagggctcaattcgagaagcacctcactgtcaatgacgtgcatagctgtgggaatggttacattatacctcggagtaatggtacaagctgacagcggatgcgtaattaattggaaaggacgtgaattaaaatgtggatcaggtatattcgtgactaatgaagtacacacatggacggaacaatacaagtttcaagctgacagtcccaaaaggcttagtgcagcaattggcaaagcgtgggaggaaggagtgtgcggtataagatcagcgacgagactagaaaatataatgtggaaacaaataagtaatgaacttaaccacattctcctagagaacgacatgaaatttacagtggtggtgggagacgcaaacggcattctggcacaaggtaaaaagatgatacgcccgcaacctatggaacataaatattcttggaaaagctggggcaaagcaaaaatcataggagctgacatccaaaacacaactttcattatcgacgggccagacactccggaatgcccagataaccaacgtgcgtggaatatatgggaagtagaagactacggattcggcatttttaccactaatatttggcttaaactaagggattcgtatacccaaatgtgtgatcacaggcttatgagtgctgctataaaagactcaaaagcagttcatgccgatatgggatattggattgagtcagagaaaaatgaaacgtggaaacttgcacgtgctagctttatcgaagtgaaaacatgtacctggccgaagtctcacactctatggtccaatggtgtgttagaaagtgaaatgataatacccaaaatatacggtggccctatctcacaacataactatagaccaggttattttactcaaactgcgggaccatggcatctaggaaaacttgaattggatttcgaactatgtgaaggtacaacagtagttgtggacgaacattgtggcaatcgaggtccctctcttagaacgaccacagtaacggggaaaataatacatgaatggtgttgtcggagttgcacactacctcctttgaggttccgtggagaagacggctgttggtacgggatggaaataagacccgtgaaagaaaaggaggaaaacctcgttagatcgatggtatcggcggggagcggggaagttgatagcttttccttaggtatattatgtgcctcgattatgatagaagaagtaatgcgcagccgctggagccgtaagatgttaatgaccggtacgctcgcggtatttctattactcataatgggacaactaacctggaatgacttgattaggctgtgtatcatggttggcgcaaacgctagtgatcggatgggaatgggaacaacttatctagctttaatggcgacatttaaaatgagaccgatgttcgcagttggcctcttatttcgcagacttacgtcgagagaggtactactccttactataggactttccttagtagcaagtgtcgaactccccaatagtctagaggagctgggagatggtctggccatgggaattatgatgttaaaattacttactgaatttcaaccgcaccagctgtggactacgctattaagcctaacctttattaaaaccactttgtctctagattatgcctggaagataaccgcaatggctctctcaataatatccttattccctttatgcttaagcactacgagtcagaaaacgacctggctgcctgtgctattaggttcatttggatgtaaacctttaacaatgtttctgataactgaaaataagatctggggcaggaaatcctggccgttaaacgaaggcattatggcgataggaattgtttctatactactatcaagcctcttaaagaatgacgtacccctggccggacccttaattgctggaggtatgctaattgcgtgttatgtaataagtggatcctcagctgatttatcattggagaaagcagcagaggttagttgggaacaagaagcggaacactctggaacatctcacaacatcttagttgaggtgcaagacgatggaaccatgaaaatcaaagacgaagaacgtgatgacacacttacaatattacttaaagcaacactattagccgtcagtggtgtatatccaatgagcatccctgcaacacttttcgtatggtatttctggcagaaaaagaaacaacgatccggcgttctttgggacacaccttcaccaccagaagttgaaagggcagtacttgatgatgggatctataggattttacaacgtgggttattggggagatcacaagtaggcgtaggtgttttccaagacggagtatttcatactatgtggcatgtgactaggggcgctgttctcatgtatcaaggaaaacgattggaaccttcttgggcatctgtcaagaaagatttaattagttacggaggcggctggcgatttcagggatcatggaacaccggggaagaagtacaagttatcgccgtagaaccaggaaagaatcccaaaaacgtacaaacaactccaggaacttttaagacgcctgaaggtgaagtaggtgccatagcattagatttcaaacccgggacttcaggctcacctatcgtaaacagagaaggcaaaatcgtcggactatacggtaatggtgtagtcaccacctccggcacatatgtaagcgcgatagcacaagcgaaggcttcacaggaaggaccattgcctgaaatagaagatgaagtttttaaaaagagaaatctaaccattatggatttacacccaggttcggggaaaaccaggagatatttaccagcaatagttagagaagccattaaacgcaaacttcgtaccttaatcctagcgccaactcgcgtggtagctagcgaaatggcagaagcactaaaaggcatgccaatcagatatcaaacaactgctgtgaaaagcgaacacacaggtcgcgaaatagtagatctaatgtgtcacgcaacattcactatgagactcttgtcaccggttagagtcccaaactataatatgattattatggacgaagcccacttcactgaccctgcatcgatagcagcaagaggctacatatctacgagagtaggaatgggagaagcagcagctatttttatgactgcgacgcctcccggaagtgttgaggcattcccccaatcaaatgcagtcatacaagatgaggaacgagatatacccgagagatcatggaactcaggatatgactggattacagatttcccgggcaaaactgtttggtttgtcccatcaatcaaaagcgggaacgacattgccaattgcttaaggaaaaatggtaaaagagtaatacagctctctaggaaaacattcgatacggaataccaaaagactaaaaataacgattgggattatgtcgtaaccactgatataagtgagatgggagcaaacttccgggcagatcgagttatcgacccccgacgttgtctaaaaccagtaatattaaaagatggaccggagagagtcatcctagcaggaccaatgcccgtcacagtagcctcggctgcccaacgtagaggtcgtattggacgaaatcaaaataaagaaggagaccagtatgtttatatgggtcaaccacttaacaatgacgaagatcatgcacactggactgaagctaaaatgctattagataatattaatactccagaaggcataatacctgctctatttgagccggagagggaaaaatcagcggcgatcgatggcgaataccgtttaagaggagaagcacgtaaaacgtttgtcgaacttatgagaaggggtgatttaccggtatggctatcatataaagtagctagtgaaggttttcaatattccgacagacggtggtgtttcgacggtgaaaggaataaccaggtgctagaggaaaatatggacgtagaaatatggacaaaagaaggggagaggaagaaactgagaccaaggtggttggacgcccgtacatactctgatccactagccctacgcgaatttaaggagtttgcagctgggaggagaagtgtttctggagatctcattctggaaataggtaaactaccacaacatctaactttacgagctcagaacgctttagacaaccttgtgatgctacacaattcagaacaaggtgggaaagcctataggcacgctatggaggagttaccagatacaatagaaaccctaatgctgttagccctaattgcagtattaacgggaggagtgacattattctttctctccggaaagggactgggaaaaacgagcataggtttactgtgcgtcacagcaagttccgccctattatggatggcaagtgtagaaccccattggatagcagcatcgatcatccttgagttctttttaatggtattattaatcccagaaccggaccgacaacgtacgccgcaggacaaccaattggcatacgtcgtaattggtcttttgttcatgatacttacagtggcagcaaacgaaatgggtcttttagaaacgacgaaaaaggacctaggaattggtcatgtggcggcagaaaatcatcagcatgcaacaatgttagatgttgatctaaggcctgcgtcagcctggacattatacgccgtagcgacgacggttatcacacccatgatgcgccacactatagaaaacactaccgctaacataagtctaactgctatagcaaatcaagcagcgatcctcatgggtttagataaaggttggccaattagtaagatggacataggtgtgccattgctagccttgggctgttactcacaggtcaatccattgaccttaacagcagcagtgctaatgttggtagcgcattatgcgataattggcccggggttacaagccaaagctacgagagaagctcaaaaacgcacagcagccggaattatgaaaaaccctacggtagacggtatagtagcgatcgacctcgatccagtagtttatgataccaaatttgaaaaacaactaggacagataatgttactgatcctatgcacctcacagattttattgatgagaacaacctgggccctatgtgaatcgattacattagcgacaggccccctaacgactctatgggaaggaagtccaggcaaattttggaataccaccatagcagtttcaatggctaacatatttcgcggcagttacttagcgggagcaggtctagcattttcattaatgaaatctttaggaggaggtcgacgtggcacaggagctcagggtgaaacattgggcgaaaagtggaaacgccagttaaaccagctaagcaagtcggaatttaatatttataaacgatcaggaataatggaagtagatcgttcggaggcgaaagagggtttgaaacgtggtgaaacaactaaacatgctgtatcgcgcggtaccgccaaactacgatggtttgttgagagaaacttagtcaagccagaaggtaaggtaatagacttaggatgcgggaggggaggatggagctattactgtgccggtctaaagaaagtgactgaagtaaaaggttacacaaaagggggaccgggacacgaggaaccaatccctatggcaacatatggttggaacctagtaaaactgcatagtggtaaagatgtatttttcatgccgccggaaaaatgcgatacattactatgtgatatcggggaatcgtcacccaatccaacaattgaagaagggcgaacattacgcgtattaaagatggtggaaccatggttaaggggaaaccaattctgtataaagattctgaacccatacatgcctagtgtagtagaaactttagaacaaatgcaacgaaaatacggtgggatgttggttcggaatccgttgtcacgtaattctacacatgaaatgtactgggtgtcatgtggaacgggtaacatagtttcagcagtgaatatgacaagcaggatgctactcaatcgctttacgatggcacatagaaagccaacatacgaaagagacgtagatctcggagctggaactcgccatgttgctgtagaacccgaggtggcgaacttagacattatcggccaaagaatagagaacattaaaaatgaacataaatcaacatggcattatgatgaagataacccgtacaaaacttgggcataccatgggtcttatgaagtaaaaccatcaggcagcgctagttctatggtcaacggagtggtgcgtcttttaactaaaccctgggacgtcataccgatggttacgcaaatcgccatgacagataccactccatttggtcaacaaagagtttttaaagaaaaggtagacactcgtactccaagagcgaaaagaggtacaacccaaatcatggaggtaacggccaagtggttatggggatttttgtcacgtaacaagaaaccgcgaatttgcactagagaagaatttacacgcaaggtacgttcaaacgcagcgataggtgcagtgttcgtcgacgaaaatcaatggaactctgccaaagaggctgtagaagacgaaagattttgggatctagtcagaagagaaagagaactacataaacagggaaaatgtgctacttgcgtctacaacatgatgggtaaaagagagaagaaactaggggaatttggaaaagctaaaggatcacgagcaatatggtacatgtggctgggcgccagattcctcgaatttgaggctttgggcttcatgaatgaggaccactggttctcgagagagaatagtctatcgggggtagaaggtgaaggactacataagttagggtatattctaagggacatatctaagattccaggcggaaatatgtatgcggacgatacagctgggtgggacacacgcataacagaagatgacttacaaaacgaagcaaaaattacggacataatggagccagagcacgcattactcgccacaagcatattcaagttgacatatcagaacaaagtcgttagagtacaaagaccagctaaaaacggaacagtaatggatgtaatatcaaggcgagatcaaaggggaagtggccaggttgggacatacggacttaatacgttcacaaacatggaagtgcaactaatcagacaaatggaaagtgaaggaatatttttaccctcagaactagaaacaccgaacttagctgagcgagtcctcgattggttagaaaaacatggagctgagcgccttaaacgcatggctataagcggcgacgattgtgttgtcaaacccatagatgatagattcgctacagcactaacagcattaaatgacatgggcaaagtaaggaaggatatcccccaatgggaaccttctaaaggatggaatgattggcaacaagttccattttgttcacaccactttcatcaattgattatgaaagacggacgagagatagtcgtaccatgtagaaatcaagatgagttagttggcagagctagagttagtcagggcgcagggtggtcattgagggaaacagcatgcctcggaaagagctacgctcagatgtggcaacttatgtatttccatagaagagatctaagattagccgcaaatgcaatatgttcggccgtcccagttgactgggttccgacatcaaggacgacatggtccattcatgctcaccatcagtggatgacaacagaagacatgctatccgtatggaatcgtgtgtggatcgaggaaaatccgtggatggaagataaaacacacgttagcagttgggaggaagtcccttatttaggcaagagagaagatcagtggtgcggaagcctaatcggcttgacagctagagcaacctgggcgacaaatatccaagttgccatcaaccaagtacgaaggttaattgggaatgaaaactatctagattacatgacttcgatgaagcgatttaagaatgagtcagatcctgaaggagccttatggtag

SEQ ID NO: 21337 - RNA, 9879 nt, synthetic construct
  misc_feature 1..9879: note = derived and/or modified CDS sequence (opt6) from DENV-1__KF973462__SS-prME
  source 1..9879: mol_type = other RNA
tcagtcactatgttattaatgctgctcccaactgcgctcgcttttcaccttacaacacggggaggtgaacctcacatgatagtatcgaaacaagaacgaggaaaaagtctattatttaaaacaagtgctggtgttaatatgtgtacattaattgcaatggatctcggtgaattatgtgaagacacattgacgtacaaatgtccccaaatcatcgaagcggaaccagatgatgtagattgctggtgtaacgcaacagatacttgggtgacatatggtacatgtagtcaaacgggtgaacaccgtagggataaaagatccgtcgcactagcacctcatgtagggcttggactagagactagaactgagacttggatgagcagcgaaggggcctggaaacaaattcaacgtgtggaaacatgggctttaagacacccaggtttcaccgtgatcgcccttttcttggcacatgccataggtacttcaataacacaaaaaggaataattttcatattattaatgttagtcaccccgtcgatggcgatgcgatgcgttggtatcggcaacagagattttgtggagggtctctcaggtgctacatgggtagacgttgtgttagagcatggatcatgtgtaacaactatggctaaaaacaaaccaactcttgatatcgaactgcttaaaaccgaggtaactaacccagctatactgagaaaattgtgtatagaggcaaaaatttcgaatactactacggactcacgctgcccaactcaaggagaagccactttagtagaggaacaagatgcgaactttgtgtgcagacgcacttttgtcgacagaggttggggaaacggatgcgggttatttggtaaaggtagtctactaacctgcgcgaaattcaaatgtgtgactaaactcgagggaaaaatagttcaatatgaaaatcttaaatattctgtcatcgtaaccgtgcatactggggatcaacatcaagttggtaacgaaactacagagcatgggactatagcaacaataacgcctcaagctccaacttcagaaatccaactgacagactacggcgcgctgacattagactgttctccacgaactggactagatttcaatgagatggttctgttaacgatgaaagaaaaatcttggcttgtacataaacaatggttcttggatctgccacttccctggacaagtggtgcctcgacaagccaagaaacctggaaccgtcaagaccttctagtcacttttaaaacagcgcacgccaagaaacaggaagtggtagtcctcggatcacaagaaggagctatgcataccgcattaactggtgcaactgaaattcaaactagcggtaccaccacaatatttgcaggacacttaaaatgtcgcctaaaaatggataaactcacattaaaaggaacatcatatgttatgtgtactggatcctttaaactagagaaagaaatggcagagactcaacacggcacagtgttagtccaagtcaaatatgaaggcactgatgcaccatgcaaaatacctttttccacacaggatgaaaagggagttacacaaaacgggaggttgataacagccaatccaattgtgactgataaggaaaaaccagttaatatagagacagaaccaccattcggagaatcctatatcgtagttggggcaggagagaaggctttaaagttatcatggtttaagaaaggtagctctatcggaaaaatgttcgaggcaaccgcaagaggagcaagaaggatggctattttaggtgataccgcatgggactttggcagcataggaggtgtatttacatccgtaggaaaattagttcaccaggttttcggcacggcgtatggagtgctatttagtggagtatcatggacaatgaaaataggaattgggatcctcttaacctggttggggttaaattctaggtcaacctccctctctatgacctgtatagcggtaggaatggtaacattgtaccttggagtcatggttcaggccgactccggatgcgtcatcaactggaaaggacgagagctgaaatgcggatctgggatattcgttactaatgaagttcatacgtggacagaacaatataaattccaagctgattctcctaaacggctatctgcagctatcggcaaagcgtgggaagagggtgtgtgcggtatacgtagcgcaacacgattggaaaatataatgtggaaacaaatatccaatgagctaaatcatatactactcgagaatgatatgaaattcactgtagttgtcggagatgcaaacggaatcttagcacagggcaagaaaatgatacgtccccaaccgatggaacacaaatacagttggaaatcttggggcaaggcaaaaataatcggagctgatatccaaaacactaccttcatcatagatggtccggatacgccagaatgtccggataatcagagggcatggaacatatgggaagtagaagactacggttttgggatatttacaacaaatatctggctcaaattacgagattcatatacacaagtttgtgaccaccgcctaatgagtgcagcaattaaggatagtaaagctgttcatgcagatatgggttattggatcgaaagtgagaaaaatgaaacatggaagttggctagagcttcatttattgaagttaaaacgtgcacatggccgaagtcacacacattatggagtaacggagtattggaatcagagatgattattcccaaaatttacgggggtccgattagtcagcataattataggccaggatattttactcaaacggcgggaccatggcacttgggcaaactagagctcgactttgatttatgtgaaggtactactgtcgtagttgatgaacactgtggaaatagaggtccctcgttgcgaacaactacggttacaggtaaaattatacatgagtggtgctgtcgaagttgtactctaccgccattaagattccgcggggaagacggctgttggtacggcatggaaatccgtccggtaaaggagaaagaggaaaatttggtgagaagtatggtttcagcaggaagtggggaagttgattcttttagtctagggattctttgtgcatcaatcatgatagaagaagttatgcgatcgagatggtcaaggaaaatgttaatgacgggtacattagccgtattcttattactaatcatgggacaacttacatggaacgacctcataagactttgcataatggtaggcgccaatgcatcagatagaatgggtatgggtacgacatacctcgccttaatggctaccttcaaaatgaggcccatgttcgctgtggggttactcttccgccgtttaacctcaagagaagtcctattgttgacaattgggctatccctagtcgcaagtgttgagctgcccaattcattagaagaactcggagatggcttagcaatgggaattatgatgctaaaactacttactgaatttcaaccacaccaactgtggaccaccctcctctctttaacatttatcaaaacaaccttgtctctggattatgcctggaaaaccacagcgatggcgttatccataatatcattgttccccttatgtctaagtacaacatctcagaaaactacatggttaccagttttgctgggttcgtttggatgcaaacctttaacaatgtttttaataactgagaataagatctggggtcgcaagtcgtggcccctgaatgaaggaataatggcaattggaattgttagcatactcttatcttctttattgaaaaatgatgtcccgctcgccggaccgctaatagctggtggcatgctgattgcttgttatgtcatatctgggagtagtgcagatttatcccttgaaaaagcggcagaagtaagctgggagcaagaagcagaacactctggtacaagtcataatatcctcgttgaagttcaagacgatggcaccatgaaaataaaagacgaagagagagacgatacactcactatattactgaaagccaccttattagccgtatcaggagtgtacccgatgagtataccagcgaccttatttgtatggtatttttggcagaagaagaaacaacgaagcggtgtattgtgggacactccatctccaccagaagtagaaagagctgtattggacgatggcatatatcgtattctgcaacgtggattattgggccgttctcaagtcggcgttggtgtatttcaagatggggtatttcataccatgtggcatgtaacccgaggcgcggttttgatgtatcaaggtaagagactagaaccaagttgggcgtctgtaaagaaagatctaatatcctatggaggtggatggcgttttcagggtagctggaacaccggagaagaagttcaagtgattgccgtggaacctggcaaaaaccccaaaaacgtccagactacaccaggaaccttcaaaaccccggaaggcgaggtaggagccatagccttagatttcaaaccgggaacaagtggctctccaattgtaaatcgtgaggggaaaatcgttgggttatatggcaatggagtagttacaacgtccggtacgtacgtatcagcaatcgcgcaagcaaaagtttcacaggaaggtccactgcccgagatagaggatgaagtgtttaaaaagaggaacttgacaataatggatctgcatccgggcagtggcaagactagaagatatttacccgcaatagttagagaagcaataaagagaaaactcaggactctaattctggcaccgacaagagtcgttgcatcagaaatggccgaggcattaaaaggcatgccaattagatatcaaaccacagcagtgaaaagcgaacatactggaagagaaatcgtggatttaatgtgtcatgcaacattcacaatgcgactactatcacccgtacgagtaccaaattacaatatgataattatggatgaggcacactttaccgacccagcttcaatagcggctcgtggatatatatcaacaagagtaggaatgggtgaggcagcagctatttttatgacagctacaccacccggttcggtagaggcattcccacaatccaacgcagtgatacaggacgaagaaagagacataccagagcgaagctggaacagcggttacgattggataactgactttccggggaaaactgtctggtttgtaccaagcataaaatcaggtaatgatatcgcgaactgcttaaggaaaaacgggaaacgagtaatacaactatcaagaaaaacatttgacacggaatatcagaaaactaagaataatgactgggattacgtcgtaacaaccgatatatcggagatgggagcgaattttcgcgccgatagagttattgatccccgacgctgcttaaagccagttattctaaaagatgggcccgaacgagttatcttggcgggtccaatgcccgtaacagtagcctcagcagcacaacgcagaggtcgcataggccgtaatcagaacaaagagggtgatcagtacgtatatatgggtcaacctctaaacaatgatgaagatcatgctcactggacggaagctaagatgctattagacaatattaatacacctgaaggtataattcctgcactattcgagccagagcgtgagaaaagcgcagcaattgacggagaatatcgtttaagaggagaagctagaaaaacattcgtagagctaatgagacgcggtgacttaccagtgtggttatcatataaagtagcatcggagggctttcaatattctgatagacggtggtgtttcgatggcgaaagaaataaccaagtactcgaggaaaacatggacgtcgaaatttggactaaagagggtgaacgtaagaaattgcgaccaagatggctagatgctagaacttattcggaccccttagcactgcgcgaatttaaagaatttgctgcaggtcgccgaagtgtgtccggggaccttatcttagagataggaaagttaccacaacacctcaccttacgggcacaaaacgcactagataacttagtaatgttacacaatagcgaacaaggcggtaaggcgtacagacacgctatggaagaactgccggataccatcgaaaccctaatgctattagcactaatagctgtcctaacgggaggggtcaccctatttttcctaagcggcaaaggtttaggaaaaacaagtataggcttactctgcgtaacagcttcgtccgccttactttggatggcgtcagtagaaccacattggattgctgcatccataattttagagttctttttaatggtacttcttataccagaacctgatcgtcaacggacaccgcaagataatcaattggcttatgtcgtaataggtctattatttatgatattaactgttgccgctaacgaaatgggattattagaaactacaaagaaagatttagggatcggtcacgtggcggcggaaaatcatcagcatgccacaatgctagatgtagatttacgaccggcatctgcttggacattatacgcggtagcaaccacagtaataaccccaatgatgcgtcatactatagaaaacacgactgcaaatatcagcttaacggcgattgcgaaccaagcagcaattctaatgggtctagacaaaggttggcctatatcgaaaatggatataggggtaccattattagcattgggctgttattcacaagtcaatccgttaacactaactgcagcagtcctaatgttggtagcacactacgccattatagggcctggcttacaagcaaaagcaacgcgagaggcccaaaaacgaaccgcagccggcataatgaaaaaccccactgtagacgggatagtcgccattgacctagatcccgtggtatatgataccaaatttgaaaaacagctgggccaaataatgctcctcattctctgcacatcacaaattttattaatgcgtaccacttgggctctctgtgaaagtattacattggctactggtccattaacaacactctgggaaggatcacctggcaaattctggaataccacaattgcagtatcaatggcaaatatatttaggggctcctatttggccggtgctggcctcgcgttttctttgatgaagtcattaggagggggaaggcgagggaccggggctcagggcgagacacttggtgaaaagtggaaaagacaactaaatcaactatctaagtcagagttcaacatctacaaaagaagtggaataatggaagtagatcgttcagaagcgaaggaaggtttaaaacgcggcgaaacaactaaacatgccgtctcacggggcaccgcaaaacttaggtggtttgtagaaagaaatttagtaaagcctgaggggaaagtaattgatctcgggtgtggcagaggtggttggtcgtattattgtgcaggccttaagaaagtaaccgaggtgaaaggatacacaaaaggtggaccagggcacgaagaacccatcccaatggcaacgtatggatggaacttagtaagactacactcgggaaaagacgtattctttatgccaccagaaaaatgcgatacattactatgcgatataggcgaatcctctcctaatccaacgattgaagaaggtcgaaccctgcgagtgctaaaaatggtagaaccatggctacgcggcaatcaattttgtattaaaatcttaaacccgtacatgcctagtgtagtcgaaaccctggaacaaatgcaaaggaaatacgggggaatgctagtccgtaacccattgtcaagaaacagtacccacgaaatgtactgggtttcgtgcggaaccgggaatattgtaagcgcggttaatatgacttcaagaatgctactcaaccgatttacaatggcacaccgaaaaccgacttatgaaagagatgtcgaccttggagctggtaccagacacgtcgctgtcgaacctgaagttgctaacttagacatcatcggacagagaatcgaaaatataaagaatgaacacaaatcgacttggcactacgatgaagataacccgtataaaacttgggcatatcatggatcgtatgaagtaaaaccctccggttcggcttcatctatggtaaacggagtcgtacgacttttaacaaagccgtgggatgttatacctatggtgacacagatagccatgactgatacaacgccatttggacaacagcgagtatttaaagaaaaagtagataccagaactccaagagcgaaaagaggcaccacacaaataatggaagtcacggctaagtggttatggggatttctatcaagaaacaagaaacctaggatatgcacaagagaggaatttactagaaaggttagaagcaatgcagcaataggtgctgtatttgtggatgaaaatcagtggaactctgcaaaagaagctgttgaggacgaacgattttgggatttagttcatcgcgaacgcgaattacacaagcaaggaaagtgcgcaacatgtgtttacaacatgatgggtaaaagagagaagaaactaggagaatttggaaaagccaaaggaagcagggctatatggtacatgtggctgggagccaggttcttagagttcgaagcattgggcttcatgaatgaagaccattggttctcgagggaaaatagccttagtggagtagaaggtgagggattacacaaattaggatatatcctacgagacatcagtaaaatccccggcggaaacatgtacgcagacgacaccgcaggatgggatacacgaataactgaagatgatttacaaaatgaagccaagataaccgacatcatggaaccagaacatgcattactagctacaagcatctttaaactcacttatcaaaacaaagtggttagagtacagcggcctgctaagaacggaacagttatggacgtaataagtagacgtgaccaaagggggtccggacaagttggaacatacggcttaaatacatttacgaatatggaagtacaattaataaggcaaatggaaagtgaaggcatattcctaccttcagagctggaaacgccaaatcttgcaaaaagagtcttggattggctagaaaagcatggagctgaaagactaaaacgaatggccatatctggcgatgactgtgtagtcaagcctatagatgatagatttgcaacggcattaacagcactcaacgacatgggcaagattcgaaaggatataccgcaatgggaaccatccaaaggttggaacgactggcaacaggtacctttctgtagccatcactttcaccagctaattatgaaagacggaagggaaattgttgttccgtgcagaaaccaagatgaattagtaggccgtgcgcgagtatctcagggggccggatggagtctacgtgaaacagcatgcttgggcaaaagttacgcgcagatgtggcaacttatgtatttccaccgccgggacttacgtctagcagcaaatgctatatgcagtgccgtaccagtcgattgggttccgacatccaggacgacctggtcaattcatgcgcaccaccaatggatgaccacggaagatatgctatctgtttggaatcgagtttggatagaagagaatccttggatggaagacaaaactcatgtatccagctgggaagaagtcccatatctaggaaaaagagaagaccagtggtgtggtagtttgattggattaacagcccgtgcaacatgggctactaacatacaagtcgctataaaccaggtaagacgcttaattggaaacgagaactatctggattacatgacaagcatgaaaaggtttaagaatgagtccgatcccgagggagcattgtggtaa

SEQ ID NO: 21338 - RNA, 9879 nt, synthetic construct
  misc_feature 1..9879: note = derived and/or modified CDS sequence (opt6) from DENV-1__KF973463__SS-prME
  source 1..9879: mol_type = other RNA
tcggttactatgcttctaatgttaatgccaactgcgctggcattccatcttactacaagaggaggggaaccacatatgatcgtatcaaaacatgaacgaggtaaagcgttactcttcaaaacaagtactggagtaaatatgtgtacattgatagctatggacctcggagaactatgtgaagacactatgacatataaatgtccgcgcatcacggaagcagaaccagacgacgttgactgctggtgtaatgctactgacacatgggttacctacggaacatgcagtcaaactggtgaacaccgtcgagataaaagaagtgtagcactggcacctcacgtcggactaggtttagaaacacgaacggagacgtggatgtcttcagaaggagcatggaaacaaatacaacgagtcgaaacttgggcattgcggcatccaggttttacggtaatcgcactattcttggcacatgcaatcggaacgtctataacacaaaaaggaataatattcatattactaatgttagtcactccgtccatggctatgagatgcgtcgggataggcaacagagattttgttgaaggcctttctggcgcaacttgggtagatgtagtgctggaacatggttcatgtgttacaacaatggccaaaaacaaaccgacattagatattgaattactaaaaacagaagtgacaaacccagctgtcctgagaaaactatgtatcgaagcgaaaatttcgaatacaacaacggatagcagatgcccgacacaaggggaagcaacgcttgtggaagaacaagatgcaaacttcgtatgtcgaagaacatttgttgaccgaggctggggcaatggttgcggactctttggaaaaggcagtctgttaacatgtgcgaaattcaaatgtgtcacaaaactcgaagggaaaatagtgcaatatgaaaatctaaaatactccgtaattgtcacagtacacactggagaccaacatcaagtaggcaacgaaacgacagaacatggaactatcgcgactattacaccacaagctccaacctcggagatacaattaacggattacggtgcattgacattagactgtagtccaagaacagggttggatttcaatgaaatggtactattgactatgaaagagaaatcatggttggtacacaaacaatggtttcttgacctaccattgccttggacatccggagcctctacctctcaggaaacctggaatagacaagacttattagtcacgttcaaaacagcccatgccaagaaacaagaagtggttgttttgggaagtcaagagggagcaatgcacacagcactaaccggggcaacagagattcaaacaagtggtacaacaacaatttttgcaggacatttaaaatgcagattaaaaatggacaaactcacattaaaaggtaccagttacgtaatgtgcacaggtagttttaaattggaaaaagaagtagcagaaactcaacacgggacggtgctagttcaagttaaatatgaggggacggatgctccatgtaaaataccgttttcaacccaggatgaaaaaggtgttacccaaaacggacgactaattacggctaatccaatcgttactgataaagaaaaacctgtaaatatcgaaacggagcctccattcggtgaatcatacatagtagtaggagctggtgaaaaagcactcaaattgtcttggttcaagaaaggatcaagtattggcaaaatgtttgaagcaacggctagaggagccagaagaatggctatacttggagatacggcgtgggacttcggatccattggtggtgtctttacatctgtgggaaaattggttcatcaagtttttggtaccgcttacggagtactatttagtggagttagttggacaatgaaaataggaatagggattctcttaacatggctaggactaaattcaagatcaacaagcctaagtatgacatgtatagctgttggaatggttacactttacctaggcgtgatggtacaagcagacagcggttgcgtcatcaactggaaaggaagagagctgaaatgcggatctggtatttttgtaaccaacgaagttcatacatggaccgaacagtataaatttcaagcagatagtcctaaaaggctaagtgcagcaataggtaaggcttgggaagaaggagtctgtggcatacgatcagcgacacgattagagaatataatgtggaaacaaattagcaacgagctaaatcacatacttcttgaaaatgacatgaaatttacggttgtggttggagacgccaacggcattctggcacagggcaagaaaatgatacgaccgcaacccatggagcacaaatattcctggaaaagttggggtaaggcgaaaattattggtgctgacatacaaaacacgacgtttatcattgacgggcccgatactccagaatgtccggacgaccaaagagcatggaacatatgggaggtcgaagactatggattcggtatattcacaacaaacatctggctgaagctacgggactcgtatacgcaaatgtgcgaccatcgtttaatgagcgctgcaataaaagattcaaaagcagtccacgccgacatgggttactggattgaatcagagaaaaatgaaacgtggaaattagcaagggcctcgtttatagaagtcaagacttgtacttggccgaagagtcatacattatggagcaatggagtactcgaaagtgaaatgataattcctaaaatatatggaggaccaatttcacagcataactaccgacctggctacttcacccaaacagctggaccctggcatttggggaaattagaactagattttgatctatgcgaaggaacaacagttgttgttgatgaacactgcggtaaccgaggtccctcattaagaaccaccactgtgacgggaaaaataatacacgaatggtgttgccgttcatgtactctaccgccacttcgttttaggggagaggatggctgttggtatggcatggaaataagaccagttaaagaaaaggaagaaaatctggttcgctctatggtctcagctggtagtggagaggtcgacagcttctcattagggattctatgcgttagtataatgattgaggaagtcatgcggtcacgatggtctaggaaaatgttaatgacgggaacgttggcggtgtttctgttattaataatgggacaactgacctggaatgatttaatacgcctatgtataatggtcggtgcaaacgcaagtgataaaatgggaatgggtactacttatctagctttgatggcaacgtttaaaatgagaccgatgtttgccgtgggaatcctattcagacgtttgacatcacgggaagtactgctattaaccataggactatcgttagtggctagtgtagaactgcccaattcattagaagaattgggcgatggtttagcaatgggaattatgatgcttaaactacttacagaatttcaaccgcatcaactatggaccacattactaagtttaacctttattaaaacaacgctttcacttgactatgcctggaaaacaacagcgatggctcttagcatagtatctttattccctttgtgcctatcaacgaccagccagaaaaccacgtggttgccagtactgctgggatcatttggctgcaaaccacttactatgtttttgattactgaaaataagatttgggggcgtaagtcttggcccataaatgaaggcataatggccatcggaattgtaagtattttgctatcaagcctcctgaaaaacgacgtaccacttgcaggtccactgatagcaggaggaatgttgattgcttgctatgttatttcaggtagctctgccgacctatcattggaaaaagcagcagaagttagttgggaacaggaagccgaacattctggcacatcacacaacatattagttgaagtacaagacgatgggaccatgagaattaaagatgaagaaaaggacgatactcttacaatactgcttaaagcgactttattagctgtttctggggtttatccaatgagtatacctgcaactttatttgtctggtatttttggcagaagaagaaacaacgctctggagttttatgggacacgccatcaccacctgaggttgaaagagccgtactagacgacggcatttacagaatattgcagcgagggctactgggaagatcacaagtcggagtaggggtgtttcaagatggagtgttccatacaatgtggcacgtaacacgtggcgcagtattaatgtatcagggaaaacgactagaaccaagctgggcgtcagtaaagaaagacctcatcagttacggtggaggatggaggttccagggaagttggaatactggtgaagaagtccaagtaatagcggtcgagcctggtaaaaatcccaaaaacgtgcaaacaacgccgggaacatttaaaacaagcgaaggtgaagtgggagcaattgctctcgacttcaaacctggtacgagtggctcccctatagtaaacagggaagggaaaattgttggactatatgggaatggagtagttacaacatcagggacttatgtttcagcgattgcacaagccaaaactagccaggaaggcccgttacctgaaatagaagatgaagtatttaagaaacggaacctaacaatcatggatctccatcccggaagtggaaaaacaagaagatatctccccgcaatcgtaagagaagcaattaagaagaaactaagaactttgatcctagccccaacgcgagtagtcgcctcagaaatggccgaagcactaaaaggaatgccgatacgatatcaaacgacggccgttaaatctgaacatacaggaagggagatagtagacttgatgtgccacgccacgttcactatgaggctactcagtccagtcagagtcccaaattacaatatgataataatggatgaagcccattttacagatcctgcttctatagcggccagaggttatatctcaacaagggtaggcatgggagaagcagccgcgatatttatgacggctacgccgcctggttcagttgaggcgtttccacaatcgaatgcggtgatacaagatgaagaaagagatatccctgagcgatcatggaatagcggatacgactggataaccgatttcccaggtaaaacggtatggttcgtcccaagcattaaatcggggaatgacattgcgaattgtctaaggaaaaacggtaaaagagtgatacagttgtcgcggaagacgttcgacacagaataccagaaaactaaaaacaacgattgggactatgtagtaaccacagatatcagtgaaatgggcgctaattttcgcgcagatcgggtgatagaccccagaaggtgtcttaaaccagtaattttaaaggatggacctgaaagagttattctagccggacctatgccagttaccgtagcttcagcagcgcaaagaagggggagaatcggacgtaaccaaaacaaggaaggagatcagtacgtatacatgggacagccgctaaataacgacgaagatcatgcacactggacagaagcaaaaatgctattagataatatcaatactcccgaagggatcataccagcattattcgaaccagaaagagagaaaagcgctgccatcgacggcgagtatcggctacgcggtgaagcgcggaaaacatttgtggaattaatgcggaggggagatttaccggtgtggttgtcatataaggtagcatccgaaggattccagtatagcgatagacgatggtgttttgacggggaacgaaataatcaagttctcgaagaaaacatggatgtagagatttggacaaaagaaggcgagaggaagaaactaagaccccgatggttagacgccagaacatacagcgatccgttagctctcagagaatttaaagaatttgcagctgggaggcggagtgtatcaggggatcttatcttagaaattggcaaactaccacaacacttaaccctaagagcacaaaacgcgcttgataatctggtaatgttacataactcagaacagggtggaaaagcctatcgacacgcaatggaggaacttcctgacaccattgagacgttaatgcttttggcattaattgccgtacttacaggaggagtgaccctattcttcctatcgggcaaaggactaggaaaaacaagtatcggcctgttatgtgtaaccgcctcttcagctttactatggatggcttcagtagaaccgcattggatagctgcatctatcattctcgagttctttctgatggtattactcattcctgaaccagacagacaacgaacacctcaggataatcagttagcatacgtagtaatcggcctactttttatgatacttacagtagcggctaatgaaatgggtttactggaaaccaccaagcgagacttaggaataggacatgttgcagcagaaaaccaccaacatgcgacaatgttggatgttgatcttagaccagcctcagcatggacactttacgcagttgcaactacagtaataacaccaatgatgagacacacaattgagaacacaacagccaacatctcattaacagcaattgcaaaccaggctgcaatactgatgggtctggacaaaggatggcctatctctaagatggatataggggtacctttactagccttaggttgttatagccaagtaaatccactaactttgacagcagccgtattaatgttagtagcgcattacgctataatagggcccggcctacaagcaaaagctacaagagaggcccagaaaagaacggccgcaggtattatgaagaaccccacagttgacggaatagttgctatagatcttgacccagttgtttatgacgcgaaattcgaaaaacaattaggacaaataatgctacttatattgtgcactagccaaattctgttaatgagaacaacatgggctttatgtgagagcattacattagcaactggacctctaacaactttgtgggaaggatctcctggaaaattctggaatactacaatagccgttagtatggcaaatatatttcggggctcgtatttagccggcgcaggtcttgctttttcattaatgaaatctctcggaggcggaagaagaggaaccggagcccagggggaaacgctaggagaaaaatggaaacgtcagctaaaccaactttctaaacccgaatttaacacctataagagatccgggatcatggaagttgaccgcagtgaagcaaaagaaggtctaaaaagaggagagacaactaagcacgcagtatcgcgaggaactgccaagctgcgttggttcgtagaaaggaatctagttaagccggaaggaaaagttattgacctaggttgcggacgtggaggttggtcatactattgtgcaggtcttaaaaaggttaccgaagtgaagggctataccaaagggggcccaggacatgaggaaccaataccaatggcaacctatgggtggaatttggttaaattgcactcaggcaaggatgttttcttcatgcctccagaaaaatgcgatacattactatgtgacattggggaaagctcaccgaatccaacaattgaagaaggccgaactctaagagtcttgaaaatggttgaaccctggcttcgtggaaaccaattttgtataaaaatcctcaacccctatatgccatcagtagttgaaacattagaacaaatgcaacgaaagcatggaggaatgttagtacgaaacccgctatcacgtaacagtactcacgaaatgtactgggtttcttgcggtaccggaaatattgtatctgcggtaaatatgacaagtagaatgttgttaaatagatttactatggcgcataggaaacctacttatgaacgggatgtagacctaggagctggaactcgtcatgttgcagtagagcctgaagtagcaaatttagatattataggtcaacgtatcgaaaatatcaaaaacgaacataaaagtacttggcattatgacgaagataacccatataagacatgggcgtatcatggatcatatgaggttaaaccatcaggcagcgcgagtagtatggtgaacggagtggttcggttattaacgaaaccttgggatgtgatccctatggttactcagatcgccatgacagacaccactccattcggacaacagagagtttttaaagagaaagtagacacacgaacaccaagagccaaaagaggcacgacccagataatggaggttactgcaaagtggctctggggatttttatctcgaaataagaaaccgcggatctgcacaagggaagagtttacccgaaaggtaagatcaaatgctgcgatcggtgcggtttttgtagatgaaaatcaatggaacagcgcaaaggaagccgttgaagatgaaaggttctgggaccttgtacatagggagcgggagctacataaacaagggaaatgtgcaacgtgcgtttataacatgatgggtaagagagagaagaaactcggcgagttcggaaaagcgaagggcagtcgggccatctggtatatgtggctaggagcccggtttctagagttcgaagcacttgggtttatgaatgaggatcattggttttctagagaaaatagcttgtcaggtgttgaaggcgaagggcttcacaaactaggatatatactaagagacatctcaaaaataccagggggaaatatgtatgctgatgatactgcaggatgggatacaaggatcaccgaagacgatcttcaaaacgaagcaaagattactgatatcatggaaccagaacatgcattattggctacctcgatttttaaactaacttatcaaaataaggtagtacgggtacaaaggccagccaagaatggaactgtaatggacgttatttccaggcgagaccaaagaggtagcggacaagtcggcacttacggtctaaacacttttacaaatatggaagtacaattaatccgccaaatggaatcagagggtattttcttaccttcagagctggaaacccccaatcttgctgagcgggtgctagattggctagaaaagcatggagcagaaagattaaaacgtatggctattagcggtgatgactgcgtcgttaaacctatagatgataggtttgcaacagctttaacagctttaaacgatatggggaaagtccgaaaagatataccacaatgggagcccagtaaaggatggaatgattggcagcaagtaccattttgcagtcatcattttcatcaactgattatgaaggatggtcgcgaaatagtagtaccctgcagaaatcaagatgagttagtcggccgggcgcgagtttcacaaggtgctggatggagcttgagagagacggcatgtttgggaaagtcatacgctcaaatgtggcaactaatgtacttccaccggcgggatttaagactggccgcaaatgcaatctgttcagcagtccccgttgattgggtacccacttcacgtacgacgtggtcaatccatgcacatcaccagtggatgacaaccgaagatatgttaagtgtttggaatcgagtatggattgaggaaaatccttggatggaagataaaacacatgttagttcatgggaggaagtaccatacctaggcaagagagaggatcagtggtgtggatcgctgatcgggttaactgcaagagcgacttgggctaccaatattcaagtagctataaaccaggtcagacgcctaataggaaacgagaactacttggactatatgacgagcatgaaacgttttaaaaatgagtcagacccagaaggagcattgtggtag

SEQ ID NO: 21339 - RNA, 9879 nt, synthetic construct
  misc_feature 1..9879: note = derived and/or modified CDS sequence (opt6) from DENV-1__KF973464__SS-prME
  source 1..9879: mol_type = other RNA
tcagttaccatgctgttgatgttgttgcctactgctcttgcatttcatcttacgacgagaggaggggaaccacatatgatagtttccaaacaagaacgggggaaaagccttctgttcaaaacctctgcgggggtaaatatgtgcactctaatcgcaatggaccttggagaattatgtgaagatacaatgacttataaatgtccacaaattacagaagcagaaccagacgacgtagattgttggtgcaacgcaactgacacatgggtaacgtatggaacatgctcacaaactggggaacatagaagggataaacgctcagtcgcactggcacctcacgtcggactgggacttgaaacgagaaccgaaacctggatgtcatcagaaggagcttggaaacaaattcaacgcgttgaaacttgggcattacgacacccagggttcaccgttatagcgttatttctagcgcatgctataggaacatccatcacacaaaaaggaattatcttcatactattgatgttagtaactccatcaatggcgatgagatgtgtaggaattggaaaccgcgatttcgtcgaaggcttatcaggagcgacttgggttgatgtggttctcgaacatggatcttgtgtgactacaatggctaaaaacaaacccacactcgatatagaacttctaaaaacggaggtaacaaatcccgcaatacttagaaaactatgcatcgaagccaaaataagcaacactactactgatagtagatgccctactcaaggagaagctactctagtagaggagcaagatgctaacttcgtttgtaggcgaacgttcgtagacagaggttggggcaatgggtgtggacttttcggcaaaggcagtcttcttacatgtgcaaaatttaaatgtgtcactaaactagaaggaaaaatcgttcagtatgaaaacctgaaatacagcgtaatcgttactgtgcacactggagaccaacatcaggttggaaatgaaactacagaacatggtacgattgcaactattacccctcaagcacctacaagcgagatccaactgactgactacggagcgttaactctagactgctctcctcgtaccggactagactttaatgaaatggtacttctaacaatgaaagaaaaatcttggctggtccataaacaatggtttctggatttaccactaccgtggacatcaggcgcatcgacgtcacaagaaacgtggaatcgccaagatctattagtaactttcaaaacagcacatgccaagaaacaagaggtagtcgtacttggaagccaagaaggtgccatgcatacggcgcttacaggcgcgaccgaaatacaaacaagtggtactacgactatttttgccggccatttaaaatgccgtttaaaaatggataaactcacattaaaagggacatcgtatgttatgtgcactgggtcttttaaactcgaaaaagaagtggccgaaactcagcatggtacagtattagtacaagtaaaatatgaaggaactgatgcaccatgcaaaattccattcagtacacaagacgaaaaaggtgttacacaaaacggacgattgattaccgcaaatccaatagtcacagacaaggagaagccagtaaacattgaaacggaaccacccttcggtgaaagctatatagtggttggtgctggtgagaaagcattaaagctaagttggttcaagaaagggtcatcaataggaaaaatgttcgaagccacagctcgaggtgctaggagaatggccatactcggggataccgcttgggactttggatcgattggaggcgtcttcacatctgtaggtaaattagtgcatcaggtgtttggcaccgcatatggggttctgttcagcggagtaagttggactatgaaaataggcatcggaatactattaacttggttaggactaaattcacgatcgacgtctttgtcaatgacttgtatcgccgtaggaatggtaacactctacttaggagtgatggtacaagcagactcagggtgtgtaataaactggaaaggacgcgaactaaaatgcggctcaggaatatttgtaacaaatgaagtgcatacgtggaccgaacaatacaaatttcaagcggatagtcctaaaaggctttcagcagctataggcaaggcttgggaagagggggtatgcggaattaggagcgccaccagacttgaaaacataatgtggaaacagatttctaacgagctgaatcatatactactggagaacgacatgaagtttaccgtagtagtaggagacgccaacgggatactagcccaaggcaagaaaatgataagacctcagccaatggaacataaatattcatggaaatcgtggggaaaggctaaaataattggagctgatatacaaaacactacgtttataatagacggacctgacacaccagaatgtcctgataaccagagagcgtggaatatttgggaagttgaagattatgggtttggtatatttacaaccaacatttggctgaaattacgggattcgtatactcaaatgtgtgatcacagactcatgagtgcggctattaaggactcgaaagcagttcacgccgatatgggatactggatagaaagcgagaaaaacgagacatggaaactggccagagcatcgttcatagaagtaaaaacatgtacttggccaaaatcacacacgctttggtctaatggtgtattagaaagtgaaatgataattccgaaaatatatggaggacccatttcacaacataactaccgaccgggttacttcactcaaacggcggggccatggcatttaggtaaattagaactagacttcgacttatgtgagggcacaaccgttgttgttgatgagcattgcggaaatcgtggtcctagtctacggactactacggtaacaggaaaaataatacacgagtggtgctgtcgatcctgtacactcccaccattgcgtttcaggggagaagatggatgttggtatggtatggaaattaggccagtgaaggagaaggaagaaaatctagtaagatcaatggtcagcgctggatcgggggaagtagacagcttctctttgggcatactatgcgcttcaattatgattgaagaagtaatgaggtcgaggtggtcaaggaaaatgctgatgacaggaaccttagcagttttccttctactaataatggggcaactgacatggaatgatttaataaggctttgtataatggtaggagcaaacgcttcagatcgaatgggaatgggaacaacgtatttagcacttatggctacatttaagatgaggccgatgtttgcagttggactattattcagacgtcttacatcaagagaagttttattactaacaattggtctatcgttagttgctagtgtcgaactacccaactcgctggaagaattaggagacgggttggcaatggggattatgatgctgaaattattgactgagtttcaaccacatcagctttggactacattactatcattgacgtttatcaagactacactgtccttggattacgcctggaaaaccacagcaatggcattatcaataattagcctatttccattatgtttgtcgactacaagccagaaaactacttggttacccgtgctactagggagcttcgggtgtaaaccgttaacaatgtttcttataaccgagaacaaaatctggggacgaaaatcctggccgttaaatgaaggaattatggctattggcatagtttctattcttttgagttcacttcttaaaaatgatgtaccactagccggccctctaatagccggcggaatgttgatagcatgctacgtgatatctggatcgagtgctgacttgagcttagaaaaagccgcagaggtatcatgggagcaagaggccgagcacagtggaacgtcgcataatatacttgtcgaagtccaagacgacggtacaatgaagataaaggatgaggaacgcgacgatactctaacgatactcctgaaggccacacttttagcagttagtggagtgtacccaatgtctataccagctacacttttcgtatggtatttctggcagaaaaagaaacaaagatctggggtgctatgggatacaccctctccaccagaggtcgagcgtgcggtcttagatgacggaatatacaggatattacaaagaggcctgctgggaagatctcaggttggtgtaggggtttttcaagatggggttttccacacaatgtggcatgtgacgcgaggggcagtattgatgtatcaaggaaaacgtcttgaaccatcatgggcgtcggttaagaaggatctgatatcttacggaggaggctggaggttccagggcagttggaacactggcgaagaagtgcaagtaattgctgtagaaccagggaaaaatcccaaaaatgtccaaacaacaccagggatctttaaaacccccgagggagaagttggagctatagctttagacttcaagcctggcactagcggatcacccatcgtcaatcgtgaaggtaaaattgtcggattatatggtaacggagtggtgaccacatcaggtacttatgtaagtgcgattgcgcaggcgaaagctagccaagaaggaccattaccagagatcgaagatgaagtattcaagaagcgaaacctgaccataatggatttacatcccggaagtggtaaaaccagacgatatttaccggcaatggttagggaggccatcaagagaaaacttagaacgttgatcttagcacccacaagagttgtggcttctgaaatggcagaagcactgaaagggatgcccattagatatcagacaacagctgtaaaaagtgaacacaccgggagggaaattgtcgacttaatgtgtcatgccacatttacgatgagacttttaagtccagtacgagttccgaattacaacatgataattatggatgaagcacattttacagatccggcaagcattgctgcaaggggctatatatccacgcgcgtcggcatgggtgaggcagcagccatctttatgactgcaacgccgccaggttcggtagaggcttttcctcaaagtaacgcagttatccaggacgaagaaagagacataccagagaggtcatggaactctggatatgattggataactgattttccgggaaagactgtctggtttgtaccaagtataaaatctgggaacgacattgcaaactgcctccgtaagaacgggaagagagtcatacaattaagtcgtaaaacttttgatactgaatatcaaaagaccaaaaacaacgactgggactacgtagttactacggatatatcagagatgggcgcaaattttagagccgacagagttatagatccacgacgatgtctaaaacctgtgatactaaaggacggacctgaaagggttatcttagcaggaccaatgccagtaacagttgcatcagccgctcaaagaaggggacgaatcggaagaaaccagaacaaagaaggagaccaatatgtttacatggggcaacctttaaacaatgatgaagaccacgcgcattggacggaggccaaaatgctactagataatataaacactccagagggaataataccggcattatttgaacccgaaagagaaaagagtgcagcaatagatggtgaataccgtttacggggtgaagccagaaaaactttcgtagagttaatgagaagaggagacttgccagtatggttatcttacaaggtagcttcagaagggttccaatacagcgataggagatggtgcttcgatggggaaagaaataaccaagtattagaagaaaatatggacgtggagatttggacaaaggaaggagaaaggaagaaactgcgaccacggtggctggatgcgagaacatattcagatcctttagcactaagagagttcaaggagttcgctgcggggagaagatccgtatctggcgatttaatattagaaatagggaaattgccccaacacctgactttaagagcacaaaatgccctagacaatctggtaatgttacataactcagaacaaggtggtaaagcgtaccgtcatgcaatggaggagttaccagacacaatagaaacattaatgttactcgctttaatagccgtattaaccgggggtgtaactctattctttttgtcggggaaagggctagggaagacaagcatagggttgttatgtgttacagcatccagtgcgttgctgtggatggcaagtgttgaaccacactggatagctgcatcaatcatattggaatttttcttaatggttctgcttatacctgaacctgatcgacaaagaactccgcaagacaaccagctagcatacgtggtaattggacttttatttatgatactaacagtagcagctaacgaaatgggactattagaaactacaaagaaagatctggggataggtcatgtagccgcggaaaaccaccaacatgcaacaatgttagatgttgatttgaggccagcaagcgcctggacattatatgctgtggcaaccactgttataacgcccatgatgcgtcacaccatagaaaatacaaccgcaaacatctctctaacagcaattgcaaatcaggcagctatcctgatggggctcgataagggatggccaataagtaaaatggacattggtgttccattgttggctctaggatgttatagtcaggtcaatcctctaacattaactgcagctgtactcatgttagttgcacactacgcaataatcggtcccggtttacaagctaaagcaacaagggaggcacaaaaacgaacagccgcagggatcatgaaaaatccgaccgtagatggtattgttgctatagatttagatcctgtagtatatgatactaagtttgaaaagcagttaggtcaaataatgttattaatattgtgtacatcacagatcttactcatgcgaacgacatgggcattgtgtgaaagtataacattggcgaccggacccctaactacactttgggaaggcagtcccggtaagttttggaatacaactatcgcagtaagtatggccaatatatttagaggaagttacctggccggtgcaggcttagcattttcactaatgaaaagccttggaggcggtcgacgggggacaggagcacaaggagaaaccctaggagagaaatggaagcgtcaactcaatcaacttagcaaatcagaatttaatatatacaaacgaagcggcattatggaagtagatagatcagaagcgaaagaagggttaaaaagaggagagactacaaaacacgcagtatcaagaggtactgctaaactaagatggtttgttgagagaaatcttgttaaaccagaaggtaaggttatagacctgggttgtggaaggggaggatggtcatattactgtgctggactgaagaaagtcacggaagttaagggatacacaaaagggggtccaggacacgaagaacctatcccgatggcaacctacggatggaatctggtaaaactacattctggtaaagatgtgttcttcatgccacccgaaaagtgtgatacactcctttgcgacatcggtgagtcgagccccaatcccaccatagaagagggaaggacgcttagggtactaaaaatggtggagccctggttacgcggaaaccaattctgtattaaaattttaaatccatatatgccatccgttgtagagacgttggaacagatgcaaagaaagtatggaggaatgttagtcagaaatccattatcgcgaaatagtactcacgaaatgtattgggttagttgcggcacaggaaatatagttagcgccgtgaatatgacaagccgtatgctattaaataggtttactatggcacacagaaaaccgacttatgaaagagacgtagatttaggtgccgggacgaggcacgtagcagtagaaccagaagtagcaaatttggatataataggacaacgcattgaaaatatcaaaaacgagcataagtcaacctggcattacgacgaggataatccctacaaaacctgggcatatcacggttcatacgaggtaaaaccatcgggttctgctagcagtatggtaaatggtgtagtacgactgcttactaaaccctgggatgtaatacctatggtgacgcaaattgctatgacagacactactccttttggtcaacaacgcgtgttcaaggagaaagtagatacacgaacaccaagagcgaaacggggaacgacccaaattatggaagttacagccaaatggctttggggatttctttcacgaaataagaaaccaaggatatgtacaagagaagaatttacgcgaaaagtcagaagcaacgcagcaattggagcagtatttgtcgatgagaaccaatggaatagtgctaaagaagccgttgaggatgaaaggttttgggacctagttcatcgtgaaagagaactacacaaacaaggaaaatgtgctacatgcgtatataacatgatgggaaaaagggagaagaaactgggtgaatttggaaaggccaaagggtcccgtgccatatggtacatgtggctaggagctaggtttctagaatttgaagctctaggatttatgaacgaagatcactggttttcacgggaaaacagcctttcaggtgtagaaggagagggcctccacaaactgggctacattctccgagatatttcaaaaattccaggaggtaatatgtatgcagacgatactgcgggatgggacactaggattactgaagatgatttacagaacgaggcaaagattactgatatcatggagcccgaacatgcgctgttggcaaccagtatctttaagttaacgtatcagaataaggtagtacgtgtccaaagacctgctaaaaacggaaccgttatggatgtaatttctagaagagaccaaagaggttccggacaagtaggaacttatggcctcaatacattcacgaatatggaagtccaactgatccggcaaatggagtccgaaggaattttcttaccaagtgaactagaaacgcccaatctcgccgaacgcgtcctcgattggttagaaaaacatggagccgagagattgaaaagaatggctatctcaggcgatgattgtgtagtaaaacctattgatgacagatttgctacggctctaacagctctaaacgacatgggaaaagtcagaaaagatattcctcaatgggaacccagcaagggctggaatgattggcagcaagtaccgttttgttcgcatcactttcatcaactaataatgaaagatggtcgagaaattgttgtaccatgtagaaaccaagatgaactggtaggtagagctagagtttcacaaggcgcaggatggagcctgagagagacagcatgtttgggcaagtcatacgcacaaatgtggcagctgatgtacttccataggagagatttaagattggcagcaaatgccatatgcagtgcagtaccagttgactgggtacctacctcaagaacaacttggtccatacatgcacatcatcaatggatgacgacagaagatatgctcagtgtctggaacagagtttggatagaggaaaacccgtggatggaggacaaaacgcacgtaagtagttgggaggaggtaccctacctagggaaaagagaagaccaatggtgtgggtcattaattggccttactgcgcgagcaacgtgggctacaaacattcaggtagctatcaaccaagtccgacgtttaataggtaatgaaaattatctggattatatgacatcaatgaagaggttcaaaaatgaatctgatccagaaggcgcattatggtaa

SEQ ID NO: 21340 - RNA, 9879 nt, synthetic construct
  misc_feature 1..9879: note = derived and/or modified CDS sequence (opt6) from DENV-1__KF973465__SS-prME
  source 1..9879: mol_type = other RNA
tctgttactatgttactaatgctgttaccgacagcacttgcatttcacttgacgacacgaggaggagaacctcacatgatagtgtcaaaacaagaaagaggtaaatcattattgtttaaaacaagtgcgggagtcaacatgtgtacacttatagccatggatctaggggaactctgtgaagacactatgacatacaaatgtccccaaatcacagaagcagaacccgacgatgtggattgttggtgtaatgcaacagacacatgggtaacatacggaacatgcagccaaacaggagaacaccgaagagataaacgatcagttgcgttagcgccgcatgtgggtttaggattagaaactcgaactgaaacttggatgagcagtgaaggagcctggaaacaaatacaaagagttgaaacgtgggctctgcgacatccgggttttacagtaatagctctgtttttagctcacgctatcggaacctctataacgcaaaaaggaataatttttatattgttaatgctagttacaccttctatggctatgagatgtgtgggaattgggaatcgcgatttcgttgaaggtctgagtggggctacttgggttgacgttgtacttgaacacgggagttgtgtgactaccatggccaaaaataaaccaaccttggatatagaactattgaaaacagaagtcacaaatccagcgatactacgaaaactttgcatagaagcaaagataagcaacacgactacagacagcagatgtccgacacagggagaggcaactctagttgaagaacaagacgctaattttgtgtgcagacgaacgttcgttgaccgaggatggggaaatggatgcgggttattcggtaaagggagtttattaacttgtgcgaagtttaagtgcgtgacaaagctagaagggaaaattgtgcaatatgaaaatctgaaatattcagttattgtaaccgtccacaccggagaccaacatcaagtaggaaatgaaacaacggaacatggaactattgctaccatcacgccgcaagccccgacatctgaaatacaactaacagactatggagcactgacgcttgattgtagtccccgaaccggacttgatttcaatgagatggttctgttaacaatgaaggaaaaatcatggctagttcacaagcaatggtttctagatttaccactaccatggactagcggagcaagcacctcccaggaaacctggaatcgacaagatctattagttacttttaaaacagcacacgccaagaaacaagaagtagtagttttgggttcacaagaaggagccatgcatacagccttgactggcgctacggaaatacagactagcggaactacgacaatattcgcgggacatctaaaatgtcgccttaaaatggataaattgactctaaaaggtacatcatatgttatgtgtacaggttcgttcaaacttgaaaaagaggtagcggaaactcaacatggtactgttctcgtacaagtcaaatatgaaggtacggatgccccatgcaaaattcctttttcaacacaagatgaaaaaggagttactcagaatggtcgactaataacagcgaaccctattgtgactgacaaagagaaaccagtcaatattgaaacggaaccacccttcggagaaagttatattgtagtcggggcaggagaaaaagctctaaaattaagttggtttaagaaaggtagctcaatcgggaaaatgtttgaggctacggcaagaggtgctcggaggatggccatacttggagacacagcctgggattttggatcaatgggcggagtatttacgagtgttggaaaattggttcatcaagtattcggaacagcgtatggcgtcctattttctggagtatcctggacgatgaagataggcattggcatattactcacttggctaggacttaatagtcggtctacgtcattgtccatgacgtgtatagcggtcggtatggtgacattatatcttggtgtgatggttcaagcagactcgggctgcgttataaactggaaaggacgggaactaaagtgtggtagtggtatctttgtcactaacgaagtccacacctggacagaacaatacaaattccaagctgactctcctaaacggttgtcggctgcaataggaaaagcatgggaagaaggcgtttgcggcatcagaagtgcgacgaggttagaaaatattatgtggaaacaaataagtaatgaactgaatcacatattgcttgaaaacgatatgaaatttacagtagttgttggggacgcaaatggcattctcgcacaaggcaagaagatgataagaccgcaacctatggaacataaatacagctggaaatcctggggaaaagcgaagataataggagcagatattcaaaataccacatttataatcgatggacctgacactccagaatgtccagataatcaacgcgcgtggaacatctgggaggtggaagactatggattcggtatcttcacgacaaacatttggcttaaacttcgcgattcgtatactcaaatgtgcgatcatagacttatgagtgcagcgatcaaagactctaaagctgtccacgcggacatgggatactggattgaatcagagaaaaatgaaacatggaaattagctagagcgagttttatagaggttaaaacatgtacatggcctaaaagtcatacactgtggagtaatggtgttctcgaaagtgaaatgattatacccaaaatctatgggggacccatttcacagcataactatagaccaggctatttcacacagactgccggaccatggcacttaggcaaattagaattagactttgaactatgcgaaggaaccacagttgtagtggacgaacactgcggaaatcggggcccttccctaagaacaaccaccgtcaccgggaaaataatacatgaatggtgctgtagaagctgtaccctaccacctttaagattcaggggcgaggacggctgttggtatgggatggagataagacccgtaaaagaaaaagaggagaacctagtccgctccatggtcagtgccggttcgggtgaagtcgattcattctcgttaggcattctttgtgcgtcaataatgattgaggaagttatgagaagtcgctggtcgagaaaaatgctaatgacaggtacattggcggtatttctcttattaatcatgggacaattgacgtggaatgatctgatccgactttgtataatggttggggctaacgcttcagatcggatgggaatggggacaacatacttagccttgatggctacatttaaaatgaggcccatgtttgcagtaggtttattatttagacgccttacaagtagggaagttcttcttctaacaataggactgtccttggtagcttctgtagaattaccaaattctcttgaggaattaggggacggcttggcgatgggaattatgatgttgaaactactgactgaatttcaaccgcatcagctatggaccactttattatctttgacctttattaaaacaacgctctcacttgattatgcatggaagacaactgcaatggcgttatcaatcatatcactttttccactatgtctaagtacaacgagtcagaaaacaacttggttaccagttttattaggatcctttggatgtaaacctctcacaatgtttctcataaccgagaacaaaatatggggtcgtaaaagttggccgttgaacgagggaataatggctataggaatagtttccatactactaagctcattattgaaaaatgatgttccactcgcaggtccactaatagcaggagggatgttaattgcatgctacgtgataagcgggagttcagcagacttgagcctagaaaaagccgcagaggtatcatgggaacaagaagctgaacactctgggacatctcataatattcttgtggaagtgcaagacgacggaacgatgaaaataaaagacgaggagagagacgacacattaacaattctgctaaaagctactttacttgccgttagtggcgtatatcctatgtctatacctgccacactgtttgtatggtatttctggcagaaaaagaaacaaagaagtggagttttatgggacaccccgagccctcctgaagtggaacgcgcggtattagacgatggcatatatcgaatactccagagagggttattaggacggtctcaagtaggagtgggcgtgtttcaagacggagtatttcatactatgtggcacgttactcgaggggctgtattgatgtaccaaggcaaaaggctagaaccaagttgggccagcgttaagaaagatttaattagttatggaggcggatggagattccaagggtcctggaatactggagaggaagttcaggtaattgccgttgaacccggaaagaaccctaaaaatgtgcaaacaacacccggcacgtttaaaacaccagagggtgaggtcggcgcaattgcactagatttcaaaccggggacctccggaagtcctatcgtaaaccgggaaggaaaaatagtaggattatacggcaacggcgtagtaacaacttcgggtacttatgtatcggcaatcgcacaggcaaaagctagccaggaaggacccttaccggaaatcgaggacgaagtattcaagaagagaaacttaaccattatggatctacatccaggaagcggaaagacacgacgctatttaccagctatagttagagaggctatcaagcggaaactcagaacattgattctagctccaaccagagtcgtagcaagtgaaatggcagaagccctaaaaggaatgccgatccggtatcagacaactgccgttaaatctgaacataccggccgagaaatagtcgatcttatgtgtcacgccacctttacaatgagattgctgagtcctgttcgcgttcctaattacaatatgattataatggatgaagctcacttcaccgatccagcatcaatagctgctcgaggatacatcagtacgcgagtaggaatgggagaagcggcggcaatctttatgaccgctacgccacccgggagtgtcgaagcattccctcaatctaatgccgttattcaggatgaagaaagagatattcctgaaaggagttggaacagcgggtacgattggataaccgacttcccgggaaagacagtctggttcgtcccgtcgataaagtcaggcaatgacattgcgaactgtttacgcaaaaacggaaaaagagttatacaattgtctcgaaagacctttgatactgagtatcagaaaacaaagaataacgactgggattacgtagtaacaactgacattagtgaaatgggagccaactttcgagctgatagagttatagatccccgaaggtgtttgaaaccagtaatcctcaaagacggaccagaaagggtaatactcgcagggcctatgccagtgacagtcgcaagcgctgcccaaagaaggggccgtattggaagaaaccaaaataaagaaggcgatcaatatgtatatatgggccaaccattaaacaatgatgaagatcatgcccattggaccgaagctaagatgctcctagataatattaacaccccggagggaattataccagcactttttgaacctgagagagaaaaatcggctgcaatagacggtgaatatagattgcgaggtgaggctcgaaagacattcgtcgagctaatgcgtcgtggtgatttaccagtatggctgtcatataaagtggcaagtgagggtttccaatactcagatcggagatggtgctttgatggagaacggaataatcaagtattagaagaaaacatggacgtcgagatatggacaaaagaaggtgaaagaaagaaattacgaccgagatggctagatgcgaggacttactccgatccattggcgttacgagaatttaaagagttcgcagcaggtagaaggtccgtaagcggggacctaattttggaaattgggaaactccctcagcatttgaccttacgcgcgcaaaacgctctagataatctcgtaatgctacataattcagaacagggaggaaaggcttatcgccatgctatggaagaactaccagatacgatagaaaccttaatgctcttagcgttaatagctgtactgacaggcggggttacactcttctttctatcgggtaaaggtttgggtaaaacaagtattggtttattgtgtgtcaccgcgtctagcgcactactgtggatggcaagtgtagagccacattggattgctgccagtattatactagagttctttttaatggtgctgttgataccggaaccagaccgccaaagaacgccacaagataatcaactagcttatgtagtcataggactattgttcatgatacttacagttgctgcgaacgaaatgggcctgttagaaactaccaagaaagacttgggaatcggacacgtagctgctgaaaatcaccaacatgcaacgatgctagacgtggacctccgtccggctagcgcgtggactttgtatgcagtcgccacaaccgttataactcctatgatgagacatactatcgaaaataccactgctaatatatcgctaacagcaatagctaatcaggcagcaattttaatgggacttgataagggctggccaatttcaaagatggatataggagttcctctgctcgctctaggttgttattcccaagtgaacccactaacgctaactgcggcagtgctgatgctcgtagcccactacgccataataggacctggattacaggcaaaagccacgcgggaagctcagaagagaacagcagcaggcattatgaaaaaccctactgtggacggtatcgtcgcgatcgatctagatccggttgtttacgacacgaaattcgaaaaacaattaggccagataatgctactcatattatgcacaagccaaatactgctaatgcgaacaacttgggcattatgtgagtcaataacactagcaactggaccattgactaccctatgggaggggtcaccaggaaaattctggaatacaacaattgcggtttctatggcaaatatattcaggggatcgtatctcgctggcgcagggctagcgttcagtctcatgaagagtttaggcggtggaagacgcggaacgggagcgcaaggagagactctcggagagaaatggaaaaggcaactaaaccaattatcaaaatctgagttcaatatttacaaaaggtccggaataatggaagtggatcgctcagaagcaaaagaaggtctaaaaaggggtgagacaacaaaacatgccgtaagcagaggaacagcaaagttgcgctggttcgtagaaagaaatctagtaaagcccgaaggtaaagtcatagatctcggttgcgggcgtggtgggtggtcatactactgtgcaggactaaagaaagtaacagaggttaaaggatacacaaaaggtggaccagggcacgaagaacctataccaatggccacttacggatggaatttagttaaacttcattcgggtaaagatgtattctttatgccgcctgaaaagtgtgatacgttgttatgcgacataggtgaaagcagccccaaccctacaattgaggagggacgaacgttgagggtacttaaaatggttgagccatggttaagaggtaatcagttttgtattaagatattgaatccgtacatgccgtccgtagtggagactctagaacaaatgcaacggaaatacggaggaatgctggtaaggaaccctttgtcacgcaatagtacacatgaaatgtattgggtaagttgcggaacgggaaatatagtgagcgctgtaaatatgacgtctaggatgttgcttaacagatttaccatggcacaccgtaaacccacttatgaaagagatgttgatttaggtgccggtacaaggcatgtggcagtagaacccgaagtagctaatttagatataataggacaaagaatagagaatatcaaaaatgaacataagtcaacctggcattatgatgaggacaatccatacaagacatgggcctatcatgggtcgtatgaggttaagccatcaggaagtgcatcatcaatggtaaacggagtagtacggttgttaactaaaccttgggatgtaataccaatggtgactcaaatcgcaatgacagatacaacaccatttggtcaacaaagagtatttaaagagaaagtagacactagaactcctcgagccaaaaggggaacaacacaaattatggaggtaacagcgaagtggttatgggggtttttgagccgaaataagaagcctcgaatttgcaccagagaagagtttacgagaaaagtccggtcaaatgcagccataggtgcagtctttgtcgacgaaaatcaatggaacagtgctaaagaagcagtagaagatgaaagattctgggatctagttcgacgggaaagagaactccataaacaaggaaaatgtgcaacctgtgtatataacatgatgggtaagagagagaagaaattgggtgagttcggaaaggcaaaaggaagtcgagcaatatggtatatgtggttgggagcaaggtttcttgaatttgaagcactaggcttcatgaatgaagatcactggttttctcgggaaaatagcctatcgggtgtagaaggagaaggattgcacaaactaggttatatccttagggatatctccaaaatcccgggaggaaatatgtacgcagatgatacagcgggatgggatacaagaataaccgaggacgacttacaaaatgaagccaagataacagatataatggaaccagaacatgcattactagcaacgtcgattttcaagctcacctaccaaaataaggtagttagagtccaacgaccggccaaaaatggaactgttatggatgttatctcaagaagagatcagcgagggtcaggacaagttggtacatatggattaaacacttttactaatatggaagtccaattaattagacaaatggaatcggagggcatttttctaccaagcgaactggagacacccaatctggccgaaagagttttagactggttagagaaacacggggcagaaagattaaagagaatggccatatccggggatgattgtgttgtgaaaccgatcgacgatagatttgcaacggccctaaccgccttaaacgacatgggaaaagtgcgtaaagatataccccaatgggaaccgagtaagggctggaacgattggcaacaagtacctttttgttcacaccacttccatcagcttattatgaaagatggtagggagattgtagtcccgtgtcgaaatcaagacgagttagtgggtagagccagggtcagtcagggagccggttggtccctacgggagacagcgtgcctcggaaaatcctatgctcaaatgtggcaactaatgtactttcacagaagagatttacgtctggctgccaatgcgatatgctccgcagtacctgtggactgggtgccgacctcacgaacaacttggtcaatccatgcccatcaccagtggatgacgacagaagatatgctatctgtatggaatcgcgtgtggatagaagaaaatccatggatggaagataaaacacatgtcagttcatgggaggaagttccttacctaggaaaaagagaagatcaatggtgtggcagcctgattgggcttaccgcaagagcgacgtgggcaacaaacatacaagttgcgataaatcaagtccgaaggttgatcggcaacgaaaattatctcgattatatgacaagtatgaaaaggttcaaaaacgaaagtgatcccgaaggtgctttgtggtga

SEQ ID NO: 21341 - RNA, 9879 nt, synthetic construct
  misc_feature 1..9879: note = derived and/or modified CDS sequence (opt6) from DENV-1__KF973466__SS-prME
  source 1..9879: mol_type = other RNA
tctgtcaccatgttattaatgttaatgccgacggcgttagctttccacctcacaacaagagggggagaaccacacatgatagtaagtaaacacgaacgtggaaaggctttattattcaaaacatctactggcgtaaacatgtgtactctaattgcgatggacttaggggaactttgtgaagatacgatgacatataaatgcccaagaataactgaagcagaaccggatgatgttgattgttggtgtaacgcaactgacacctgggtgacctacggcacatgtagtcaaacaggtgagcatagaagagataagcgatcagtggctctcgcaccacacgttggccttggcctcgaaactagaacagaaacatggatgagttcagaaggggcatggaaacaaatacaaagagttgaaacatgggctctaagacaccccggtttcacggtaatagccctatttcttgctcacgcaatagggacctctataacgcaaaaaggaataatctttattttactaatgcttgttaccccaagtatggctatgcgatgcgtgggtataggaaaccgagattttgtcgaaggtttaagtggtgctacctgggtcgatgtggtactggaacatggttcctgcgtgaccactatggcgaaaaacaaacctaccttagacatcgaattgctaaaaacggaagtaacaaatcctgcagtattaagaaaactgtgtatagaagctaaaatatcaaatactactacagactctagatgcccaactcaaggtgaagctaccctcgttgaagaacaagatgcgaatttcgtttgtcgacgtacgtttgttgatcgaggttgggggaatggttgtggtctctttggaaaaggatccctgttaacgtgtgctaaatttaaatgcgtcactaaattggaaggaaaaatcgtccaatatgaaaatctaaagtattcggttatcgtaacagttcacacaggtgatcagcatcaagtgggaaatgaaaccacagaacatggaacaatagctaccataacaccacaagccccaacatcagaaatacaattaacagattacggggcactgacgttagactgcagtccaagaacaggactcgatttcaacgagatggtcctactaaccatgaaagagaaatcctggttagtgcacaaacaatggttcctggacctaccactaccgtggacaagtggagcttcaacctctcaagagacatggaatcggcaagacttgttagtgacttttaagacagcgcatgccaagaaacaggaagtagtagtattgggaagccaagaaggagccatgcacactgctttaacaggagcaactgaaatccaaacgagcggtactacgacaatcttcgcgggccacctaaaatgtcgtttaaaaatggacaaacttacattaaaagggacttcttacgttatgtgcacaggcagcttcaagctagagaaggaggtagctgaaacacaacatggaacagtattggtgcaagttaaatacgaaggtacagatgcaccatgtaagataccattttctacgcaagatgaaaaaggcgtaactcaaaacggtagattaattacagcaaaccctatagtaaccgataaggagaaaccagtcaatatcgagacagaacccccatttggggaaagttatatcgtggtaggagctggtgaaaaagcattaaaactatcttggtttaagaaaggatccagtataggaaaaatgttcgaggcaactgcgcgaggagctagacggatggctattctaggtgacaccgcgtgggatttcggcagcataggtggagtattcacatctgtaggtaaattagtacaccaagtttttggtaccgcatacggagtcctcttctctggcgtatcgtggacaatgaagattggaatcgggattctactgacttggttaggactgaatagtcggtcaacatccctgtctatgacatgtatagcagtggggatggtaacattgtatctaggagtaatggtacaagctgactcaggttgcgtaattaattggaaaggacgtgaattgaaatgtggatcaggaatatttgtaacaaatgaagtgcatacctggaccgaacaatataaatttcaagccgactcacctaaacgtttatcggcagccatagggaaggcttgggaagaaggtgtatgtgggatcagaagtgccacccgcctagagaacatcatgtggaaacagattagtaacgaattaaaccatatcttactagaaaatgatatgaaatttacagttgtagtcggcgatgcaaacggaatcctagcgcaaggtaaaaagatgatcagaccacaaccgatggagcataaatactcatggaaatcatggggtaaggcaaaaattataggagctgatatccagaatactacattcatcattgacggaccagatacaccggaatgtccagatgaccaaagagcgtggaatatttgggaagtagaggactatggatttgggatatttactacgaatatatggttaaaacttagagactcatatacgcaaatgtgtgatcacagattgatgtctgccgcgataaaagattctaaggcagtacacgctgatatgggatattggatcgaatctgagaaaaatgagacctggaaattagcaagggcatcttttatagaggtaaaaacatgcacatggcctaaaagccacaccttgtggtccaatggagtcctagagagcgagatgataatacccaagatatatggcggccctatttctcaacataactatcgaccggggtactttacacagaccgctggtccgtggcaccttgggaaactagagctcgactttgacttatgtgaaggcacgactgtagtagtcgatgaacattgtggaaatcgaggaccttcactacgtacaacaactgtcacagggaaaattatacatgaatggtgctgccggtcctgcacattaccaccattacgatttagaggggaggatggctgctggtatggaatggaaataaggccggtgaaagaaaaagaagaaaatcttgtacgcagtatggtaagtgcagggtcaggagaagtagactcattttcattaggaatcctgtgcgtttcgattatgatcgaagaagtcatgcggtctagatggagtcgcaaaatgctaatgacgggaacgttagctgtatttctactattgataatgggccaattaacttggaatgacctaataagattgtgtatcatggtaggtgctaatgcgtctgacagaatgggcatgggaaccacttatttggcattaatggctacattcaagatgagacctatgtttgctgtcggaatactgtttcgacgattaacgagtagagaagtcctgttgttaactataggattaagcctagtagcaagcgtagagttacctaattcattagaagaattaggtgatggacttgcaatgggtattatgatgttaaaactactcacagaatttcaacctcatcagctttggacgacgttactatcacttacatttattaagacaacgctttcgcttgactatgcatggaagacaacggcaatggctctttcaatagtatcgttgttccccttatgcctgagtacaacctcacagaagacaacatggttgcccgttttgttaggatcgttcggatgcaaaccacttacaatgtttttgataaccgagaacaaaatatggggccgcaagtcttggccaataaatgaaggtataatggccattggaattgttagcatacttctctcatcattattaaagaatgatgtgccacttgcaggtccactaatagctggtgggatgttaatagcatgctatgtgatatctggaagctcagcagatctctccttagagaaagcagctgaagtatcctgggaacaagaagccgaacacagcggcacttcacataatattcttgttgaagtgcaggacgatgggacaatgcgaataaaggacgaagaaaaagacgacactttaaccatactactaaaagcgacacttctcgcagtttcaggcgtgtacccgatgtcaatcccggctaccttatttgtgtggtatttctggcagaaaaagaaacaaagatctggtgttctttgggatacccccagtccacctgaagtagaaagagctgttttagatgatggtatatatagaatactgcaacgaggccttctggggagatcccaggtaggagtgggagtttttcaggacggagtttttcatacgatgtggcatgttactcggggtgccgtacttatgtaccaaggcaaaagattggaaccgagttgggcgtcggtcaaaaaggatttaatatcctatgggggaggttggcgtttccaaggcagttggaatactggcgaggaggttcaggtaatagcagttgaacctggaaagaatcccaaaaatgtacagactacacccgggacgtttaagacatccgaaggtgaagtcggtgctatcgctttagactttaaacctgggacatctggaagtcctattgtaaacagggaaggtaaaatagtcggactatacggaaatggggtagttactacgagtggtacatatgttagcgctattgcgcaggccaaaacctcgcaagaaggacctttacctgagatcgaggacgaagtctttaaaaagagaaacttgacaataatggatttacatccaggctcaggtaaaacacgtaggtatttacccgccatcgtccgagaagctataaaaagaaagctaagaacgcttattctggctccaactcgtgtagttgcatctgagatggcggaagcccttaagggtatgccaataagataccagaccactgcagttaaaagtgaacacacaggtcgcgaaattgtagatctaatgtgtcatgcaacgtttaccatgcgcttgctatctcctgttagagtaccaaattataacatgattatcatggatgaggcacactttaccgatccggcttcgatagcggcccgaggatacatcagtactagagtaggaatgggtgaagccgctgcgattttcatgaccgcaacccctccgggcagtgtcgaggcatttccacaatcgaacgcggtaatacaggacgaggaaagagacatacctgaaagaagttggaactccggatacgattggataaccgatttcccagggaaaacagtttggtttgttccttcgatcaaatcgggaaacgatatagctaattgcctgaggaaaaatggtaaaagggttatacaattgtcaagaaaaacattcgatactgagtaccagaaaactaaaaataatgattgggactatgtagtaaccacagatataagtgaaatgggagcgaacttccgcgcagaccgcgtgattgacccccgtcgctgtctgaaaccagttattttaaaggatgggccagagagagtgatacttgccggaccaatgccagttactgttgcaagtgcggcacaaagacggggtagaataggtcgcaaccagaacaaagagggtgaccaatatgtctacatggggcaacccctgaacaatgatgaagatcatgcgcattggacagaagccaaaatgcttcttgataatattaatacgccagagggcatcataccggcactcttcgaacccgaacgagaaaaatcagcagccatagatggggaatatagattgagaggagaggcaaggaaaaccttcgttgagcttatgagacgaggtgatctgccagtttggctttcctataaagtcgcgagtgagggatttcaatacagcgacaggcgatggtgttttgacggagaacgcaacaatcaagtattagaggaaaatatggatgtcgaaatatggacaaaggaaggcgaaaggaagaaattaagacctcggtggttggacgcacggacttactctgatcccttagcactgagagaatttaaagagtttgcagctggtcgccgaagtgtttccggtgacttaatactagaaataggaaaactgccgcaacacctgacattgagagcacaaaatgccttagataatctagtaatgttacacaactcagaacaaggaggaaaagcatacagacacgcgatggaggaactaccagacaccatagagacattaatgttgttagcattaattgcagtcttgacaggaggtgtgactctattctttctatcgggcaagggacttggcaagacgagtatagggctcctttgtgtaacagcgagttcggcactactatggatggcaagcgtggaaccacattggattgccgcaagcattatactcgaatttttcctaatggtcttgctgataccggaaccagatcgccaacgaacaccccaggacaatcagttggcgtatgttgttataggcttgctctttatgattttaacagtcgctgcgaacgaaatgggtctcttggaaacaacaaaaagggacctgggtataggacatgtagccgcagagaaccatcaacatgctaccatgttagatgtggatttgcggcccgctagcgcgtggacactgtatgcggtcgcgacaacagtaattacacccatgatgcgacacacaatagaaaatacgactgcaaatatcagcttgacagcaatagctaatcaggcagcaatacttatgggtttggataagggttggccgatttcaaaaatggatataggagtcccgttgctagcactaggttgctactcacaggtaaatccactgacacttactgctgcagtactaatgttagtcgcacattatgcaattattggaccgggattacaagcgaaagcaacaagggaagcccagaaaagaactgcggcgggaatcatgaaaaacccaacagttgacggaatagtggctatcgatttagacccagttgtctacgatgctaaatttgaaaaacaactaggacaaattatgttacttattctctgtaccagtcagatattactaatgcgcacgacctgggctctatgcgaaagtattacattagctacaggacccctaacaactttatgggaaggttcgcccggtaagttctggaatacgactatagcagtatcgatggctaatatttttagaggtagttatttggcgggggcaggactagcatttagcttaatgaaatctcttggaggaggaagacgtggaacaggagctcaaggagaaaccctaggagaaaagtggaaaagacaattgaatcaactaagtaaacccgagttcaacacctataaaaggtcaggaattatggaagtagatcggtccgaagccaaagaagggcttaaaaggggcgaaaccactaaacatgcggtgagcagggggacagccaagttgcgatggtttgtggaaagaaatttagtaaaaccggagggaaaagtcattgatctcggatgtggtagaggaggctggtcatattactgcgcagggctaaagaaagtaacggaagtaaaaggctatacgaaaggaggcccgggccatgaagaacccatcccaatggcaacttacgggtggaatttagttaaactccacagtggaaaagatgtattctttatgcctccagagaaatgtgacacgcttctgtgcgacataggggaatcatctccaaaccctacgatagaagagggacggactcttagagtgttaaaaatggtcgaaccttggctgagaggaaatcagttttgtataaaaatactaaatccttatatgccgtcagtagtggaaacgttagagcaaatgcaaagaaaacatggaggtatgctggtgaggaatcctctcagccgcaactctacacatgaaatgtattgggtaagttgtgggacaggaaatatcgtaagtgcggtaaatatgaccagtagaatgttgcttaaccgatttacaatggctcatagaaaaccaacctacgaaagagacgtggacctaggagcgggcaccagacatgtagcggtcgaacctgaagtggccaatctagatataataggtcaaaggatcgaaaatatcaaaaatgaacataaaagtacatggcactacgacgaggataacccatataaaacgtgggcatatcacggtagttatgaagtaaaacctagtggaagtgcctcgtcgatggtaaatggtgtagtcagattactaactaagccatgggatgtcattcccatggtaactcaaatcgctatgaccgacacgacgccatttggacaacaacgtgttttcaaagaaaaagtggatacaagaacaccgcgtgcaaagagaggaaccacccagataatggaggttacggccaagtggctctggggcttcttatcgcgtaataagaaaccaagaatctgtacgcgtgaagaatttactaggaaggttagatctaatgccgctatcggggccgtcttcgtggacgaaaatcagtggaatagcgccaaagaggcagtagaggatgaaagattttgggacttagtacatcgggaacgagaactacataaacaaggaaaatgtgcaacttgtgtatataacatgatgggaaagcgagagaagaaactgggcgagttcgggaaagcaaagggtagcagggctatatggtatatgtggttaggggctagatttctggaatttgaagcacttggatttatgaatgaagaccactggttttcgagggaaaatagtcttagtggagttgaaggagagggtttacataaactgggatacattctaagagatatttccaaaatacctgggggaaatatgtacgctgatgacacggctggttgggatacaagaattacagaagacgatttgcagaatgaggcgaagataacagatattatggaacccgaacatgcccttcttgctaccagtatattcaaactaacttatcaaaacaaagtagtgagagtacaacgacctgccaaaaacggtaccgttatggatgtcataagccgtagggatcaaaggggatcaggtcaagtaggaacttacggcctaaacaccttcaccaacatggaagttcagcttataaggcaaatggaatccgaaggaatatttctccctagtgaacttgagacaccaaatttagctgaaagggtccttgactggttagaaaagcatggagcggaaaggttgaagagaatggctatatcaggggatgactgtgttgtgaaaccaattgatgatagatttgctactgcacttactgcactgaatgatatgggaaaggtaagaaaagacataccacaatgggagccgagtaaaggatggaacgactggcaacaagtaccgttttgtagtcatcacttccaccagctaataatgaaagatggaagggagatagtagtaccgtgtagaaaccaagatgagttagtaggccgagctcgggtaagccagggtgccggatggtcattaagagaaacggcatgtctagggaaaagctatgcacaaatgtggcaattaatgtacttccatagaagggatctaagactagcagctaatgcaatatgctcagcagtgcccgttgactgggtaccaacaagccgtacaacatggagcatacatgctcatcaccaatggatgacgacagaagacatgctttcagtgtggaatagggtatggattgaggaaaatccgtggatggaagataagacccatgtatcatcgtgggaagaagtaccatatctgggtaaaagagaagaccaatggtgtggttcgttaattggtttgaccgccagggcaacctgggctacgaacatccaagttgctattaatcaagttcgtcgactaattggtaatgagaattacctagattacatgacgagtatgaaaaggtttaagaatgaatccgatccagagggagctctctggtaa

SEQ ID NO: 21342 - RNA, 9879 nt, synthetic construct
  misc_feature 1..9879: note = derived and/or modified CDS sequence (opt6) from DENV-1__KF973471__SS-prME
  source 1..9879: mol_type = other RNA
tcagtgactatgttattaatgctattaccaacagcattagcgttccatctcacaaccaggggaggagaacctcatatgatagtatcaaaacaagaacgagggaaaagtcttctatttaaaacgagtgcaggagttaacatgtgcacattaatagcaatggacctaggagaactatgtgaagatacaatgacgtataaatgtccgcaaataacagaagcagaaccggatgatgttgactgttggtgcaatgctacagacacatgggtaacatatggaacttgttctcaaaccggtgaacacagaagagataaaagaagtgtggcactagcccctcacgttggactaggacttgaaacaaggacggaaacatggatgagctcagaaggagcatggaaacaaatacaacgggtagaaacttgggcgttacgacacccaggattcaccgtaatagctctatttttagctcatgcaattggaacgagtattactcaaaaaggcattatatttattcttttgatgttagttacaccctcgatggcgatgaggtgtgtgggaataggaaaccgtgactttgtagaagggttgtcaggggcaacatgggtcgatgtagtcctcgaacacggatcatgtgtgactactatggccaaaaacaaaccaaccttggacatagaattactaaaaaccgaagtaacaaatccagcgattctaaggaaattatgtatagaagctaaaatatctaacacgaccactgactctcgttgccctactcagggagaggccacgctagtagaagaacaagatgcaaactttgtatgtagaagaacattcgtagatcgtggatggggtaatggctgcggacttttcgggaaaggatcattactaacatgcgcaaaattcaaatgtgttactaaactggaaggaaaaatcgttcaatatgaaaatctaaaatatagcgttattgtaacagtacacacaggagatcaacatcaagtaggcaatgagactactgaacatggcaccattgcaacaattacaccacaagcaccaacctccgaaatacaattgacagattacggtgcactgactctggattgttccccgcgtacggggctagacttcaacgaaatggtactgctaacaatgaaagaaaaatcatggcttgtgcacaaacaatggtttttagatctacccttaccctggacaagtggcgcaagcacatcccaagaaacctggaatcggcaagacctactcgttacttttaaaacagcccatgctaagaaacaagaagtggttgtactagggagtcaagaaggtgcgatgcataccgcactaactggagcaactgagatccagacaagcggtacaactactatatttgctggtcatctaaaatgtaggttaaaaatggataaactaacattgaaaggaacatcatatgttatgtgtacagggagcttcaaactagaaaaagaagtagcagaaacacagcacggtactgtcttagttcaagtcaaatatgaaggcacggatgcgccatgtaaaataccgttttccactcaagatgaaaagggtgtcacacaaaacggtcgtctcattacagcaaacccaatagtaactgacaaagaaaaacccgttaatatagaaacggaacctcctttcggagaaagctacatcgttgtcggcgctggcgagaaggcactaaaactttcctggttcaagaaaggatcttccattggcaaaatgttcgaggctaccgcaaggggcgctagaagaatggcaatcctaggagatacagcgtgggacttcggctccataggcggcgtattcaccagtgtagggaaactggtacaccaagtctttggaacagcttatggagttttattcagtggcgtctcatggacaatgaagataggcatagggatactcctgacatggttgggacttaactctagatctactagcctatccatgacttgtatagcagtcggtatggttaccttatacttaggagtaatggttcaagccgatagcggatgtgtgatcaactggaaaggacgtgaattaaagtgtggttcaggcattttcgttactaatgaggtgcatacatggactgaacagtataaatttcaagcagatagtccaaaaagactttcggcagcaataggcaaagcctgggaagaaggagtttgcggcattcgttcagcaacacggctagaaaacattatgtggaaacaaatctcaaatgagctaaatcatatcctactagagaatgacatgaaatttacagttgtcgtgggagatgctaacggcattctagcacagggaaagaaaatgatccgaccccaacccatggagcataaatacagttggaaatcgtggggtaaagctaagatcataggtgcagacatacaaaacacaacgtttattatagatggaccggatactcccgaatgtccagacaatcagcgcgcatggaacatttgggaggtggaagattacggtttcggaatttttacaacaaacatatggttaaaactaagagattcttatacccaaatgtgtgaccatagattaatgtcggcagcgataaaagatagtaaggctgtccatgcagatatgggctactggatagagagtgaaaagaatgagacatggaaacttgctagggcctcatttattgaagttaaaacgtgcacctggcctaagtcccatacgttatggtcaaatggtgtcctagaaagtgagatgatcatacctaaaatttacggaggtccaatctcacaacataattatagacctggttactttacccaaacagccggtccttggcacctgggcaaactagaattggactttgacttatgcgaaggaacgacggtggtagtcgatgagcactgtggtaaccgaggtcctagcctcagaactactaccgtaactgggaagataatacacgaatggtgttgcagaagctgtacccttcccccattaagattccgaggagaagatgggtgctggtatggcatggaaatcagacctgttaaagaaaaagaagagaatttggtcaggtcaatggtctcggccggttcaggagaagtcgacagcttcagtttaggaatattatgcgctagtataatgattgaagaggtgatgcggtccaggtggtcgcgaaagatgctaatgacagggacaccagcagtcttcctactacttatcatggggcagctaacatggaacgatcttatacgactttgtattatggtcggagctaacgcatctgataggatgggtatggggaccacctacttagcattaatggctacgttcaaaatgcgaccgatgttcgccgtaggccttctatttagacgtctgacgtcccgagaggtcctcctacttacaattggacttagtcttgtagccagtgttgaactgccaaactctttagaagagttgggtgatggattagcaatgggaattatgatgctcaaactgttgacggaatttcaaccccatcaattatggacgacacttcttagcctgacattcatcaagacaacattatctttagattacgcatggaagaccactgcaatggctctcagcattatttccttgttccctctttgtctaagcacaacttcacaaaagactacatggcttcctgttctgttagggagctttggatgcaaaccgctcacgatgtttctaataactgaaaataaaatctggggtcgtaagtcttggcccctgaatgaagggattatggcgataggaatagtgagtatacttctctcaagcctgctaaagaatgacgtaccattagcaggtccactcacggctggaggcatgttaattgcttgttatgtaatcagtggttcatccgctgatctgtcactggaaaaagcagcagaagtcagttgggagcaagaagcagaacattcggggacatcgcataacatcctagtagaagttcaagatgatgggactatgaaaataaaagatgaggagagggacgatacacttacaattctccttaaagcaacacttctagcagtcagtggggtatatcctatgtcaattcccgccacgctgtttgtatggtatttttggcagaaaaagaaacagagatcgggagttttatgggatacaccaagcccaccagaggtggaacgagccgtcctagacgacggtatttatagaatacttcagaggggcctattggggagaagtcaagtaggggtgggagttttccaagatggtgtgtttcatacgatgtggcacgtaacccgtggagcagtattaatgtatcaaggaaaacgattagaaccaagttgggcatctgtcaagaaagatctgatatcttacggagggggttggagatttcagggatcatggaataccggtgaagaagttcaagtcatcgcagtcgaaccagggaagaatcccaaaaatgttcaaactacacccggcactttcaaaacacccgaaggagaggtcggcgcgatcgcactggacttcaaaccaggaacatcagggagcccaatcgtgaatagagaaggaaaaatagtcggattatacggaaacggtgtagttaccacctctggaacctacgtatcagcaattgcccaggcaaaagcgagccaagaaggccctctgcctgaaatagaagatgaagtatttaaaaagcgaaacctaaccatcatggacctacaccccggtagtgggaagacaagaagatatttgccagcaatagtaagggaagccattaaacgtaaactgagaacattaatccttgcaccaacgagggttgtagcctccgaaatggcagaagcgctaaaaggaatgccaatacgatatcaaaccactgctgtcaaatcggaacatacagggcgcgaaatcgtggatttaatgtgtcatgcgacattcaccatgaggctactctcgcctgttagagtccctaattataacatgataataatggacgaagcgcatttcactgatcctgcatctatcgccgcccgaggatacatatcaacacgtgttggtatgggagaagctgcagcgatttttatgactgctacaccacccggcagcgtagaagcatttccacaaagtaatgccgttatccaagatgaagaaagagacattccggaaagaagttggaactctggatatgattggataacagactttccaggtaaaacagtgtggtttgtaccatcaatcaaaagtgggaatgatattgcaaactgtctgaggaaaaatggaaaaagggtaatacaactgtcgcgcaaaacctttgacaccgagtaccagaaaacgaaaaacaatgattgggattacgtagtaacaacagacatatccgaaatgggtgccaatttccgtgcagacagagttatcgaccccagacgatgtttaaaaccagtaattttaaaggacggtccagaacgggttatattagctgggcctatgcctgtaacagtcgctagtgcagctcaaagaaggggtcgcatagggaggaatcagaataaagaaggcgaccagtacgtatatatgggtcaaccacttaacaatgacgaagaccatgcccattggacagaagcgaaaatgcttttagataacattaataccccggaaggaataattcccgctctattcgaaccagaacgtgaaaaatccgcggcgatcgatggagaatatagacttcggggcgaagcgcgaaaaacttttgttgaattgatgagaagaggcgatttaccagtttggttatcatataaagtagcatcagaaggtttccagtattcagatcgacgctggtgctttgacggagaaagaaataatcaagtattagaagagaatatggatgtcgaaatttggaccaaagaaggggaaagaaagaaacttagaccacgctggctagatgcaaggacttacagtgatcccctagcacttagagaatttaaagagtttgccgccggtagaagaagtgtaagcggtgaccttattttagaaatagggaaattacctcaacacctcactctaagagcgcaaaacgcattagataatctggtaatgctgcataatagtgaacaaggtggaaaggcttataggcatgctatggaagaattaccggacaccattgaaacattaatgttattggccctcatagcagtgttaactggaggcgtaacacttttcttcctatctggaaaaggactgggaaaaacttcgataggtttactctgcgtgactgcgagcagtgcgctgctatggatggcaagtgtcgaaccacactggatagcagcatcaattatacttgagttctttttaatggtgcttctgatacccgagcccgaccggcagaggactccacaagacaatcaattggcgtatgtcgtaataggactattatttatgatactaacggttgccgcaaacgagatgggtctattagaaacgacaaagaaagatctgggaattgggcatgtagccgcggaaaaccatcaacacgcaaccatgctcgatgtagatttgcgtccagctagtgcatggacactctatgctgtagcgacaacagttatcacaccaatgatgagacataccatagaaaatactacagcaaatatctcactgactgctatagcaaatcaagccgcaatattaatggggctcgacaaaggctggccaataagcaaaatggatataggtgtcccacttcttgcattgggatgttatagccaagtcaaccccttaacattgacagcagcagtactaatgctggtagcacattacgccatcataggtccaggtctacaagcaaaggcaacaagggaggcgcagaaaagaacagctgcgggaattatgaagaacccaactgttgatggtatagtagcgattgacttagacccagttgtctacgatactaaattcgaaaagcaactaggtcaaataatgcttttaattttatgcacaagtcaaatattacttatgcgaacgacgtgggcattgtgtgaatcaatcaccttagcaacagggcccctaacaacactttgggagggatctcctggaaagttttggaatactacgatagctgtatcgatggctaatatatttagagggagttatctcgctggcgcaggactagcattttccctaatgaaatccctcggaggagggcgccggggaacgggtgcgcaaggcgagacccttggcgaaaaatggaaaaggcaactaaatcaactgagtaaatccgaatttaacatatacaaacgaagcggtataatggaagtcgaccgttccgaggccaaagaaggactaaaacgaggcgagactacgaaacacgcagtctcacgcggaacagcaaaactgcgatggtttgtagaacgaaacctcgtcaaacccgagggaaaggtcatagacctaggatgtgggagaggaggctggtcgtactattgtgcaggtttgaagaaagttactgaagtaaaaggatataccaaaggcgggccgggccacgaagaaccgatacctatggctacatatggatggaatttagttaaacttcatagtggcaaagatgtattctttatgcctccagaaaagtgcgatactcttttgtgtgacataggcgaaagtagtccgaacccaacagtagaagagggtcggactttaagagtactaaagatggtagagccttggctcaaaggcaatcaattttgtattaaaatactgaatccctatatgccttcagtcgtggaaacgctagaacagatgcaacggaaatacggaggcatgttggtacgaaatccactctcacgcaactctactcatgaaatgtactgggttagttgtggaacaggaaatatagtatcagcagtaaacatgacatctcgaatgttacttaacagattcactatggcacatagaaaaccaacatatgagagagatgtggatctaggagctggaacaagacatgttgcagtggagccagaagttgccaatctagatataattgggcaacggattgagaatattaaaaacgaacataaatccacatggcattacgatgaagataacccttataaaacctgggcataccatggttcatatgaggtaaagcctagtggctctgcctcctctatggtaaatggagttgtacgcttgctcacaaaaccatgggatgttattccaatggtaacacaaatcgcaatgacagatactacaccattcggtcaacaacgagtgtttaaggaaaaagtcgacacccggactccgcgggctaaaaggggcacaactcaaatcatggaagtaacagctaaatggctctggggtttcttaagtcgaaataagaaaccacgaatatgcacaagggaggagttcactcggaaagtacgatcgaacgcagctatcggggcagtttttgttgacgaaaaccagtggaacagcgcaaaagaagcagttgaagacgaaagattctgggacctagtacatcgtgaaagagaattacataagcaaggcaaatgcgcaacttgtgtatataatatgatgggcaaaagagagaagaaactgggcgaatttggaaaagctaaaggaagtagggcaatctggtacatgtggttaggagcccgtttccttgagtttgaagcgcttggcttcatgaacgaggatcactggttctcacgggaaaacagtctaagtggtgtggaaggtgaaggtctgcacaaattgggatacatcttgagagatatatctaaaattccaggtggaaacatgtatgcggatgatacagccggctgggacactcggataaccgaagacgatttgcaaaacgaagctaaaataacagacattatggaaccagaacatgccctactagctacatcaatattcaaactcacgtaccaaaacaaagtggtacgtgtacaacgtcctgcgaaaaatgggacggtaatggatgtaatatcaaggagagaccaaagaggctcagggcaggtaggtacttacgggctcaatacatttacgaatatggaagtgcaactaataagacaaatggagagtgaaggtatcttcctaccttcagaattagaaacaccgaacttagctgaacgcgtactagattggttggaaaaacacggagcggaaagactcaaaagaatggcgataagcggagatgactgcgtagtcaaaccaatcgacgatagatttgcgaccgcactgacagcactaaacgacatggggaaggtgagaaaggatataccacaatgggaaccatctaagggttggaatgactggcaacaagttcctttttgtagccatcatttccatcaactcataatgaaagacggacgtgaaatcgtagtcccctgccgaaatcaggatgagctagtaggtcgagcacgagtgtcccaaggggcgggatggagcctacgagagacggcgtgtctaggcaaatcatatgcccaaatgtggcaactaatgtacttccataggagagatttgcgtctagccgcaaacgcaatatgctcagcagtacctgtagattgggttccaacgagtcggacaacttggtcgatacacgctcaccaccaatggatgaccaccgaggatatgttatctgtctggaatagagtatggatagaagaaaatccatggatggaagataaaacgcatgtatcatcttgggaagaggtaccttatctcgggaaacgagaagatcaatggtgtggatctttaatcggactaacggctagggcgacatgggcgactaatatccaagtggcaataaaccaagttagacgtttgataggaaatgagaactatttagactatatgacctcaatgaagagatttaaaaatgaaagcgatcctgaaggcgcattatggtga

SEQ ID NO: 21343 - RNA, 9879 nt, synthetic construct
  misc_feature 1..9879: note = derived and/or modified CDS sequence (opt6) from DENV-1__KF973472__SS-prME
  source 1..9879: mol_type = other RNA
agtgtgacaatgcttctaatgctactccctactgcattagcatttcatctcaccacgcgagggggcgaaccacatatgattgtttcaaaacacgaaagagggaaatcgctactatttaaaacaagtacaggggttaatatgtgcacattaattgctatggatttaggcgaactgtgtgaagatactatgacttacaaatgtccacgcataaccgaagcagaacctgatgacgtggattgttggtgtaatgcaactgacacgtgggtcacatacggtacctgttctcaaactggtgaacataggcgcgataaaagatcggttgctctagcaccacatgttggcctcgggttagaaacaagaacggaaacatggatgagttcagaaggcgcatggaaacaaatccaacgtgtggaaacatgggctctacgacatccagggtttacggtaatagcactattccttgcacacgccataggaacatccattactcaaaaaggaataatattcattttactaatgctcgtcaccccttctatggctatgagatgtgtaggaataggaaatcgcgatttcgttgaaggactatctggtgcgacctgggttgatgtagtactagaacatggctcctgcgtaactacgatggcgaaaaataaacccaccctggatatcgaattacttaaaacagaagtcactaacccggccgtacttagaaaactatgtattgaagcgaaaattagcaataccacaactgactcaagatgcccaacacaaggagaagctactctagtggaagaacaggatgccaatttcgtatgtagaagaacgctagttgacagaggatgggggaatggttgtggactttttggaaaaggatcattgttaacatgcgcaaaattcaaatgtgtgacaaaactagagggaaagatcgttcaatatgaaaacctgaaatattcagtcatagtaacggtacatactggcgaccaacaccaagtaggaaatgaaacaacggaacacggcaccatagccactattacaccgcaggcaccgacgagcgaaatccagctgacagattatggcgctctagcattagattgctcgcctagaacaggcctcgatttcaatgaaatggtactattaacgatgaaggagaaaagctggttggttcacaagcagtggtttttggacctgccattaccgtggacttcaggagccagcacatctcaagagacgtggaaccggcaagacctcttagttacatttaaaactgctcacgcaaagaaacaagaagtagttgtcctaggatcacaggaaggggcgatgcacacagcactaacgggtgcaactgaaatccagacatcgggaactactactattttcgccggacatttaaaatgcagattaaaaatggataaacttacactcaaaggcaccagttacgtaatgtgcactggaagttttaagctggagaaagaagttgcagaaacacaacacggaaccgtactggttcaagtaaaatatgaagggactgacgcaccctgtaaaataccgttttcaacacaagatgaaaagggcgtaacacaaaatggacgcctcataaccgccaacccaatagtaacagataaagaaaagccagtaaacattgagactgaaccgccctttggagaatcatatattgtagtaggagcaggagaaaaagctctaaaactgtcgtggtttaagaaaggatcttctattggtaaaatgtttgaggctacagcgcgtggagcccgacgtatggctattctaggtgacactgcctgggattttggatcaataggaggtgtattcacgtcggtaggtaagttagtccatcaagtgtttggtacagcctacggggtgctattctccggagtatcatggaccatgaaaattggaataggaatactgttgacatggttaggacttaatagcagatcaacatcgctgtcagttacatgcattgcagtcggcatggttacattatatctaggtgtaatggtccaagctgatagtggttgcgtaatcaattggaaaggaagggagctcaaatgtggatcaggtatatttgttacaaacgaagtgcacacttggacagagcaatataaatttcaggcagattcaccgaagaggcttagcgctgctatagggaaagcatgggaagaaggtgtatgcggaatacgtagtgcaacgagactagagaatataatgtggaagcaaatttcaaacgaactcaaccatattttgcttgaaaatgatatgaaatttaccgtagttgtaggggacgcgaacgggattttagcacaggggaagaaaatgatacgacctcaaccgatggagcataaatactcttggaagtcgtggggcaaagcaaagatcatcggagcagacatccaaaatactacattcataatagatggacctgatacacctgaatgccctgacgatcaacgcgcttggaacatatgggaagttgaagactacggatttggaattttcacaactaatatctggctgaaactaagggattcttatacgcaaatgtgcgatcatcgactgatgtctgcagcaattaaggacagtaaagcagtccatgcggatatgggatattggattgaatcagagaaaaatgaaacttggaagttggctagagctagttttatagaagtaaaaacatgtacgtggcctaaaagccatacgttatggagtaatggtgtccttgaaagtgaaatgattataccaaaaatctatggaggcccaatatcacagcacaattataggcctggttattttacacaaactgcagggccttggcatctaggaaaactagaattagattttgacctatgtgaaggcacaactgtcgttgtagacgagcactgcggtaatcgtggaccgagtttacgaactacaacagttacaggaaagatcatccacgaatggtgctgcaggagctgtaccttgccgcccctgagattccggggcgaagacggttgttggtatggaatggagataagaccggtaaaagaaaaggaagaaaacttggtacgatcaatggttagcgctgggagtggtgaggtcgattctttcagtttaggtatactttgtgtaagtattatgatagaagaagttatgaggtcccgatggtcacgaaagatgctcatgaccggtacgctagcagttttcctgttgctaatcatggggcaattaacgtggaatgacctaattagattatgcattatggttggcgcaaacgcctccgatagaatgggaatgggcacaacgtatttagctctgatggctacctttaaattacgaccgatgtttgcagttggaatactcttccgtagattaacatcgagagaggttcttttattaacaataggtctgagtcttgttgcatcagtagaactacccaattcattagaggaattaggtgacggactagcaatgggcataatgatgcttaaactcctaacagaatttcagccacatcagttatggacaacgttattaagcctaacctttataaggacaacactctctttagattatgcttggaagacgaccgcaatggcgttaagcatagtatctttgttccccctatgtttaagtacaacttcccagaaaacaacgtggttaccggtgttactcggatcctttgggtgtaaaccattaacaatgtattttataacggaaaacaaaatttggggacgaaagtcatggccgataaacgaaggaataatggcaataggcattgtgagtatactactatccagtttacttaaaaacgatgtcccactggctggtcctcttatagcgggtgggatgctaattgcatgttacgtgatatcaggaagtagtgcggacttatctctagaaaaagctgcggaagtatcctgggagcaagaagcagaacatagtggcacatcgcataacatactcgttgaagttagagacgatggaaccatgagaataaaagatgaggaaaaggacgatacacttacgatattgctgaaagcaactttactagccgtaagtggtgtgtatccaatgagtattccagcaacgttattcgtgtggtatttttggcagaagaagaaacaaagatcaggtgtattgtgggatactcctagcccacctgaggtagaaagagcagtgttggatgatggaatttataggatattacaaaggggacttctcgggagaagtcaggttggggtaggagttttccaggacggcgtcttccatacaatgtggcatgttaccagaggggcagtattaatgtaccagggcaaaagacttgaaccgtcttgggccagcgttaagaaagatctcataagctacggcggaggctggcgctttcaggggtcatggaatacaggcgaggaagttcaggtaattgccgtagaaccagggaagaaccctaagaacgtacagactacacccggtacattcaaaacaccagaaggcgaagtaggagcaatagcattagatttcaaaccaggtacatcaggttcacccatagttaacagggaaggaaaaatagtgggattatatgggaacggcgtagtcacaacaagtggaacatatgtgtctgccattgcccaagctaaagcgagtcaggagggtccgttgcccgaaatagaagatgaagttttcaaaaagcggaatttaacaataatggacctacacccaggttcaggtaaaacgagaagatatcttccagctattgtcagggaggcaatcaaaagaaaacttcggactttaatactcgcaccaacaagagttgttgcaagcgagatggcggaggctctaaaaggtatgcctatacggtatcagacgacggcagtaaagtcggaacacacaggacgagagatcgtagacctaatgtgtcacgcaacattcacaatgagattactctcaccagttagagttcccaattataatatgataataatggatgaagcacacttcactgacccagcgtcaatcgccgcccgcggctacattagtacaagagttggtatgggtgaggcggctgcaatattcatgactgccactcctcccggatctgttgaagcatttcctcagtctaacgcggttatacaagatgaggaaagagatatacccgaacgtagctggaactcaggatacgactggatcacagattttcccggtaaaactgtatggtttgtccccagcataaagagcggtaacgatattgctaactgtttaagaaagaatggaaaacgagtgatacagctcagtcgtaaaacatttgatacggaataccagaaaacaaagaataacgattgggactatgtcgtaacaactgatatatctgagatgggagctaattttagagcggatagggtaatagacccaagacgatgcctaaagcctgttatattgaaggacggtcctgaacgagtcatactagctggacccatgccagttacggtagcatctgcagctcaaagacgaggtaggatcggaaggaaccaaaataaagaaggtgaccaatacgtatatatgggtcaaccgcttaacaacgatgaggatcatgcacattggacagaagctaaaatgttactagataacataaatacccctgaaggcatcataccagccctctttgagccagaaagagagaagtcggctgccattgatggagaatatcgtttgcggggagaggcaaggaaaacgtttgtagaacttatgagaagaggagacttgccagtctggttaagttataaagttgcgagcgaaggttttcaatactcagatcgaaggtggtgtttcgacggtgaaagaaataatcaagtgttagaagagaacatggacgtagaaatatggaccaaggaaggagaacgtaagaaattaaggccccgctggcttgatgcgcgcacttattcagatccactcgctctcagggagttcaaagagtttgcagcgggtaggagaagcgttagcggggatctcattctcgaaataggaaaattgcctcaacatttaacactaagagctcaaaacgctcttgacaatctagtaatgttacataactcagagcaaggcggaaaggcttacagacacgcgatggaggagctaccagatacgattgaaacgttaatgctattagccttaatagctgtgttaacaggcggagtgactctatttttcttatcgggtaaagggctaggaaagacgtcaattggtttactatgtgtaacagcctcgagtgccttactatggatggcaagtgttgagcctcactggattgctgcatcaatcatactagagttctttctgatggtactacttataccagaacctgatcgtcagagaacacctcaggataaccaattagcttacgtggttataggattactattcatgatactgactgtcgccgctaacgaaatgggtttgttggaaacaacaaaaagagacttaggaatcggacatgtagctgcagagaatcatcaacatgctaccatgttagatgtagatctcagaccagcctcagcctggacattgtatgcagtagcaacgacagtaattacgcctatgatgcgacatacaatcgagaatactacagcgaacataagcctaacggctatagcaaatcaagcagccatattaatgggattagataaaggttggccaataagcaaaatggacataggagtacctttattggcattgggatgctacagccaagtgaaccctttaacccttacggcggccgtactgatgttggtggcacactatgctataataggaccaggattacaagcaaaagcgacccgggaggcacagaagcgaactgctgcgggtataatgaagaacccgacagttgacggaattgtagcaatcgacttggacccagttgtatacgacgccaaatttgaaaaacaattaggacagataatgcttttaattctttgtacgtctcaaatattactaatgaggactacgtgggcattatgtgagagtataacactggcgacgggtccattaactacactctgggaaggctcgcctggtaaattttggaacacaacaatagcagtgtccatggcgaatatttttaggggttcctatctagccggtgctggacttgcctttagtttaatgaaatcacttggaggtggcaggagaggaactggtgcccaaggagaaacacttggtgaaaagtggaaacgacaactaaatcagctctcgaaaccagagttcaacacatacaaacgaagtgggattatggaagtagacaggtcagaagccaaagaaggattaaaacgaggagaaacgacaaaacacgcagtcagtcgtggaacagccaaacttcgttggtttgtagagcgaaatctagtcaaaccagaaggcaaggtaatcgacctagggtgcggcagaggaggctggagttactactgtgctgggcttaagaaagttacagaagtcaaaggatacacaaaagggggcccgggacatgaagaacctattccaatggcaacctatggatggaatctcgtcaaacttcattcagggaaggatgtgttctttatgccacctgagaagtgtgacacccttttatgtgatataggagaaagcagcccaaatccaactattgaagaaggtagaactcttcgcgtattaaaaatggtagagccatggctccgaggaaatcaattttgcataaaaatattaaacccttacatgcctagtgtcgtagaaacacttgaacaaatgcagagaaaacacggaggaatgctagtaagaaaccctctatcaagaaattcaacacatgaaatgtactgggtttcatgcgggactggcaatatcgtgtcagcagtaaacatgacatctcgaatgttactcaatcggttcacaatggcacatcgaaaaccgacgtatgaaagagatgttgacctaggcgccggtacacgacatgtagcagtggagccagaagtagccaacctcgacattatcggacaaagaatagagaatataaagaacgaacataagagcacatggcattatgacgaggacaacccctataaaacttgggcttatcatggaagttatgaagtaaaaccatctggtagcgcctcatcaatggtcaatggcgtggtacgcttacttacaaaaccgtgggatgtaatacctatggtaacgcaaatagcaatgaccgacacaacacctttcggtcaacaaagagtatttaaagagaaagtagatactagaacccctagagcaaaacgcggcacgactcaaataatggaagtgaccgcaaaatggttatgggggtttttatctcgtaataagaaacctcgaatttgtacaagagaggagtttacacgcaaagtgcgaagcaatgcagctatcggcgcagtgtttgtagatgagaaccagtggaatagtgcgaaggaagcagtagaggacgaaaggttctgggatcttgtccacagggagcgagaactgcataaacaagggaagtgcgctacttgcgtatacaacatgatgggtaaacgagaaaagaaactaggtgaatttggaaaagctaaaggaagtcgcgcaatctggtatatgtggctgggtgcaaggtttcttgagtttgaggcactcggattcatgaatgaggatcattggttttcccgagagaactctttaagcggagtagaaggagagggattgcataagctagggtatatcttaagagatattagtaagatacctggagggaatatgtatgcagatgacacagcaggatgggataccagaataacagaggatgatcttcaaaatgaggctaaaattacggatattatggaaccagaacatgctctactggcgacctcaatctttaaactaacgtatcaaaataaagttgttagagtacagaggcccgccaaaaacggcacagttatggacgtaataagcagacgagatcaaagagggagcggacaagttggaacatacgggttaaatacattcacaaatatggaagtgcaactaataagacaaatggagagcgaaggcatatttctaccatcagaactagaaactcctaatttggcagaaagagtattagactggctagagaaacacggcgctgagagacttaagagaatggctatttctggggacgattgtgttgtaaaacctatagatgaccgttttgccacagctctaactgcactgaatgacatgggcaaggtaaggaaggacatcccccaatgggaaccaagcaaaggctggaacgattggcaacaagtaccgttttgctcgcatcattttcatcaattgatcatgaaggatggcagggaaatcgtagttccctgcagaaatcaggatgagctagttggacgcgcccgtgtaagtcaaggtgcggggtggtcactccgcgaaactgcttgtttaggaaagagttacgcacaaatgtggcaacttatgtattttcacaggagagatctaaggcttgcagcaaatgcaatctgttccgcagtcccggtagattgggttccaacaagtagaacaacatggtcaattcatgcccatcatcaatggatgacgaccgaagacatgttatcggtatggaatcgagtgtggatagaggaaaatccttggatggaagataaaacacatgtaagttcatgggaagaggtaccgtaccttggaaaaagggaagatcaatggtgcggatcattgatcggcctaacagcgagagcaacatgggcaactaacattcaagtagcaattaatcaagtaagaagactaataggaaacgagtcatatctcgattacatgacttccatgaaaagattcaaaaatgaaagtgatccagaaggagcactatggtaa

SEQ ID NO: 21344 - RNA, 9879 nt, synthetic construct
  misc_feature 1..9879: note = derived and/or modified CDS sequence (opt6) from DENV-1__KF973474__SS-prME
  source 1..9879: mol_type = other RNA
tctgttactatgttactcatgttactaccaactgcgctagcttttcatctaaccactagagggggagaaccgcatatgatagtaagcaaacatgagaggggaaaatccttgttatttaaaacatcaacaggggttaatatgtgtacactaattgcaatggatttaggagaattgtgtgaagacaccatgacctataaatgtccacgcattactgaagcagaaccggatgatgttgactgctggtgtaatgcaactgatacatgggtaacatacggcacgtgcagtcagaccggagaacataggagagacaaacgatctgttgcgttagcgccgcacgtaggactaggtttggagacgagaacggaaacatggatgagcagcgaaggagcatggaaacaaatacagcgagttgaaacatgggcacttagacatcctggttttacagttattgcattgtttttggctcatgcaattggaacttcaattacacagaaaggaattatttttattctgctcatgctcgtaacaccttctatggccatgcgttgtgtagggattggaaatcgagattttgtagagggcctatcaggtgccacatgggtcgatgtggtcctcgaacacgggtcatgcgtgaccaccatggccaaaaacaaacccacactagatatagaactattaaaaaccgaggtaactaatccagcagttctacgtaaactatgtatcgaagcgaaaatcagcaacacaactacagatagccgttgtcccacacagggtgaagccactcttgtggaagaacaagatgcaaacttcgtttgtcgtcgaactctagttgatagagggtggggtaacggatgtggactctttgggaaaggctcgctattaacctgcgcaaaatttaaatgtgtaaccaaactggaaggaaaaatagttcaatatgagaacctcaaatatagcgtcatcgtaacagtccacactggggatcaacatcaagtcgggaatgaaacgacagaacatggaactatagcaacgattactccacaggctcctacatctgaaatacaactgactgactacggagcccttgctctcgactgcagccctagaacgggcctagatttcaatgaaatggttctattgacaatgaaagaaaaatcatggcttgtgcataaacaatggttcttggatcttcctctaccatggacgtctggagcatcaacatcacaagaaacatggaatcgtcaggacttacttgtgacgttcaaaacagcacatgctaagaaacaagaagtggtagtccttggatcacaagaaggagccatgcacactgcccttacaggtgcaacggaaattcaaacatcgggaacaactaccatatttgcagggcacctcaaatgtaggttaaaaatggataaacttacgcttaaaggtaccagttatgtaatgtgcactggatcgttcaaactagaaaaagaagttgcagaaacacaacatggcaccgtattagtacaagtaaaatatgagggcacagatgcaccctgtaaaatcccattttctacgcaagatgaaaaaggtgtcacacaaaatggcagattgatcacagcaaatccaatagtaacagataaagaaaaacctgtaaatatagaaaccgagccaccctttggggaaagctacattgtagtaggtgcgggtgaaaaggcactaaaattaagctggtttaagaaaggttctagtattggaaaaatgttcgaagcgacggcaagaggtgcccgtagaatggctatattgggcgatacggcatgggattttggctcaataggcggagtttttacgagtgtgggaaaattagttcatcaagtatttggcacagcatacggggttctcttctccggggtgtcgtggacaatgaaaattggcattggaatcctactaacatggcttggtttgaatagcaggagtacaagcctatctatgacctgcatagctgtaggaatggtcacactatatctaggagtaatggttcaggcagattcgggatgcgtgattaattggaaaggtcgggaattaaaatgcggttcaggaatctttgttaccaacgaagtacatacgtggactgagcagtataagtttcaagctgactcccctaagcgtctaagcgctgcaataggaaaggcatgggaagaaggagtgtgtggtattagatccgctacacggctagagaacatcatgtggaaacaaatatctaatgagctaaatcatattttactggagaacgatatgaaattcacagtcgtggtaggggatgctaatggaatattagctcaaggcaagaaaatgatccggccgcaacccatggaacataaatacagttggaaaagttggggaaaggcaaaaataataggtgcagacattcagaatacaacatttataatagacggacctgacactcctgaatgtcccgatgatcaacgggcttggaatatatgggaagtggaagactatggcttcggcattttcactactaatatatggttaaaactaagagatagctatacacagatgtgtgatcaccgtttgatgagtgcggcaattaaggactcaaaagctgtccacgccgatatgggttattggattgaaagtgagaagaacgaaacatggaaattagcaagggcttcatttattgaggtaaaaacttgtacttggccaaaatcacacactctttggagtaacggggtcttagagagtgagatgataatacctaaaatatacggcgggccaatttcgcaacacaattacaggcctggctatttcacacaaactgcaggaccatggcatctaggcaagttagagttagatttcgatctttgcgaaggaactaccgtagttgttgatgaacactgcggtaatcgaggtccatcgttgcgtaccacgaccgtgaccggaaaaataatacatgagtggtgctgccgaagctgtactttaccaccactaagatttcgaggagaagacggatgctggtatggaatggagataaggccagtaaaagaaaaagaagagaatttagttcgatcaatggtttcggccggaagcggtgaagttgattcattttcattaggtatcttgtgcgtctcaatcatgattgaagaagtcatgaggagtagatggtcaagaaaaatgctcatgactggcacactagcagtgttcttgctactaataatgggccaactaacgtggaatgatttgatacgcctatgcataatggtaggagcgaatgcttcagaccggatgggtatgggcacgacatacctagctctcatggctacttttaaacttcggccaatgtttgcagtaggcatactatttcgaagattaacatcaagagaggtattattgttaactattggactatcgttagtagcgtcggtagagctaccgaactcgttggaagaacttggagatgggctggcgatgggaatcatgatgttgaaactgctaacagaatttcaaccacaccaattgtggacaacgttattaagtttaacgttcataaaaactacattaagtctcgattatgcttggaaaacaacagccatggctttatccatcgtgtcactgttcccactatgcttgtcaacaacgagtcagaaaaccacatggctacccgtgctattaggttcattcggttgtaagcctttaacaatgtaccttatcaccgagaataagatctggggacgaaaatcttggccgataaatgaaggaattatggcgataggaatcgtatcaatattgttatcatcactattaaagaacgatgtcccactagcaggaccattgatagcaggagggatgctaatagcttgctatgttatatcaggaagtagtgccgacctgagcttagaaaaggcagctgaggttagttgggaacaagaagcagaacactctggaacatcgcataatattctagtcgaggtgcaggacgatggtacaatgcgaataaaagatgaggaaaaagacgataccctgactatattattaaaagcaacattgcttgccgttagtggtgtgtatccaatgtccatcccagctacacttttcgtatggtacttttggcagaagaagaaacaacggtccggtgtcctttgggatacccccagtccaccggaagttgaacgcgcagtactggatgatggaatttatcgtatattacagagaggattattaggaagatcccaggttggagtaggcgtcttccaagacggagtatttcacacgatgtggcacgttaccagaggggcggtgttaatgtaccagggcaaacgtttagaaccatcatgggccagcgttaagaaagaccttatcagttacgggggtggatggaggtttcagggaagctggaacacaggcgaagaagttcaggtaattgcagtagaacccggtaagaatccgaaaaatgtacagacaacgcctgggactttcaaaaccccggaaggggaggtaggtgctatcgcattggattttaaaccgggtacaagcggatcacccattgtgaacagagaaggtaagatagttgggctatatggaaacggagtagtaacaacctccggtacttatgtatcagccatagcgcaagccaaagcaagccaagaaggtccactcccggaaattgaagatgaggtctttaagaagagaaacttaacaataatggacttacatccaggttccgggaagacaaggaggtatttacctgccatcgtgagagaagcaataaaacgaaaactaagaacgttgatcctggcgccaaccagggtagtcgcttcggaaatggcagaggcccttaagggaatgccagtaagatatcaaaccacagccgttaaaagcgaacatactggaagagaaatagtagatttaatgtgtcatgcgacgttcactatgcgtttactctcgccagtccgagttccgaattataacatgataataatggacgaggctcatttcacggatccagcgagcatagcggctcgaggttatataagtacacgagttggaatgggggaggcggccgcaatttttatgaccgcgactccgcctggatctgtggaagcatttcctcaatcaaacgctgtaatacaagatgaagaacgggacataccagaaaggtcatggaactcaggctatgactggataactgatttcccggggaagaccgtgtggttcgtaccgtctataaaatcaggcaatgacatcgctaactgcttaaggaaaaacggaaaacgagttatacagttaagtaggaaaacatttgacacagaatatcagaaaactaagaacaatgattgggattatgtcgtaactaccgacataagtgaaatgggggcgaatttccgagctgatcgtgttatcgatcccagaagatgcttaaagccagtcatattaaaagatggtcccgagcgagtaattttagccggccccatgcctgtaacagtagcatccgcagctcagagacggggtagaatcgggcgaaatcaaaataaagaaggtgatcaatacgtatacatgggacagccgttaaataacgatgaggatcatgcacactggacagaagccaaaatgcttctggacaatattaacacgcctgaagggataatacctgccctatttgagcctgaaagggaaaaatctgccgcgatagacggtgaatatagattaagaggtgaggcaagaaaaacctttgtggaactcatgcgaaggggtgacttaccagtatggttaagctacaaagtcgcaagtgaaggattccaatacagcgaccgaaggtggtgcttcgacggtgaaagaaataaccaagtcctggaagagaacatggatgtagaaatctggacaaaggaaggtgaacgaaagaaactgcgacctagatggctagatgcaagaacttactcggacccacttgcactaagagaatttaaggagtttgctgcaggccgtagatccgtttcaggcgacttaatactggaaatcggaaaactaccgcaacatctaacgttacgtgctcaaaacgctttagataacctagtaatgcttcataacagtgaacaagggggcaaggcttacaggcatgctatggaagagttgccggacacaattgaaacgctaatgttattagcactgatagcagttttgactggtggagtgacattattctttctatctggtaagggactaggcaaaacatcgataggattactctgcgttaccgcttcatcagcgctcctatggatggcatccgtggaacctcactggatagcggcaagtataatattagaatttttcttaatggtcttattaattccagaaccagacagacaaaggacccctcaagacaaccaattagcctatgttgtaatcggtcttctctttatgatattaacggtggcagcaaacgaaatggggttgttggaaacgacaaagagagatttgggaatcggacatgtggcagcagaaaaccatcaacacgccacaatgttagatgtggaccttagacctgcgtcagcatggactctatatgcagttgcaacaaccgtcataaccccaatgatgaggcacacgatcgaaaacacaacggcaaatatatccttaactgctatagccaatcaagcagccatcctgatggggctagacaaaggctggcccatatcaaagatggatataggtgtccctctcttggcattaggttgctactcgcaagtgaatccgttgaccctaacagcagccgtattgatgcttgtagcgcactacgctataatagggccagggttacaagccaaggcaacaagagaggcgcaaaaacggacagccgcgggaattatgaaaaatccaacagtagacggaatagtagctatcgatctagaccccgttgtatatgacgctaaatttgaaaagcaactagggcaaattatgctattgattctatgtacatctcaaattctccttatgcgtactacatgggccctatgtgagtctataactctagcgactggaccgctcaccacgttatgggagggaagtcccggaaagttttggaacacaactattgcagtaagcatggcgaacatatttagaggatcctacttagcaggagctggtctagcattttcgcttatgaagtctttaggcggaggacgtcgaggaacgggagcgcaaggcgagacgctcggagaaaaatggaaaagacagcttaaccaattatcaaagcccgaatttaatacttacaaacgtagcggcataatggaggtcgaccggtcagaagctaaagaagggctaaagagaggggaaaccactaagcacgctgtttcacgtggaactgccaagttgagatggttcgtcgagcgcaacttagttaaaccggaaggaaaagttattgacttaggatgcggtagaggtgggtggtcttattactgtgcaggtcttaagaaggtcaccgaagtgaaaggttatacaaaaggcggtcctggacatgaagaaccaatacccatggccacttacggctggaatcttgtaaaactacactcaggtaaagatgtctttttcatgccgccggaaaagtgtgacactctcttgtgcgatataggtgaatcctcaccaaatccaactatagaagaaggtcgaacattacgggtcttgaaaatggtcgaaccatggttacgaggcaaccagttttgtatcaagatcttaaatccatatatgccttctgttgtcgagacgctagaacaaatgcaacgtaaacatggaggaatgttggtaaggaatccattaagtagaaattctacacatgagatgtattgggtaagctgcggaacaggtaacattgtttctgcagtaaacatgactagccgaatgttattaaatagatttacaatggcgcatcgtaaaccaacttatgaaagagatgtagatctaggagcgggcactagacacgtaacggtagaacccgaagtcgcaaaccttgacataataggccagcgtatcgaaaacattaagaacgagcacaaatcgacatggcactacgatgaagataatccgtataaaacctgggcatatcacggaagctatgaagtaaaaccatcaggtagcgcgtcatcaatggtaaatggcgtggttagacttctaactaaaccatgggatgtgataccaatggtgacccaaatagcaatgacagacacgactccgtttggtcaacaaagagtattcaaggaaaaggttgacacgaggacgcctagggcaaagaggggcactacacagataatggaagtaaccgccaaatggttatggggttttctatctagaaataagaaacccagaatctgtacaagggaggagttcaccagaaaagtcagaagcaatgccgcaattggagcggttttcgtggacgaaaaccaatggaatagcgcaaaagaagcggtggaagacgaacgtttttgggatctggtacaccgcgaacgagaattgcataaacaaggaaaatgtgctacctgtgtgtataatatgatgggtaagagggagaagaaattaggtgaatttggaaaggctaagggaagccgagcaatctggtatatgtggttgggtgcgcgtttcctagagttcgaggcactcggattcatgaacgaggatcattggttttcgagagaaaacagcctcagtggggttgagggggaagggctccataaactcggttacatccttagggacatctcaaaaattccgggaggaaatatgtatgctgatgatacagcgggttgggataccagaataaccgaagatgatttacagaacgaagctaagataacagacattatggaacccgaacacgcacttcttgcgacaagcattttcaaactcacttaccaaaacaaagtagttagagtgcaaagacccgccaaaaatgggacagttatggacgtgatttccagaagggatcagcgaggctctgggcaagtgggaacatatgggttgaatactttcaccaatatggaagtacaattgattagacagatggagtccgaaggaatatttttaccttcagaattagagacccccaatctagcagagagagttttagactggctagagaaacatggagcagaacggttaaaaagaatggccatctctggtgatgactgtgtggttaaaccgattgacgacagatttgcaacagctttaaccgcccttaacgatatgggtaaggtaagaaaagatattccgcaatgggaaccatctaaaggttggaatgattggcaacaagttcctttctgttcacaccactttcaccaattgattatgaaggatggaagagaaatagtggttccatgccgtaatcaagacgaactcgttggaagggccagggtaagccagggagccggatggagtctcagagaaaccgcgtgcctaggaaaaagttatgcacaaatgtggcaattaatgtactttcatcggagagatttacgactagctgctaacgcaatctgctcagccgttcccgtagactgggtcccgacatcacgaacaacttggagcatacatgcacatcatcaatggatgaccacagaagacatgcttagtgtctggaaccgtgtatggatcgaagaaaacccgtggatggaagataaaactcacgtaagttcgtgggaggaagttccgtatctagggaaacgagaagaccaatggtgtggtagtttaataggattaacagcaagagcaacgtgggctacaaacatccaagtagcaattaaccaagtaagaagactcatcggtaacgaaaactatcttgattatatgactagcatgaaaaggtttaagaacgaatctgaccctgaaggagcactgtggtga
